United States Patent 11,549,145 (METHODS AND COMPOSITIONS FOR INHIBITING AND TREATING NEUROLOGICAL CONDITIONS) - sequence listing, part 62

SEQ ID NO: 1411 - DNA, 791587 bp, Homo sapiens
gcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgtaagcgccgtgcgtcgcgtgtgctgtcaggggaagggggcgtcagggcatccactagcggggtccgggcagagtgacagcgggcagcggggactcgcgggcggggcgagggggtgccccctgaggatgcgggaggagcgggcatcaccaagtgtgtgcaggtgtgcgtgttggggcgagggaaggcaagggcgcgtgtctgtgcgcgcgtgtggaaagctagaggatggagcgcggctagccggcggcaggcgcccgggctcggacccggggcaccggggacaggagcgtcggagctgcgggaaccgggagaggaggggacggccggtccggcctgcctggtggcacggctgggacctcccgggcggccgggggcagggtgcagagcagggtggcccgtgggggcgcggggagcggcgggaactcgggctgtttctgggaataccgccgccgggaggtttcttgggctttcgggctggacccgcgcgttgtcacggagcgaagacgttggttcgcttactccgtgtagcgtgcggcgcagctgaccgggggcgggggtgatggtgcaggacgctgcgcggaggtttcccccaagtcaaggtgctgcgaaagcggaggaggagtcgcctccgtggtccccgcggttcccggggctggtgccatccgtggtggtgctgtgaccgcttgcaaagcgtggaaggcatgggaagcgagcgtgtgtttgcgtgtgtgcgcgcgcgcgggtggtggtggggagaacatcgtgaacgtgtcgttctctaaatgctggcttattgcatgccaagtgaagcaaagtgtgtgtgtgtaagtgtaagggcagggtggctgcccgggaaaggttggctccacactaatacaattctttctccttaagtacctcttggcactgctccttcctttctctcatttgttcgaacactgcagatacttcccaggctgaggcattgcacacctccaagctgggactggagagcctctccagaaaagaaaatgccctaacttcctgctaataataacctagttagcatcctttcagtcgttccttctccacttctgtcctccttcccgaaggatgttcccttgcaggattccccagacttccccaacctagaactgcagcttctgctggtacttctttcctcagcagtacaaaaacaaaacaaaacaaaacaaacaaacaaacaaaaccacttcccggttacagttacctataatcacagaaaatcgtagatacggtggaattttggaatattaacttttaggtgtgaaaatagtcttgatgtatttgggtactaaacatatgaaaacagcgaatttgcaaaggaacgttgtaaacgactgtctctttctcttttgtgcattaaacggactgggagaaagctttgggaaggataaaaacccagggtccacatcagatgacaacctaatagtaatccagtctaatagctgcaggttatgcaccattgcatatgctttttgaagtactgttggcccaagaccgggcttggaagagcctcttcactaataccttggtcacggtgtataaacctgctagtaatacagttgtctttttcatagaaaatagactataagggtttttttttttttaagtaattaacaccacattagatttttctcaaaactaaggactattttattcaggtggacaaatacggttgctgtataatttttcaatcaattcgtatcaaactctgtggggttaaaactagctgggacattttggtaggcttcatgcactcaagggcttcctgcgggcttaactgttaagccgagctcatggaggtggtgttatcagaatgcttaatggggaccgagggaacgtgctggctgatgaggttctgcacatatcaagtaatgtcaactctgtgccactcagcagctgcctgtcagctagagcagcacctttgataagtgggtcctgggtagagatctggcagtcccaggctgggatttttcttttaataaaacatccgtaggttgctgtgctgacgacaaatgaccttgaaggaggtgacacagtggagcagggggatttttttttttttggtatagcattaacatctaaaaggaaaacatgcctttcctcacaattttccaattttcatatggaaattctcaaatcctttaccggcttctccacccattaccctccatccttccctcccccaccccccttttttttctcttaacctgagaatgttggtggttcagaaatgctgatggggtgaataatggggagactgtagtatagttcccacattgaagtcgcttcttttttttctgagggcatttatttctctgtcatgtgcaagcttgtcaatatgagttatttcttcttcttcttctttttttttttttttaaagcaaatagcccaaggagtattaggaatctgtacatcttgataaaacagttgtagatggaagaattcttgatagtgatggatgaagctgttttgcatagaaaaacaaaaacagtcattaagacaccgtaattgtgaatttgatgggacatttcatatgtcctgattagaacatctggattattatcttgagcaggtcattgtctattggatttgtattcagcaccccagcacattgaggcatctttttgaccactgtccacagaaagcttttttgcttttctttttttagaagaggtgtgagatcactgttaagggaagtagaggtgaaatctttaatgggctgtatctgtgagttatgtatgctgctgtaaattaattcctcatttgcaaaggggtttgtcactgtttagcttgtacctgtctctctggcatctctgttccatttgctgctgcttgtcgagttggctcacattccttccaaatagttatgtagatgaatgatcattgattcagtggctcccccatctgttggaaacctgcccacttgggtctgtttatctttgagagagattgaaaatatgtttttgtaaactctggatatgctgggacacttattttatgagagaaaaatcctatcataaaataagctgtcagcttgtaatggattcattcactgtcatatccaaacatatccatgatttggaatgtgtgttttattttaaagattttattaacttaccaatgtagcatcaaactgtcatttggcatttaaaaacacgcatctttttcgttatggtcctctttttttttttttttccaacaatcatacagaatgttatagaagatattcctctgactttaggaaaaccatggtataaaatgaccttggtcaaggttttttttttttttttttttttttttgagtactttgtctttctttcatttgtctaagcacagttgagttacccttgtggtgtactgtgtcatgtagttttgtatttacccatagattgagacttaaagcttagtcctggctgtaagaatgatcctgataggaatgcttacggtcttcctcctgtcttcttttgcagaatgaagtatttcattatagatttcttctcagtgttcatacatcttgttccacaatgacaagaagcatctttaaatatactcatctacaaatggtgacaattatgcagtatagatgctggtgtacaacactgcatagtagtttggatgggaatacttagccctagtttgtagaggtccaggaaggttaatggtatgaagtcagtactcagcagtgcagaacgaggactaaaattcaaatcttaggctaatagtgttctttccaggagagaaaggcttctttatctgctgttcaagtatgttttaggtttatagcaaaagaataccaagtcagttttctcagctgtaggaatgtcacagagtacaaaggaaaagatggaatgagcagtggaaattcgcactttttgctcccttcataatgaagctacgaggagctttagatagatatgcactatggtattttcccaaggaactgatggaaagcccacccaggcttacatcatcagacttattttattttaacttagaaattagcatgtacacattggcaggaagggcaagatctaaaacgcttagggcactaatttatttgacattcaattgtatttgtactttggcttcagataagtgtttttatcacggctgaattacccaagaaaggactccagcagcactgggtgactgtgcttctttagatagctttcgggagagagggagaggtgatgaagcacacatttttcctgaaactctgacattgtgggaattagattaattcagaaaacatttgttgaacaccgtctgtatgcatagcatgttaaggaagtattccaaataagtagggaagtggtttgcagctgtaattgcaaagaatagatatagaggatggcatggagcaatcagaaggaaaaatgcataaacaaactccaaaacattagggtaggaagaggcctttagaaaacattaccctgtccaccccatgcctctctgatattgcagataaggaaacaaaagctcagaaagccaaatgacttggcccagtgtcacactccaagttagtggcatttagtaatggagagtatatgaaaatctgtgaagaatttccagaaaggaggtttaccagcacatcattctttatagagtagatttaaacccacttttccattttatccttaacttgaccttcatagagttctgtctccaaatctgtcctcttgtccttccagccagtgaaaaggaggtttcttttgtcttttctaatgttacagtccctcacatggcctgaatcttggtcctggaagccaagattggaatccatcctttctagcctttttttttttttttttgcctccctatccacttactccttctggtttatcttgaagcctgttaatttctcccatcttaaaatgtctgtctttgacccggataccttatttggttgctcccctcctgcagaagtggtcttctcccactgcttgtacccctctccatgtaattatctagcttctcttccttcttcaatttactttccaggatgttgccagtaactccctccttgccacgtctaaatgtccctctctgtccctattcccttagattccttctcaagctctactaccctgactttcctttttgaagctactcttttgactttggggacatggtaccttctgggtaattttttacatttctgatcatgctttttccaggtgcttttcattccttttactccaagtgtgtggttatcccaaaagattctgtcctatttcctgttctggctcttctgccttcatgagcttatctatgtcacaaaatctgggatctcttgaataacagagtctgaaaagacttaacaatgacttcatccagctctgagagccagagagatgaaaggaatgttcccaaagcgactcttttttgtaggagaaacccaccgtagattcgacagccctgggccttcacttcaagcctctgtttagacttccctcttgcctctcggaccccagaaacaccagcttgacatcattgcctgttcggttccctaagcgactttccttcctagtgtctctgctgatcagtggcactgccgtttgtggctgtggctccagtgtgatcctaaccttcagaagacctgagtctgaggccggaatccaccagcacctagctttacggacttagaacaacagtgcctggctcatgggagtggctcaatgcatttgtctagttctctttcttctcttctgcatctaatttgtcatcatagcccatcgtgtttctctttgcaatccaactcagatttcgatgtgtttcatactccgttagcttcttgttctgatcccagtactcatttcaaccttcgtcatccttcctcctgcaacaaatcggcaacccacctagaatccgcctgccattttagtcctcctgaaaccctcgtgtccatctcccagcctcagctcacatccttgcatatcctgtctaatttctctacttggccttttatgatctgccccttgataccttgcttatgcttttcatcctacacagagttttcttggatcactctaaccaattccgattttacctttctccgaccatttatcactaataattaataaaatgtatggaactgattgggaaactcaagcaatggtcagagaatgctctgaccctgatgctctgtgggtgagttgggaccgtgttgggcatcggtttcccatgatgcttggtgcactgttaactacaaggacagacttgagagaaatcttgtggcaaggagaagatcgggacaagagaaaggatcctcctgcccacaagtttaatgtgaacatcacttgaatgcgtccaaatgcagaaagaaggaacctgctatgaaggaagtaggcaaagatagtgggggtggaagaatagaggtaagatctcttctggaagcagaagagtaggagtgttggtgggtgaaattctgagatgaggacaccggaggtgtgtagggtgagagaggccaggtgatgattgctgctttgggaggccgcagtggctcccaggtccagtgggaggggacacccggagaaggcaattagagagagggaagttacagtcactagagcaaatgaacaaaggagagtaagagaataaattaaggattaattgagtctgagtgattagggctgcccaaaagaaatactggtttagagtcagaagctgtatttcaaatgagcagctgtcagggggtgaggtgacttccaggggcactgttagagtgtccagtggatcagtttcatccccttactttcctctttattaatcacgggaagaacattgggatgaggaccctgccaacaaatggttgtgtgaccttggggctggtggggtcagatagagatttgtttgagagaggtaaaatggggaggttgttttctcagagggacttgcggtaatttccattgtcatgttcgtagtcttagggtcaaccagactcaaaccattctgcaggatgagcataacaaaatctcaccctgggactggaaagaaaagctttgaatgatcctggggtccctggaaatcctcatcctggtggattacaggccctgaaagctgacaacaagctttgagccaggattcttgatgatgggtggttttctttcagggaagaggagatgttaacaataagagaagcttgcagacaggcatttagaaggagctaggagaagaattctctcatgtcagtagccctcttagggactacttaggttcggatccatttagtaactgaactcctagtgagcttgtttgcaaatcctctctattgtcccagccgtgaagtacttctctggcttccatagttaccttctccctggctggtgaagaagtggcccatgtttctggggtttcccagaatgttacagtcagcctcaaagcccatgtggaaggtatatttcctggtttctattgcaaaagttctgtagtggtgttgctgcaatgaaatggaagtccaaggcattccctgttagtgacggagtgttcagaggacctacacgtaattgctttcatgttcgttacccaagtaggggacagagagagaggagccactgacacgtgaacccagggagacctcccctggatggctgggtgcaggtacttaccacccaccaaccgatgatgagtatctgccaatttactggaagaaaacctgaaatctagctgtggagccaagatagatgcagaagaaagcgagtggaacaggagaaagtgtataggaactcagaggctggcagggccttcctgagtctgggaagggctgaggcgggaacgaggacacatttgctccctgggacacgtggttcttagtgtgcaggggaaacccgcatgtggtcactgagggagaggcacaggcccacacatctcatcaccatgaaggaaggaacaattcaatgtggccaatttgtttttctactatggcaagcactttttttcctttaacatttttggtattttaagagtttttgcacatttattctgcttctaatgaagttttaattgtttctctttcctcctgagtttagaatctgattcataatgtacatgggaacccatgaatttcactcatatttaatgcataaccaaagatataaactgaaatgatacattttgagaagatcaagaaaagaaaaagaaagcttacaggaaaaatgatatccttagtcttgagtcaattgggatattgttaaaatgaagccgaacagcacactgaggtgatagccactagaagttgtattctcttcttttccacagcaggtttctggttttcaaaataaaagcaattatgatttaaattcttctagcttttgctagagtttatatttatttcataatcaaagaaactttacatgaggaaagttcggtctcacacacacgcacacatgtgtgcacaaatgaatgaaagatattccaccatattttttttcaccaattttgactgtggtgtagaattcagttaaattagttcatgtgtagcagtgaattgtctgttgatctctgttatttcttccagtgctttggggtttttatttttatggttcctttccctttgtctttccctttccctcccctcccttcccccttccctccttttcccttccctccctttccctttctctccccccccttcctcccctttccctccccttcccctccccttcccgttccctaccctctcctccccttctctctctctctctctctctttctctttatctctctccctcccctcccctcccctcccctctcgtcttctctcctcttctctcctcggggctcatgagtgagttacttttgagagatgctattttgatagtggcaggaccagcaacaaacctgtaccatctcagcattcaggaacaatggtgtccacatgtctttttgaggttgtacagggcattcttaaggcacatttgaatagtcccacaggctgagaggagttcctctgatcttaaatacagcatcagcctgaggagtaaccatttctagtcaggagatcagagcttttttacgccgtggcctacctactgctgttggcaactttatttcttgtaggtgcattgatatgtaattgtctggcaggtctgttctaagcattgcatgtgtattttctcatgaaatccctagaaaatccctcagaggtagctacctgcaaagaagtgaagtgagcccagtgtttgcagacacaggcagtggagcgacagtttcagacctgggcaggctggctctagaactctcacttaatcttgccatacaggggccctttctgctggagatggacatattttaaaatgagagggaaacttggtgccctgcttctacctgcaggaagttactttataatatcaaatgtgaatttcttacattaccagagccttgcaggctgtgtgccacatcataggtcctgtgtttaatgtttgtggaattgcatcgaactgattccatgagatagtattttacataataaatacagagtagggtaattatatgcagtttactagggtaccttaatgcagtgtgtgtgaacgggatacctcttttatctgtagcattataccaggtacctaagagataccatgaaggtggaagccatagttcccgtagagttcagatgctcaaacagtgaaaccttatatgcatcaacctgggaacagtaagcttatggttctagggggattgtgtcctgtgtaaaattcagagggtccaaaaggtgaagagatgatggatgtggtcatgatattgggctccaaaactcacggagtaaatggccaatggtgaagtaaatggtggtaaaagcagagattctatttcattataaaatatgaaaaaaacatgaaaggcagaatccagactatagaacaacatgtaaggcaggaattaaagtttcaatgaaatgccgccttgatctctaaaagtgctccaaaatctcttttgtagcgtttcaggaaattttgattcattttatttttgaaacagttgacatttgggggagtgggctaagggatgaaaatatgttttaaagtgcttgtttttttaaggacaatattttcaagaactgtacttcaggagcatgtcacagttatgagcctgtaggcaagaacagggttttttttttcctctccttttagggaagaacaacatattgaaggatgattaagacacttgaaaaatgtaacagaaacatacacacacacgcattgcatacacaggatccaatccctgatgccctttgcctctcttcttgttttatttcatttatttatttatttttagacagagtctcactctgttgccaggctggagtgcagtggtgtgatcttggcttactgcaacctctgcctcccagcttcaagtgattctcctgcctcagcctcctgagtagctgggattacaggtgcccgccaccatgccaagctaatttttgtatttttagtagagatggggtttcaccatgttggccaggatggtctcgatctcttgacctcatggtccgcccacctcagcctcccaaagtgctgggattacaggtgtgagccaccgcacccaacccatctcttcttattttttagactatcccgttagttccctttggtcttggacatgtctgtcatgacatgtttccaaggccaatgcccacagctgggagtcatgatcagcttacacgtcctggcttgtaggttcgacgaaacgtcaggagaacatttcttcttcagacaaatgaaaagctgagatgaaacgtttttgattgatggctgtcagagaagcgtaaaaacttcagcttcactgccattccctttgtgacagggaaggggccatcatctcctgaagatgggggtgtcattattaagtctaaatgtcctgctcccgtcatgaagaattgcatcacacagaagcctgcaaagtcagcccgacttgagtcagtcctactcacaccaaagaggatacggaaactggtgaaggataagagacaattgtgatttcacctcttcctgcgccagcgcccggtctcttctccttcattctgaaatgttcgtggactgcctgctacgtgccatgcttcttgctggacttatatccacgcttgtcctgcctttaaagagcttattctgtctctatgggtgggatagggaataaggaaaacgcaaatattctactacacagtggacataacaatcagaaaaccgtcagaggaaaggatgttgaggagggagggatccgtgtcccaggagtaccattatctaaggcttggtggaggaggcagcatttccagtcacagaattctcagactgaaaaggatcttcagggatcagggtctaacccctttatagtgaaggaacatgaaaggacaagtatattggcccacattattccgctcagacaggatagctgcaattcatttgattcctggaacaatccatttagtctataaagcggttaattgcattaatacagatcaggaaactgagttgcaaagaggtgaaatgacttgttcaagggcaattaatgagtaagtgatgttgctggcgagcccagggttttcagatgccaaagcccttctttctccttcctccctccctccttccctccctcccttcttcccttctttcctcccttccttcctttttcttccctccttctctccctccctttatccatcacttcctcccttccttcccttttcctccctccctcccttcctccttcctccctcttctcccctccccgcctcccccctccccccctccctccatctgtcaggaaaaatggtaaaagactgtaaattggattataaggaatgatttatggctgtcctatcacatttgtccatttaggttatctgtgcttttcacttgtctgggagctatcttactgctcttaaattgtggaaaactgatagtaatgattcctgaactgttgattcttgattatagaaaatgcaaattgtgtctactagaatgcagttgtagataccgagtgggtttattcttctcaagcaaattcatctcagccttcctgatgggctgatatctctgtatgtcctttggagtctcctttgaacctgctgtgataccacactggttctttagtgaagaaattaaataaaatctttgatgtgttcattttgtctttgtttgagtcgtatttttactttaaaaaaagttaccttcaacaccactactatgcctcctaaagtaaaagtgagtgggatcttgctgaatttgggtggggagggcaggaagacaggacagatgaaagaggaaggtgagtgggggccatgtgttgtttcttctgtctccccatccccagggccactttccagtcttctctgccctgttctatgttcaggagcctcctactctagatggtgccgggagcactgtttcctttccttgttggctcagatccagggctggggacagtttcccactgttgctggtccctagaagtcccacctctgtcggatcctgtcacgctcccagcccgcaccttggtaaatgatccctcattcacctctcttcagttaaacccttgagagtgccattcccttccttgatgagaccctgatgcgaaggcgggaagcacggtgacacgtttgggagagagatgacgggcgagtactgctgtgtcatcctggggggactggggagccctgagaccagggtcagggatttgttcttaattcataaggtaaaaggggccctggaagttattcttttttctccttctcaagggagaaaaatgggtcagagctgtccattagaaagattaatggggcagcaatttataagataaattgggatgtagagagatcagagcgggaccggagctgagaagcctattaggagacagtcaccacggagctggtgcaagataattcgggcctaaatttgggtggtagttgtgggaatagaaaggagcgggagctttaggacacagtggagaaagggtttatggggttggtaactgattagatacaagaagaggaaaaagacaaagctgagcttcagatggtgttggtcatatggaaatcaggaggaaggggaggtttcaggggaaggcagtgggatttattttggatgtatttattttgagatatgttatggactgaattatggctccctaaaaagtatgttgacatcctaatccccaggaccttagaatgtgaccttaatgggaaatagggtctttacagaaggaatcaagtgaaagtgaggccattaagctggcccctggtcctatatgactagtgccctcctaacaagaagggattaggacgcaggtccacacagagggaagatggtgtgaagatacacagggagcacacctgtgaggactggagcactgcacctgtgaggactggagaccgtacttgagaggactggagcactgcatctgtgaggactgcagcactgcacctgtgaggactggagcactgcacctgtgaggactaaagactgtacctgtgaggactggagcactgcacctgtgaggactggagcattgcatctgtgaggactgaagcacacttgcaaggactggagcatcgcacctgtgaggactagagactatacctctgaggattggaacactgcacctgtgaggactggagcactgcacctgtgaggactggagcactgcacctgtgaggactggaacactgcatgtgtgaggactagagactatacctgtgaggactggaacactgcacctgtgaggactggagcactgcacctatgaggactggagccctgcacctgtgaggactggagcactgcacctgtgaggactggagcactgcacctgtgaggactgcagcactgcacctgtgaggattggagcactgcaactgtgaggactggagcactgcacctgtgaggactagagactgcacctgtgaggactggagcactgcacctgtgaggactggagcactgcgtctgtgaggattggagcactgcacctgtgaggactggaacactgcacctgtgaggactgcagcactgcacctgtgaggactggagcactgcacctgtgaggactggagtactgcagctatgaggactagagactgcattgtgaggactggagcactgcacctgtgaggactgcagcactgcacctgtgaggactggagcattgcatctgtgaggactggagcactgcacctgtgaggactagagactgcatctgtgaagactggagcactgcacctgtgaggactggagcattgcatctgtgagccaaggagcactagggctgagagaggcatggaacaggttccccctcccaccctcggaaggaaccagccctgctgaccccatctcggactctgggcctccagagctgagagataatacatttctgttgcttaagccacccagtctgtgatacgttattatggcagcagtaggagtcgaattcaaggcacaaagctagaagtgtggatttagtgttttggagagaggagtgacccagtgaggcagattggaggccactggtgtgattgagaaaccacaaaaatggaccagatgatctgggaggagcatgtagaggagtcagcaacagaggctcagacgaaggtgactgaggaaacttcttttttttttggacggaatcttgctatgtcgcccaggctggagtgcagtggtgtgatatcggctcactgcaagctccacctcccgggttcaagcgattcttctgcctcagcctcccgagtagctgggactacaggtgtgtgtcatcacgcccggctaattttctgtatttttagtagagatggggtttcgccacgttagccaggatggtctcgatctcctgaccttgtgatccacccacctcagcctcccaaagtgctgggattataggcgtgagccaccgcgcctggccctgaggagacttttgatgtgatcattatgggagtctctgcgaggaggttgaaagtagactcccgattgccagagacccagaagcaacagagcagcagtaaatagaggcagatgatatagacaatcttttcaccccatgtgctgaagaggaagagaggaggtgggagcttgaaaggggaggaagggtaaaagttagggatgcttttcttttctcatgaaagagaccataatctaaggttgtagaggagaagtggtgattgatgttgcaagttcctaagtacaagatgggatagagatgccccccagccccaccaacacacatcaccattgttgggcacacgcctaagctgatgcatcgcctctctttgcagatacctaattactgcttttcttaattcgagagcacatacgattttcatttgcctttggtttagctttgcatcatttcattttctgctagggaccttttgatcattaaaattagagctctataaagctttgttggttcaaagctgggcgtgttttgtttgcaatttgcagtggtttggtgatgaaataatccagctaggcttgaagcaagcatgtctcattaagacaaatgggagaagctgatattgctggcgggttttttctcatagctgttaactcaaaaagaaggtagggcttatataggtaattatgtatactattaagcaaatagtcagtctagggatatattggagggattttctgaaagctcaggtcaggggaaaatgttgaaatatcttaggaaacagaatgattctgctggtagtgactgccctcagctctcctactatgataggatctggctaagaaaattccagtaatttttcagaaaattagcaatttatattttgagagttttttcctccacatttttgtgtaattggcactatgctgtacatataatttgttgcttgcaaagcactgtctttcaaaaaaatctaaccagtaaatctatacagtatttacatgtgtaaattccacatttgttccatacttcacactgttgatttaaaggtaaaagctttcaacaaatgtctgcacttaacaacagagcatatatcttcatctcttttgtgttctgaatgagcacctataacactttctcaaaaggaatcttccttggaggcggggcgtggtggctcacacctgtaatcccagcacttttggagccagggcgggccggattacttgagcccagaagcttgagaccagccttccttcctccccggagacttcaccatcttctcacctggttaaggtgcttagagatgctggtctggagaaggggcggggggccggggggcggggtgttcagtaacaatcaggtagcaattagaaggtgggagatagcgcctcacattttttactgtagagtgataaaaaaaaaacctgccatatctactgcttattgaacattctctagttttggtcctgactagtacattttctgcagaaatttttttttgaatttcacatgtctagcagaacgagaaatctggcatacattacaaccaaccaaaacattgctctggacaggcctaaaacaaggacctgaacgtcagtagagaatggaatcagcgattccataaatgacaccagtttcatgcagtcacacagtagggagggaacagagatcatttccgcatttccctctaaatgggcaaactaaagcccacagttttgttaagagggtgctgtgtataactcagatgccttactgggatacagaaatggactttaaaatctcggggttaataatgatgatgccattgccatctaacgtgaataatggggcagactaaaatctgacccaaacagaatctgataaataaatcaaggagaaggacttgcaaatctttgcataagagaggagatgagtaatgacaccctcttttgcttgttgttcataccaccaggagtcgagaactctgcataacttagcagtacagcttccaagaagggccctgatattgtggataaatggagtctatttttaaggttagataaatccagcctatttttgtgggcagggaaaaattattgctgaagtgtttttgataagattcttctgtgccataaactgaaatactgagagtataacagtttttcataagaggaaaggaagaaaaactactgtaagttatgggagactaaggccatgtatttatttggggattgcattaataagttttcaagcattcacttttatttagctacatgatcggctttgtggttgtcccagttcatgaagaatgccataaatattggattgaccacggttgataatttttactgcatgataatactatgaatgtattggatggaaccatgattccaatatatgtgtattctttcattcagcaaagatatatatactcactacctcctgtgtgtcaggtgtctgtagggtgctgtagacttatacttaaagcgttcttcttcatttgtgttttaaaatggtttccacatagttattaataagactcctaaatgggaaggtgctgaggctagaatctgatggccaaccaggtaagatttccttcaaagtctgtgtcaaatcagttctacatttctctacatccagtctacatttttctattttattcatagggatattaacaaggaagattaaatgctggctgaaagctctcatatttgtatccacagaaatacaaattatatataaaattatatgattactaccattatcatgattatgttcttagcctttccgaattcctgttatacgcaaagcattctacttaactccatgggtataatgggatatataatccttgcccacaagaaactattaccaacactaatttattagcctttcatagactgtttttttcccctgctaaatctttcttaagtaactttaaaggaaacttaaaaattgaagtgtaatatattaacatacagatagtaaagtacataaatcttaagtgtacagcttgatgaatatttgcagtgtgaacgcagttgtgtaactaccactcacattaatgcattgaatgttaccattacctgcaagcctctctagcaccccctcccaagagttacctgcctttccaaaggttactactctatggacttctagaaaaataaattaattcggcttgtttttccactttgtgcaaatggaatgacaatgcaatatgcactcttttgtgtctagtttcttttgcttcatttatatcagagatgcatccatgttgtagctcctggtggcttagtgctgtatgctacaattcatctatccattctgttgatagacaatgggttgtttctggtttcactaataaaaacaaagctggtactaatattctcaaatatgaaagatttaaatatttaagtgaacacctgaaataagggtatgtatacatttctgctggatatatacctatgagtagaattgctgattgggttatatatatgctcagccttctaaacacttttccaaagtagttgactcagttaacatttccactagcagtacttagtaaatgttggtttcaaaaaagtaggaatcattatggtggatgtatagagggtttcattgtgactttaattttgcatttcactgacaactcatgatggggaacacctgctttgtatctttaatgtccatttggatatactgtattcttttgtgaaatacctattcaggctttagcctgttttaaaaatacggttgttctatctatctatctatctatctatctatctatctatctatcatctatctatctatccatctatcatctatctatctatctatctatctatctatctatctatctatctatctaatcatctctctagacagagtctcattctgttgcccaggctggagtgcagtggcacagtcatagcttgctgcagccttaaactactgggctcaagggctctttctgcctcagcctcccaagtagctaagactacaagtgtacaaccatgccagctaatttaattttttgtagagatgaggtcttaccatgttgccaaggctagtctcaatctcctggcttcaagtgctccttccaaagtggtaggattacaaatgtgagccatggtgcctgaccagaattgtcttttttaaacattaacttttggggagtattttatatgatgtgaataggaatcttttgttagatacgtctattgcaaatatcttttccaacactcttgcttttcccccctctgttactgatgttgttagtgtcgaagagcagtttttcactttaatgaagtccagattatcagtttttttaaatcatggtttgtggttttttttttgtatcttctttgcctacccaaaggctgttctcccatgttatcttctacagcctttactattttaaggctgatatttaggtctgtgctcttagaattgatattttgtttatagtttgaggtagagatcagtccctccacctatggatgtccaattgatccaggactagttatttaaaaggctaccttttcatcactgcattgcagtggtacctgggtagtaagtcaggtggctgtaagcagggatatctattacttgactctcttttatttcattggtctatttgtcttttcttgttccaaatttataacttttaaattaactccagatttctgctgttttgttatatgttggtgttcatcttctaactttgctctaagtcttcaaaattatctttgctattcttggctcctttcatttcagtttaaattttagaattagcttataaatctccacaagatgagctgctggaatttttaatgaaatagcatcaaatctgtagacccgtttgagaagaattaacatcttttcgatattaagactcccaatctatgaacatggtatatctttcttttatatatttagatattttaaaatttctctcagtatttgcacttagttttccatgaaagactttgcacattttgggggtcagatttatttctaggtatttgatgtttattgatgtcaatgcaaatgtatctttaaaaaattgtttcttagactgtaaaaatataattgactttacatttgaccttgtatctagtaaccttgccaagttcacttattaattctaatagtttatagattcttttggattttctatatgcccagtcatgtcatctgtacatactgaccattttattttttgcttctcagttttcatttcttgttattgcctcattgtacttcccaggatctttgtaaatgctgactagaagacatgatagcagatctttgatcctttccctcagtttcagggaaaacttaagagaatttcatcaaggattttatgatgcttgctgtggtttactaagctgttttgttttgtttttgttgtgtttggcagctgaattctgccttgtattgggagtcttacactgtgcatatgcagcttaaaaatatcagtttagaattatgattttactgtttttttttttctgttagtgcaatggactgtttgtgcctacccccaaaattcttatgttgaaatcttaacccccaatgtgatagtagtgggagatggtagatgattaggtcatgagggtaaagccttcatgagtgcaattaatgcctttataagagagatgagagagctctcttgctctaccatgtgaggacacaatgagaaaacagcaggcagtctgcaacccagaagagggccttcaccagaacctggccatgctggctctctaatctcacacttcccagcctccagaatggtgagaagtaaattcctgttgtttataagccaccaggtctgtgggactttgttgtagcagtttgaactatgatatttattttatttattttttcattttttgcctttctttagattaatatttattaacaagcttctattagcttgtgagttattcattcttttattactccttcagtgtttacactagagattataatatcgttaatttattagtatctaccttaaatgaatacttttatatttttctggaaatgcgagtctgtttatataatactttaaatttatttatcctctctttttgtgctcttctggctatgtattttaattctacacacacacacacatacacactctctctctctctcttcaactccttaagacattattattattctttaacagtcagaattcatgtagatttacttatatgttgcactgtctagtgcctttccgttgtcctgcttgccatgctgtcatctgggatcattttgctgctgtctgaagaagtaccttaagatttattttatgatgggtttactgacaagatattctctcagtttttgtttaaaaacatctgtgtttctccttgtttgcgtatggaattggcagttgttggtgatccacccccgaccccacccccagcaattctggcttccattatttctctttggaaggtcagctgtaagtctcactgttttcctttaaaggtgatattttcattctatttatcctgcttgaggtttgtggagtatcttgaatctgaggcttggtatttttcattcattttggaaaattcttggccagtatttcttcaaacattgcttctgcctcattctctctctcccttctttttgggattccgatgatagatattttgctcctttttctcatgtctcttttacattcttttctgtattttcattccttttattttttctttgtacttaattcggagtatttcccactgacctttctaccagttcataaatctctttttgctttgtccagtcagctggtaagtccatctactgaattcttaaattttgagctgttttattttttagtaattggttttacatttggttctttttccagattcaaattctgttgtaacattcttcctcttcatctattttcaaatatatttattattgtaataaataagcataatacatgtatcacatttacgtttgtttctctttccttttcttcctcttggttttcagatatttggtcttattttctggcaaaaatggtatttttaaatgtattggacataatgtaagaaaagatatagaggttctagatgatgttatcttcttccacaaaacattaattttattctggtaggtaggtagcatccaggcacatcattgtcatctcattgaggcttatttgtctccatattgcccttcctagtaggtataactcttctgaggtctcatgtgaatacctgcagttttttgtttttgttttttgtttttactagaacctgtctttttttttttttttttttttttttttttttactagatcctgtcttgattgtgaaatctcaattcagtatattgcatgcaagcccatcacatcctatgatttggttgctcttcagcgacttcaaataatcttctacttaaactagtttttatagttattctcagcgaaagtttagttcagtaccagcgtctctatcataacctggaactgaagtcccccatgagaaactaacttttggtggcacgtaacatcgtattgtgtgttctgttttaacttgttcttaagaaactttttaggttgaaataatgatagagtcacagaaagctgatactctccagtcatttttctcattggttatattttacataatatagtacaatattaaaagcagaaagttagcattgctataaagcgtgtatatagttttatgctattttatcacccatagattcatgtaatgaccactgcaatcaagatacagaactgttccatcctcaaagagctcttgtgtgctatcctttttttttttttttttttttttttttcgagagggagtcttgcattgtcgcccaggctggagtgcaatggcgtgatcttggctcacctcaacctccacctcccgggttcaagccattctcctgcctcagcctcctgagtagctgggattagaggcacccaccaccacgcctggctaattttttttggtattttttttagtagagacagggtttcactatgttggccaggctggtctcgaactcctgacattgtgatccacccacgtcagtctcccaaagtgctgggattacaggcgtgagccaccgtgcctggcctgctatccttttatagtcatacacttcctccttagtgccaccatccctagcccatgggagccactgttttgttctccatctctgtaattttgtcattttgacaatgtaattgtattagtccgttcttgcactgctgtaaagaaatatctgagactgggtaatttgtaaagaaaagaggtttaattggctcatggttccacaggctatacaggaaacatgacagtttctggggaggtctcaggaaactttcaatcatggtggaaggtgaagggaagcaggcacgtcttacatggctggagcaggaggaagtgtggggaaggtgctgcacacttttaaacaaccagatttcaagagcacttgctcactatcaccagagtagcaccgagggggaaatccccacccatgctccagtcacccccaaccagaccccacctccaacattggggattacaatttgacatgagatttgggtgggggcacagatccaaccatatcagtaatataaattgaatgatacaataggtgacctttgagattggcatttttcattcagcgaaatgctcttttcatgctatggacataccacattttgtttggccatttacaaaatgtcttgcaaaatgccttttctcatgtctgtttacattcttttgtaagacatcttggtcgttttcagtttttggctattacaatgaaaatggctatgaataatcttatacaggcatttatgcagaaatcagttttgtttctttgggataaatgcccaggaatatgttttgttggttgtaagttatgtttggttggttgtaagctatgtttagtttttaaagaattgcagtattttccagggtggctgcagttttagattcccatcagcaatgtttgggagatccagtttctccacaccctcgtcagcatttggtattgtaactgtttttaaattttagctgttctgctaggtgtgtagtgatatctaatcatggtattaatttgcttttccctaatggttagtaatgttaaacatctttcatgtgcttatttgccacccgtgtctttcttttttttttttttcttcgagacggagtctcgctctgtcgcccaggctggggtgcagtggtgcaatctcggctcactgcaagctccacctcccgggttcatgccattctcctgcctcagcctcctgaatagctgggactgcaggcgcccaccaccacacccggctaattttttgtatttttagtagagacggggtttcaccgtgttaggatggtctcgatctcctgacctcgcaatccgcccgcctcggcctcccaaagtgctgggattacaggcgtgagccaccgcgcccggcatctgtgtcttttaaaagtcgaatgtcttttcatgtcgtttgcctatcttctaaatggactttataaaaaatgctgaatttcgaaaattctttatcaattttagatatgggtcttttgtcagatatatggtttgcaaatgttttctcctggtttgtagctcatcattttctccctctcaacagtctttcaaaaaaacagaagtttttaattttgatgaagtaaaatttattggtatttttcttttatggattgtgcttttttttgccccatgcctaagaactctttgccaagctcttggtcttgaatattttctcttatgttttcttctaaatgttttatagttttatgtttctcatcgatgatctgattttgagttaatttttgaataaggtatgagactcaggtagagattctatttttttcctgtctccaattattccagcagcatttgttgaaaagattaccattcctccattgaattgcttttgtacaaaattatttgttcatacttgtgcagggctatttctgtgttctgtattccgcttcattcgtctatgtgtctagctgtccaccaataccatacagtgttgattactgtagctatatatgtcaggtagcgtgttttctctcatttaattcctctttttcaaaattgttttaccatttcctttgtctttctatataaatgttaaaatattcttgtctatatctacaaaaaatttcaccggggtttcgataagaattgtagcaaaacttgtgtatcaatttgggttgaattggcatctttattattttgtcttccaatgcgtgaacactgtagcaggtgtttttgatttggcttactgtaacattgtggaagagttcttcctgactaaactcttttctgttaacatcctgcgctttaattattgcttcctatttcctttagctgagtttttaaacctgcagacatgtcaatttcacatcatttctctttgatggtagtgaacctccattgcattgtactatacacagtttgtggtataattaatcatgccctacacttaaatcactagcagattcaacattgcataccttgatttatccagaactttgattttttttttttttttttgctaagaactgtacctatttttagactctttcactttctcatcatgtcaatctcagaatagatagcactagtacttggctttctggggcccattttcctcaaagaaacaaaacgtttcgttgttttttaaaaaaacacttcttgaaaacaagtatatacagtatggtgattacaataaagtcacactgacatgcagagacgaggacattggtggggttatcaaaatacagccagattatcagtaaacaacatataaatgggatacctataaataggcaaaatttatgcctcagcaaaaatattagtttaatagctaatgaaatgttcttatgttcttggcatggctcaagaacagttgacattgttatgttgcccatgtgctgttgaagcctttattctgataacattggtaaattgtcccttaccaacgtggccatttgtgtaaatacattctttacttcagtctgtggtttcacattttcactggtggatgaatattctcaattcttaggggcttttaaaaaacacttcccatgtgttaatttagtctcatctaccctgtattattcttctcattacatttgccctgacttttgcaaaaatgggttggttatgagaatttcctcaaaaaagtctttactgtgttatgattgaagcaaatatgtaaattaattcttcttcaccatcatttatttttactttgagctttaagtggttttgctgactccattttctggcttttggtgtataaaatgaacttccctttactgtttttagatctccccgtactgtggcctttaactgacatttttcttccaacctgctcctaggtgagccagttgagaaaaaaatacatgtaatggtaacattgcactggagcaaaaatcttcctgtatctcttaatatttggcataattgcagcaactctagtagaattccctttttcagaaaagaagttataaatgtaagaaaagttcaatgatgggtggaggaaaatagctcattaggacattatgatctcttgaactgtgaattgtttaaaaatgatattaaattctgctcttcattggttgttctggaagagtgctggtgaatgaattttctagtccaggccctagaaaaatccatgcagcttatcccatttatatgttgtttactgataaactggctgtattttgtgataagagaaagtgggaaagattaatgggaaccactcagaggtttagcaatagaacttaaagagagcaattttcaaaaggtaattttgaaatatgtacttaatataggaacataaatggacttctttaggtatttaattttaatattacttatatctagtataagtaaatacatttcaaaacagggcacagcaagttggacatttatagcttatacagtgagtacagagaggacttttgtattggacttaattattaatgcctgtcatccagatgactgaaagtagttcatgaaaatcaggaatgtttatataacatttaacttaagagagaaatatttcccaaggaaaatgcttgatgattttttatcagttaatgctattgcctttcataattttttaaaaccttagtgaagtactgaattattaggagtgaggaatttccttcaatattctggaaaagtccatttttaaaaaatggtgtcaggcaagagtttaggcttcttaaattatgctttattttcaaagctactccagcttatttttattaggctatttctcaaggaatagattttattttattggttttcacgttaatactgtttttccctaacaattgcattttattagaaaatttttcctgaaaacttaatgtttgaaatgaaatgcacatagagtatggcatgatgtgactaaatattttcctttattctcttaaatttttaattgttttccattgctcattataaactggtccagttaagctactggaggctggtttgacatacctgttggtgttttaacttttttttttttttttggagacacaatcttactgtgttgcccaggttggagtgcagtggcatgatcatggctcactgcagccttgacctcccaggctcaagtgatcctcccacctaggcctctcaaagtgctgggactacaggtgtgagccaccatgcctggactgtgtttaactttttacctttctattttttatgattttttcttgcaggctgacttgaagcaaaattggcagcaagatcctcctgcctcagcctcctgagcagctgggcctacaggtgcatgtccctgggcccagctaatttttaaataagtatatcaaaccatcctccaacagcttaattggaccagttttatgataggatgaataacagaaaacaattaaacatttaggagaataaaggtcttatactcctggtttcaagcatttcttctgcctcaacctcccaaagtgctggtgtcacaggatccttagggtgtttctttaccagctggaacctctgtggccagtggtgcctctgcttgggttttgcttgctcccactgggcttatttcgcccacatggcccggcaggctgtgcttggtttgcactactgtcccagatcccacacctgccaagggcaagccaggtgcaggaggccagggttgtgtgagcaagtgagtgtggggtccagccactgtgtgtagccaggcatgctggctggggtggggtgggctgctccaggtgctggcacaggtgccagctccatgtgaggctgtggctggatcagacctactgcaagtggcttctgctgtgggcaccagtatctggacaaggagaatgcaatggtgccaaaagctcagagatgccaggaactgcagagccccaaggagggtgttacagcatgtcacagccctggctcagggagcccccaagggccactgctcttctctccttgttgcctgcaatgtggtgagtggggggcatgtttccagcctgtttgtgttacaactctttcggtcctgccaggtcccaagttctagtccagcgtctgggaagaatgaggtatgcagataactggtgggtgagttagtcggagaggagcttcattgagtaaaagaacaactctcatgagacctgaagtgggcagctcccttccgcaggcaggtcttcctgacgagtgtgcgagtccagctgagtccagggttttgatttttgtttttttttttgagacgaagtcttgctcttgtcccccaggctggagtgcaatggtgctatctcggctcactgcaacctctgcctcctggattcaagcgattctcctgcctcagcctcctgagtagctgggattacaggcacctgtcgccatgcccggctaatttttctatttttagtagagacaaggtttcactatgttggccaggctggtctcgaactcctgacctcaggtgatccacctgcctcagcctctcaaagtgctgggattacaggaatgagccaccctgcccggccgagtccagggtttttatgggctcagaggggaggaagtgcgtgctgatgggtccacggtcggccatggcaggcctggaaaaaacactataaactcttactctgtgttggggattccactgggaactggccccctggcccccaggcttcaggtcgtgcctggcttgaaggtgaggcttcaccagggacctaccccttcctgcctaggaacctgtttgccccctgtggcaatcaacattctgtccaagatgcccaggctgtgcacaccgaggggtgcctgccgagctgctctcagccccacccggctccagcctttctccctgagcttgaaactcccccagagtttcagagggggatgaggcggcgggggtgctggtgtgttatcgctgccttgagcgtgggtatacagctggccaggtcgcgatagcgcccgggctcggcttctactttactctgaaattggagcaggcactggaggtggggaatggccagggagcaggcacttctgaccctgctgggggaagagggtgtcctgggcccccaagagcacatggatgcccaggtctggagccatatccaggtggctgcagctgtgcctgcagcatggggctcccgttctgacaactcagcagggcacgggggtcctgcttgttcctcgtgccctccggctccatggggcatgccgccccggttgtgcctcccccgctgcagctggcatccccacagtggctgctccagaggggccaccgccgccatcactgggattacaggcatgaaccactgaacccggcctgtgcagcttttgagatcagttgcagtttagcaaactccactttccactgatcagggtcggcttccaggcattgagcggatgggcagaggagatgagagacagatgaagagaatactcccagcaaaggggcagagacaaggagacatgagctggtctggagagcaagggttcattagagattttttctttagtgcaccaaccagcaagggggaagtgaatgccaaaaggagctgtgggaggttttctagaatgtcagttataaagctacttgttgcacacataaaatggatttggaaactcgtatttaatcttaaaaaaaatcttttagtgtttgccagagcattttaatctgaaaatatttaaaaatactcgcctgtaatcccagcacttcaggaggccgaggcaggtggattacatgaagtcaggagttcgagaccagcttgggcaatattgcgaaaccccgactctactaaaagtacaaaaaattacccaggcgtggtggcagtcacctgtaatcccagctacttgggaggctgaggcaggagaatcgcttgaacctgggaggcaaaagttgcagcgagcagagatcatgccactacactccagcacgggcgacagagcgagactccatctcaaaaaaaaaaaaaaaaacaaaaactcatctgttagtataactaatgctccaggaagctgccacatatttacctcaggacctatttctatcttcgccccaccgcacgctgaactagacacttaaggacctagtgtagaggactatgaagaggattgttataaggagttaaaggctaaacctgattgtcattttaaggaatttggattttatcctggagtctttagttgattgactatttgacaaacatctacggaatgcctggtttgtggtgggtgttgagaatacagataggggccctgctttggatgggcctctctctcgagcagacaaggaagatcgtgccaggtagttgaatccatatacaacgtggaccacacaggtagtgagagtcagcaaggccagaggcgaacctcataagacaaaggggaccacgtaggaagtcactgtcctgctctgcatttgaaataagcactgttcagagccccgctgtccagtatggcagccactggccatgtgtggctgttgaatacttgaaatttggcccctctgagttgagatgtgctgcaggggtaagatgcataccagatttcaaagacctatcatggcaaaaagaatataaaatatctcattaataatgcttcagggtgggcactgtggcttatgcctgtaatcccacactttgggaggctgaagtgggcggacacctgaggtcaggagttcgagaccagcttggccaacatggcaaaaccccgtcttcactaaaaataaaaaaaattagctgggtgttgtggcatgcacctgtagtcccagctactcaggaggctgaggcatgagaatcgcttaaacttgggaggcagaggctgcagtgagccaagctcataccactgtactccagcctgggcgacagagactccatcttaaaaaaaaaaaaaaaaaagcttcagtagtgattgattacatgttgagataatattttggacatattagattatacaaaatatatggttaaaattaatttcaccttttccttttcgtcgtattttttttaaccatggctatgagaagatttaaaatttttttgtgtgggagccctaaatgatggctcatgtctgtaatcccagctactcagggggcagaggcagaagtattgcttgagcctaggagtttgaaaccagcctgagcaacatagtgagaccccatctctaaaaaaatgaaaataaattagctgggtgtggtggaacgtgcctgtatcccagctacttgggaggctgaggcaggaggaccatttgagcccaggagttcaaggctgcagtgagctacgattatgccactgcactctagcctgggtgacagagcaagatcaaggctaggtttcaaaaaatagattaaataaaattgtatatgtggataggctattgggcagcactgccataacctacgtactaactgtgagatggggaagaaaaggatgactccttgggaggaagatgcggcaatgggaggacactgatggatagaggctgctttacacctctgaggcctcaagcaggattcaccatgatgtcatctgcatccctccaaagtcacctgcttttgtcttattgcataacttgtttcaaatgttctgccacaacctcccccagcccagacatattcatgatgttcttttatgattagtcagtcaccacgggtagaatgtgtgttccagtgccacatcagggatgacttatgcaaacccaagatggccctttggcttagtccttcttcgcccagtgtaagagtctgtcttgtgcctggacactgaagactgggggagggcagtccatcagagatgattcaggcgatgttacgttggtgtgactggaactattgttatattattaaacggtagaggggccatcctgggcaagagttgatttgcaggttaggttgatgagtcaccgattttgaagctggtgtatgtctaggtagaaatactgaacatgcagctggattgtgcagccaggtctcggagagggatctgggctgattccacatgtttgggagctatattgatagagaaaaggctgtgggagtcaccccatgtttaggagggcagagacccaagcgctgaacccactctcattctcatgtaggttttatgcttggatatcactgcgtgaatttaaaatctgagcctctaagcaacattttggaaagcctgtttcatagttctgcttatgcaggattttctgcctttttttttggcccatgcatttttctctatgcttagagggggaaaaatatgagaagaaagtgtgttggaaagaaagtctgcgggaggagccaagatggccgaataggaacagctccggtctacagctcccagcgtgagcgacgcagaagacgggtgatttctgcatttccatctgaggtacccggttcatctcactagggagtgccagacagtgggcgcaggccagtgtgtgtgcgcaccgtgcgcgagccgaagcagggcgaggcattgcctcacctgggaagtgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatcgcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagttacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaggttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgtcctaaaagagctcctgaaggaagcgctaaacatggaaaggaacaaccggtaccagcctctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacatgcagagacacacataggctcaaaataaaaggatggaggaagatctactaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccagaaattgaactcagctctgcaccaagcggacctaatagacatctacagaaccatccaccccaaatcaacagaatatacatttttttcagcaccacaccacacctattccaaaattggccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggcaccattccttctgaaactattccaatcaatagaaaaagagggaatcctccctaagtcattttatgaggccagcatcattctgataccaaagctgggcagagacacaacccaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcagcttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctagcaatgcctttcttcacagaattggaaaaaactactttaaagttcacatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagtcatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacgtgaagaaatgctcatcatcactggccatcagagaaatgcaaatcaaaaccactatgagatatcatctcacaccagttagaacggcagtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataagtcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattggaagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaagaaagtcaacaaaggtctgagctacggactcgatgtacctacatttgctttggttcaggatccacaggtttgtgcccctcagtccccttgtatgggtacccatggcccacacttcagggagggccaggttctaaagggacaaccaagatccacaggaggaccctgtctttctttatatatgtatatacatatataaatacaccccccacatatatatatatatatacatgcatgtatacatatatatcataatttagacatttctcatgcatttatgttccagatatgtgttacatatatggcacacacacacatacgcacacactctctctctccctctctctgtctctctcaatattccatcccaatgacccatccagctggaaagatggttttattggcttttatcaggaacctcgcccttcccaggagacttacctcatttatatggataggaggcagccattccagcctaaagaaacaaaacctttactcatgaaaagtcttcagtttctcctgcggcatggccttcctgtcctagctgcatcctcaaactcttctttcttttaagggtgagctccaccaggcactacttggcgatgatccctgggaggcaggagacatcagcacctgtgcaaagggaaaggctaattactccaagataactgtgatttcttaatggggagaagaacttggtgggcaaagacctctttagagatgaaggtttctgtcctagtgacaccctgtgtcagcgaggtccccagggagaatctcagtttgctatgatctggtgctgataaacattaactgattaaactagtggctgacattattgatcatgtactgtgggacaggtcctattgtaagcagcgttcatgttatattaacttattgactcttcacaggatcatgtgaggtatgggaggttaagccacacagctcatcgttttgtgccagaacttaaaacctgtgtcagagcctaagcactaagcactaagcatgactctattctgctattaagacaaagtccttttgtaggaagccaatgatgatgagcaaagatggcggacatttttaatggtctggaaatgaagtattaaaattgctattgtcgatgcacctttgtattaatttgttggtgctgctttcatgcacctgataactgcctgttatcttgatggaattaaaacccctgtgttatattctttcaaataggaaaacatatatatatatatatatatatatatatatataaaatcggatataaaatcagagagtaaactgcctcttatagccgcccctcctgcagtcttctgtttccaagttctcagtaccataaggttaacccacgaagccttggctaagcagatgtgtgtgggctgagtgcttgttagtttctgtgagtttcttctatatgtaacaagtgttaaattggaccctgctagtgttaagattctttatttgagcaatttaatagggaaagttaggtgtgaatacacgttttcagtctcacctgcagtgtcaggtgatgttaattctttgatctccttgctattatatcgccttgctattcttataaaatactagagaaatcactaaagcctgattaatgtttagtttttgtggagcaaagacttggaaatttttaacaatttccccgacgatttactttctgtaagcccttgcacactttcttctttataaatgtttatagtgacttgttgcccgttcagaattatagcctggccctgcttctgggatgcagtatgggcccactgttgccacaagtcccctttcagaagttacagagagccatcagcagttacccttttcaacattcatttatttgaagactagggagtaggaggagaaaaccctctaagtgttctctggcagtttggtgcatgctttgaagtgagagagaaaattcctcacgaccatgtagaagtttcccgataaatttatgttcaagtggtggcatttgggcagccaacagccagatgaaaagcccgtggaatcccaggatctggtatgtgcttagtggttctcatgccatgccactctcaggcaagccaggtaaccctccctcagcacttctagcctttcactcggggatctcatgcagaatttaaaacaaaaaacatgggagggctaagctccttttttgataaattgcagaatgcctctttattccacagtcatctctcctctctgcttgtgttggtgtatgagcttgtttccagatggttcagtgggactgagaatgtgaactgatgaggcaagtatgtctgtgtctttctggggagagaaggagatagtgggctatttacaaacatctgcaggtcttcctttcagagacaacaaagcaaagtgccctttaactgtgctcctctatttctctgccccaaaatgctagacacagcagtggtttatttacccactgcttcttatattactggccttaccactcactgaaatggcgctgaaagatgaccagggagctctcaaatgctttccctcagtattcatccccttaaacttccctggaggatgtgggacttttgtccacttaggcatgaaaatccagtgtgtatgttatgcccacggcacacctcagtgcagatcagccacatttcaggtgttctgtggacacacgtggcatatggctaccatattggacagtgtggctctgaagagtgattattttatgacccacctctgttctccctgggcctctcttggttctctcactgtccaagtgtgaatgcctccagagtttggtcctcggtcctccatcatctgcccccacattccattctcctctttgaagatctaattcacaaccacaacaggagctcaccgtggaaaggacattaccccagtgcctcatacccattttcacctggatgctcatggtatttcaaattcggcttatcccaaagcaaatccatctgtgtcaagctggcttctccactttcatccatgcatctttcattttcctgacttctaatgctcccgctaatgttataaagcagttaacaaggcaatcaggctacataagcagaaatctgtgaatactaagacccgcgagctgagggtattatggaaattgaatggcacttgtaagaaagccgaacatgtataatgacgtacataattcttataggcagcaaggtgactaggcatgtctagttattcatgaacattaaggttgttattgctttaattcacaagcagagcaagcgttttgggtaacagatggaaaggcgggggaggggtagtttgtggccctcagtcccctccctgatgccaggaggaattgaagctttgctttcatcatccctcctcccagctgcatttccttggtgccttcactgttcccagtgtcactggttagggaatagtcctttgcttttggccaggcatttcttgaatgtgctagtccctttttaattctctaaaaggagaattaaattaaaagctgacttgggtcccgacctaatgtggagttaactgctaatttcaccctctgtgcccatgcaggaagcatgaaagtgcctgattgaagggccggggccggccctcttgtatacataccctggtctcagagagcctggaataaccttgccgacagagctgtattcccccaaatgctgaataatgataggaaagcaccaaattcacatcggctttttattttcattatttcttattttaaaagtaggttatttcattgagttatctttccacaaaaactactcaagggtgtgattgccgtttatgttcattttgtagcatgagtcgtgaaatttgaagtgcaacagatattttagtttctctataggcttacgtagtagagtgcatccaattaatatcaatttaaaattgatctccagggatattagggtagtgtttacagtgacttatttcttttcctaatagaactattttataaaactttagtcatttcagctactgggatggaaccgtgacttatcaaaaggagtcaagtctttggagtcaaaaatatctgagtttcagttattggttctactattggaaaagttactcttgtcttttggagtcccttccctgttgcataaaataaaatctaccccatcagataaaattcttaacttgctccgcatgtgttaatttcctctctactgttcctggaagctggaggaggagaagggaagcaatgagaaagatcaggaggctgaagccacaagggtatacaacagctgtgattttagaagagtgtaattgggtgcacgtgtgtgtttaatctatttgattagattgctttcctaatatcaagaaccaagagcatttgaggtgaactgccccattacttgatctcagttggaggggcctggaatcctgggaacttgagggggagaagagagctattcagacagggataggaagatcagtgaggcacctgcttctgactttttttttgagaggaggtgtccctctgtcacccaggctggatggagtacagtgttatgatcacagctcactgcaacctccgcctcccaggctcaagtgatcctcccacttcagcctcccaagaagctgggaccacaggcgtgtgccgctacgcctggctaattttttgtatttttggtggagatggggtttcaccatgttgcccaggctgatcttgaactcctgagctcaagcgacctgactgccttggcctctcaaagtgctgggattataggcgtgagccactgcacccagcctgcttctgacattttagcctaaggcatgctctgttaatgcctgcattagtttgcctgagctgtcataacaaagtaccacagactcattggcttaaacaacagacatttatttcctcataattctggaagctggaaattcaagatcaaggtgttggcagggctggtttcttctaaagcctctccccttgactcttagatggctgtcttttccctgtgtcctcacgtggtctttcctccatgtatctgtgtcctaatctcttcttcttctaagctcactagtcatattggatgagggctcaccctcatttcctcattttaactcagtcacctctttaaaggacctatctccaaatacagtcacattagagctttaacatacgaattttgtaggaggagggacacaattcagtccttaacccttcttgtctcagtggacaagatttttgaacttttctgtgtttcgggttcatccttcccttcttcccagtctgttacctttatcttactatggtgttatgatggggaggaaaggaagggtgctgacctcaacagggagccagcatattgcttaactaatccaagccagggcttgcatggaggatttttatttcccacaatatcatgggtaccctgtgcagggtggtgaggggtgctgggtgggaccatatcactttacttcgcgatgctggaagtgtttgggctttgggaggaaaggtcacaggcagcgttatggtttgagtatgtagagatattgggccttcactctccagctgcagtagaacgaggttggcaaacagcagtcaaacttatgcttttaaatgagatagagctgatactaatggacaagttggtgctatccccggaggaacatgaactgcctgtatttgagtatgtatatgtctgcagctctcggattatagtgttatggcttgttgtgccagagagttcttctcttttcaggctgcatagaatattttcatggccactgaccttgagaaagcaattctcagcacgcgcaagtgaaaggcaggaggacccctttcacagtaaagctgggattccctgaaggagggactgcattcgggaaaacttccaaattgctgaatttcttttcttccctcattagttgctggtgcttccagatggcacctgaaccagcatctgggccaggagaatagcatcctagccagtcttcactcactgggcttggttttcgtgtgtgtttgtagcaactctgttacatttttttctgtttccaggttcaattccaggtttaggacatactgctcatttcactttcctctcctcctcctcctccttctttgttgctcacctggttacctaccatgatgaatcatctgattttatagcctaccaaaatcaggataaaaaatgtaaatgtttttgtttaaagggagatgcaaaatgtgagaagtataatgagtaatgattcactcttcaagtactatttgaggaggtagatttatttctaatgccagatgcaccaagacatgtttcttttctttgcagcccacagagatgtcaataagcagaaaatggcattcgtatatcttgttagaaaccaagtgcatggaagttgaatttatcagtggatctcaccacattctcgaatttgagatgttggcagaattggtgcccctcttggtgtctgggtggccagcctgggtttctcctcctacattcccccctccacagtggggcttggatgtgtttgtaaaatgagccttaataaaaatgtgagaaagtctccatttaattttgtgtgattttcatctcagaagttctcgcattatttggaatagagaaaacatcttagatcactttagatagatggtattcaacacaattagttctctgtgcatgctgggttaagtcattggtatttgtgccacccatttggcatttgctggcaccagctgagaactatgtcctgtacctttgaatttagaaatgaaatgctgactgcacttgccatttctgcctttggaaattaatgtaatattggatatatgtaatattggatactattggaaattaatgtacatggaagacatgatactccttgactgtacttttttttttccaatcccaagtggcttggggctagccagctgtaaaggcgtgtaaagcatgcatgtctggcatgtttgcatttgtggattggcaacccttggtacgtgtgccaaacgcagatggttagtgaggtcctggccatctccacgctcctgtgaccaccactcatgaatctcaggagagataaagagagataggatgcaagggcttggctacctgtgcttttctttcctttttctactttccttgcaagactaaaccatatttacaagttccttcaacaaatgtgtaaatgtgtattggatgcctcctggaagttgtgtactggaatcaatgcttttcgcaatttattatctcaaactcctgtgccctatgagacaaaacaaaataaaaaacaaaagccaggggcattggtgttgtacgtttctttttctaagtttgctaatctatgatttatcattcttccatgtttttgagttcattacttggcttaggattaaaccagggattcagaaattgtcctgcattggttttatgttgtagaaaatattcgaggggtaatgttaagttttctacctacaaaatacattctttccagccttgtttttgtggtaggtaatcctttctcatagtacttagacagtttaggttaagttgtcatgtgaaggatacaagatatggctcataatatcttaccttcaaaagaggcaaggacagtattcagagacaacattttatttaatttcagttgtttccagtacttacaaagccaaaataaccctttcttgcctgagtttccactgtaacaggagaagccttttctattcccgaataacaaaccaaacccacatgggtcccatagatctggacctctcattcttagattaaaaatagctccaaattcatggaaaggcaccctctggttttttgccctttgcacctgctgagtctcaccttttaaaaacctcagacctctcaggaaattccctgccaattacatccatttcatctgcctccaacttaacccattctcagtgtgggggtaactgtattacataacggagttcagattaatttttcttacacataaatgaagaaagctaatatctaggtaggcctgtttgagaataagcagagccttttcttcccattcctttaattgttagattttaaaatgcatttccaactaagatagtagtgtagaaaagaataaccatttctttccatatactgttttattccttttgactacatttattataggaaattattttttgttcagtctagtactagttcagatatgtccctaagaaatagtgagtcagtaagaggtaaccatctagccacatgattttaaagaaatcagacactgagagtgaaattaaactaaaatgtatcttgtcaagtttatatgtgacctcacatttattgccagcctcccttgagggatacagtgaaatccacactacttttagccaatagaattgtatgttatcttgttaagaaatatgaaaaggtaaatagtctaaactggtttagaaaaataagtcatgttccttttagctaatcccagtgtatcccacgtgatgctgaaatgcaaaatgcaagtggaaaacttcagttggtgggagtatatagtgaatttttaagtaatctctggtatttcagaagattattcttagatagtctgcagagatgagtttataaggctggtgtggtcggctgaataagggcctgtattagtccgttctcatgctgctatgaagaaatacccgagactgaataatttataagaaaagagatttaattgactcacagttccacatggctggggaagcctcaggaaacttacaatcatggcagaaggcacctcttcacagggcggcaggagagagaatgagtgctgagtgaaggcaggaagagtctctttcaaaactatcagatctcttgagaattcacttactgtcaccagaacagcatgggggaaaccgcccccatgattcaattacctcccactggatccctcccatgctatgtggggattatgggaactacaattcaaggtgagatttgggtggggacacagccaaaccatatcagggccctccatggatgtccatattctaatccccagaacctgtaaatatgttactttacatggcaaaagggactttgcagatgtcattaagttaaggatcttgagattatctcgtgcgggggcagtgtaatcatgagaggattacatgagggaggcagggggatcagagtcagaggagatgtgatgatggaagcagagatcagagacagttgaaggtgccacattgctggaaggccaggaaccaacagattttcccctagagtcactagaaggagtgcagccctgcagaaccattttactttagatgtctgacctccagaactataaaataaatttgcattgttttaagacattatgtttgcagtaatttgttacagcagcaacaggaaactaataaaggaaactaatataggaatataggaaactggcatatactttgggtgtccttggttataaatgactgaatgactgactgtcctccctgaccttcaggtgaagtgtagtctggcatttgatttttgaatgcaaaacaacttcagttgcagaaaattcacgagactcttttactgggccaagggtttcaagaggaaggctctgttttgagaagaaggttggcatgaaagttaaaggttcagtagctactatgtcacatgtacagttgacttgagaatattatcccatgtgcattacaaaatatagtaattttgtaataagttaaaccagttaaatgaaaattatgtacttgtgtttaatgtcatacatttatttttggaacgactttcacatgacatttgtgtagagtaagagcttggtttggtgaaggagtgttactattctggaggaagataacaatataggttgaattagatggttaactttgaaaatgtggcttgggacatggactgaatagaaaaaagcctgggatcaaacacccctgctaactactggggggttctgtgaacacccagaaacacaattggcagctcttacagcgtgaacttcaccatcaagcaggttgtttcaggattctgactgagggatggaaactttctcttgtaacctgtccagtgagcttagcatcccttaggaaatgacttaccctaaggagggtgccattcccaaatctctgttggtctggaattcaaactgtagaaacaccagggacttttctttcttttttttggggggggcggggggggatagggtcttgccccattgcccaggctggagtgcagtggcacgatcttggctcactgcaacctccgcctcctgggttcaagcaattctcctgcctcagcctcccgagtagctgggattacaggtgtgcggtgccacacctggctaatttttgtatttttagtagagacggggtttcgccatgttgcccaggctggtctcgaacttctgggctcaagtgatccccccgccttggcctccctaagtgctgggattacaggcgtgagccactgcacctgacccagggacggttctaagacctgttctttaaatcctaaacctgaactctgatttctccttcctctgagtcctatccttgccctttaaattccaggcctgtgctgcctaatgtggcagccaccagccagagcattcctagactgaaggtgccctggaagcagaaagcacagcttttgataccagggttcttggctgagaagatgggaatatgcagagaagagcagagagtcaacaggggatgggttaaaaatggagagatgttttgatagccatatgttcattatttcttttattttgtcctgtttcttcctagctctctctggtcttgatttgacatacggatacagctggaatgacaattacctaaatatactagagcacctttataatactgatttcagagggaaagcatgttgagagaaaagatctaccataaggatgcgttgtataatgggctgtagtctgcccacccttgggttaacaatgggttgatgttacctggtgtgccgtgtagagtggtgttaaggtcaaataaaggaatgtaaaagcaggctgaaatatccttaggtacgctccagatggccattttgatgccttatgagtccctcaaattaaagagtgtttgtttccttgaaggagaccctctgctatcttctcaggcttggtgtttgctcttatgtgactgtctgtgctattctgccatgtgaaatgtcccatttgaaaccatgttattttaaaatatatgtaaacattgtttatatatgtggtatactatacagatcacagatagtcttttttttttttttttcctttttttttgagacagagtctcactgtctctctgttgcccaggctggagtgccgtggtgtgatttcggctcactgcaacctccgcctcctgggttcaagtgattctcctgcctcagcctcccgagtaactgggattacaggcatgtgccaccatgcccagctattttttgtatttttagttgagatgggagtttcactatgttggccaggctggtcttgaactcttgacctctagtgatccacctgcctcatcctcccaaagcgctggggttataggcgtgagccaccgtgtctggccaaagatagtcttattattatttcaaaatctaattcaacttgcttccttcacagcatttcttggataaatcccacatagcagaattgccttctccctccacatgcagaacctcactttgctgaggccggagcagcagtgtgtgggcgtatatgggtgctctgtgacagtgctgtcccgtagaactcccggtgaagatgggcatgccttatgtctgtgccatccagtaccactagccacatgtggttattaaattcttaaagtgtgacgcgtttcaccaaggaactggattttacattttatctaattttaattaacccaaatttaaatacccacaggaggcttgcagccaccttattggacagcagtgattccataagatcatccaagtagagggaataacaagccgagaacctgatgggaggctccctgaaggacatgttgtagtgacattggctgggacacgacctcagaagcccatagtgatggtgggctaggggaggagctgagaagaaactgagactttcaggaaaacttgagaatagaaatagagggcagatgatttattcatgacatggagctgcccgggcagtcacctgggaaagagatgtcaaatatgggagatcaaggacagcacagaggaacagtgacaggagcaggagccccagggggcttctgcaagagagtccaggctgaccctggcctgggctcaggtgactggaagagagcagtttcatccctgaggacttagacctttgtttctctaggaccacaggctctggatgaagtgatcagccctggatggaggtggaaggagaaataagcattgagcggagggagttaggaaaatctcaaggacccttagaaattggatcttaatgagcagctagagtattggcaggcgtgggatcccagaggccagagagattaatcgattcttttgcttagtgaagttaacagtgatgcttttcctgtaattgagataatctgtgtgcggcctgtgtttcctggggttcttctcacgctgctgtgaattaggccaccttgaacagctgactgaacgtggcaaaccagagtggtgcagcgcaggctgtgggcagagagtcgaggggaagcaggagtcctgggtatttggacgatggatgcctgaaccctaggcagtggcgacaggaagagagaaggcaggcagctgggagagcaggcccggagcctctgtttggaagggccagtggggcaggcgagctggcctgactcccttcttcgagtcctccatttcgacctctgtgcctttgcacagatacatctggctttacagatagaggtgttcctggaaaaggaagtcaaatgaaacaggaaaatctatgttcagcttacatgcacttaaggggaagctcgctatatgtaggaagcctgtggttattgctaataattgccaccaatttattggttctatgggggctcagttgtaccgtagttacactttaacttcctctttctgtaggatctgtaaatgctcttaggcgtttttaaaagtgtgtatcactcacccactaggtaatgaaatccttataagcaaaaaccatagtatcgtttctgtttttttgggacgggcagggaggatactgtttctccatgcaatctttgaatgcgaacatgcttaataaatattgatggacagaagtgacttaatttttatcaaactcttcacagttttatgaatgcatcatttgttttgtctttataaatattattattattattttttgagacggagtctcgctctgtcgcccaggctggagtacagtggtgcgatctcggcccactgcaaactccgcctcactgcaagctccacctcctgggttcacgccattctcctgccttagccttccgagtagctgggactacaggcgcccaccaccatgcccagccaattttttgtattttcggtagagacggggtttcaccgtgttagacaggatggtctcaatctcctgacctcgtgatcctcctgccttggcctcccaaagtgctgggattacaggtgtgagccaccgcacccggccttgtcttcctaaatattattaacaaacaacccaagccttcatatatcaattgcttcctggatgccttgccctgtgctaaacatagtgtgtgatttatgtcatgtaaacctccagcaactttatagatgggactgaactttatagatgtgacttctgaggctcagagaggttaagtaatgtcttcaggttatcgttgcaaattaaaatgttgaaaataagaccatacatatggtgagccttttctcccttcagtattttttcctaaaagtgttagagacaacaaagggcagagggcatgtcaaaggtatctaagacaaactttctttattgaatcaactttgtcttggcttcaactgtgaaacttggatgatgtaatctagggttgggtaccgtacatttctagtctctgggtcttccactgaacactgctgtaccacacgcttcaatggtagagggtttcatggcagggccgtgcagcactgttgtgacatagacaatctggaagttacagaacaaccaccctcccacgtatttacaaaaagtgtaacatttcactgggatcgtgtctgaaagcactctgtagctgaaaagtgctatacaaagccaaagggttatttatcataattttagctgacagcagcactgccgacatctctttctcactcaagggaagtacccacaaggcaagctacagagcatccccctagcctggtgactggagatcaaggagctaaccttcagtgttccgtctgtgaggaacacttgccatctgtgaggttttgggagatgctgacaaccatccatttccacagagtggtcccagctggggagattatatgcaaaggagacctctcagaaagcaaggtggcatgtagtgggcatgtgataagctactcactgcatggctcaacatggctcaggcaacaactcaggcaagaggattctgcagaaagagagatggatgtcatcagaataggcggggaagtggacttgtggttgaccttgaagtctgggcattccaggctggagggacagcctgggccctgagaaaaccaccttccactggagccattctactagaatagttttcatttctcatgcagaggtctggtcttcaaataaatgattctgaaaaattggacttagagactatcacgggaaaatgatgaaggtcatagcctctgggatcctgaaaattgtttgggacttttatagactttcacagtcctggatttctgggtgggaggaataaaaaccggattggacagtgtcgtccttcaacagaagaggcctgacgttaagcaatgccctatttcaaatactttccactgcagaaagagtgctgtccaattgccagtctgggaaatctcttcctgggcttgttttgttttgggattaaatcacatggaactcttttcttcagctcatgttgtcatacttgagacactgctatttcttcccttttatttctaaattgtgaaccttctccttttgtttcaacctagaaatgtacacttctcgttaattgttcttatgagaatggtttctttacagcaataggtggcggataacaagactggaaactttgagtacacaggaccacactggtttcagttctaattttcctaagtggctttgctgagggaggcaatatacattggtatatattggtatatatttggcaagggaatatacgttggtatcttatttttctaaccatagtaatggtatctggaattgttgttggcttttaggctaagccattcattatttttaaccttcagaaaaaaatttgaagatacttaattataaaataaaggctgctcagattttaccacttggacaagagatgaaagttccagaagagtacaaactgagctgctctggcatgttcggaacctgttttctatgacatagttggtagagagcaacatctcatgccccctataaatctgtgtgggtgtgtccaggagagcttgcctcctaaattgtattgaattagaaatcctgcaccttgaagcaattggaattggtctgtcctgcaggtcttctgttggagtagagtcccaagagaaagctgtgcagtcgcccatgtgattttagtctattttagtcttgcctgttttttcaaaaccttactgaaattggggttgactaatggcctccttaaaattggatttattttagcttgaatatgtattttctcttctttttcaacttctagatggcatatattccaatgaatatgattcaaatattccaatgcagtacaggatccaaactatgtccctttggtagagaaataaatagagagtggaattctttagagctgccagattgaccttttccatcaaccactaaactgtctgaaaaatggtacaaatggtacaaagatttaagaccttgagttaaaagggggaagaaactgagctatatgagttaaaagatccaggagactctctcctgtttggttgctcattcttgtgtattaatttttaataaggaagtgaaccccagatgacagaactgattttcttttattgggtgacggttgagatctcctattgcttaaatcaggttaaataagagagaatgctgctctgtaagtctggcctctgggtctctggtatatttacaaagatttaaacgtaatacctattcctgtttctcaggcatcctcatgacaccatcttccagtataggagaccaaaatggataagatgaaagcaaaacatcttgtgtaatgcaatcaaagcaactttaattttttggtttctggcaaggaggatatgggcttaagtaaaatactccattgcaccgtttctggggatttatgtttttaaaccaagtataataatattccatgtacatccactaccagtgatattagctattcccagtccgtgtcacccccagggatggagtgggctggagacctggggagggagaaatcaagcctcatatgctgtgatgtcttgacaagtgagtgcccccaatcctgttggcatttgtgctgcaggagtttggttgatcagatttgtattttagataaatatattaggtcacagtttgaatttcaaattgcatgtcctttgccatttttctttattaaaatgtatgcattaaaattgttatgcatgaagacaaatatcaagattgactgatgttttcctccctattaatttcccgtaggaatggtaaaaatgcaattattcatctatgaaaatggtgtttaagaccttgaaaatgaagagaatttggaaagccacttgtgccataaaatttctgaacacagaaacgggccagtgattcagtcgatattgattgattggttgattgattttaatttcttctccagctttattgaggtataattgacaattaaaaattgcatatactcaaaatgtacatatgatgttttgatttcattgtgaaatctttactataatcaagccagctaatatatccatcacctcacatagttgccattgtgtgtatgtgtgtgtgtgtgtgtgtgtgtgtgtgtgtgtgtggtgagacactcaagatgtactgtcttagcaaatttcaggggtacaatccagtattattaacatgctgtccattattcacaaaaggcaagatgaagaaacaatctaagtgcctaaggctggatgaatggataaagaaaatgtggtatatatacacagtggaataatattcagccttaaaaagaaggaaatctgtcatttgtgacaatgtgggtaaacatggtggacatgatgctaagtggaatgagtcacacacagaaagacaaatactgcatgatctcacttacatgtggaatctaaaaaagtcaaactcatagaagcagagaatggtgttttccaggaacgtggtggaaagggaaatgaagaggtgtggtcacaaggatacaaagtttcagttgtgcaggatgaataaattctggagatgattcaatcctgactgaaagagaagtccatgtgatttagagcagactgtgcaaaatattcagcgaggagctgagacggtctcttcccctggcatgtctcagctatccttgcctctgaatcgcatatgatgtgcacaagtacaatgaggagggctcagacaaccactgcgcttctcacctgcggggacaacaagccaccttctcccgataaatgaatgggcttttaaagatcatctttcagcagtgagaaggtagtgtgaacggaaaaaaaaaaacccaggaaattcaatatcagcatacatataacatttaagttaattcagcccagctggtcagcagaggttgctgttctcggtgtgttccaagaccacagatggcaagccagtcttgatggctttttaaaaaaaatatttgagacagggtcttgttctgtgactcaggctggagtgtggtggcgtgatcatggctcactgcagtctcaacctcccgggctcaagcaatcctcttacctcagcctcccaagtagctgggaccataagtgcacaccaccatgcctggctaatttttaaatttttcgtagagatgaggtcttgctatgttgtctaggttggtcctgaactcctgggcccaagcgatcctcccaccttggcctcccgaagtgctgggtttacagatgtgagccactgtacccagcctctcaatagcctctttgacagctctttgccattggttgcaagatgaatccaaggggagggcataatgtacaaggaaaaatgataaattaaaaatcctacactgtactaggagattgttccataccacatgccgcatggcagatcaatagaaccttcttttgctatgaaaaactacattttgaaacaaaagttttagtgtttatttggggcagtggaaaaagaaggaagaggtgagtattgagtgctaggcactaatcaagtacttactcatttaatctttccccaaatattatgaggtaggcactattttttttcaccaatttacaaatgtggaaactgaggcagagaggagttttgtaaatttccccaggttaagctgcagttggaagctgaactgggatatgaacccagcggaggggctctgcagccgtgccttccagctgcacagtatcctcggtgctgcctcagctcctggggctaaggtaaaggctccctcctgccttccaggaccctcctgcctgcccttgttaacttaggttagaaatgggttagcttctatttttcttaggtctctattgggacaagcttggagcttttaaaggaaggcttactaaagaataagtgggggaagtggtaggaaatgagaaaaaaataaaatgaaaaagcaaagaaatagatgaggtgaaagagcatgcatttccttccgtcacctacacattatttactaagtccctcctgcacatggctgggccttcaaggagttcctgatctgggatgggtggactcaatctcgcttctcgattctctcttctctcttcttcttcctcttcctcttcttctttttttttctttcctctctctctctctctctcagagtctcactctttcacccaagctggagtgcagtggtgtgatctcggctcaatgcaacctccacttcccagattcaagtgattctcctgtctcagcttcctgagcagctaggattacaggcgcccaccaccacacccggctatttctgtatttttagcagagatggggtttcaccatgttgtccaggctggtctctaattcctgaccccaagtcatccacctgcctcagcctcccaaacttctgggatcacaggcatgagccaccgtgcctggccctgatctgggatttaaaggggcagttgctgagcaaatagaagccagggcaagaaaggatttatgtgcttgggattcttgaggggttttccagagtcagtccccaattctgatgtttttatacgcaacactaggggtccttctgaagttatcccggcccctgggaaactcacgtggcatggggcccccttctgccctggtctctttcatcccatctgtcccggccccagagcctgtccagtctggtcctctctgtcctgcttggtttgtcaccatgtgatgttgggatggcttgtctttgccgcctcacttcctaagctgacagacgtgtctgctagggaccaccagctcccaagccgcatgacggtgctttccttcaaggttcagaggcttccctttcagtctggcccatctcccacatcctaatggctctgctgtctcaggggcagctctcctttttaacttattggcagagctgggatgacttataggtccctggctcagtgagtaagcaagttcagagacttggctttggccattttgttctcttaggctcatccttggatgccaacagggaaattacctgccagatttcagtcactactttttagaagttaaaaaaaaaaaaaaaaaaaaaaaaacctcacaaacaagatgtttcttttttgtgcaggcacaatatgtagtctctccactattaaggggagcaatctccttagcgcagtggtagatttttttttaacattcttcatctgtatttatttctatttttcattctataagttagtcaattaaataatatttattgagcagttactaggttctatagatgatcaaaagcaaacacacacacactctcgatcttacaagagcaagagctctttttcgtacatataatttctcaatcttgtttaaagtacacacgcacataagaagctaattaatagtacaaggcagaatcagttaaatgccacatgggtggcagacagttttataaacaccacccaaacctttatttgtacaaaagcaaaagcaagcaacctcatcgttaggagaggagttactgccccataacccaggaaagtcttaaaaagaaattataccaagtgtacttttcatctctatttctgtttttcactttttcagtcaatcagccacttactatttattaagtatttcttccatctaagcaaggtgggggagggagagaaagagattattcctacgtttatgattccaatcttgtttaaagtgtattcgtaaaacgtgagttaataatgtggcatcaaatgagtgccttgtgggcctcttgatggtgagtgttataggaatgtagaggtcaaaggaattgctgtggactgtggtgtgtgtgaaagcttcatggtagacttttgacttcaaggtcaaagacattgctgtggactttggtggtgtgtgaaggcttcgtggtagactggggctgagatgagcccctaggaaggaccaggatttagacgggagcttgaggaacaggacagacaggtggggggagtgctccaagggagcaagggatagagagggagtagatcagtctgcctggagttgaggctttgtttacaggcgaggtgctggtgagggtggtggagaggcatccaggaaggttgaaaatatatttctgtagccacctgccatcctgcatgcaggcacacacacatacacagcagccgtcctcttgttgaatgcctcttctcactaaatacagatacatccatgaggcttacacttactgctcatttagtaaagtagtaaagtcacagtgggagcccgggaatcaggaaataaacactcagatgttttccttctagttttgatcagctgccctgagagaatgagattttaaaataatttgacaggccggcatggtggctaacgcctgtaatcccagcacttcgggaggctgaggagtgtggatcacttgaggtcaggagttcgagaccagcctggccaacattgtgaaaccccttctctactaaaaatacaaaaattagctgggcatggtggtgtgcacttgtaatcccgctactcgggaggctgaggcaggagaatcgcttgaacctgggaggtggaggttgcagtgagccaagatggcacccctgcactccagcctgggcaacagagcaagactccatctaaaaaaataataataatttgatagagaaaatttttgttttattataaaatacacgtataaaacttatcaaaaccatttaaaacgatacagttcagtcgtgttaagtatatgcacaccgttgtgcaacaaatctccgaacagtttcatcttatgaaacagaaactccacgaaaaacaaccaagaacagttttatttgaacccaagggtactttctgggatggaaaagctgggagctcaatcttggatattatagtactgtggagctgggattatggatgtctgaggccagtaggagctctgaggccatccaagatagatgtgtccattggaaattgggcttagagttagaaactgctaagtggacattattttaaaatttattttggatattcagcttccgaacactgtcctacgtttgggaacctcactgttgcgtgagtcatggcatcacctacaacggaagctgaaaaggtcagtacctgctttctccatatcctgctgcccagggcatgcaacttgaccttagcacaaccaatcctcctgtagcctggtactttgaacctgaagtaagcaacgtgaagaacaggggacaggttagggctacctcaggtgttggtgctgaattatcgtaactgcttctgtgtgtgtctgggccgtgggccttctgaccaccaccttcctttggtttctgcccattttccaggctacattgtccagtgtccctgtttttttgagacagaatttcactcttgttgcccaggctggagtgcaatgccatgatctcggctcactgcaacatccacctgccagattcaagtgattctcctgcctcagcctcccgagtagctgggattacaggtgtgtgccaccacatctggctaattttagtatttttagtagagacagggttttaccatgttggccaggctggtctcgaactcctgacttcaggtggtccacccgcctcggcctcccaaagtgttgggattacaggcgtgagccaccgcggccagcccctgtcaattctttgaacacctgttagctagcattccaacttggttggtttctgtcatttgcaaccgagaattctgtctcttttgtctggttgtctctctgtggtcaccatgcctttatcagtctgtgtcatcccgggctgaagttcctcacgtgatatttagttgcttgtggccaaaacccgccttcactgcaaatgcatcggttcctcatcatttctcctctggaccagcaaggggctttcctctcgcccatccatctcccaccttttcgttttgtaggtagaacctggagggagcggcagtaattcatcatccatggaacgtgcctgtctgtggcctggacctgtgggatttggccggcgttccctttgcattacatttggtacttggaagcaagcatccctcagtagggacaaggctccagctgtccctttcattagggccctgccaaggacgtttcctttgttcagcacctcctcctgcctgcccttaggaccatcttccaaaaaactctgctctgccctcacccgctgctgtcccctcccacctgtaagaccaggccagctcagcacctttccctgtctccttgtctagcactgctgcttctgtgtgatgctccggcatggtgagttgaccaacaccatcgcttaaatgtgctgtgccttttacaattatgtggctttgcaggtgctgttcccttgcctttttttctttgcccggcaaattctactggtttgtcagtcacttctcctttctgatagcctttgtgactctcccagctgttactgggtcctggtcaccctctagggccttgtgtaaacctttctttcaggttttacccagggcactgtacttacttgtatatgtacttctctccccgcctagacccccatctccctacggataggaaaggagtctcctcctcatctttgtaccgagtttgcaagcacagtgcctgtgcgtggcaggccctctgtacctgttgactatcgtgcagtggagattcaagctggctgatctgtgcctggtgcttaatggctgtgatgagtttgccacattcccttctccctcgaggtcttctcaacggtctgatggtaatgctgggaatttcaggctttctggcagactgtcagggagaaatttcagtgcagaaaggccttctagaacctcacgaataaggggtgctgctcacatcttgtgagtcctcccccttcctgacatgagtctcagtgccggcaaacacggctggttgaaccctgagctagcccagctgctttgttcaccttacgtttggggaaggctgaaattttattgagcaccgactgtattccacacactcttctaggtgcccgaaatatgctgttaaacaaatactcagccctcatggggctgagagtctggtggggaagacctgttgaaaaacaatcatattaaatgaattgcattgcatgttagaagatcgtaagtactctgggggaaaatgagagtagaacaggataagggggtgatggagggaatgagtggtgattttaaatgtagttatcaggctgggcacaatggcttacacctgtaatcccagcattttggaaggccaagacgggcaggtcacttgaagtcaggagtttgagaccagcctggccaacatggtgaaaacctgtctctactaaaaatacaaaaattagctgggcacagtggctcatgcctgtaatcccagcacttcgggaggctgagacggacagatcacttgaggtcaggagatcgagaccagcctggtcaacatggtaaaacactgtccctactaaaaatacagaaattagccagcaatacaaaaattggcagctgtagtcccaactacttgggaggctgaagcacaagaatcgcttgaacccaggaggtgggaggttgcagtgagctgagattgcgccactgcactccagcctgggcgacaaagcgagactctgtctcaaaaaaaaaaaaaaaaaaaaaaaatccaaacaaaaaacatagttatcagagtgggtctctttgagatagtagcagttgagcagcttgaagatagcaggggagttagttcatgggcttccaggcagagggagcagccagtgccagcaccaacgtgggagtgtgcctggagactctaaggaacagagtgtgcagcaggactggggcacagtggtggggaggccagaggggctgcgggtgtgggccgggcaggtggaggaggccttgagggctgttgagaggactgggctcttgctattacttttagccatatgggagtcattgcaatcctttgagctgaggggtagctcgttctgattttcattctgaaaagacccgtctggccactgtgttgagaatagatgttcctggtaaacaggggtgggcagggagaacagctcccctgcaccagctcccgctgggctgcagacaggctctgatgtggcttgcagcacggtggcagcagggggaggtggcaccgagcagcaggaccctggatatttttttggacatagagccaggaggatttcctcatggttctgatgagggttgagagagagaaggggagtccggatcatcccaaggtttctggcagacagatgatgtttcaccagctaagatggagcggtcctggaaagagtgaagatcaagagtttcattctggaaatgtgggggttttcgctgtctgtcagagagtcgtggagctgctgggaggtggttagtgtggacttctggagagagggctgaaactgtccttgaaaaaatggatttctcagtgtgatgtgtatacagtgtccctttttcagacatggcaccttcgtccatttgggctgctataacaaaatgccatggactgggaggcttagaaaccacagaaattattcctcacagttctggatgctgggaagcccaagatcagagtgccagcaatttggtgtctggtgaaggctcgcttcctggttcataggcggctgtcttcttgctgtgttgtcacgtgtagaagggacaaaggagctctctgaagtccctttgtaaagggcagtaatcacctcccaaggccccgcctcctaatgccattacatttggggttaagattttaacatatgattttggggggactgagggacataaacatttagtctgtaacacaaagggaggttaatttggattaagaaatctaaggccatatgggggaaataaaaggctggagggctaaagaaggatgaaccaataaaagtcttataagcattattatgtttactaaaataaaatagaccaacacattaaacaatgacatcaaaacatcaatggacaacatatactttatatatcttaacttagaagttatagatgctgtactatgagccccacttaggagttcttgcttaatagaaaacattgtaggttctgggaggctgaggcgggcggatcacgaggtcaggagatcgagaccatcctggctaacacggtgaaaccccgtctctactaaaaatacaaaaaattagctggacgtggtggcgggcgcctgtagtcccagctactcaggaggctgaggcaggagaatggcgtgaacccagaggtggagtttgcagtgagccgagatcgcaccactgcactccagcctgggagacagagtgagactccatctcaaaaaaaaaaaaaaaaaggaaacattgtaggttctcacttctctgcagctttagttttaccaagttgcttttacatttaccttgctctattataggtaatagatgtgaagcttccgattcctggctcagagttggtgacttccatctcccgtggaagatgcctctgagtccactcaggatcttgtgtggtcacaaaggtgtaggaaacgtctggacacttgaggtggaagatgctttggggcattcccttccagattcacggtgtcctgcagccttagttctttccagaagcacgtcacacgtgtggcatccacctcccctgcacaggctgggctcctccctccttccctggggttcccctgggcttcacatgccctcatcttcctttatttttcttgaggcattgttgaaaagcctctactcctttgtggggctgttttacctcctggtaaaaaggttccggtcctgagctcacggtttctctcatgtcccctgtgggagtaattagagctaaccttcctggtggtgctggaaacctctgtggaagctggttcatgtatgcctcaactttgcataacagggaacatgatcctagaatattctttagggtagcatttcccaaattttccagggaataagaatctcctgggctccttgcctaagcatcaagcactgatttagacttagcgacccagaacctccaggagaggggcctgggaatctgggttgtgaggctacacctgttggagggatcggaggggcccagtatatgatactcccctttcctgcccagcttctgaatgaattgagacaaaaacaatgactaggacaaatgagaggtcaaaatgtcctcatagaggcttggctggaggatgctgcgttaagtcagctagcccagtaggcctgctaattgaattcctggaatgaggctgatgtaccgcagaggcctccctgggagcagggccgctggagcagcaacagaaccttgcagcctgcagaagctcacaaccaaaacagagaacagggctgagctgcgctgagcagagctctgggattctcttaaatctatcagtcgaaattatttctcctgaggcacataggaagtagagagggctgagagaggccgggagtgtgtaggggcgtggaggctgcagggtggaggagagtccctcctcctggcaatcaggaatgggaaaaagcatctcttttacacaccccaggtgatttgcatgatcaggaaagtctgggaagtgggtcttaggaagcctgcaatgttgtctcttgtctgtgctttccaccagcgttccagttttgcacttttggtatttctgagcaagctcagcttctgtgttttggggtactggctcctaagagcagctgggtgtgtgattagacaaggaactgcttcactagtttattttcattgtgagcacacttcaatatcactctttacatgaacatgagcaaatgggtttaattttgaagtcagggcttgggattcttgcctttgtgtctatgtatatgtgtgttcaacagaataaccagtgtgaaacctaacctagccgaacataaccggaataaccagggtaaaacctaaccatctgtgtatatattcacaaatacatacataaatgtgtatatataaaatacatatatacatatacatatgtaaaatacatatatgtatatataaaatatatgtattttattttgaaataattacagtcataggttgcaaagaaaaatgtacagggaagtcccatgaatgcttccagtttatattttttgaaattgagaaatataatcttagaagatggtaaagctggttttttttttaagttggcaaagaatatgcagttaaattcaggcatggagagaaaattgctttgaaaggaagattttttgcattgacttttgtgtgtgacattagctgtctgttttggaaaatctaagagcaatatctgattatctatgctttccatccctaaaaccaccaacacatagaggctactgaatctcccgaagggcctcggtgatgggcctgggcaggaggaggcccctgcagcctgtgggtggtgcatgggcagcatctcctctctgcagtgtcctgcagcagcagtgcaatgtgattgatttcagaaatttaaaaaatatttgctgacactgcactccagcctgggcgacagagcgagactccgtctcaaaaaaaaaaataataataataatttcctgggataggtaggggaaacggaaatttacatgattgccaacctgactactgatattttccaaggaagattacctctgtgagggcctttttgctttaaatgtcaccttcatggtgttcagcaatgttcactgagcgtatgacctggctttgtgcaccgagaaaactgcccaaaataacaggtgccacagcttggtcacaagacagacacagggccagtaaggtgctgtcagttgtaccccctatgctaagctgtgaaattctaatcccccggccccactttctaaccgtggaaatgttgggttgtgccatatcctggtatgaattttctttgtggaatgataggcccatagagttaagttttctctactgctgacttttactcacttaatttttactcaagttcttaaacttgagtgtgcatctgaatcccctggaaagcttgttaaaacgcagattgctgggctctggccccagagtttctgattaggtgggtctgaggtggggcctgaaaatgggcattttttttttctttttttaaaagttttagggtacatgtgcacaatgtgcaggttagttacatatgtatacatgtgtcatgctggtgtgctgcacccattaactcgtcatttagcattaggtatatctcctaatgctatccctcccccctccccccatcccacaacagtccccgaagtgtgatgttccccttcctgtgtccatgtgttctcattgttcaattcccacctatgagtgagaacatgcggtgtatggttttttgtcctttcgatagtttgctgagaatgatggtttccagtttcatccacgtccctaagttcccaagggatgctgatgcctctggtttggagtctgcactttgagaactctcgctctaggcaaagctggcaaatttgtctcaggtaggggcacacctgctatcttccaggtaggcactgttcctctactcttctgcgtcatctcagcttcatttctccctcggggtaccaatgctctgaaacctcctgctgtggactgaaacattctctttggttaattcaaactgaaatattctatttggcatcaactaacatttgcatatttctgggggaccagccactttgctgcaaggtgcttgtatttgttatttaatctctaccacaaccctgtgaggtcaattgtgaagtccccctttaatgagactcaagaattcaatgacattttcaaggtcaagcacgatgccaggtctcaggcttggagcctctggtactgggccactggtcttccttctctctagcttcaacatccttctgaagagcaattgggtcctttgtgaggatgcttcgaggttggaccaagtaaatgaatatctgtttggtaacattgttgacactgctgtatcgagctgctctaagaaagggaaacatttttggttcagaggacattcacagcactgtgcttgttggagtatttgtaccattgcctcttccaacagttacattttgctcttctttccctcaagagtagaagagggtggagaagaggaaatgattataattcattcctttcccctccctgccaatttctcacaatacccttattgggaggccaaggcaggtggatcacttgaggtcaggagttcaagaccagcctggccaacatggcgaaaccctgtctctaccaaaaatacaaaaattagccgggcgcggtggcaggtgcctgttgtcccagctactcaggagactgtgggaggagaatcgcttgaacctgggaggcggaggttgcagtgagctgaggtcgtgccgctgcactctagcctgggtgacagaatgagactccgtctctttaaaaaaaaaaaaaaaaaaaaaaggcacatttgaagttctgagtgtgaagtgtgcttcaggatagtaaatggaaatggcaaaagaaaatatccagtggaaatctttgccatctttgggattctctttagtttttgctcatttttgcctatcctgcaagggtaacagaaagctctgagatttggaggtcagacaaacctgtctggctcctgccctgattctgctccttgagggttctagtgcagggaggacctctggcaagttggaggattgtacctctctgagctagagaactggcagaaggacaaaatgtaatttactccactgtaagcccttggaaagcaggtaccttgtctgtttggcaccccagtggcagcccatgcccagcagctgtcattggttgggggtgggtggtgggtgagtgcaccctagtgggtagttggaggattaaatgagatagtatgcaaatagaggagagtaggtaagttccccctccatcactggatgtttttgctacttcccctactcttttgtttgtttgtttgagatggagttttgcttttgttgtccaggctaggtgcaacggtgcaatctcaacacactgtgacctccgcttcccgggttcaagcgattctcctgcctcagcctcctgagtagctgggattacaagcgtccaccaccacgcctggctaattttttgtattttagtagagatggggtttcaccatgttggtcaggctggtctcgaactcctgacctcaggtgatccgcccgcctcggcctcccagagtgctgggattacaggcgtgagccaccgtgcccggccccctcctctctttttatctctctgctctttagttagctggcctcatgattcccatttttattttgtttaccttttctgttaaagaaatttttgcccaggctaccctttaggcagggaggagaacttccccctacctcttctttctaagctacaacatcaaaaaaaaaaaaaaaaaaattagctaatggctctccccttccaggcaaatttctaggattaaacgacttgatgcttttttgctctgatccaggcccacctttccagcccacatatagtaataattatggttttatgtttttagggctccacttttgtttgatttatctccccatgaggatgtaagcctcttaggaatggggatcatgattcttcctgacttttaaaataacaactgtttctggctcctatttggtttatgctccatcatgtaatttgctgtcattcttgtattcagctgatttatccttaatcctgtatctcggttgtttgcttttttatccctaagtgccctaccttgcagagccctggcgtcatataactatttattaaataagcttcacggaacctcaacggggactctgttcacatgtaccagcagtgtgctccttctcctttctgcatccaagacatgatcctcagtaggaattgagaacaaaacccagctctttagccaaaaatggtttctgaggttcggttttcataaattcagaaagggggcttttttcccctccatctggccataggatattgttggcctctcttttatttattttattttatttttatttttatttttattttttgagatggaatctcactctgtcgcccagactggggtgcagtggcatgatctcggctcactgtaacctctgcctcctgggttcaagcaattctcctgcctcagccccctgagtagctgggattacaggtgtgcgccaccatgcttggctaatttttttgtatttttagtagagatgagttttcaccatgttgaccaggctggtctcgaactcctgacctcagatgatccacctgcctcagcctccaaagtactgagattacaggcatgagccatcgtgtccagccggcctctcttttagaagactctgtcccattgtcctttaagggcatgtcacttccctggaggtcaaaatcatgtcatactagtttttgcaatccacagctccttgcacaattcctggcccagggagtgggtacatcatcaatgtgtgaggaacagactgccatgaaatagtgtaaaaaatccacatagtacacttgtgagaaaagagataagaaccagaattttccaagcaaagggatagagagctacaaggtggaattcagcaggctcacacctattgggtgttagagagatgaacttagatcacatttatttaaacatctctgagtgcagtatttttaaagatcacacaagaataaaactgtagcactgaacttttctttaagtgttgaagtgaaggaaatgaagaactcagcacggaccctgcttagactccggcagaacaggtggtcttgacatgacgtcgctccaacatgcacgcaacttgccttttattctctcagctctttgtgccactagtacatggtcacctgggcatttctttagaaagggtgcagagactttcatttcgtgaaaatatagatgtcccagggaaaaataataatccaactggtataagtttatatcaaaccatatggaagtgattttttctggttagtcattttcacggggattagagagtagagaaaagtcaaagaaccagggattcccaaggacacacttggcctggtcaatattactaggattggcccagatgccaccaaatccttttttcttcctacttattgaaaaccctgttaaatttgatatgtgtaatatcttttctctaaaattttagccttgcaaataaaattttgcataacatttttattgacaagacattgtgtcacattaaggcttttgaaggtgatgaaatggacatgacatcttcaccttagcaagtaacactgaattaaagaagtttgtatttcagagtggaagagtacagtataaaatatttgaattcagacactttagagcttggaccctgtcagaagcttggaaatacttcgattttaaagctgctactcttccatttacctcactccaggaaatccttttagaaatcatactcttgagggaagaagacctaggggatagagcatgactccactgagaaatttaatttaggaaaataatgggggaaggggctgtagcctagaggctaaaaacccatgctctggagctagactgcctggcttcacatcccagccctaccaccttttaactagtgtactgaccttgggcaagttactcaacctctctgatcctgctgcttaatctgtacaatgggatgtgtggtagtattggccttgtagggttatttggagcattacttgagtcaataccagtgaaggcacatctttagcagaatgtgatgactgaacatgcactcaactggggactcgtttgttgtaaagattatccaggaaattgggaggagcaaggtagtcatcaccaagtataggacttgagggaggtttccagacctttgaggtccaaattgcaaggaggaggggaaggaaggatggccaggcaatagttgggagggaagtgaagtgaagaccccaggctatctgtcggtacctttgctggctgctgggaggggcagtgtctggactctggagaccacgcctccagagaccacaccctccaagaggccacacccttctagaggccacgccttcgtggaaaccacacccccccccttgctctgggccagttggcagcccctgctcttggggctggaccactccttcccagagaccatccattgtacaagaagcacggtctttgataggcttggaggaaaatccctcttccctctccggatccataaggactgcagagagcagccctcacacagcaaggctaattcctggaaacccttaagaaccccagatcagcttgattccaacacaaaggagtaatcaaggcggttgcaaaggaaacaatggcaagtgttttgtgaagcatttttttaagagagtgtgatggaaaattttctttttgaggaagaacatgttctccttgttggaaatgaagttgattttagttataattactaccaaagacaaaggttcattttcacacagacaatgtgatgaagccccaaacagtggaagtcagctctgatttcaaaatagacgcgtgaaggtatccgtgcctctgggtgagaacaaacttgtaggccttagttcttttgtaggtgtgaaatgttctcctcaaaaactgcaacgttcacttaatgaagtttgaaactttgctgcaaagttttaaaaatcttttaaataatttactctatctaggaagattgcaaatgatagtgatgttaacaaattgccctatttggtcttagtggattgtttaattccttactctgaacaatacatttcttgtgttttcttatcaaatggctgaaatatgaaagaatgtgtggacccataaggaaaaaggagaaaactatgagaagaattaatagggttgaaagatgatttcaggtgattttcaaggctgaaattatgatattagaatctgaatatcttttatttaagaattgtaattctttctgagtggctttgcgagccttctttgtggatccttgtgaatccctgcagggaggggagagcaggtgccatcttgtccttgttttgcagaaggggaaggggaaccaggctgaacgacttgcccaaccacttacctaccttgcatggactgttgctatccaaggggagccgagacagctgggagatttgttcctgtcctttcttcatttaaggatttactctgtgccagaaactgtggtcaggcattggagagtcacagctggctaagacaccttgcctgccttccaggatgttctcgtctcatgcaggaggcagacataataggaggtactcttatattagtcagggttctccagagaatcagaagcaattgaaacagaagcaattatatctatttgcttacacacacacaaatatatatatttatacacatgtacacacatatatacatacacatacacatatataatttactatttactatatttatttattatgagaaatgggctcacatgattatggaggatctgccatctgcaagctggagacccaggaaggctggtgatatatataataattcagttggagtctgaagagaagctgagaaccaggggagctgatagtgtaaatcccagtccaggggctagagaagatgaagtgagatgtcgtagctcaagcagtgaggcagagaacacaagggggcagattccttcctctgcattttgttctattcaggccctgaatggattggctgatgcccacccacattaggtagggcagtctcctttactgagttcaccaattcacatgctaatctaatctggaaacacccatacagacacacccagaaatcgtgtttaatctgggcatcctgtggtccagtcaagttgacatgtaaagttaaccatcacactgacagtagaggtgtgagctaatggtctgagctcatggaccaggaagcaataaccttggtgtgtgtgggttgagaaaggcctgtgtcatggaaggctgtgtctttgagggcaagtagaagcttcttaaataaaaaagatgatggagaaggaagacaggatagcaaatgcaaaagtagagaaacttacttgaaaattttagacaacagtgagaagtacagtagaagatgaggtattgtttgggcaggatgggggacatggtgggagtgggggataaggcccaggtcacgaaagaccttctccattacgctaagggattctgacccatttctctaggtggggaggtcagtggaggtttataaacagaggaaaatgtcatgttgtataccatataaatatggtcgtaatttggaggatggacaagttaggtaaagggactcattttttttctctttgattgtctgcctcaattgggtatttctggattcctgaaatgaggcttcatgccctggactgagatactggccatcattaggaggagttagagtccatgattgattgacttttcttttctcttcttttttctcttctcttctttctcttctcttttctctcttctcttctttctcttctcttttctcctcttctcttctcttccttctcttctcttctcttctcttctcttctcttctcttctcttctcttctcttctcttctcttctcttctcttctcttctcttctctgttctgagacagagtctccctctgttgcccaggctggagtgcaatggcacaatctcggctcactgcaagctctccctcctgggttcaaatgattctcctgcctcagcctcccaagtagctgggttacaggcatgcaccaccacgcctcactaattttttgtatttttagtagagacagggtttcgccatgttggccaggctggcctcgaattcctgacctcaggtgatccattctcctcagcctcccaaagtgttgggattacaggcgtgagccactgagcccagctgattgtttcaatcaattttcaattttcaaactttgtggttttgcaacatgtacacaaatacctgcaaatatcctttctcccatttcaaaagaaattgaagggatatatacatacataggtacattttaaattgaaattgattgaaatttattacgtctttgagaatttttttttggagaattggagtttttcaggtacatctgaaacttgaggtacaccataaaaaatgatagttcttcccactcaccttacagaaagtccttttctgtatcccatgtgacaactgtagtcattatggcagccacagacgtttgctagataaagtaaagcaactgccgttttcatcatgcagtaacctgccacaactccatactagattctgtgcttggtactggggaaacacaagtacaatttttcatggttactaccttcaagggtaggctcagtagctattcagaaatagtctatagtcaagtgcacagagacaacggtagaatggtggtcaccaggagctgctgggagggaaaatagggagttattgtttgtttgtttttgtttgtttgtttgttcttttttgagatggagttttgctcttgtcacccaggctggagtgcagtggcatgatttggctcactgcaacctccgcctcccggattcaagcgattctcctgcctcagcctcccgagtagctgggactacaggcatggaccaccacgcctgtagtgataccatgtttagttacatcttttataaagattttcctattctccttattaacaatattttaacaatattattctaatagttatggttcaatatttaaagaaaccggaactacttagtcttttttttttaaaagacctaattcacgtgaaaaaggaaaaaccccttgtgcaaaaaaaatgaattttagaatgaaaccattctgactgggtgaagaagtctatttctaatgtggggggtatgggctgaatgatgttcttccaaaattcataagttgaagccctaaccccctagtaccttagaatgtgcctgtgattgcagatggggtctttaaagaggtaatgaagttaaagtgaggtcattaggttgggtcttaatccaatagactggtgtccttagaagatgaggaagagacaccgggagggtgtgtgcacagaggcaaggctgtatgaggacacggggagtagacagccatctgcctgccaaggaagggcttccagaagaaaccactcctgccaacacttcatctcagatgtccagcctccaggactgtgagacaagacgttcctattaagtcagtcagtctgtggtacttggttaagatggtcagagcaaactgctacagtaattgggaaaactgcatgtgtgtgtgtgcatgtgtgtgcgtgtgtgtgcgtatgctctcatcttggtgcacctgcgccagcatctgaatgcttgagttggtcatggcacactgggccccaggtgtccagagacagatatccaggtgcagtgtcagatgggccgttcaggttccttgggtccatctctcctacgatggccagtttgtttggaggatcacatcggatgaatggaaggaagtggtagctggtctcatggccatggcactcttcagcctatcaaatataaatgcagaagtcaggaccacaggaacagtctctactaaagtggaggacctgccttccattgcctttcggtgccagggagacctgggggaaagcctttcacctggatgggaaggtcttggtattgataccacatctctgccttgaccttcaatcactgcatctcatctctgatcacttttcttcagctttggtctttagttacaacattcatgcaattaagtgataaacgagttatccctaacttttttagattaaaggacacagcaatcacctttctgtccgagagcacaggcaaatgtttttgggtcatgtagacaggaggttgttttaaaaagccgaggtggtaccatgtgatgtttattttatgatctctggagtcagaccactgggttttaactcctgtctcctcagtttgctttatatcacttagcaaatttgtcagcttcctgaccctcagtttcattatctataaaatggtttaatagtcatttttttttatcaggggttttgagaagattaatgaggtaatgtattgtttatgtcacgtggcctgacacacggtaagtgcctgataaatgtgagcaactcttcctacattattaagcatcccatcaaattgtactttaggaattatagtggctaggaaatgcactttgaattccaacaattctggactatttagctccacttgaatttgtgtcagaaatatggtaaatttaatgaagctggctcatcgttaaaatgcaaagctgttctgagtctgaaaagagacaatgcctgggaagtatttaataggggcccagaattttctaagtgatcaataaatggtgacgataaaatgtgcagagtcaagatgggtatgatcttggtttccgtccagctcttccactaagtagctttgtggcctaaggaaagtctcttaagttcctcaagcctctctctcctcattggtaaagtatcaacaatagtcgaacctaccctcctaggtttgtggtgaggctgaaatgtgctttgtggggctttgtatcgctttgtattatggtggtggcggttttcccctgacatagctctctaggatatgtaatggtaaaggatgaataagggcttttcaaaatggagctctgagcggctgtgggagcaatctgtgtggtacatctgtggccccgctggctgccaggtgtctggagacctgtgctccatctctcccctcatgccatgtgcctccctcctgaggctgtgggttgcatccaagagaatgaccttcctcgacagaggagggcagctctccaggaaaagaaatgggaggaacttccttcttctgctggaacccccaactacaggtttaaaatgctgtgtgtgtgtgtgtgtgtgtgcacatgtgtgtgtgtgtacatctttagttagtgagaccactgtaggtggtttcaggtggtgtttagaaggtatggtgctgactggaaagggtggcaacagaaatgataactatccaaggaggtgaggcttatgcagtttgcaaaatgcagacaaatcggcatacaccatgtttttaaagttacatttaggtcaaggagaaaaatgaaaaagccttacttaggcttctgatgaaacggggaaaggaagaaagcaagtgtttttgactaccagcttagtgccaagcacggtggctggcactttccaaaaaattcttccattcagataaaaagagagagcactcaactccttttacctcctgttttcttgatcgaggagaaagctgtttacagtaaaaatgtatttgcaagagaattttaagataatttccaagaaaagttaggaaacggtaaactccaaatcagttggtttcctgatccagattaatcatttcctaggattttccccaaattattagaagacattgctggaccattgtcattagccattgaggagctgtagagaaagagggagatgtaatagaggcagagatccgaattctagtagctgtagattggtgtttctgatctcagtcccaggtgacaccctagactgatagtcaagtatatgttctgtgagaaacggaggccaccatgggttccttggggcaggcatggcgggtgacctcgtgggtttgtaaatagcatcactatgctagaagcattagtggaatgttgtagatatgggatataaaaatttagatgtggtgtatttgataaagtctctcttagtatccttatggaaattaagtgtgaaatgcaggaaaacagacaatggatgatggttcattgatgtggagacacaattagctcagtggctgattcctgaaaatactggttggtgatttgagagtagaggtcacccttgaggaacacctgccttacctgttttgggctcaacattttttatcagtgtcctgaataaggaccatagataataggcttataaaatttgtggaaaatgtagagttacttaaatgttagttagcagaacattggggttgcggttggaggccggggatgccgaggggaatgatccagttaagagggaagcaacccaccgggatgcgccacatcagtggtgaagtccctccacatcgaccgcttgctgatttgaagtgaaaagagggttcctcagtaaggacagacttaacagaagtacaatgtttcctttgcaaaagatgagtgttaaaagggaacatgcagaaaaatgatggcttacatgggatgaataaagacttagcaaactctggccagccatggtggctcatgcctgtaatcccagcaccttgggaggtcgaggcggggggatcacttgaggccaggagtttgagaccagcctggccaacatggtgaaaccccgtttctactaaaaatagaacaatcagccaggcgtggtggcctacgcctgtaatcccagctacttgggaggctgaggcacaagaatcgcttgaacctaggaggtggagattgcagtgagctgagatcgcgccactgcactccagcctgggcaacagagcaagaccgtctcaaaaacaaacaaacaaacaaacaaacaaacaaacaaaacttaaactctatgatcctaagtaaaagataagagaagcagttaactaacttccttttagttaggtactccagggtactactttttgtgatggcagacacacttaagctatttgtaaatgtgtcaccaccttttcaaataatttccttgaaggttaacatgttttctctgagaaaaatttatttaattaaaaaccttatgtatataagggctacaataaaattttcatggactctgagatgaaaagacatgtatatcttcttgaagttatatagttagcaaatgtaaaggctataggggtggattgtgtattatgcaactgctaaacactgtcttgcaatttgtgtgcgtgtgttttgtattaaaccatgtgctcctgtccttgctagtacagtggcttttataatttttgagatgatgcccatagtgagaaccacatttttcatagtgttccagggtatgcacatatcatatactccacacagaactgcaacaaaaaactcaggaaacaatacttaccctaagatgctttctcatttattctgctttatttgcttctatcctatttttatttaaaaatactgatgagagctgagtgctgtggctcatacctgtaatcccagcactttgggaggccaaggctggaggattacttgagcctaggagtttgagaccagctcaggcaacatagcaagacctagtctctacaaaaaaataggaaaattagctagatgtggtggtgcgtgtctgtagtcccagctactaggaggctggggtgcgaggatcacttgagcctaggagttcaaggttacagtgagctacgactgtgccactgcgctcaaatctgggtgacagagtggggccctctctcttaacaacaaaaataacaacaaaaaagtgatgaagactttctcctttgatcctatcagtcactattttttttttttttttttttttttttttgagacggagtctcgctctgtcgcccaggccggactgcggactgcagtggtgcaatctcggctcactgcaagctccgcttcccgggttcacgccattctcctgcctcagcctcccgagtagctgggactacaggtgcccgccaccgcgcccggctaattttttgtatttttagtagagacggggtttcaccttgttagccaggatggtctcgatctcctgacctcatgatccacccgcctcggcctcccaacagtcactatttttaaagcaatgctctggcagagactgaatacacgtttaatgctatagctgtctcttttcttccaaggagaaactgttttatgttatcatctcatattacatcattttaaatgatgtcaagtgaaatactttgagatagagtttctattttatagctggagaacagggttacggtgagtgtcataattatgaaaaaagctggcatcttgccattggcttatggatcattttgcaatgatttgcccaaagcctgtcagccatcacatgtccaggaattagggaaaagaattgttgcttatagactcttagtgtaggaaggacatgtagaggtcatctattctaacatctcaccgagtgcgggggtcccttctgtagtagtttcacagttgaccattcggtatctgcttgattaccttcagaaacagagagcccactgtgttagttttttattgttgctataatacattaacacatatttcatggctgaaagcaacacaaatacattatcttacagttttgtagttgagaggtctgtaaagggtctcagtgggctaaaatcaaggtgttggcagaactacatttctttctgaaggttctaggagagaatccgttttcatgcctttttcagttcctagaggttgttagcattccggggccagctatggaggtcatgccattccatcttcaagaccagcaatggctagtagagtctttctcacatcctatcacgctgacccacaagtcttctgcttcttctatctgcaaccttaaccctcccttgacagggaaggtaacattcacagggtctagaaattatgatgtgggcccttttttttggtggggggcgcggggggcattgctgtgcctgaccacccccatcccatctccccaccttttccccctggcaagccaattctactttctgatggttctaattttgggaatcacacatatgttgacttatgacaatgactgctattcatgcagcaggtgagtttttaaaagagaaataaaggaatctgcaacctggagattttcaactttgagaccaccagccgttttgaaggctgagactgagcgaaaactggtagaaactaattcataggcagtaatgtctccctctactggctgcagagttaacacgtgcattttgcagatagaaatgcttggtggttgccagaaagagggtaacaatgagttttgaataaagagccgagaagtatctgtaagatacgaaactggtggatatcttagttgcactgtgcttacttggtcactgtggagaaggtatttttaaggtcgccacgcccaggcctcggaggttcggtgggttgggagggtttatagggagtcctttggcagttctgattttgttagggattcagatctgctgagccgtgtgagtttggtgtgctgcctgtgactctcatccacagaggggaaagaactaagcaaagggatgacttaacaaaagctgttttgctaaaaaaaaaaaaaaagcagacttatagatccttactgcttcattcttttaacactgaaattgcagtagttgagtaaacgctttaacatactttactattataaggatgccttcattttggagagatgaaaatttaattgaagaccaaaaccagaaagtttaaggaattacataaaaatattaacgtcattgtttttgtgctaagttcctcaaatgcgttctaaatattaaactgaatgaaaaaatcagtgtagacagtttttcaaattaaagttctttgtaaaaaacaaacatgtatcataaaataagtattactttttcctttcgtgcctattttggttttatttaagcatgggcaggaagagaccttgttacttataaatgaaaatatccattttcaaaatgtcactttctgtaatgtacaaaactgagtaagtgttggcaaagacatgtggcaagaagagacctttgttacttaataaatgaaaatatccgtttttaaagtgccactatctctaatgtacaaaactgaggccgggcacagtggctcacgcctataatcccaacactttgggaggccgaggcgggcggatcacctgaggtcaggagtttgagaccaccctggccaacatggcaaaaccctgtctctactaaaaatacaagaattagccaggcatggtggcgggcgcctgtaatcccagctactcgggaggctgacgcaggagaatcgcttgaaccagggaggcagaggttgcagtgagccgagatcatgccactgtactccagccttggccacagagtaagactctgtctcaaaaaaaaaaaaaaaattgaatagttggcagaaaaccctgtggtggccatggaggtgtgccactcagctgtccttccagggaacttgctatgagagtaattggtgacagtcttcagctatggaggtcatgccaaacctaccgtctactggggctgcccccagctgatgactgggcatggtgaggggagctggagctgagccctccatgcccctcttgggactcttctgatgggcaaccttttatctccctccctcctaccccatcagcctggccaaggctttctcagagctccactgcagtctgaggctccttctccataatcctccttccttccctctttcttccacaggtgtcagacctccatctgggtctgaaggttgtctatgcctactcctcctttttcccttcatccttcctaggtatttctcccagaaaaccactggcagttctaattctgtcttggagtcagctccttgaaggatctgaacatgtacctgtgtaaagacttatggaaagaatttttattttattttttttatttatttatttttttaaatttattttttattgataattcttgggtgtttctcacagagggggatttggcagggtcataggacaatagtggagggaaggtcagcagataaacaagtgaacaaaggtctctggttttcctaggcagaggaccctgtggccttccgcagtgtttgtgtccctgggtacttgagattagggagtggtgatgactcttaacgagcatgctgccttcaagcatctgcttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacagggcaaccatccgatttctcaatcttttccccacctttcccgcctttctattccacaaagccgccattgtcatcctggcccgttctcaatgagctgttgggtacacctcccagacagggtggtggccgggcagaggggctcctcacttcccagtaggggcggctgggcagaggcgcccctcacctcccggacggggcggctggccgggcggggggctgacccccccacctccctcccagaagggggcggctggccgggcagggggctgacccccccacctccttcccggacggggcggctggccgggcggggggctgatgcccccacctccctcccggacggggcggctggcctggcggggggctgaccccccccacctccctcccggacggggtggctgccgggcggagacgctcctcacttcccagacggggcggctgccgggcggagggtctcctcacttctcagacggggcggccgggcagagatgctcctcacctcccagacggggtcgcggccgggcagaggtgctcctcacatcccagacggggcggcggggcagaggcgctcctcacatcccagacaatgggcggccgggcagagacgctcctcacttcctagataggatggcggctgggcagaggtgctcctcacttcctaggtgggatggcggccgggcggagacgctcctcactttccagactgggcagccaggcagaggggctcctcacatcccagacgatgggcggccaggcagagatgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcacttgcggttaggggctggagaccggcctggccaacacagcgaaaccctgtctccaccaaaaccagtcaggcgtggcggcacgagcctgcgatcgcaggcactcggcaggctgagtcaggagaatcaggcagggaggttgcagtgagccgagatggcagcagtacagtccagcttcggctcagcatgagagggagactgtggaaagagagggagaggcagaccgtggggagagggagagggagagggagagggactggaaagaatttttaaatcccttcagaaagttgttcaatttccctctgccagtgatagcaaagaaggtggtatagctagagtagggtgaataagggagtgagtggtaagagatcagagagaggtggcagtgcagattgtgtaggacctctttgagcagtttattaatttggaccatgactttgagtaagtcaagccatcagaagttttgagcagaagagtgacatgatctcagttacattttagtaaggccaccgtggctgccagaatagactgaatggcagggattgggaggtcgggatgggaaggaccaaaatacaatcacagagaactgctgcagctgcagagagctgttgcagtgatccaggggaggaatggtagtagctggcatcaggatgctagcaggagaggtggagaaaagaggttggattccggatatattttgaatatagagataacaggaacagaggttggatatgagtagaaaaggtgttaaagaagactttaaggttcttagcctaagcgatttgaaggatagagctgccattttctggtgtggagaagattgaaggaagagtagctttgagtgggaagaggaaaagtttatattttgacttgttaagtttgaaatacattttagacattcaagggcaaatggagaacaggtagttggacatctgactactttctgccacccccactacaaccttcccagcccaaggcactgccttctctcatctggattactgcagtgcagtagcatcccagctggtattcctgcttctgccattgtcccttttctatttccacgcaacagctagagttagttccttgaaaatataagtcagacttctgcttcatgtattgatggactaggcattttggacacatattcctgttgaaggcaaccaagaagcccagataaagtctttgaaaaaatctacttgaagacagatgttagtgatggctaataatatgatgaagaattactgtccaggattcgggagaacatggaaatcaagagaggagaaactgacattcggatgcatttttctggagatgtacacttagtctagagaatgttgctgagagttctagaagcaattttgacagattgaagagtctgcaggaatgcagatctctcttcagcatgacacttgccaagatatggaatccacctaagtgtctataatgggtaaagtatgagatatatatatgtgtgtagcataatgatatatataatatatatagtatgatatatagtatgatatagtataacatatatagtataatgatacatatatatagtataatagtataatgaaatactattcagccataaaaaagaatgaaattctgtcattcttggcaacatgaatgaactatgaggacattatgctaagagaaataagccaagcatctgaagaaaagtgccacacatcatctcacttatatgtggaatctaaaaaagtttaattcatagaaatgactagtacaatggtggtttccaggagcttggctggggttagggaggacatgaaatggggagattgtggtcaaagagtatgaagtttcagttagatagtatgaataagttgtgaataagttctggagatctattgtacagcatggtgactatagttaatgtatgcttgagaattgctaagagagtagatcttaaacattcttactacaaaaaataggtatgtgaggtgatagatatgttaattagtttgagttaatcatttcacattatatacatatgtcaaaacatcacgttgtacacagcaaatatacataatttttatttgtgaattatacctttataaaactgggggaagagtaaaaaagagagtatggaggaaaatgtgaaattcaaagctagctaaggggttatcctctgtgtttgggattggttccctagagaactacataactaggaaaagagtgaactgaaaatagaccaatagcctggctattacagggccttatgtccccttaaaaatcatctcactaggttgggcacggtgattcacacctgtaatcccagtactttgggaggctgaggtaggtggatcatgaggtcaggagttcgagaccagcctgaccatcatggcataaccccatctttactaaaaatacaaaaattagccaggcgtggtggtgtgcacctgtaatcccagttactcaggaggctgaggcaggagaattgcttgaacccagtgagctgagatggtgccattgcactccagcctgggtgacagagcgagactctgtctcaaaataaaaaaaaaaaagtcatctcactaactgacagtagactaaggtgatcctggattatgatcaggcatctagcagaagtaaatgttaattttctctagagaaagataacatcgccatatgcctcaaattatttatatgatcaatttttttagatacagggtcttatagaaatctaaaatagcccagctgttccctggcagatgggaaaggaattctgagaaagtctcatctctgagacagtcacacagggctgtctaagactgaggctagggtaagagaagtgagaaactctcctgtctccactctgagctttacaccaagtaaaaagcaacactattgtactgctgaggaggggcaaaagccagagaaagatagcccctggcacagatgagcagggtctgctgaaagggaaggtgaagcaggaatactgagaaaagataccccaggcctcacactaagcccaagataatgacagttccccctgggaggaatttgaagtctgtggaacactgaaggcaacttcctgtagttacaaaactcaaacccagtttaactgtatactagatcaactcaacttctcacactaatggcctgatagaagaaaaggcatgtacatttctggttgtaaatattattatctttgattctcttaaatggaatgtttagtattcaataaaacatcatgagataaacaaaagagtcaagtgatggggtggggagggggaacaaggcccattgtcaagaaataaaatagtcaacagaaacagaccaagagatggcccagatatttgaactattggacagggccgttaaaaatagctatgattaataagttgaaggagttcatggaaaaggttaatactaggcttgaagtgatggggaatttcaggagaggtatgaaaactgtaaaagtgaatcaactagaaatgctagaattggaaaacataatatcaaagatgaagaattgttttgacaggatggtagctagcctctaagatggcctgtaatgatccctgctttcaaatctgcatttttttttttaggtagagtcttgctctgtcacccaggctgtagtgcagtggcacgatcatggctcattgcagcttcgacctccagggttcaagtgatcctcccacctcagcctccagagtagctggcactactggcatgcactaccatgtttggctgatttttaaaaaaatgtgtatgtaggtggggacgccctacgttgcccaggctggtctcaaactcctgggcccaagcaatcctcccacctcagcctcccaaaatgctaggattataagcatgagccaccgtgtctggcccaagtattcataatcttgcatactttcttcacacactgaatagggttggtctgtgtaaccaaaagaatattgcaaaaatgactgtgtaatttctgaagcaacattgtaaaatatattgtggcctttgccttgctctctgtttggtgacacgttctgaaggaaactattcactatgtaatgaggacactcaagtaatctatagcggggcctgtgtggagatgaattgagccttctgccaacaactaggactacatgagtgagtcatcttggaggaagatcctccagctctagcaagtcctttaggtggttgcagtcctggatgactccatattggtagtaatgtcatggcagatcatgagctagagccagcagcttaggtgctcttgaattcctgatccacagaaactgtgagatagtaaatgttgatggctttaagccacaaacatttcattgtgggctaatttgctataatagatgactaatgctgatggacatttcagcagactggacacttcagaggcagaattggtgaacttgaagagaggtcaataaaaggcatccaaaccaaacacaaagaatggcaaaaaatgacaaaactgaacatcacatctgagatatgtgaggaaaatatgaaacccatgcagtgggactcacagaaggaaaagaaaggggtagaataagtattttttatcaggaaaaatttttctaaaattaatgaaaggcaacaaatcacatatccaagaagcttagagaacctcaggcagggtaagtacattgagagtaaggattgggaaaatgtcgaagtgttaaggagagaagaaacctgaaattgcatgggatgatgtgagagtgaacagggaaatgtcacatgattctcactggtcccacttaatgcagtgttcaggtagagttgggttttttaccaaggatggttttttgtcaagcaagtaaagggaaggaagagagggtaggcactgaggaagcatgcaagggagatctgtgatgatggctgattgacatgctctgggtaatgaaagaagtgaggacttcagaggagacagcgtgggttgggagacagtgggctggtggcaagattaggaattgtagggttcaggggccagacaagtctgcacacaggacttccgagaatgtaagtgagatgcttggaattggggctgtgggggctgtacttagtaaggtccagggaatgaccttaggtatgagagatggagatcaggtggagagcgaggtcactgggaaagaacaaatcaagaaagtgacagactactttcttgaatgtgataatctgtgtgatttagaccattggtttagaatgcatttcctaggccccctttcttacttgatatgaataagagggagtaaatgatatgtttagtctctggtgaagacctagatattttgctcagctccaggtttaataggagggagggttgagttatttgttggaagttgagaggtctagtagtcccactcatttggaatgtctttattgtaatttatgcacaagaagaaaacatatagatactgtatggtcaagattggattgtcattccaattagacattcccccagttgtttgtcaggagtaggagaagagagcaacttgtataagaagtgggagtcggccaggcatggtggctcacacccgctgacgcgggtggatcatgaggtcagaagttcaagaccagcctgaccaacatggtgaaaccccgtctctactaaaaatacaaaattagctgggcatggtggcacattcctgtaatcccagctactcaggaggctgaggcaggagaatcgcttgaacccgggagatggaggttgcagtgagccgagatcacgtcattgcactccagcctgggtgacagagcaagactccgtctcaaaaaaaaaaaaaaaaccaagtgggagtcatcccttagttaggaaaggtatgaaaacttgcacccttttggttgtccacgtttccgttggtggttattggaggtgttcccttgggtctgaagtaccaagctcactaggatgacttctgaatgattcaccgctgatctgactgatccagcacttgtgatacttggaggacattgggcagcttctgagacactgtggttcaggaaaccttgaagttcctggcacagaatccacactggtaagcctcactggtcccctggcttggcacacattactgagagagtccctcccttagaaagaacaaccactgatttctgggtgttcagttattttttttaatcagtgtatttgtccatgttcatgctgttaatcaagacatacctgagactgggtaatttacaaaggaaagaggtttaactgactcacagttccacgtggctggggaggccccacagtcatggcggaagagcaagggatgtcttatatggcagcaggcaagagagagcttgtgcagggaaactcccccttataaaatcatcagatctcatgaaacttattcactatcacaagaacagcatgggaaagacctgcccccatgattcagttacctcccactgggtccctcccacatgtgagaattgtgggagctacaattcaagatgagatttgggtggggacacagccaaacgatatcaatcagtttgtctgatgttctctttaatgataatctatgtaaagatgatcagggtgaaatagaatttaatacttcctttcaaagcaagtggtcaaaggtcaaaatatttgattctatcataatcaagtgccagggattgttgtaagcaatctattaacttccttaattcccaaaacactctgtgatgatttttatcatccctgttttacagatggggaaattgagtcatagatcaagtaagtggcagggctgtgatttaaacctagataatgtggccacaaactgttagcctcaatcactgtatgatcctgtgcctcatggtgggaggaaaaatggacatggaatagaaccatgctgataactcgaaaatgcagccagaatctagaaaacataaaacttgggtcagtttcatttaacaagtaagctgtttgcaacatatttagtatgcaagtccctggtggtagatgacgcatgctttcaatgccttatgtaaggttactcagatacatttcatttattttcaggtatcttcaggaaatcttagtaacagcaaccaaggaaggtgcagcatcactttccagttatcttgtaatagaatatcatgaggcaagtaaaaaaagtccctgtaatagactatcttggggaacagaagtttctcattgttctcctgggctacagattctaaaatcacactgtccagcatccccttgttggttttttttttatttttctttttttttttgatacagagtctcgctctgttacccaggttggagtgcagtggcacgatctcggctcactgcaagctccgcctcccaggttcacgccattctcctgcctcagcctcctgagtagctgggactgcaggcacccgccaccacacctaattttttttttttttttttcatttttagtagagatgggttttcacctccttaaccagaatggtctcgatctcctgaacttgtgatccgctcgcctcagcctcccaaagtgctgggattagaggcatgagccaccgcgcccggcccccctcgttggttttaactgtgtgtattttacaatgagttttcacttgtagcttattgaaggtctgtcattgtgatagatttgtcttttgtacagcttttgctttcacacatggcatctatgtggatacctctagagaatctttcctatgctgaatgcagccttttgagtggacgatgtgaagccaagagagagggcagagaagaggtggtgtgtgcaggggcattagtctgtggctactcctctgcttggccatggggcccctggggagtgctggagtggccctggcctgagcagggccacagaggccccactcatttcccactgctgttgtgcaggaaagccactttgcttcccttcttcttcagatcctcttcactggctgttgagaaggagagatgcatataattaccaacataacttgagtgtccatgacaaatgacccttccagcactctcctaaaccaccagcttagcccgttgagttttactaatgctgtttgatgcagtgataaagcggaaacattgctctgctacctgcccaggatagcattgccatgtaaagggcaagtgatgtggactgagaccaccataatgcaggtcttcttggaaaagtatctaatgcaaggcagagttgcataaggggctgaataaccctgggttattcttactgtgaaaaattcccctacttttttcccgtagttacctgggctatataagaggtatgcatgctatgcaggggcctctgagagctataaatgacatagggtcaaattgaaccattttcccaccgactggggtgtcagaatcccaaccagcatgtgaagaacacaccctgcctcctccagcaggactcagacaggcctcctgtctcgcacagtggtggtttagaatgcatgttgaatgcttggatctttctagaccaggctgtgtatgggaaggggaatattggcaagagggagaaggttttcctgttcaagcatactacaatgggaaagcaaagttatgtttcttagtacatcaacagttataggttggtggttaaaaaagatgctgagcaggctgggtgtggtggcttacgcctgtaatcccagcactttgggaggccgaagcaggcagatctcctgaggctaggagttcaagaccagcctggccaacatggtgaaaccccatctctactaaaaatacaaaaaattagctgggcatggcggcgagtacctgtaatcccagctactcaggaggctgaggcaggagaattgcttgaaccaaggaggcagaggttgcagtgagccgagatcatgccactgcactccagcctgggtgatggagcaagactccatctcaaaaaaaaaaaaaaaaaaaaaaagatgctgaacaaaatattctagattcccgtagccagtggctctaccatactgttcatgggctatactatggactttgcaaaagtttactttacttcatgaatcatccagtaacatgatttgtgtgtatgtgtgtggtcctcattgtgaccatgaatttcagtccccttaaggaacaattatttctttgctggtggaaggagcctgggtcagtgacagtggggcatggtacttacccctcccatggtctctgtcaccttgtcatcatgcctttgtgctggtggggctgacctctagttctctagctggaaaataatttataagagagcaagcatgggggcataacagtgcagatgttaaggcttctaatatctactgtgagatatcctttcctcaactcataatttcttggtgaggaggaagaacaggcgtgaacctgagggttgtgcttcgtttagacttgacaagaatgtcaaagagtttatgatcttgcaataaatgtaattttccgtaaattggtagcaaatgatgtttctcgaaggggagtcccctagaagaatgggttatctttgaaagcagtgcttctgtttatctgtacagataagatgtgcgacgtggcatccatttgaataagtaggaaggatcaaaggaagataattctactctttatttgtcatctttagattgattttaagtaatttttttgtaaggcaaagatctctcatttaatactgataagttgcgtgggaaaatatttgtttttaacctttcttattatgaaatgtaaaatccacacaacatctagaaacagttaaataacaagtgaacactttttaaatcatgacctgaaatagaactttatgagtatcacagactctcaacatgcttaccccttccctaatagatagccactatcccaacttttgtgataatcatttatttgtgttactttttaattttaccacttttgcactggatatattttattttattttattttattttattttttgggactgagtcttgctctgtcacccaggatggagtgcagtggcacaatctcggcttactgtagcttctgcctcctgggttcaagcgattctcctgcctcaggctcctgagtagctggaattgcaggcgtgtgccaccgtgcccggctaatttttgtattttttggtagaaacgaggttttgccatgttgcccaggctggtcttgaactcctgagctcaggtgatccacccaccttggcctcccaaagtgctggaattacaggcgtgagccaccatgcccatcctggatatattttaaaatgcaccctgaaggtgttttattactgattttgttgttgttcttgttcatttagttctgctagaaagaaccatggcctaggagacaagagactgtgattatttttattctccagctcaatctagttttgtcatttaaagtctcggggcttattttcttatatgtggaaaaataagtgggaaattttttattagattggtggtttcataattattttcttttaaaagtcagatgaagtttatgaaaccacaatataaaaacaaactatttattttctaagttcagatgtatacagtttactcattataaagtcaacaaatgagaacacattgacatgctggcagtattcagcatgtaaacatttggaatctggagtcccctagcttaaaagtaattctactttaaaagtatgtaatagttgaatgtgccaaagccaataagcacatgagaagatgttcaactttgttagttattagggaaatgcaaactcaatctgcaatgagataccacttcacatccaccagaatgactgtaataaaggcagacaagtgttgtcaaggctacagagaaattgaaactctcatacactgctggggacctggtatagctgccacggaaaacagactagatttccttcaaaggtgaaatatagagttaccatatgaaccagcaattccactcctatatataccctagagaaatgaaaatatatatccacacaaaaacttgctcatgaatgttcctagcagcattattcagccaaaaagtgaaaacaactcaaatgtccatcagttaatgagtggatgagcatgatatgctgtatccatacaatggaatgttatttggtcataaaagggaaaggaatactaccatatatactaccacatggatgagtcttgaaaacattatcctgagtgaaagaaaccagtcacaaaggacaacatctgtgggattccactgatatgaaatatccagaataggcaaatctataaaggcagaaagtagatgagtggctgtcaggggctaaaggcagtgggaggattgggtggctaagggatgcagagttccttttttggggggataaaaatgtccttaaattgattgtggcaatcaactgtgtactttaaatgggtgaattgtatggtttatgaattatatctcaagccattatttaaagagttgaatgtgcaaaagtgagatcatagtcttacatgatattaagtagggagtgagtggtagagaggaaagatcctgttcctgagaagaagataccatgacaatatctctgtgagaggtacttggtgtctatctcatgggttccttttcttctacactgtttatgactagagtcacctcttctggcatgcctactgcctaatgactgtcttcattaccactaacattcatatctccaaaatatttctatttagattcatttttacacagcgcaaaacactaacagattcaaataatttgacagactctatggtactgaaactatggtggctttgacgaaatggaatcattgtctggcaggcagtgctgtgtgacgtgctagctcacaacgtgtgtgcagagatgcaggcgagttaacactcagtgatgtgtaggcgatgtgtgcctgaaagtgaggtttgttcaagagctaaacatagaaaagtggatgactgtctgactctaacacatttgaatgtgtatgtttctgtaagaagagttttgataagttcgaaatctaaaaaaagaaatcagaatgaagtgttcatggaaccctgaagcaccgttgcagaacagtttgtaaaccacaaagtttaattacacctaacgtcttttttggctttcatattttattgttttatttcatttatagctacatttgaatatctgtttatcagctttcatccaaaagacttgatggattgatttctgatatgtgccatcttggtagggtaattattgtgcttgattatttagacagtagagcttaaaattaactttagtggtattgcataatggaaactttttataaggccatgcaaatttattattaagtgaatcatcacaaattaagttgtgactagttcaccgctctgtgaacttgaattctctcttgcagaacacacaacactgatgccccaattgggggtgtctgaaataccccagcacaaaatccatttactcacagaacttatttatgttctccttataaaattggagacaataaaggcttaattagggataacatgttcaactttctcatttccagatgtgtaaatagagtgaaatcaggcactcctagttggtggagtttgttgataaaatctttgagataattttaggaatttggaattagaccatatttgttcctggggaagtggattaattattataagcttactctgaaccattacaggtgtctttgacttaccttggaccataggatttctctggagtatctgcataaagtccatctataatacaatgacctggcctcaccttacccagcctcttagtatccttcagatatgcagagctaggccgagctcagtgtcttctttattagcagctgcagattagggagtgcatctgctgtgttatagtcacttttggaagcataatgcaatggatttatgtattgtcctgtttaaggacatttatattgtttcattttaaaatttttctcatagaaaatcattctgcaatgcacaatcttgtacatgtcttcttgtgcaaagtgtgagaacagcttctggatgtatttaggaatggaattgctcagaaatagagcatgcacatattttgtttctttttcttgtctggctgtagctgctagaatttctagtaccatggtttatagaaacaatgttggtaggtgtccatgtctccttcctgacttcaagagggatttctaatgtttcatcattaattaatgtgtttgctgtaggattttggtagaatctctttgttgggtaaaggaaatcttcttattccttgtttggtgagaatttttatcgtaaatgatggttgaattttttcaaattccttttcagacaacttgttttgatccagtcctctgagatcttcctaatgaggcgtcccccaaattgcctatcatctcatgtttatggggtagtctgggacctttagtgacttaaatttagccttcatgtcttgggtgcagttgttaagagaaaaactggggagtataatgcctcccctggttccccaactgggaagatgtccagagaccaaggaatgactcaaacaagtccagcttggcaagcggatgagtttattaagacttacatatggggaccttctgggcggcagcgggacagctttagagatcggccctgcctgccatttttaagctgcttttaagctaattttctggctctttgcctacagtgtgtgtgcaatggaactctttttgctatgttcccggatcctctccaggatgtttgggttctcagaaacaccttcttcttggctgggcactatggccttggttcaccacttggacctcagggttcaagcagtggacatatgcccttaagtaacctgatgggggacctgtcacactacagaagtcatgtaactttcagttaacaactgtgccaggattttcacttccccaggacacttgtgggatttgcaaacaacagatcccttcttacagccagccaatcagatatattcttacctaagtggctcctcactggagatgccttatgaccaggtggggcccccattgccctgactgcctccttgggtctttctgaagccctgggtggctgtcctcagcttcttgggcatgtagggtggctccagcagcctgagggaaggcatacacacttgagcacacctgagaggggcctgagccccgctctgtcctatttctcatgttcttatgctgaagagtttgccaggagcttgtatgaaactgaagtgctagagtctgttattcatggacaaaaaggggaatgctgtatttttggtaatatcccaatgccctatctaaaggaaagtcaaacaaggctggaagctggggctttgaattaagaaaatggcctcatgctccatttatctaaggtaaatttgaagaacacttctggggcttgggtccctgggaaggaagcaatatggtaggataaaggagaatacccagtaatctggggtgtaccacagggcatggaggaaaggggaaccctacaacctgactgctgcagtgctgccagggttcctgccaccctgtgatgaggagctcttcattggtggggcagttgggaagagcatgctgctctctttgggcaaagagatttcccatgtcatagactttgatctcgtccgcactgtgagctccaggtcagacacacagagggaccgctaagccctagagtgcaacacttcactgcccattaacagtttattttatttttgcctgcccttgtttcactggaagctaggtatggagagagaatgccagaggtatcattacctctcacttttctctaatacagatggaaaccagcattgcaggtaatttcgggggcctctcggtagcaccggctccccactgggaaagacatgcattagatgcctgcctgaaaaactggccggctctcaataggtttagactatcgttcgaacaccttcttccttgaaaaaagaaggttcagtagttcctcggtgttcttaaacttaacattcacagtttgtcttcagtgagtaacccttaaggtccctaaccagaaattcataaatttgccagggcacaaaagtacctgcatttccctattgttttgctgttctgatttgatgatgcagaaatgtaaatcaatgtgaatcactatgtaaaacataaattgagtcattccttgaaaactctctgagaattcccattgcatttaggctgaaacccaaactttctgacatgagctgatggtagccacagtgtcagggtcccgcctgtatctctgatctcattccatcctgctttggctcacagggactttctgcaactcttaccctctcctcaactttggagagctttgtctttccaatgtagaccctgtaactcaactttggaggagattcctccaaatgctgtagctgctttgcctacagcagccagtggctggaattaatgtccctggctgtccccagcctcccataactgtccagtatggaagcatgaaagcccagttcacgctttcacggggcagaacttaccgtgtagagttccactggagtctcccgtggcccccttgcttggttttcaccccatgcctgtcttgctttgtccacaccctcactagcctcctaggagcacttccttcctaatcctcttgcactggactcttccttttagggcccgtgccttgggaatccaacctaaaatacatcacccaactcaaataccccctgtctgaccagtgttggggaaaaagaacaaaaaccaaaatctcccaacccagtaaactactctgtaaaggtagtagaaaaagaaaacagtttacttattgaataaatatcctagcactttgggaggctgacatgggtggatcaagaggtcaggagtttgagaccagcctggccaacatagtgaaaccccatttctactaaaaatacaaaaattagctgcgcatggtgacatgcgcctgtagtcccagctactcaggaggctgaggcaggagaattgcttgaacccgggaagtggaagttgcaatgagctgagactgcgccactgcactccagcctgggtgacaaagtgagactctgtctcaaaaaagaaaaaaaaaaaattagaccagaatgtgacgcatgttataggccatctactaaaagagtgccaagacagaaatctgacccttttatatagccaagtagacagaacccattatatacatgttctcaagacagactactccttaagaaagaggactcgacagcactatttgttacacatagtttatgctaaattcacctggtaattagggtgaccattggtgttaactcattcctatctttatgtcagaaggtagttttgcaacttggagcctggtacctgccgaagttagactgccgtcttccagtagagactgcgagatagggacactatcttctttggatgtttacattccaaagagatgtttctcaggtcctggagaaagacatttctgggtcacagagctgacagaaacatcatttagcttttaaaataatttacatatatttcaaagagataagaaagaacttacaacttttctatagtaaatattctaagaaaaaggatgggcaacatctcttattttttatctgtgagaattaaacctcttatttttaatttttatttgtcttcatactataggtctagctgccctggagactctatcatattccttgtgctattttcctcagagctttctgaatgtttgatacatacacaataatagatgtaacatatacttaagttataaagtctagtaataaagtaaatacgagtgaaacatgcatccaactcgagaactggatcttgggtatcccctattccaccctcagacgtcccctaacctgaattttgtgtttataatttccttgcttgtaccactatacatgattccctggccaatagttctaaatgaaccctgtagtttagctctggagttgaacaatgagaacgcatggacacagggaggggaacatcatacactggggcctgtcggggggttgggggagctaggggagggatagcattagaagaaatacctaatgtagatgacgggttgatgggtgcaggaaaccaccatggcacgtatatacctatgtaacaaacctgcacgttttgcacatgtaccccagaacttaaagtataataataaaaaaaaaaagaaaaaaagaaaaaggtgcactgtgggtagactcttgggactagccgtttgcaattagcattgtttctaagacacctatgtggttgcatttagctgtgcacgctcatttttgttactatctaaatattcctttatgtgaatatataagcatatatccattctcctgtctgtggacaactgggttgttcctggtttgtgatatgaggaacatgcttctttgaacattcctattgtatctcctggcgccatatgcaagagtttttctgatgggtactcctagagatggaattactgggctgttttgttttcctatgtatgcctctgaaaacatcttgttcattggcttgtttcctgctcactgtctgtccacttgcctctgtaccagtgtcagcaggcctttgtctcagtcttggtacatgttggatatagacctactatacccataaacatgaatgacccagttctagatgaccagttttttgaaacagaccctccagaaatcaataactatctattcttgtaatggcagtgaagaaaaaaagcaaggaatactgggaaactgggatgattgttagcctgaaaatagaagttttaagggaggaattagatgcctcagctatatttttaaacgagggggtttctgactgtcaaggtctattattagttaaagttaaaagggttttctcttccagctgccgctgtatttgggtaaacaaaaatcctgtgtaagacttcagaatctcagtaagcagggtaatgtcggtattaataaaaatgttagagtaaaatttgccaagagttagtgtgttgataatagatattgactgcagagggactatagcatatatttgggtaacaaatttgatatgtggtgttgtgtttggtatcatgaaaacataagtaattgttgaatttctcttaaaaagccagctctttagaaggggtggggaggttttatcagatggtagggtttggaaatttagggagatgtttaagtgtaacttaaaaccttacttcgttgattccagttgttttaaccccacatttttaatttagtgtttggcttctattggctctaagtcaactatctaatgaacacggcactgctgggaaggggcactgccgaatttagcgtatggtttgtgtcttggagaaagttgttcagttgacttggagaggaatgcgtgggaatgcagttccaagaatcactgacacagctctcctgggaacccacttcaaatatgtagataacataacagtcggcatgcttggagtaaacaattcccactgctttgcaggatgcgctccttcttatagcactttgttgtactgccagctgtttttcttgactagttcaattgtgacaatgtaaaccttttaaaaatgcattttttcaccagtttctgtccactagcaaaaatttgctcctagctccactgagagttgggcttttttgaattgtcatgttgccagttttctttcacttggaggatgtgttcatctatttccagaatgcattttaagtattaccctcatctattctagtagttttgttcctgaattttaaactacagattaatcatcccatttaatctttttaaaaaagagattatagtttggagacacagcttcttttggaatttctttctggttaaaagttagaataattgcctgcttataattagtttagtgttgaacatactacttgttaaaatctaaaattgcccttaattttataccagctttaaagtttgggagctgcaaatgccctttgttctggggatggggatgattaatgcctggaaaaaactatgagcaaacttcagggtcaatcagacaatagatatctcattatctattgaaaatatagatgtgaaatctcaggaaactctttttacttaaaaatattaagtgccagaaaagattaaggctactatgctgaattgcatatttacatgagagattgagaaatctttctttttaattgacaaattaaatgatttttagagcatttttagtttgggttaataattaagcagataagtgagaactttgttagtcttgctaattttgataaaattccctatttctattactgtaagaggaaaagggtgtgcacctgttctggtaataccaacagtatccaatgaaaaaatattatgagggtatgggggtaggggtggaaatacacacaaattatctgttgctttgtgtattcttttttcaatcttttcctctaaacttgagcccctcacaattcacgttccttctgttcaatgaccattttgtatcttcagtttgaatttatctgagagcagtcatgcaattaagatttcattggtgatcacattttaagtttcattatgagtaacttttcactaagagatgtctgccaacctcatggtgaatacatcatgtaaaatcagctcctggattagaagagccatttcttaacatttgtacattctcctcatggtatacctggcacattatccttgtgccttgaatgtttgttgaactgaatcctttgcgatcccgcaacactgtggctatcagagagtcacaaagtttaaactggatctagcaaagtccaagcgagtatagtttctgcaaaagcttcttatgttgggataacagttagtgatgggatgttggccaatttcaatggtgttttattaaacagacctccactagttaccttgatttggccttggccttttcatggcaccctatctggttttattcaggccagagttaatgatagttaggaagtcatgtggtcgaatcatctggaaattttgcataatatgacagttttctcctgaagcaagttccaccgcatgtcgtgtcacacatatattatggtggagatgacatgggcctgcagatggacttcggctgaagtgttcagggtctcatcaagtcagatggtaggataaacaagatagttaataaaacagcttttaacctctctttttaaaaggagattggttttcactgaaatacgtgcacgtgcaggaacagaaaaccaaacaccgcatgttctcactcataagtgggagttgaacaatgagaacacatggacacagtgaggggaacatcacacactggggcctgtcgggagggctgggggatgtgggggagagcattaggacaaatacctaatgcatgtggggcttcaaacctagatgacgggttgataggtacagcaaaccaccatggcacatgtatacctacgtaacaaacctgtgcattctgcacatgtatcccagaacttcaagtaaaaaaaaaaaaatatatatatatatatatatatatatacacacacacatatatatatatatacacacacatatatatatatgtgcatgtggtatggttattgtaaacacaagtttattgaaaaaggcagcatgggagaatagaaagattttgggttttgaagccagctagacttgcatttcaatcctgtttctggctgtgtgggttttggacaagccaatctgagcttccatttttctctcataaaaataatgataattataccgacttcgtaggattgttaccaagtgtctagtacacagtaggcattaaatactaagacctttgtgattttattgtcgttggaattgccctgccctttcagatctggataagattgcctttgacctctatttttcagattttgggaaatccagccccctaccccaaattttgtgaattcttcaggttcatacatttttgttttcacttctgttcccaagctctagcttcctctgaatgaattttcctcttcgagtgagcaaatcaagtaggataaattgttcaaagcatttctggagtgttcagagagtcaaatgtattgggagataattatactttgaaaacttaggcaataattgataccaaccatgatagaggaaatatttttagagctgcataatttgtttgaaaggtgtcgcttattttctatgcctatctatatccttgaaattttgggaagttaaaagacagttttagtttgaggctagcctgagcaacatgctgagaccccgtctctacaaaaaacaaacaaaaacaaaaacaaaaacaaaaaaccaaaaacaaacaaaaaacccccgaaaacaaagcaagaaaattttaaaggaggtagaatacaagctttgagaagtacatggtatggctggtcagtttacaagggtgtgttgatgagatttagcagttaggcctcaaaacatacttgaagccaagtgccataaacacaataaaataatggctcatttaataggattaaccataggtagcattccaactctgaggggaagaatacaagacagtagcagaaaaattgtcaaattccattaagagtggaatgaaggcttttttcttctgtgaagtgtgatgaagtttccctcccacacacctgttatacattaccacaatgtatttgattagtttaacttttattttgacttctccgttaatttcattggaacattaagatattttatagcttatcattggctatcctatttccttgttttcatgtgaaatgaagtccgagctacttcaatgctatcttgaaatgctgcctttctgggaatttttaggtgaagaagatagatgtgagtattttcaaatacatgagccgttgccatgattagttacatatgctggcccattttccacccgagatagctcattaggggggttttgtgttataagatgagtttgaaggctcaacttaatacagtaactgctactgctgttgtattagtattataaaagcaagcaacatttactgagaacttatatatgccaggcacagtgccaagtattctctgtgcattgtcacttgcaataaccttatgaagttctctcattattttcctttgttcctttcctttcctagggtttggaaatcttaaataactttcgcaaggacatgcaagtgtatgtagcagagttgggcctcaagcaagacctgtctgacttcagaggtcacagtcttgatcactgctctagggctctgcttctgtaacagctgcttcttgagatgtaggaattaagaggcatgtaaggaaagctagcatctggtttcatgttggatttggcttggccctcaatctatcaatatcattgatgggatgaattcagaggatggaagattcttggaaaacaagtttctagatagggctgggatggaatcttttctgtttttgtatccccggtgcttaacctaatacctggcatgtggaaagcccctgaagacagatatggcaggcacttttcttggattggcagttgaaaagaactgaaaacaatgacaacaacaacaacaaaaacacaaagaacacatagcatagtctgtacaaacatctcctgtattctatgaaagaaaaaactagaggtagaacataggctaatgggaatattgaaactatggtgccttttccaggtttttaatcatagatttggagaatttgacaatgccgagatgaagctcttgaatgttttagctggaggattctggaaatccttctggagttcatgtctggaggaattaatagagaattcctccagattttggtttcaaaagctttaattttgcttttgattttcaggggtctacttaattccaagtgctctggaagaagagtatgctgatttgttaacatgagggccaagtgtttaagttggtggttttagttttacttggagaacctttcttcttttagatctcagggtttcgattttgaaagtgagtttaaacaaatacacaggagtcactggaaaaagtaggttgggctgattaattttcatctagattttaaatttatgattcattttagatctaggaatcatggtgctgttaggaaaatagttttagaggttatttaattttgcattaggagtatactgtgcctgagctttcattttaagcttgatattaagaaattcatattcagatgcagttctacatttgctagaactgtccagagacaaaattatgcttctcccgaagggcattattacttacttgaaacagaaaccgagtatgtgcctgttccagtaatggatatgtcagggtggaataatcaccctaacagaggcagccacccaaagtttttgtgttttgactagagaaaatgactcttagcgatgcataagacacccctcaacatgttctttgaatggttgctgatgttatttagcaataattcaaattaagtgatgtttcttgctgtaaagaaaaactgagctgtaagcaggatagtgatatgattatagaactcagtcagaaagatctaagttaggagtttgctacttggaatctatctgtatttccttaagacttcagttttctcatctgctgggtgaggatataagtacttgaaaaggtatacggtatttagccagtgctaacttagccattgtttttgttgttgtgtgtaatgatgcagacgtcatgatgactgctgaaggagcagaggaggacctttacaatcaacaccctttaggaaatggtggtgggccaaggacagagtcaaaggtttttaagcagtggggtgtggcatggacattgatcttgcagctattttcttttctttttaaattttactttgctttaagttccaggatacatgtgcagaatgtgcaggtttgttacgtagataaacatgtgccatgggtggtttgctgcacccatcaactcgtcacctaggtattaagacccacatgcattagctatttgccctgatgctctctctcctctagcccccaccgacaggccccagtgtgtgttgttcccctccctgcgtccatgtgttctcattgttcagctcccacttatgagcgagaacatgcggtgtttggttttctgttcctgtgttcgtttgctgaggatgatggtttccagcttcatccatgtctctgcaaaagacatgatttcattcctttttatggctgcatagtattccatggtgtatatgtgccacattttctttatccagtctatcattgatgggcatttgggttggttccatgtcttcgctattgtgaatagtggtgcaataaacatatgtgtgcatgtatctttatagtagaatgatttatattcctttggtatatacccagtaatgggatggctgggtcaaatgggatttctggttctagatccttgaggaattggcacactatcttccacaatggttgaactagtttacattcccaccaacagtgtaaaagtgctcttatttcttcacagccttgccagcatctgttgtttcttgactttttaataatcgccattctgattggcatgagatagtatctcattgtggttttgatttgcatttctctaatcatcagtgatgttgagctttttttcacgtttgttggctgcatgaaacaaaaattaactcaagatggattaaagacttaaatgtaaaacccaaaaccataaaaaccccagaagaaaatctaggcaatgccattcaggacataggcgtggacaaagattttatgatgaaatcaccaaaagcaattgcaacaaaagctgaaattgacaaatgggatctcattaaactaaagagcctgtggacagcaaaagaaactatcatcagagcaaacaggcaacccgcagaatgggaaaaaatttttgcagttacccatctgacaaaggtgtaaatatccagaatttacaagggacttgaataaatttataagaaaagaaaaccccatcaaaaagtgggcaaaggatatgaacagacaccagcagccattttctaagggctttggtaacagtcactgtgctggttgctgaatcagatttgtgttttaaaaagatgagtcagagtgtgtgtatttagacagggaaaccaattaggatgctcttgcatgggtgagagatagtgaaggtctggacaaagagtagatgtatgtgatggacaatttggagcaagaatgaacaagagacaaagcggtgaagattttgagatttggggggaggggaaggaatgaattaggaagaattaaaggtttctagtgttggcagttgagtaacttgtggctttattaatggatgtaggacagataaaaggaacaagttggtaggggatcaaacagaagacagggtcttccctagaaagtctttaactgaaacctaaactgttctgtgtgtgtgtgttttaaataacgatggacctttattacccatcattattctggcagttcaacttggcgataatatttctataaaataactgtggtgcactgatgcaatacatttggaataatgaatttaatgttgagttgagctggcatggaacagttatagatagtctgggggatgtgtatgtgtagcattttttttttgcagggatagttgttgaaggttataaactataatcaataaatcttttttttttaattttcccaataattttgcagacaatctgcaaaaccgttattttaggccacaggtagaaaatgagcaacataaatttagatgatgcttctctgaattgttacatatttttcatttaagttaccccaaggctgtgtttgtattggaaataaagaagtggttttctgctgtaaaaatactgttttgctactaggcaaacagggtttttgttttgttttttattctgaaaaggtagattttatctacttttaaaattttctgggttggtactcatgactttcaaaaattttcattctaaaggacagtagatttaaagggtggatgaccttgggaagcagctttgtcataaattgataagtgcaatttaagagggagatgagtaggaataaaaactgcaacttgcaagaggggctctgggctgcattgcagtcacaagataacattgctaacttccagtgaaatccctggtgggaagcagctcaggagttatggatgcggattatgagttatgtagtttttatgcaaataagattctgggcttctcttcaatttagatttacgtttccaaacactcctagtggggctggtttggtactccattgttattttatgatgacacaaataagaggctttatccaatgataagcgtgtgattcattgctgttctgaagagctgtgagccgagtgctttggtgcaggcagcctgagatatgttgaaacctgcagtgattcagtgatgaagatatcccttgcaaggcttgaaggactattggctgaggaaagtcggttgcagcttattttcagtttttggttggtcagtgaaacactccaaacctgcttacctagctttctaaaaacaatgtagattttcaggcaggtgcagtggtgtgcctgtaatcccagctactcatgaggctgaggagggaggattgcttgagcataggggtttgagaccagtctgggcaacatagcaagaccctatctcaaaaaaaaatgtagtttttaaactaaagaattcaataatggcctgtacagatttggacctccgtcctatccctagagggacattttatagacttcattatatataatatatgttgtttaaagtgtattatatgtatgtatgtttttcctattttcttcttgttagctttaaggatgaagtaggatttttaaaacagttgttaaagttcctcaaaacagttgtttaagttcctctgtagcaggccaccattcttgtcagcaataaaggtgaagaatgccccattacagaaaagaaaataaacactttctcattgttcatactttctactcttgtactaagcttcagatgccactgggcgccagttgctttccaagcctcaaggatccttagggatgttggggctttctttggtgactgttgtctccttgtttgctcaaattaagctccccagcaaaagagggaagtgaaataaattaatacatgaaaccaagaactgttactgaataatggtatatatatatttttttcttttcttttttttttttttttgacagagtctcgctctgttgtccaggctggagtgcagtggtgcggtctcagcgcactgcaatctccacctcccgagttcacgccactctcctacctcagcctcccaagtagctgggactacaggcgcccaccaccacgctcggctaattttttgtattttttagtagagatggggtttcacaatgttagccaggatggtcttgatctcctgaccttgtgatccacccacctccacctcccaaagtgctgggattacaggcatgagccgaatagtggcgtatttaagaaagaaaggggaaattagattccattttggaattttattgagcggaaaggatagatgatttgattggaaactaaagggagatacttccagttttgtattggaagacaagttattaaactttcacgaaataatgttgatgttcatttaaatgttcttacagtttgtttctaaatgatttagtagtttatgtaggaccagctatttaatgatcctttgatcattaaatatgcagttatatatctcattgggatgaatgggaatggctaggattgttactgattcttgcccctaaaaagagaagttgaattcagaatctcttagaaggcataaaaatttaccatcaccatggcattgaggaaggcaacacaggcataaagtgatctcattgttcaacctcgtcaccatttaaccagctgtttccttacatatggtggcaccctttctgagagcctgtaagtattttttatagccctaatcatgtgctgtccctcttaatcctgggcatttaccctgctgttccctctgctgaacctcacacatgtgttccctctctaactctggttagacatttaggcttctttctgttggagagacctgccctggtccttcaatcgtggcttgggctctgtgttctctgacctcttcctctgctgtattcctggccatcatgtcaagtgtttctcaaaatgtgttccgtgggaccccacccaggtgctattctccacaaaatctattctcagaaagttctagaatggatagtaagatagctgcactacattgtgaaggtactaaatgccaccaaattgtacattttaaaggttaattttttttgttatgtacattttaccacaacacaaaaacatcttttgaaagatgtttctcaaaagaaagtctcagactcaaacatgttacacttacctcctggaggttttacaatgcatattagtaaagaatctgagatgtcttaaaggaacccgcttaattttgcttgattcaatgttcccaaagctattaatagactttaagaaaatgcacaactacctgttaatgtccagctagttaatattcttagggatacaaattgtaattgcctgcttaatcatgctctcctatactaagtggtagggatgggaccatatttgtagttctagaccagagatcaggataagccttcagtaaatatgtattgaatgaaatgcttaagtgaatatagtaatatgtagaatgtggtggggcattgtgaaaggaacacagagtcacagagatcaagggttcaatcctcccatgatcacatttagctgtgtaaccttcagtgagccacttgaactctgacctttgatttcatcctgtattaaatggaaatacaccccagttaaaatggcgcttatcaaaaagacaaaataatagatgctggcaaggaggcagagaaaggggaatgcttgcgcactgttggtggcagtgtaaagtagtacagccactgtggagaacagcatggagatgcctcaaaaaaccaaaaatagaaccaccatacgggccgggcacagtggctcacgcctgtaatcccagcactttgggaggccgaggcgggtggatcacctgaggtcaggagtttgagaccagcctggccagcatggtgaaaccccatctctactgaaaatacaaaaattagttgggtgtggtggtgtgtacctgtagtcccagctacttgggaggctgaggcaggagaatcacttgaacccaggaggcggaggttgcagtgagccaagatcacaccactgcactccagcctgggtgacagagtgagactccatctcaaaaaaaaaaaaaaaaaaaaaaaaaagaaagaaagaaagaaagaaaagaaaaagagaaagaactgctatatgatccagcaatcccgctaagtaaatatccaaaacaacagcaatcagtatatctaagatatctgcactctcacattcattgcagcattatccaccatagccaagatatggaatcagtctaagtgtccatcaatggataaatggataaagaaaatgtgatatatacacacaatgaaatattcgtcagctgtaaaaaagaatgaaatgctttcatttgcagaaacatgggtgaaactggaggtcattatgttaagtgaaagaagccaggcagagaaagacaaataacacatattctcatgcatgtgtgggaacttagaaattgatctcacggagatagtgaatagaatggtggttgctagagaatggaagcgtagtgggaagggacggtgggaggagctggttaatgggtacaaaaatacagtttcatagaaggaataaattctggtattcaatagcacaatagggtgactataactaacaataatttattatatatttcataatagccagaagagaagatttggaatgtgcccaatgcaaagacatgataaatgtttgagataatgtacatcccaactaccctgatttcatcattatacattgtatgctattatcaagatagcacatgtgcctccacaagtatgtacaactattatgtatccataaaataataaaattgtaaaaaccctcagaattaaagtttacaaattgcttaaaaaatggaaataaaagtaccttcctggagtttttgcaaggattacaagagttaatgtgttttaagtacatggcatagaaagtaccaaataagtgctagtttctttctcttcccatagaaagttaattaccataaaatagttatagatggagtgagttgggtgtttagagtgagaagactttcagctgtggggatcagggaaggtttgtggtcttatgagctaaaggattggaagaattaagacttacagaaataaagggaaaggacattgaagagagagaacaagataagcgtctggaagaaagagattagagttcagatgctcttaaaaaatatcgtgttcactttcatattttatccttttcatatatgccttctcccgggctttgaaggaggaaattggtgatgttttcctcattagacatttatctataaggatcacaaatcagacaattttcccttattttcctttttctctcctgttttcttctgctattcttaaaaatgattggatcccacccttcccatcttcagctgtagcattttgagacattgtgcctttttgtctaaaatattctatttgatgaacggttaaactaatagtctgtgagctcctttagggcaagaatcacgtccaggtttcgtctcctcagtgctgagggttgtgctcaaaacagagtaggtagggaaggaatgattgccgaatgaatgaatgaatggagaaagagtggatctagttccatgggcctaagactgaggcccatagtctctaatgtgtttatgcaaaatgctgcatggtagctgctaatagaaagcaagttctttcctccagttctgatgtgatgtgatctggcagagggcagcatgcccataaatcaacacacggtagtgtaagtcatccactggtgttagaaagttatgagtaaggccaggcgcagtggctcacgcctattacataatcccagcactttgggaggccgaggcgggcggatcacctgaggtcaggagttggagactagcctgaccaacatgaagaaacctgtctctactaaaaatacaaaattagctgcgcgtggtggtgcatgcctgtaatcccagctactcgggaggctgaggcaggagaatctcttgaacccaggaggcagaggttccagtgagccgagatcatgccgttgcactccagcctgggcaacaagagtgaaactccatctcaaaaaataataataataataatgagtaaaagcaaatatagaaattggaactaattaatagttattttggtacaggatgaagtatagtctatggggcgtttatctaaggaagaagaggtgatcaaatagacaggagagatgtgttacatgtgtgtagaaaaaggctccgtatcattacatagatgagaaatacacatctgttttatggtatttttcattcaattcctcacatacttacttaaatgtgaactcaggccgggcacagattacgggctcatgcctgtaatcccagcattttgggaggccgaggcaggaggattgcttgagctcaggaattcaagaccaacctggacaacaaagtgtgaccctgcctgtaccacaactactactagtagtactactactaataatagaaaataaatatgtacttagcagtgggttgtgaatcagagggctacaaagagattatgatggagcaatgctttgggaaagtttcaacttatagggaaataaaacatacaaatctgaaccatcttttaaggcctatattaatcaccatctccacaaaatcagcttcatttagtggaaacactcccttgaaattattaacgtgcacttgaaaacttaattttgtgccaccttatagtatgtattaattgcttgctctttgagtattaatcttgtttttccctccaatttgaatatctgagattagggaccatgctttactaatgaaatgatcaataggaaataggaaatgctcctagaataatcctatgtgattcctgaagtctctaacaattaatacttgacagacacagactgttatcaacagcagaatctttggattaactttcttaatattgaagaagggtatcttatactggtataaagcagttcaatttacaaaacaagtttatatgtattatttgtatttcgttaggatctgcaggatacacatgaatgatctcatttggaaacaatggattgtcagtgtttagaggaaatgtttttcagtggtgccaatatgattcaacaattttattatggtcttcaattacattttcttccttatttctttagtattgcttctaaattcttaaagcctactgatcaatagtatcaagtgatgctcttttctattatctagattttgccatcctgaaagacaatgacatttcatttttatttttttgtcaggtttttaagtccttgttttagatttagaactaatgtctgggttttttttggtggtggtggttgttttgttttttaatggaagggatgatgggcagtgtatccctgggtgtctgagtgtatattcatcctgctaattgagttgtccattttactaatgtcttctgacagcctttcattgatctttatagttcttttctgggaaggtgagattttacagactcaaggtgattggtttaaacttggaatttctttccttctaatagatagtttttaaaaaaaacccaaaagaactaagaaactaagagttgattctgaaaattgataaaagaaagaattgttctttgtaacttcactctaaatcattataatttatattttattactaatgatttatacatgcagaaagataaacagtttccacaaaggcttattcacattcctggattttaaacctatgatgagactgtgtttaattagaggtacggcccacggcagttgttttctttacaggaatttaagaaatcatatattttaaacttgcttaagataaatctaaataattctttggatggcatgttaattaggagatgctgatatttatagattaggaattatttgtagactctgcatgcaaatattatgggtaaaaagaaccatttaagtattttgaaaataacattagaccagatgatgttgtaattataatgtgtatttgattatgaccttttacttcttacaacaaacaggatggatttgaagcactcttttctaatgataattccaaagatttaaataactttctagatttttgtaccttccacactgtataaaacacccctgtcttccctgtcaagaaaattttgggggaaaaaaaaagaaaacattgtgcacagagagttgataatgaatttaaatattactaatggaaatactttatagttatatcaactaggagggtttttttagtttgttaactcaggagttttaataaaaaattgtctctaagaatgctgtttccactgcatttacataagggatatataatttattagacatctttttcatgtaaatattcacatgagtatttcaaattgtgaaattacaagtgggtctctttccatgcatactagaagacagcagttattttggcagacagtgcttttcatacattcacccctttactcatttatggatacatgcaaatattcttattaattaaactcttttcctaatgtaaataaagatactatgtgctgatgatacagtgatgaaaaaagacctgacaactaacctaaagaaggtcacatctgggtagaaatgaacaaaacaataaagcaaaatattgaagccagtaaaacagctaaccaggtttcaaataaaagtctattggttccaaaacccacctgttttctatagcaaatacgtcaaatctttgttcatttgtgtagtgaacatttgttgagcacctgttatgtgttagaaattttttttttggtttggtttgcattgcctagtgtggcagcctctagctctgtgtggatatttacacttaaatgaattaaaacaaaataatattcttctgcttcctgtggcaaatgtgacaaccagggcatcatcagagtgagtagtggagtttgggatattctgttaatcctctgcatcataaaaggtgctgtgctggaattagtgttctgaagccataggtagcttcctctggggaggagaagtttgcaacagattggccaccttactgtttatgtggattatgtatgatcaggcatttgtacctttatacagtatgtgaatgtggaatgaacacgccatcacataattacataagtcatcaacaaatctttattggccatctgcttgtcagaaagcctcttcctcatgaataaccttagtctctaatctcaaggagctgaaaaatggttaaatagggctgggtgtggccctatttaacattttccacaacttttaatttcatttcctatcaatattactcaacaacaacaaaaaattggttttgcaatccaaatattgtattaacaacataaagttggaaactttcagctaatgttcattctatttaaacatgctttgggttgttggtgcccaggatacagcaccccaaaatatgattataggagatcagaatatacctcaaaatacatgtttttggcatattgatgattttgagctggttattttgagaaactgcaggcacaggcagggaaggaggggtattgtaaagtggaagtgtacttagcctgttaagtagagaaacaatttccataggatagggttttgtgggctggaaagataaactgcaaggctcatcgtctaaatgcctgctgttcatagagttagaacgttctgcaggagtctaatggggctgttacaaaagggtggctactaagcaatctgagactctccaagggaaagaggcttcatctctacaactgctacttcagtagaaacaggagtccatcagaaactccatctgcttatccagtgctatttgatattatagttattatgtactctttatggactagagacggagaggttgaacaatagcacacactggccttagatatgttcctattttatcttttaatttttgacttgaaatatacaaccactccggtcaaacctctctactggttgctgattttgggaatccaccgtgatctctaagatacctgcaaccccattcctacatgcagtgttaaccagcagttctcccttttactgtccacctaaggaacatgccataccacattcccatcaatagcatttcctcaccagttacagaaaagaggttgtagctagcaaaaagtaccgcccacccccaaccccctaccccccccacccccacccctccacaactgctggtctttccagtatgcaggaggtatgcttgagtaccctccaggcctctgggtttgcccttggcattactgatgtaaacactgattggtttatctgcagatctcctggttttatttttgtttatttggatgcacacatctgggcgtacatctcattaggttaaggtgagtaattccttgaggactattcctttgacctcttcttataaagtgttatttacttgagcatacccagttctcttaagttcatgtagttaatgggtggtgggaaaattggtcttctgaaaaacagagacggaagagggagtggaaatacaccccatgtttgtgttagctcctcagcttctggagtgtgttagttttaccagaaagatttgatcaacaattgagaggtctagacttcagatgtcaaaccttttgagcctgctcatgtgcacacagatacacatgaaggaggtgagctaagggaccgccaaggcggtctccgggtgcctgactgctcacccaggctgctgacggaggctctgccagacttcaggatcagaaacctaatgtcattagtggctgggagttaatgagactacggcttcaaattcagaaagctcatatgtaactgaaggctgggatgcagtggcttacacctgtaatcccagcactttgggaggctgaggcaggtggatcacctgaggtcaggagttcaagaccagcctggccaatgtggtgaaacctcgtctctactaaaaatacaaaaaattagatgggcgtggtggcctgtgcctgtagtcccagtcagtcaggtggctgaggcgagagaatcgcttgaaaccaggaggcagaggttgcagtgagccgagattgcgcctgggccacagagtgagactctgtttcaaaaaagcaaaaacaaattcagaaagctcatatgaacctgagggataacatcagaatgctgatttgttaactgatgctcagaaatgctactgtcggccaggctgggctttcacaggtgcccagctgtagacgtggtgagccatgtcattgttgggtgcacagtaggtttgggctcttggggtacagtgtaaacaagacaaatattcaaggttgggctgagagggtggtggggtttaagcagagacaggcgacaaataaataaaagaagaggtaaagctcccagttaatgatgagggccaggcagtaggggctggcagtaggccaccgtggcagggactggctgatggctgggttaggtgggctggccagtgaggcttctcacacactttagccagagggcacttggtgagcttcaaatgaaaggtcacggcaacctcttacctttttgatagacatagggtttctttagttatgtttataaatacaatccagttcaggccagacctcaaagttgattttgcatatctttattttcagttttgtttttctccacgtttactggggctttgtctagctcctgtccatactccgtatacctattctgatatatttaaaatcatgaaataatcctaccctgtgtaggaatatatttcagagaattatttgctatgtaaatgatttcagattttgtgctgtttattctttttttttttttttaagagacacggtctcactctgttacccaggcaggagtgcagtggtatgcttataactcagggcagccttgaactcctcctgcttcagcctcctaagtagctgggactataggcgcatgcaccatacctggctaattaatttttttttttgtagagatggggtctcactatgttgcccaggcttgcatttattcattttatttatattcctggaataagattacagatagggcaggaacaagagtgaggtaaagtggtggatgtcctggagatgactgaaaatcagtaacgctgtagaaatgaaacttattttcaggggaaaagtcttaagtgttaattaacaagttcatgggcagactcctgctgaactaatagaggcaaacgttcttaaaatggatcaaaatcacttatcttttggcttgcttcattgaaagcactgtaaagacagatttgtgaattacaaatttttgagactgtcaaaaattgggccctagctttccttagggggtggaaattatgatctgcttatcctcaaattatataatattgtttaatatagtttaaataatgtccttttatttgtaattaagtgaggctgggcatggtggctcacacctgttatcccagcactttgggaggccaaagtagaaggacgggttgagaccaagggttccagaccagcttgggtatcatagtgataacttcatctctacaaagaaactaaaaacattagccaggcatggtgagaagtgcctgtagtcccagctacttgagaggctgaggcgggaggatcacttgagcccaggagtttgagaccagcttggcaatatagtgagacctcatctctcagaaagtaaaaaaaaattagccaggcctggtggctcatgcctgtagcctgttgtcaggcaagggtgtgaggactgcttgaggccaggagttcaaagctgcagtgagctatgatgctgctgctgcactccagcctgagtgacagagcaaaatcctgtctccaaaaattttttaaaaatccaataaacaaaaaaacccacaaaaactttaaagtgaaaaactgtttgaagatgatcttaatgacccactatcagcatggtgagattcctctgtcaggccaccactgggtgtttatctacgtgtgtgtttctgggggctggttccattaggctgaaatgagctgggaatttagcttctcaagggccaatgccagtcatctgacttagaacacctgggtaccttgccaacttccatctgcttctctgatattatttgtcagcaatctttcaaaaataatattagacagcaccagcaataaaacagatactttctgcatgagtgtgttgggagcagaaaatgagccaattaagcattctgttttctgatgcatgtgaaacatttgtacacatggatggatcttttgaaatttgagatttgctattctttacaataaaatttaagctgaagtctctcagggctggagcctagatttttaaattatttgcatttttttttagagtgaaactctatagtaagtgaaattggccatatattttaaaatgcatgaacataacaaagttagtcattgaaaagcaggcaaaatctagcatgtatgtttttctttggatttgttacgtcattgagtcatgtaatgagtatttaagaaaacaaaacagttctctggaatgcctgaattccatgttggcaattgggtacaataaagcatttgcaattctagtgacaaattgtactgcagtgcagaaggtctcatcgagcttagatcattcgttgccttacatattggttcagagatgagaaaataaaaacatcagagtgaattcactaggttctagggtttcaggttcaatctctgtacagaaagacttaacaagaaaatcagtagtcaccagagattatacttggcattagattacacgagatgaagttaaatgcttttgtttgggtttgaatgaaaatatgctgacaaataatgaagcaacaaataaacaaacaaaagcaacctcttcactgcagatgggctattaacacttagcattctaagctcacccataaaagctgtaaccaaagcttttttatttgattttgaaagccgtgctttgttgaatatttgatgaaaccgactgcagagatctgcagtgatgttcttggtgaatccctgttggcagctttaggagtctgtccttttggagatttccaggggttgattctcattctggggaagaggggaaaaaaagcacagtgattacaatcaaaggagtaggcaccagaatgatatgaaacactcagaattttctgccttttgataaaaatttcacatactggctagatagagcgatagttatcacatcaaatagagtaacggtcccactcttcttagagggccaagaactattcaacagctcacctcagtaagggctgttttgctgagtagtatctctgggaatgatggtgaggctatcctttcgtttgcaataacttttagactcggtgaatataatagcatgatcattcttgcctatagaacagagaggtaagcaaagcagctgtcaaatagtagttttctctaaattagggaataaatatagttctttaaaaaatttttttggaagttgatatttcaaaatatgtagtatgtgaaattgagtaatgtgatattatatgaaactgaactgatgtctgattgatccacctcctttttttttttttttttttttttttaaatttagagatgaggtcttgctgtgtcacccaggctggactgcagtggctgtttacagatatgcttatagcagccttgaactcccaggctcaagtgatcctcttgtcccggctttcagagtagctgggacaataggcacatgccactatgccagtccataagtagagttatgtgaagtcagtttagacaagaaagttctttaaaaatttgcatgttaggagcctagtcaggaaataagctgaatttctgtttcttaaagcaaaccccaaacaacaacaattccttcttttcctggatacttaccaagccaaagagaaacggattcattgagatactgatctcaggagaacagtaatcctggagcttgggctatcacagtgtgtcttggaaaaggcctgtagtggcacacaattcatctgtaattgggattagtagccctggccagctgtagagtggaggacaaatgttggcttcattccatgtcagtgtccttcttagattcctgggcattaatcgttaaatgttgttaggaatgaagcttaaagaaaagcaagtttgaacttcttcatgcagggggtgctgggttgggggagagatggagagagacactggtttagaaacttcatattagaatttttgatgccatacttttgctttgggtcatttatttgatggctataaactttgattgatggtttctatcttctcataactctgctcattgaaggtggagtcttctatttcttaagaggactgattaccaggttgatagatttccaagccttctgttgttctatactctctcttttcctgcctttcgccgagaggaatatccgtgtttcctgaggatgggggtgaaaaaatgtctatccaataatgcttgaattataattttggtgacaaaagttttcttttggggagggggaaggaatttagaatgtttagatttcacttttctctgttcttgctaaatgtgtgtgccggcataaagaacagagctgatggctgtcagttatacgccgctttcagatgtcgaatgctctacattgtctgtagacttaatttgatggtcaaatgtagttttgccttttgatattttaggcattgacttaaatatactaggaatatttaagtctatccgagtctttcctccccatgggatccaggccatttgaaacaatatggttattggtgctctgtttttgttttattcttcgtagtcaaccaaaaagaacagagttgattacatgtttcatttgggatatttattaatgacaattgctttcatctttagatcttccataatcagaataggaaatttaaataccttgggtatgtcatggttatttcactttttaaaaatagggatacaatgagatgtttgtaattatataaaatactaaattgttattaaattttagttagtgtcaacatgtattcatcattttctaaatgtcatctaatcagactctaatttactttcccccaaatatcaagagatcattctgaatttgtcttgctcatgatatggatgggttactctgtgtgattgccttttttttttcttcttcttctttttttttgagatggagtcttgctttgtcgccaggctggagtgcagtggcacaatctcggctcactgcaacctccacctcccaggttcaagcaattctcctgcctcagcctcccgagtagctgggattacaggtacacgccaccatgcctggctaattttttgtatttttagtagacacagggtttcaccatattggccaggctggtctcgaactcctgacctcgtgatccatcacctcgacctcccaaagtgctgggatgtgagccaccgtgccctgccatgattgcctttttgctgggtaaaatacacttttaatttcttgctgggcttttaaaataaatacggctgaaattttacattcacatttctaaatacataacatacatgaaatactttaaacaaaaaatgataaagtaagcagacttgcttggcgctctagaaataattatactatttgtatctaaataggtttctgttgtatggataattcatgtattataggcatgataacctgtttacagaaaattctaagcatgtggatctcctatcttttatgattttttcgtgtaaaagtttcctttaaaatcagctgttttatattgatttaactcagtttgggcatctctttttcatcctttattcattcattgagtgctttttgtggaaagttgttattataggtgctggggattcaatggtgaacaaagtagataaatgtctttctcccttgaagtttattttggaagatggagggattctggcaatagaataagcaaacaaggtatttgcaggcagcattttgttgtaaagaaaaaaaagaaaaacacatggtaataggaagagagcaacatggaatttgggagtaaaaaggaggaaaaggtgggttaatccagttctccttttctatggatgtgccatttggtttgagtcataatgatgaaaaggagcctgccctggaaacttctagggggagagcattcaaagcagagaagcagcaagtgccaggctcttaggcagcaggaagctccacatgtttgaaggcatcgggagggagtctgcatatccactgtagaaggtggaagggagaggaggcgggttcggaatgaggacttgaacgatgataacactgagagctgtgaccctcctccgtctctgccaggtggtctgggtaacggcaggtgctaacagaagactggctaattataaaatacgactaagcggaaacagctttgtagcttaaaaaaagtatgtatttcatttcactctcatcacaagtctttgttttgttttaaatctttgcaataaatatttgttaaagtgcctcatgaggatacaagaaagaaatttggaaacagaagaggttattatcctgcagatatagaagatctttcatgaagacattgaggaggaagatatgacctatactcagctattgtgttgtggggctggaggaagacatggctggtgcaaaacacagaacgtgtctgagcttagaggtggttctggaaaacagaatatgtgtaggtgtaggtttctgtttaggtgtcggtggagaagtaagtgtaggcatctgcgtgacaccagtgattttcagtctgggttctgagtagttctagttcctggaggttccaggagggatattgtttatggtaaaggggaggatgaggccagctgggtgacttctcttgaaaatagattctccccatgaggtcgggagatcgagaccatcctggctaacacagtgaaaccccgtctctactaaaagtacaaaaaattagttgggtgtggtggtgggcacctgtagtgccagctactcgggaggctgaggcaggagaattgcttgaacccaggaggcggagcttgcagtgagccgagattgcaccactacactccagcctgggcgacagagcaagactccatctcaaaaaaaaaaaaaatagattctcccattaaaaaaaaatatttaaagtactctgctttaaaatgtcagtaacagtataccttttgacatgtagtagttgctaaatgattgatacagatactgatgtttttggaggtagaggactttctcattctaaaccctgtttgccatacatctagaactcactaagcctgtcctgttgatgatcacctctagaggaaatacaggtgccaatatgaataacggaatcagaatgcctttgatttatttaatctcacttctgtatactcatttccttactatgtgttagaaaccctctcagcccagtgtcttaggtaaccgttctgttgaaattttggctgatcgccacttgtactatcaaaatattaatcacatcttatctagaaacaaacaaaaatctctgagactcctctggaagccattattcaaaacctaatttcctcaggcttctctaattatgcagtgcagtgggttagaaaaaggcttccatagcttcatctgcgtctgcctcattgcttcctatttttgccacacacccagtgagtaatggtatggctttgcttcccaaacaggttaaagattatgaagctctgtgctatcataaggaggttttcaatgggaatatctgcttttacccaccggtctttctgttttgcccccaagaggttaaaagcagttttcattctcatccattttgtgtttcctggatgttggcccaatttgccttaacatccgtgtctgctaagcagcaagtcagcttagcttggctgtgcccttacaaatatgcatatgtttgagaagagaggaggaaattaatcagagcccctggcttaaatgatctccattcttactagcactatcgggatgtaattaaatcatggtttaattctttctgttagggaaatcttattcctttttaaccaagttcttaatgtatggtcatacaaggtgaatttaatcagtaagcagtttcattagactttgaatgttgtttgctgttgggtaggtgaagctcattatgcttcctaggcttggatccagacagacaaggttttatcattaacctagttttcatcaagggaacagtgtgcaaactgggtaccacctgtgagaagcatcatttaagaggccagaggtgagatcctagaaaattatgtcaccttgcttgtttacaggccattgtacagaaaaaacaaaaaagctgataatttaaaaacggctatttttgatcttaaatacctgtttgatttttttttttaatgaggaaaggcagtgctccaatgagaacattctcacaggcaggtaacagaatagcacacttttattaggaggggtaaaaagagatgcagaaagcaaggaaatctttttagaaatgtattaaatactaaattttcttttgctgtaggttgtttctggcaaaaccggagttttattgatggacttcctttatgtactcactctgcgttagcatgttggagacataggatttgctggcatcatctggttatgaatgtgactgtggggccccagggaggttcccaaggttctggttggtggttcgagtcaggactcaggttttcctgtctctggaacagtcgtttgtgttataccaggccataggcacagaatggtgagtggatttctatcctaggagaggtcctttgctgtgttcaagtacttgggatatcgaatgacagaacttgtttttagagagatgacagcaataagcctgctagtatgagctgttggcaatcatatagcccatttaacccttatgataactgttaaggttgttattattattactaatactacaaaagcatgttgacttaaatttgcagatgaggaaaaagaggttcagaaagatgaatctgcaacccaggtgccttgatatagatgctgtagatacgacaaactactctttttttttttttatcagcttattgcatccagacagggtttgaaatggctctgaaaacaaaaaaggaagcaagaacccagtagttgtgtgttttcctgcttctactggggtttgaaattgaagacaattggtttgagtcctagcactgttcctcattagctgtatgccttgggcaaattacttaatctctccaaacctttatttcctcctttgtaaactgaggacagtaatagaatagaatccatctcactgggttgtggagagaattacaggactcctacacttgaaaagtggtcggaagggcacctgcacaaggtcagctgtttgtgattgttagtaatattgagattgctttgagaatacacactctgacaataaactgaggatgcttgttggaaagagtagctgggtcaggtgagtctttcaccttggagtgactgatctctttctctgcatgttaagttttctacacaccgcaaatacctgtctatacacgcacacagtttatatgtgtgattcttaattgcttggtaggcattataaaaggggacaagagcattaaaagagagtttgactttcatgataaaagattaagagtgttggccgggcgcggtggctcacgcctgtaatcccagcactttgggaggccgaggcgggcagatcacgaggtcaggagatcgagaccatcctggctaacatggtgaagccccgtctctactaaaaatacgaaaaaattagcctggcgtggtggcgggcgcctgtagtcccagctactctggaggctgaggcaggagaatggcatgaacctgggaggcagggcttgcagtgagccgagatcttgccactgcactccagcctgggcgacagggcaagactccatctcaaaaaacaaaaaaaaaagagtattggtgtcatttaatttaaaagagattgtttcaaggatgcttagttatgttggagtattcaacattatgagaattttttaaaagtttcatttttcttcattcaatctagtttaatatttaaacagaaggtgtatagtgaggttagaggatggtgcgtttataataaatcggtgtggcagagttttccttaagtatcttgagtttgaatctgtctttagattagtggcaacattaaagaaatagtaaataaccagtctgttcttactaatgtcaccctggcttatatcctcttacatgacctggtttcctgctgtgctagagcatcatccttagtcctttcctcctaaagtaggcactgtttgaaatgaactttgatttcaaatgcacctgctctctattgatgttggccatttgcatttatgaatcttcctccctcactgttcacccactaccccaacccctgacctctcttttcatctggcccttccctacctatgataacactcaatggagtgagtggccattgcctacttggtttttgtttccccttagacctaatctgagatttgccaatctcatgttctaatatcccgactgctttttcaaataggagttagcagagtatggtgactccattttaatttgtgctgaatatttaggagtaaactcataataggcctattctggactctgctgttagaaatactccaacaatgacacaggatcaggaatcaatagtatttgtcaagtatttccatttctagcaagggaaaaatgatctattaaatatactccacattaacaaaaaagtccctgatttatgtatgttgatcaatgaaggttaaaaaacactgttaactaaggttttctatttgcagtgttttctgacaaatatttttcctccagattttaagcgtgttattatgagtcaacctttatgtttgtaaagccttagtcttgttaataatgtataacttccaaatgaatcatatacttatgcatagcacttgaatatgcagattttataatacaatctgaaggctcatatttttctgtttatttttaaaatgttaagtctcattagcattatattttacagatatattatgtaccatataacctctacaaatcacagtcaatctggatagtgtccccttagggcaccttaattatatgctgtagttctagaattcttttatgtggttttttagagataatttctcctctttattttccttatgaggcatcttaaaatagcaaaaaatggttgctttggaacctactgttatagatgccagtcttctggaagtgtttccagatttttttttcttttttggcctttagaacattaagtattctgtagagttatgcccattatccataaatgatttttttcagtgtatgtctgtctctatgtacctacctatatgctcatacttgaatgtgtatatgtgcaccaataacatacctgaaaaatggatgagttgtaattgttttagtagagataactgaaccattgatgtgaactctttgggatctacagcatcatccttaatgcctgtgtcataccttgtatatcattttgaatggcttttggagcttaaagtatctctgatttcaagcagagtgccctgctaaccaagacagtcccagccaggacaatatctactgggttccaggttcactctggtcttgttcctatattcctcatttccaggcagaaggaactatcacagtcctctttcctgtctcaacagttgcaatttgtaaagcctatagcaggtttacttttgtgctccatagcatcagctctgagaatgttaaacacattgtagacgtgatgtgttggaaatttaaagttatgttttctgggccaggcgcggtggctcatgcctgtcatcccagcacattgggaggcagaggtgggaggattgcttgagcccaggagttcaaggccagcctgggcaacatagtgagaccttatctctgcaaaaaaatcattagccaggcacggtggtgtgtacctgtagtcccagttgtttgggaggccaaggcaggaggatcacttgagtccaggagttagaggctacggggagctcggggagctatgatcacttcactgcacttcagcctgggcgatagagcaagactctgtctcttaatgaaaaaaatatatatatatatataaaaaatgaaatatataaaaataatatataaatatatatttttttattaactctggcacatagcaaatattatttcacttacattcatgttgtagaattttctcagataattttgtctaattacaactgacagcacttcctaatttactttaaaatatgctatcatttataaacatgtatggttcttatgaaaatcacaaaaatggccaaaagatgattttactgggttctggcactttgttgcactgaatagcctttgaaataaataaacccttggttttgacttgaaagttttatttatttatttatttatttttttaaaaaacacctttaatatcacagatttccttatagcaatatatgaactttctgatttctattgacttttctgattttgttatcaaactgtcaatacattctgtgccttggcaactacatgttctttaaagaagtaaaatgtttaacatttcaggtgttaaatttttgcttgggatcacagtgaaaatactgatattttgatacagttggtaaccttccatttgtgttttattgctgtgtgtctggtaaagacgttctctaagtttgtgtgaaagtgtagtagaaggttcaggaacatacagtacttcaagaaaactgtgtatctacaacaagttaatattgggaagagattagtgttttgagatgtttatagaggaggaaattatatcttgatatttactgagattaccagtgcttttgcaaatagaataactagatctttttgtaaacaaaaacgttgactttagtctatgttgtattactgttggaaatattacctccttatgaacctcataagacatggagcctggctatggtcactgttaggagtattttgctgctctcttgctggcaaaaatctttgcatgggtcctccttctggactggctactacacgatcaagtcaactgtctgctttggaatggcaatatgtcatgacatatcaaattttatcttaaaactttttttaattgttaaactttacatatttaaaataacattacagatatgtaaattatgaaagctagtcataaaatgaaaatgtaagagcacacttcccaatttaagaagcattactaactttcagtggttctctgtaagcattttcctgatcacaattcctacttcccaactgataattcctatcctgaattctaagcttattctcttgctttcctattttttaaaaactgcatacgagcatgttacttgcttgtttctgaactttaaaatgatttcacataccatgtatgtattctattgcaacctgctattttcacttagcattacatttctaaaattgatccacattgatgtttatagctatagatcatttatattcacaagtatacagcactctattttgtaaatatgcagcagtttatgtgaactactgttgatggtcattagattgtttcttttaaaaaccatgctgctatgaacaatcttgtatgtatccttctaatgtacatgtacaagaatttctttagggtttatacctagaagagaaattactgagctgtagagtatgggcatgctcattttcacaagataataccaaattattttccagagttttcaaagaaacatatataaatttcttatgtatggaaaatatgtattttccaggctagcaaatacagattataagacaatgccaaatgtcttccagagttttccaatgcatgctctcagtgataacatgtaagaattctggttgttccacatctttgccatccttgatattgtcaggcattaatatttttgcttatgtaatggatgtaaaataaaatcttggggttttaatgagcatttctctgattcctaatgagctcaaatatcttttcatgtggttactgggtgtttatctttcttctggaaatgcttctcatttgtctatttggttgtcatttttgttattttatttattctagatgctgtcagtgacatgtgccaaggacatcttacttcctctaatttttggcttgtcttttccattctctttccggagttctttgaaaaggcattcttatagtaggagaatttgtctgtcatttttctttgttgttaaggcttttttgtttttgtagttaaggctcttttgtagttaaggctctgtgtgtgtgtgtgtgtgtgtgtgtgtgtgtgtgtgtgtgtgtgtgtgtgtgtttaaaagagatccctctgtcttctaaggtcatagagttacagctttaaaaattttctcttagatgtcaaagttggctagttgcggtggctcacacctctaatcccagtgctttgatcacttaaggccaggagttcaagaccaggctgggcaacatagtgataccctgtctctacaaaaaaatataaaaaattatctaggcatggtggcttgcacctgttgtcccagctccttggacagaggtgggaggattgcttgagcccagagttcaaagctgcagtgagctatgattacaacattgtactctagcctgggtgacacagcgagaccctgtttcaaaaaaagaataaagtgtcaaagttttgctttcaacctttaggttcttaattcaccaagaatttctaaatttccatttatgtactatgtggtgtgagatagatatataatattattttttcaaaaaatatataaactactatcctagcagtgttgattaggctgtctttgaccattgccacctttgttgtatgtgtgtttctgagatccctattttgttaaatttgcttatttctgtgccaatgtcatcttgctgaattataatagctcttataataaatgtgatagcttttagggcaatcctagctctcttcttctttaggaatgccttgagtagcaaattttatctctgctgtatggctggtaccagagaaacagaaatagaattggagcttctatgttgtttcagtcatcttcagaaatatttcagatatgaagagacatactcttagagcttgttggacaaagattcattaaaaccatgatctgctgataaggccaattatattgtgttgaactcagtctttctcattatatttcttacaggcaaacttgaagatttaccaagaaattcagaagttagtatcagattttacttgggatcaccccaggaaatgctttatgtttaggagactaggaataccttcagaagtccttgagattgtcttctagaaatggggagggagaaggaagcagaggagaagaactggtatttattgatgtctatgaataccaactgttccactgaactctttatctgcgttatttcatgtaatgccccagcatctctgagatggaattcttcttgttttatagctgatatgtgatctgggctacataccgtctctctgtatccagaatgtacattcttaccacccatataccagctgcccaccagctgcgttgctgatggtgctctggggctagccaagaggaatgtctggaagagctgagggtagccttttagagaggagataactttcagcagatgatgcatctggagaagcgtgggggaatctgccgggctgagtctgaagaaccttggccatagccggcaacatctattgtctttgcagagctctgtgctgggactaaattctgcctgattgaccaagaaaaagcaaaagagggtcagcatgtcctttgtaagccggaagcgcagagcaaggtttcagattggcagtggctttctgatcaaatttcgggtcttgacacagcaagtgataaagctttgacccctgggtatattgttgatgggagacccgacttactgagccatgtccgtgtcgtcctgttggtaagggctgttcaggatcctcagtgatgagaattggttgtgagttagagcctgggacaatggcctgatgggaaatgctgcatttggtccccaggtcaggaaggcgaggctcctggggctggctagaggacagacaggggtgagcacagctcaggtgaggaatgacaagggaagattccacgctgcctatccctagccctcagagcttgcctgttctccctctcctttcagctgtggacactgggctgctggatgtgacttgcatttcacattttcccagtgatttgggcctgatttatctcttgattgctctctggtaaccgactctccagcctcttcatttccagtacacaacttggctttatagcccttggacactttcccaacttttgatctttcagtgcaacccttctttttctgcttagtctttctggttggctcagattgaaaaaaacccaaatatatatatgtgtgtgtgtgtatatatgtatatataagtatatatatgtatatatgtatatatgtatatgtgtatatatgtatatgtatatgtgtatatatgtatacatgtgtatatatgtgtatatatgtatatataagtatatatacacatatatacatatacatagatatatgctattatataataaatattaatatgttaatagtaatatgctaacatgaattataccaattatataataattactaatttcaatcatgtaaatatatatcaatattaataaagtatatatttatactaattaaatatatttgattatataattataacaataaatatataactaataatatactaattaataaaaattgctaaccctctctgagcagatttatccaatatgctaagcacttttattatttatttgtttatttttttaagacagagcctcactctgtcacccaggctggagtgcaatggcatgaccttggctcattgcaacctccacctcccgggttcaagcaattctcctgcctcagcctgccaagtagctgggattacaggcacctgccaccatgccctgctaatttttgtatttttagtacagatggagttttaccattttgcccaggctggtcttgaactcctgacctcaagtgatccgccctcctcggcttcccaaagtgctgggattacaggcatgagccaccacacctggcagctaagcacttttatacattaccgtatctaatcctcacagtagcccacaagacaggttccgacgattattcctatttgaagacacaggaaaagtaagttctttactcaaggtcaacctgttggtgagtggcggagtcaggatttgaacccaggctgggagctcaagagaggctctttaacatccatgcatgagctgtactgtcactcaagagacagaccagcagatgtagaaactgctagggtgtgtcagatgagagatgtttttgatgctgtgacagagatgtttttgatgctggggacagctgagactctcatacatacaattggctctggtatgcctcaactagaaataaagcagtacataggacacgaaacccatcagcctccacatcctgtgaaaatcactgctgcacaatggctgctgagtgtcttaataggtctaatgactgtgctgcatgaatgtaaagtaggttctgtatgcaaagggttaagaaactggatgatatagttagttttgatataaaaagaaggattaatgatgaccgaatttttttcaaatctgcaattcctgtaacagctgattagttccgtgatggttaatccagacagactagcgtcacaatctggccatcaaaaagcagtgactcaccattgccagaacgagtacgtgttaaattgaattgcagtctggttggaggcagctgtggtgtggctcagcaaatgtggtcttacatttccttttaaactataagacatttgctacatacaaaagaatgtatgttatgcatatgtagattatgtgagatgaaactccctggggtttatttatttatttatttatttatttatttattttgagatggagtcgcactctattgcccaggctggagtacagtggcgcgatcttggctcactgcagactccgcctcccgggttcaatcaattctccttcctcagcctcctgagtagctgggattacaggtgtgcaccaccacgcccagcttatttttgtatttttagtagagacgggattttaccatgttggccaggatggtctcaatctcctgacctcgtgatccacctgcctcggcctcccaaagtgctgggattacaggcgtgagccaccgcacccagctccctggggcttctttttaatcatataccctgcctcaccttcccttcctggaaattgtcaccatcttactcttatttcttactctcctgctttcctttatttttgccacaggaatcatgaatatattgttaaacaatctatttttagatttgcttgcttttgaactttataaaaatggtatcacatactatatattgtctttggtgacttggtgcttctaaaatacatccatggaaatccttggctgtagattgttagttacaacggtatactagtccattgtgtggacatacacaatttaaaaaatctattataatagtttttctggttttggaggttggatccagctggatatatttgtgaaacccccagagaaggccaggaagatgggaaaagtagccagaggccagacatttaggcattacaggccagcataaggagtgtggattttgattctaaatccattgagactctatcaaggggttctaaatagggacctgatatgattgaatttatgatgatttacttcattttatctttcagagtatcccatttatctggtgaaacagccatgaaaacaggtaactctggtttagtatgataagcgcattagttggtttggtgatgagtctctgctctttgccaacccgatcctgactcaggcccttctatattcaccaccacaaaacaagtcggctgttaggggcttgcagattggaataaagctataagtcaccaccaatccttctctttttcaaaatatatcatcctaacttcttaaccgtttacatgcagaacctactttgcattgatttgctagatatattagtagaatcctagggcaagctattcatgaagcatttggtagaggaggaagaatctgtaaaaagtgactaggaaagattagttggagcaaaaggactagaaccaagaaagaggaatttagaaggaggctggctttcagtgtataaagaaggcagtggctggcacgattaaataaaggctatgggtttgcaaattacagatagtcctttggatttaccagttaggaggtcatcagtgaccttttgatagtagcttaggaaagacacgggcatggaaccactgagcacctaatgaaggaaagagtattgaaatggtaatatgacgtattcaggttaggagaaagagaattctcaggtagtaaagataaagcatacacatagaaatgagttttgggggactctttggagataacctcagaacgaaagtaaaatgttgcagtggagagttagcctaatcaagaaacacagagatgactaagtgaccttcccacacatgaacacaatattttgtctcatcctttgttcaatttagagactgacctttgctaaaatgccggtgacaaggagacagaggccagtgagaagggaggacatttatctgtcaatgaaggcagctgatactagttagatttttcataatctgttagagttgagctgacaagcaaagaaattgcttcatattgcatattaatttcccgagaagtcaatagtgagaactctgaaactccagctgcataagagaaagagattccaaacaccataagatcttgcagttaaactgatcagaattaatgacataatcctttccgcatatgttgttgctataggaagccttctgggagtacctgtcctagcattgatgtgtaacccttgggcggggtaaacccagagtcaggttagctgcaatgacctggcctgccacagcagcggggagttggggaaaagcctacattccaagcaagactgagtgtggctgcaaagaaggatgttggttcccaggagcagaggactggggcagaaatgaggaggtggctgaagagtgcttcatctccctgctgtcttaggaggaacgtggctcctgccctttctcccaattatgagatgagaagatgctgactcaggtttctctgctctacatggtgcaagtttttaagtttcctcaaattacggaatacaattgacaagagaagaactacttttcgggagccataaataacctttattaaagcttaatgttatcaagagtgtatttttcagagacttacgtaactcattttctgttaaataataggcacagttgcatgacttgcaaggttttggcagagtaaatagtctttgacaaaaataatacatagtctacttttatttaaaattagataacgatggactttagctatactgaagtaccatttgaggtacaatggtggacttatgaacggtctaggaggtccacagctttgtgttcatacattaatatttatcagatgataatgcttatatttttctagcataaatttattaggttttaaatttttttaattaaaagtatacagaacttactatggtcttgctgaaagtgatgtcagttttgtctttagttgagttgaaggttatcttagttctttgtgaagagggttttttttttttggacagggtcttgctctgttgccaaggctgagtgcagtggcatgatcacagctcacagcagcctcaaactctcaggctcaagcaatcctcctgcctcagccttccgaacagctgggactgcaggcatgcaccaccacacctggctaatcttattttttgtagaggtaggatctactgtgtttcccagactggtcttgaactcctggactcaagcagttctcccacctcggccccccaaatagttggtactacaggcgtacgtcaccacgcctggctaattttttattttttgtagagatacagtctcactatgttgcccaggctggtcttgaactcctggactcaagcaatcctcctaccttggcctcccaaattgctgttacgggcatgagccaccacacccggctacatagaggccctttataccaaaacttcctgagcagcactattttacaggcagtgttaacataattgtaacatatttagatcttggcatatttttcaatattggctttagttaaattttgtgctccatatatctaaaacagaactcattatctttcctgcacgtgctactttgcctctcacattctctatttctagcaccttcactcctggtcattagattggcagcccttggattcaaaagaagcatctctgactctctctcggtgctcctgtgtcagtcaaataacaaacctttgggtacttatgtgcagtggggatacacacacacagaggataagattcccttcctcataacctcctggtctggttgggacaagaagtgatggtgtgtggttgtgcattctcagggtaaagcaaatggcattgatcagtgctgtggaaattctcaaggctattatctctctggggccgttagacttttagaggtatagacaacaagtgagtccaaagtgagtgaaggccaagcaagcataaaccttttggctcttcctttgctgtttttgtacaccaaggttaaacagcaacatagctcctggacacttctgccacacagtcttcactgagtatagcacctgtttccttaggtgcctggctggaggattttattgtcaggattgcactgacacaaatctatccctaggtcttaggcccctgctttcttcagtttcaggagtctgagggttgtccctgcaggctctcatgggtctacaacctgggagctgatttttcccttgaaacctaaagccctcttgtaggtaaatgccacatcctgatccgtgaagatgggatattgccttgcagggctttacagctgtgaattagaaaaatgtttttctctctctctttctctttttctgtgttcctttcccagacataattactccctgtggcaaagctccctgttagtacagacagtgcatttagcactattttaacacaggcgtgatggttatgtttgcctcttttataacatgccattctgtatgtaaaaacaagtatcgtactaaggtcctgcaagagccttagtacaataatgagaaatccgcattccactgtcagtctaatgcagggacatcttagtgtctgtttaactggactcaattgaacacctggagctgtgtattgaaatggcttgaatttttaacttttatggtatcaatgatccctaattttaggccagatgctttggtttacatttgtgttttttcaactttgattcccaagattgaaagatttattctggctgaggattctgggcgttccttctaatggatcagcagaagcagaacaagacccacttgcataagagtccccatcactgtgccgaaaagcacaggctgacatttccctcatgtccccagaaatcccatcatcttgattgactgttgaaaacagagagaaaagccttcaaaacataattattcgcatctccttgtggctgtggcatagctgaagcctgcagtaaattttcagcatctggatatatttgtgtcaaatagctgcagagctgataggctgcggaggctgcagcccgcattgagcagcctccagagagccttgctctgccggccttgagctccttccactgcggctttttgaggaggagacacatgcctgagagcggctctgggacttgccctgacaagtgaagggaacttgtggaagggaggtcagctttttgcgaactctgaaagtcaaagatagaggtggctgtgttgagtttagaaagtgaatcaatgggacagttggcacccctaccttccaaattcagattagccttgtagtaaaagtatagtggcaagaatgtcacatagactttttttttttttttgaggtggggtctcactctgtcgctcaggctggagtgcagtggcgtgatctcagctcactgcgacctctgcttcctgggttcaagtgattctcctgtgtcagcctcctgagtagctgagattacaggtctctagtagagatggggttttaccatgttggccaggatggttgtctcgatctcctgaccttgtgatctgcctgcctcggcctcccaaagtgctggaattacaggcgtgagccaacacgcccggccgactttttttttttttttttttgagacaagtctcactctgtcactcaggctgaagtgcagtggcatggtcacagctcactacagcctcagcctcccaggctcaagcaatcctcccacctcagcctcctgaatagctgggactgcaggcatgcaccatcacacccagctaattttttaattctttgtagatacggtgtctcactatgttacccaggctggtattgacctcctgggctcaagtaatcctcccacctcagcctccccaaagtgttggtattacaggcatgagccactgagcctggcccacatagagttgtaaatcatgaaactgttctggacagaaagcagatggcagaatcacaatcttctgtgtccagagattatttgagattattttaagaacctaagtacaccttttagagcagggatttcttggatttgaatttttaggttacaatttgctttttagttgtattgcctgcaaaaaatcttaaatctctttgctgtttgtgacattgtgcatacttctcaatgatcttccctcttcatactttaacttactcctctccttgcccagatcactaaagcggcatgactcagccagcagaattgtcatcatccccaggccttgagcagctagtttgaaaaactgaaatagatctggcctcattgaatgctgttttaggtgaaggaaggtaattttgctctggcaggttggcgaattagtatgttacagctgtaaatgtatttctcctaaggtggttttctagcatcgtgtgcctcaattcagttgtttctttaaagttcagcattgcttttttttttcacctattcattcttggttaattaggaaaagacagcatctgttgtgggttttgttgtctggtgtagatgactgtttaatcagagaaggcattatgtcttgcagttagcagtttgaccctttgcagcacaggcttggggcgtgacctcaggatgtgactgcaccaaaccttactattttatagaaaatggggataataattctgatctaacaatttggatgattaaatgagataatacatgtaaacctctgagctcagtgcctggcagttatcattaggttatttaacatggattctttttttttctttttctttttgagatggagtttcactctttgttgcccaggctggagtgcagtggcacgatctcggctcactgcaacctctacctcccaggttcaagcgattctcctgtctcagcctcccgagtagctgggattacaggtgcccaccaccacactaggctaatttttgtatttttagtagaaatggggtttcaccaacatggattcttagatgacttgatctagggagtctagggttgcagcattattttgtagactcgatgcggactgccttaatattttacagcatttttattttgtcttcttgttttttattgtgataaaaacataaaacattaaatttcccatcttagccatcctcaggcatataatttaaaagtgttaaccgtatccacattgctatgcaatcaatctccaggactttttcatcttgcaaaactgaaattctgtacccatttaatactaattttcccttcctcccccgtcctcctcccagcccttgacaaccacctttctactttgtttctgtgattttgattacttcagatacttgatgtgagtggaataatacagcatttgccctcttgtgactggcttgtttcccttagcatgatattcctgagcttcatctatggtgtggcatgccatagaatttccttcttttaaggcttcataatgtcacgttgtgtatatatttatctgtatacatgacagtttctttatctgttcgtctgttaatggacatgtgggctgcttccaccttttagctattgtgaatcatgctgcagtgaacacaggtgtgcaaattatctctttgagattctgcatcttgtatatgtcttttggatatagatacccatgtcgtggatggaatatgtccccacaaaattcacatggcgaattccaagccctgatgtaatggtatttggaagcagggcatttgggaggagactaggtcatgagggtgaggtgctcatgaatgggatatagtgttcttataagaaaaggccagagagctagcatgctgtctttctgccatgtgaagacacaacgtaaaggtggcagtctgccacctggaagagggcctccaacagaaattgaccattctggcaccctgatctttgtccattctggcacagtgaggtctctaattgtgaaaaataaatgtgtgttgtgtgtaagccgcccagtctataacacctttttatagcagcacaaactaagacaacgtaaaaatgggattgctagattgtatggtagttctattttaatttttgagaaaattccatactgttttatttttatttttatttttttttttgagacagagtttcactttgtcacccaggctggagtgcagtggcgtgatcttagctcactgcaacctctgcctcctgggttcaagtgattttcctgcctcagcctcccaagtagctgagattataggcacctaccaccacgcccagctaatttatttattttttatttttattttttttagtatagacagggtttcaccttgttggccaggctagtcttgaactcctgacctctgatgatctgcctgctttggcctcccaaagtgctgggataacaggcttgagccaccgtgcccagccatactgttttctataatggctgcaccattttacatttccaccaacagtgcgtagtgttctgatttctctgcagccttgccaacacttgctattttcctttctgttgatagtggccatcctaatgggtgtcaggtgatattgtgattttgatttgcatttctcttattgaggtattgagcgtctttttgtatgcttcttggccatttgtatatattctttggagtattgtctatcaagtcctttgcccatttcaaaatcagggttttttggttgttgctgagttgcagaagtttcttattctgggtattaattccttatcagatacagttgtctctctgtgtgttccttatctttggattcaattaactgcagattgaaactatttgggaaaaaaaccaatacaaataacgacacaacaataaaaaatacaaataaaaaatactgcctaacaactatttatataacagtcacatggtattaggtattataagtaatctagaaatgatttaaagtatacaggagaatgtgcataggctgcatgtgaatatgacaccatttgatatcagggacttgggcatccactgattctagtatccattggttctggaaccagtcctctgaagatgccgagggatgactatataagatttgcaaatattttcccccattctgtaagctgcgtttttactctgttgactgtttcctttgatttgcagagggtttttaagtttgatgtagtcccagtttatttttgtttttgtggcctacgcttttggtgtcgtatccaagaaatcattgccaaacccattgtctggaagctttccccctgttttcttctaggagttttatagtttcatgtgttagtttaggtctttaatccattttgaattaatttttgtatatggtataaggtgtgggtccaatttcattattttgtttgtggatatccagttttcccagcaccattttgttgaagagactgtcctttccccattttgtagtcttggtacccttgtcaaaagtcattggccatatatgcaagggtttatttccaggctctctattctgttccatcggcctatataagtttctgtgccactaccacactgtctgattactgtcattttgtagtatgttttgaaatcagggagtatgaggcctcagctttgctctttttcaatattttttggctatttggggttccttgagattgcatttgaattttatgggttttttttttttcctttttctacaaagaatatcattgaaattttgataggaattgcattgagtcttgactgtcttagattttatcgggaagaagctgtttaccaggctgagcaagaaatgtgagctgttggatagaaaacacttcttttgctgcggaggggcttgcgttgccaagtgcgtgttccgattgaggctggataaaagaacggcacaatcaaaccgtgcagtgcagtctgtgaacaaattgtctccagctcgaaatgatgaaaagaatattttaacaacttttgacttcatttaatgatctaaacagtgattatttcttattcttgctgagaaataccggttttatgtgaaaaaccctcaattaacaatttaagatagcaaatgactaatggaaatttttgccagaggaagaagtcagataggagctctctgtttttgttgctgttgttacttgccaaataatatttgctacatttttgggtcagtaatgaggcttaagtgagaataagtgggttttgtatatctaagtccctaattaacaacagtgatacctttttgaattccttccatggtcttatcacctgctgtgaagtaggtgaagtaggcagaacaggagtttttggaaaatattcagtatgaagatactgagcttagagaagtcaggtgatttgtttgaggcctgatagcccacagggacagagccaagacttcaacccatgcatcacaatactgcggcctctgctttctccagaaaaaaaaaaaaaacattttcttattttttcaaaattttatttattgttttgagacagagtctcgctctgtcacccaggctggagtgcaatggtgtgatcttggttcactgcaacctccgcctcctgggttcaagcgattctcctgcctcagcctcctgagtagctgggattacaggcactcgcccaccacgcccggctaattttttttttgtatttttagtatagacggggtttcaccatgttggccaggctggtctcaaactcctgacttcaggtgatccaccggcctcggcctcccgaagtgccgggattacaggcatgagccacagcgcctagccaacaaaaccattttagatagcatataataaatttattagtaattccaaattctgtgatctcacttaatagaaaccacacattctactagtaggccaattaattagccttaaggcattgcctttacacaggagtcaaaagattatgggagacattaatcatcttaaaattccagaaaggaaggtagagggcatttattttccgctaaggggtttagaacagagatacgtaacttaagtatagcttactaagagccagttgttttgatttttattttacttcatttaaatgtgcttcttcaattaatagcagtaaatactcatcaatatgtatgatctgtgatagtattctagataatatatatagttaaattatttgatgttatttagaatccaaacctaatgacacagataaagcagatgtgtttttcagtatccttccgaatcccaaatccgtgggcaaggtaacacctgtttggagtttctctaaaaattacctttctctgcctttaaaaaatatcttgaatgcggccaggcgtggtggctcatgcctgtaatcccagcattttgggaggccgaggtgggcggatcacgaggtcaggagatcaagaccatcctggctaacatggtgaaacctccgtctctgctaaaagtacaaaaaaaaaaaaagaaggccgggtgcggtggctcaagtctgtaatcacagcactttgggaggccgaggtgggtggatcacgaggtcaggagatcgagactatcgtggctaacatggtgaaaccccgtctctactaaaaatacaaaaaatattagccaggcatggtggcgggagcctgtagtcccagctactcgggaggctgaggcaggcgtgaacccgggaggtggagcttgcagtgagcagagatcgcgccactgcactccagcctgggcaacagagtgggactccatctaaaaaacaaacaaaaatatcttgaatgcttttgagtgactccttctaacttgtcacaatggtgatgttcagtgattaaaatgtggaatcctgagggagttcattgcatgtcacaaatcagtacttctactcccctcagcactaagcattgaatactgcttttttttgaaggggtgagggggaagaagctgttttaaattgcagatgtatttggatttcttttttatgtaactcacatttcttattttccaaaaactctggaaacgagttgcatatttccactgatgtcaaaactgatgatcctcacaaagaagcacaaatatgatataaaactataaaacaaaaatattgatagcaagactttgaccagattccagaagaatgtatttgttacatctctgtcactttttttcctcactgcatttctaatagtttaataaaaaatctcttatgaagaaaagattgcctttctcttgcgtcaaacattctcataacttttcattctatcttgaagttttccttttttcttctaaactttgaagaaacagaatccttttgatgtctttgagtatttgccattgattagagcacttggaaaggaattttgcttggaaataaatgtcttttccctgcattctaaatatttcctttgcataaatgcatttcatttcttcttttcttgaccttgacatagttgctggcagagtacagcaaggaactctatgaattttgagttccttggcttctactgatttccttttcttatcctggacattcagggctggcttggagagacccggattagaaatctagagaagaaaagagattttttggctgtcgcagttctatcaggcacaaagtcaagaatattaatgaattcattatttataacccctttgttggacccaccgtactatacatgagtgagaaacagcggcaaggagctcatagtgcagcctctgagattcccgtgtgggagaggtaggcctgggaatattgagcagtggtggcaagtccaggagaacaaggggcagaatccagggcaggtggccgagacaggaagggatcgggagggcccagagcactagaaaggcaggtgctggggtgacagagttaaggaaatcaatactgaccaccaatatagacactgcccaccaatgtagactctgaccctgacccagaggcgggtccatactcctgtactgaagtaggggagagcgagtgagcagggctgtcagaagtgttcttgtgggagagaaagatgacaaagcatctttgcttctccttgaggctgccaagaaaagccaggagtttgaagaggttttagctgtaagtttccaaacatcatgctgtcttcaattgaatctttccttggcatctagaaaggtggctgaagaatagtgggaggaaacctgggctagaattttgctttctgtaggaattacctgaaccgcagtttcttcataggtaaagtgaggaatcttaagaataggatgatgtgtgtacaagtggctcacacagtgcctggcacctattagggcatcactaaatgtttattcactgacctgtgaataggtatgttaggatttttccaaactcttttaggtcttttattactgaattcatgatcataaacatattttcttataattttcctaatgtttacttttactagaaaagttgaacgtgctcattgtatacattttataaaatgtaaaatacagaaaatacagaaaatgcagaaaaataaacttcaattctgaaagtatttaatttaaagtgaaaattaaatgacccaatatctcggcacttagcaataaccagtcgctcgtgttgcccaaactggagtgcaatgatgtgatctcggttcaccacaacatccgcctcccacgttcaagtgattctcctgcctcagcctcctgagtagctgggattacaggtgtgtatcaccatgcctggctaattttgtatgtttagtagagacggggtttctccatgtttgtcaggctggtctcaaactcctgacctcaggtgatccacccaccttggcctcccaaagtgctgggattacaggtgtgagccaccacgcctgagccaccacaccaggcctccttcaatcttttctatacattcattaggaagtgttctctatttgcctttagcacatatgtatgcatatattgaaggagtgtggattagtggttaacaagtatcatatttggcatcaaattggcataggctctagtctggtcattgtatacccttgggttagctatttgtccccttttgacctgtttcctcatcagtaaaaggaggtaatactgcccacttcattgtgcagaaatgaggaataaatgagaatatatgtatagggcttaagaaattacccgggaagtaatgagcactcaaccgacgttaacattgcttattattgttgaattgtgaatattaatgacaaaaacaattatatgagaaaggtgctttataatttcagtgttaaaatagccaatgatcttagcatgtcttgtccggcatgttgtaaaacatttgggtattgaagagttcctgaaagaaattcatgcgaccttttaaggacatcgtagcagtgctttgctttttataagaaatcattaattacaaatgtcaagttaatggcagcttaagaaacaactgagtatattgtggtctaggaagtgtccttttggtaggcttttcatgttctagtaacaaattatcttcagaagcatttttaactacaataaatatattgagacaaaatttaaaaaaattttggagtcggataacttgggtagaacatggaaacatacttgtctggctctataataataaaattgccttctatgttttatggtataccttgtgcttttcaaagtgttttcatttgcattatcttattcacttctccacaaaattctaatagctagctagatattaaaatgacaatctctaatttaaaatttttcttctatgtctttgaaaattttctaggttttacttttcataattgcttattgactccacttagaatttatttggggagttagcttcattttttccatattgatagtgatttattgttgttcatttttaacctgattattttatatgtcagctctgacatatatcaaattgtcctacacttatggatctcatttgatctttgcaagtctgggccagtatcacattattttaataactatggctttacaataagtcttgatgagaagtactctaccttgctttcatttttaagatgttcctaactattccgggcactttgcattttgacacaaacttaagaatcagcttgtcaaagtctgtaagatacacagtcagtattttaattggaatggcattgaatttatgtatcaatttgggagcagttcataactttataatatcgagcctttctatccataaacatggtatagctctacatttattttgttcctgtttaaagtaactgataaagttttataattatattaaaaaattcttatgcatcttttgctatttatattcttaagtgtgtcatttttttcttgctgttgtgaatggaatctttaaaaacatatatgttctgtttgttcctgaaatatattaagtaaagtgatttttaaaaatatactggtcttatatttagctaccttgctgaattgtcattcagataatttaccgaaagattccatagccaatcatattgtctgtgaataatgtcttttgtaatcctcataccttttttattgtcgtttcattgcactagctcataccttcagcacagggttcaacagaagtggtaaaaagcaggcattaactatgatatttgctataggatttcaatacactgtatcaagttaaattcccattcatctcaatttactgagttttcataaattggtgtaaattttattaagtacttttctactttcaccgaacttaattttctgtgtcttaatatcttaattgtatatttcttaattatgtaatcatgtaatattcagatattgaggcaaagacttttccagatgaaaaagacctaacagtttttatcacaatgaggaaaaggaaccaatatgattaattaagcaaattactgaaagatgcacttacgtgggtgtgataataggagcatatcatagttgatgagatccgaagtgatgtcatcctgtaggaatgagggtggaagggattgcatagggtgcttgaagaagtggtgaatgtctgaactgcagtggagggaataggaagcaaaatgaatagaggtagtgaacagctacagtgtacttaaaattacatttttaatagcagctgttggtagagtcttagcagtcctgctccatagctggagtttgtgggcagaacataggaattcaggtagttggattgatctaaggatgtgagtttgcaagctggttgtagcacaggggagggaactactgagggaactggtttgaaaaagcagctgatttggtcaatcataggttggcaggatgtgctgcttaaggaaggaaatggaacaggaacaggtctgatacacatggacatatttttgctaatgaggcagtgggaaagacggaagaagattaggatcagatggggggaaattcaagtagaacatttcagagagaatggcccagtccgggttatggccatgcactttggagtttttgatagaatggtttccagaaagcactgtagatgagtcagttctggtcagactgcctgaaaatgaaatgaaccacttgttctcagctgtgataaatacagttttattactgcaggactatttagtttatgtgttgagtctactaaagtgttgagcagttatacaaatgtattgctatctgaactatgcgtcattttcatgaattgtggtgtgcggtgttataaaatccttgcattttatagcgattagatttttagtaatctttttaagtatgtttgaatatagtgtttccttgatttttttttttttttttttggtatggaagtattttcctttgaattccttatcgtatgctagtttgtacctctttagcatttaggagaaatgctaaaggagaaaatctttgtttcctcaaatagtttttcactctgagaaatgttgaaaaatgtgaagaaatagattttcagcctggggaattatttattcctggcaatttggcatgaacttgactgctcttagagagactatagtaagtggtaaataaataatcttcccattggattcagcaaaggtcagaatctaatgaggatctagactttattttgaaatccacaatttttagggccttggaaaacttgcaaaggattcagaaaatcactgtggaagaaaaaggttttagacatatatattttcttatcttttttttttttattttctggagaagtaatagtccatgcgtgaattaagaaagattttcaacaacttgaaaaattataggctaaccactttggttaggttttcttcatttgcaccaagaatttaacaaacttaattaaattcaggtcaatgccatgaaaattattgtctggttaatccggttatgatcaatttgataaatgcaaacttcaaaggtggttccttgccggggtcctgcagagtgtgtgaaacaaaagtgagatatggtttttgccttcaaggaaattttgctatcaggatagaggtgcgacattctgtattagtcagagttctctgtagggacagaactaacaggatagatgtatatatgaaggggaatttagtaacgagtgctgactcatacgatcacaaggtgaggtcccacaataggccatctgcaagctgaggaacaaggaagcccgtccaagtcccaaagcctcaaaagtagtgaagccagcagtgcagccttcagtctgtggccgaaggcccaagagcccctggcaaagcactggtgtaaatccaagagtcccaaagctgaagaacttggagtctgatgtttgagggcaggaagcatccagcacgggagaaagatgggggccaggagactcagcaagtcttgtctttcagcctttttctgcctgcttttattctggctgtgctggcagcttattagctggtgcccacccggattgaggatgggtcggcctctcccagtccactgactcagtgttaatcttctttgccagcaccctcataggcacacccaggagcaacaatactttgcatccttcagtcctatcaagttgacactcaatactaaccatcacacattcattggtgaaaaatcagcaatataaaacagcatatggttgcataaattctcaggattctttcaactgtggatctatgaaaactaattttatatctgaaaacatcatctcatatgcatggaaaagcctgaatattaatgttttctactaaaaattaaatgatatgttatctacactgatattaaataaattccaaattgtgccaatttgaatttacatcagaaatgttcgttaattagccgagttttgtttattataatatttctgtagtacttgctgtatacctgtactaagttctttacaagtgatagctcatgtcacctgtcttaggaactgtatgagataggtctgttactatcatcactcttttaaacataaggaaaccagacaggttaagtaatttacccaaaatcacatacccaatatgtggaggagctaggatttgaattctgccagtctaccttcaccaggctatgctgcctctttatttttaatagcctcagttttattgtttaccatctgtttgcaattttatcctttaactgccccaaccattccattctttttttttttaggtagagtctcactctgttgcccgggttggagtgcagtgagcatgatcttcattcactgcagcctccgcctcccaggttcaagtgattctcctgcctcagcctcccgagtagctgggattacaggcgcccaccaccatgcctggctaacttttgtatttttagtagagacggtgttgcaccatatttgccaggctggtcttgaactcctggtctcaagtgatctgcccaccttggccctccaacgtgctgggattataggcgtgagccactgcacctggccccattccattctttaatgaatgaagtaaaagtagatacgaatcagaaaataagtaggaaaactgcagattctggggggattacttttgccattctcgggcatatttttaataatggtgagcaaattgatactttgggttgatacccctctttcttctctggccaaataagagacagaaaccacagaaaacagcatagtacgttttctataactgtagtataattttgagtgcatatttctttgaatttggtttaaaggaacctcaaattttccatcgattgctaaagttatgtgttctgtgactatctactttagttgtgattctctcagttgtttgcttaggagtctcatccagtatagtgatggagctgggatatcaatcattcaggaaactgactccatcagtgtgtcagtcacataagagtaatcaatgtagggttcccaaatctcattacttctattccttctgctgtgcctatggcacaggatgacagttttggaaagacagtaagggtaatgataagaaacatcaaagtatccttttcttgagttctgattttaaaataagcctcatttagccaagaattgacaatgactagaccaagacatgtttgacctgtgtctgtcattagcttcctcagtaactgaatgaagaaatcaacgtcacctgatacctgttaacttctaaagtctattagtgtcacattgaggtcctggcactgccctcactattattcaaggtcttgttttactggaagaacttgatctcgacggctatctgcttttgtttttccctaatagttctggacagatatgttgatttgtaacatcagatgagatgcacacgtgtgagtccagactgaaatagctttgtgagtcttgctgtgaaatctcatttgtgtttttctggccattccagggaaattgcaggcagacatgggtaggatgcttttcttctaaaaacttgatgtattagatatgaaattaattattggcccctagtttcagtgcttagagtaatttagggaagcccattacacaaactggcattagcatcctccccacctccttttatcatcgtcattatcatcattactgaggttgaaaaaaagacaccactttctgggtggaattttcactggatgaggggctcccagggctgctgaggcctcactcctcctgtggctctctgatgactctggcattggactcttgtcgggaaggctgatgacagtcccattgtgggctcccattatctgttggagatggactggaaggtgacgtatattcaggatttgtttgataggcaccatttggttctatctgagttattttatcatatctactgatacactgaattacttgccagatgaatcaacaaaggcctatctcaatttggatggatttcctcagagaagagaaaggcagctctagataaatatgagtgcaagataaaatgttcgtagagaaatgggagaaatagggctggggtagacagaaaccttaatgtaggattcaaaagatgctatttgttactatgaattttattgtacacaaaaaagtagttttatcctaacaccattaaaatatgatatttacttatacaatttgcattaacatttccctcaaggtaggcatgtgtgcctgatatgcctatgaatatatttttgtgtctgatgatagtctcccatttctttgtcattcatttcttattgcagtctctttttctacctctttttgagtctgagcacttgaacattgggaatagatttgatggtcacttagcaaaatctcaatttccctcagtgcatgtcttttacaaattatacctgtactttcctttaaacaacattttttttttcagtcagggtctcgctctgttgcctaggctggagtgcagtggcactatctcagctcactgcaacctccacctcctggcttcaattgagtctcctgcctcagcctcttgagtagctgggattacaggcatgcatcactgcacccagctaatttttataattttagtagagacgtggttttgctatgttggctaggctggtcttgaactcctggcctcaagtgatcaacccacatcggccttccaaagtgctgggattacaggtgtgagccaccgggtccgtcctttaacaacacctttttaatggaaatcttgttctgaacagttttcgttccagcattctgaagatggcatctgcatcttctgagcatgcttcttcctcagccgtttcctctgggctctgatctctttgctgtgtggtggaagggatggaaaggagggaaaggacaattggaaccagcaacgcaacattgtgaatgctcagcccttccaaacaacatagtcaccatagaaacaactttctaaagtaacataataacattttcttgaaaagataacctgtttgccattcttggaggcaggggaggcagaggcccagacatgctgtggcccagacagcagcttctaagcggatggagcctgaacccacccagtttggacaaagaagcctccatactccctgtgaaaaagatttccagaagctgttgtgaaaaaaccaccatcaccaccaccacacacaccccacccacccaccaacactaaagatcattcttgagtctgatttgaaaactagggtcacatgttatcaggttgttttgtgtattaaatgggtgttaatacaggtaggttacttagaatagttcctagggtatagtaattgtgtgagttttagaaattgttgttattattgctgtttagtgtatattattcttaaatgtttataaaatgacaatatctgatgttggctaagtagaggaaatgagtattttcatacattgtaggtaagagtatatattggatcattattttgggaagaaagttttacaatatgtctcaaaagtcaaactaaatgaaatctttaataaataaaattctactttgggaatttaaccaataatctatacaattatttgccccaatggatattcatagcagtgttacttacaatggtaaaaagttagcaaaaacttgacctccaggtaaataggtggtttgaatttattcattgaatttcatttactttctaagcttcattaaaactgtagtaaaaattttttttttattgagggaaaatttacacaaaggaaaatatacatatattaaatggacaatttgatgatttttgagaaatgtatacacacatgttaccaagctcctaatcaagaatatctccatcctcctagaacgtttcctcttgccctattccgtgcagtctccacctccatggactacactgttcagattcctctcaccatagattagttttccttgttcttcgacttcacataaatgaaataatacagtgtgggctcgtttgtgtctggcttctttcattgaagttactatttctgagaacccattcatgtcattgttttgttttgtttttgagatggagtcttgctctgttgcccaggctggagtacagtggcgcaatcatgacgcactgcaaccttctcctcctgggttcaagtgattctcctgcctcagcctcccgagtagctgggactacagatgtgtgccaccacgcctggctaattttgtattttttgtagagacagggtttaccatgttggtcaggctgatctcgaacacctaacctcaggtgatccacccgccttggcttcccaaagtgctgggattacaggcgtgagccaccacgcctggcccatgtctttgttatatcagtagttatccctctacttttgattcccatatcctctgtccctttattgttgagtagtgttctatttttgaatatactagaatttattttcctattgctgatactgttgttgttgttttttgactgtcatgaataaagctgttatgaatgttcttgttaccaaaacaaaaacaaaaacaaaaaaaaaaaaaaagaaagaaaactagggtcgaatcctgcaaatgcattcaggtgacggggtcccaccctaacagccatgtcagtagctctcatccatcacgcctgggaaaatgctccattccgcattccttagctctggttctggtttcagacttcactttatattggcggggttttaaagctagaggagtctttacctacttactcttatgtacagatctgaatatggaggtcaggaggggcaaatgacatgtcctaagtcagaggagattcaacaagaaaaccagacagtcaacgactgagcccctggcatatgctgggcattggtgagctgtagggatgtggtgatggagaaaacagagtcccttcttcaaggagctcaatccagcaagggaggcagattctttgcaggcaggaccaggcttccctacagcagaaggaaactaaatcagggtaatgagcctcagcagggacgggcctccccactgccctgagaggacacagggctgtggcatggtcctgctttgaccggctagctgtgcagtagggccaggtggggcctggagtggcctgagctaggggctgacatgagctcccccaaggcactgcataagtaacgttagcctctatttgcacagcaaaatcaaggacatggttttctagaacacaggctgcaccctctcccccaagcctagcaaatgggctacgctggttggtgggcccttgtttgtgacagggttggaatacaccacagggttccgagtgctgagttgtggcccacaggtgactggcaaggggaggcagagctgtagagcccttgggagccatggagggcttgctgcctgccacgaaatgctctctcagcagctgctggtccagctgtgggcagccgtacaagctgtttacagcatcctgggacaggtgcttgcaaacatatggatgccatgggggatccgagcctgcagtgccatggtggcgtttgtggccaagagactatgtgcaatcagaaggagggaagagctggcccagcagaatttggtccagggtgagggccacagaaaggtcagaggcaggatggggctggcacccaggctggtggtggcctcacatcacctatgcctgaggccagtcctggattgccccagaagaaacaatttctttactccaaagaaatccaaaggagttaaaaagtgagagcccaaatccaatctgtgctcagggagcaggcctctctgcagggggcaagggcacggctggagacggaggtcctgcagctgcagctgaggcccccactcttcctgcactgggcagagagccgtgatggggcctcagcaggagtgcatggaggaggacgcctactgtctggacctggaccggaggcttggcaagatgcaggacaactggaagccgtgagtcagacccgcgactggctcaagaagattgcacaagacctggtctagaaattggagaagttccagcgggagatcctcttccacgaggaaatggctcaggaagtgtggatggccaccgggtccaccaagcgggtgctccaggagctccgggaagaatatgacttcaagaggcagaagccggctcactgggaggccaagttccagcctttctggacagtgctttggctcctagggctccagccacagtctgcagggcctggaagtaccagggggaccgtgagccactaggacccccaggagggaggtgagtcatcacctgagggcttgggtccagagcatctacctgtttgattccattttccctgcagccaggtcctgaataccctgaaactcggccgaacatgagcctgagctgctccctcgaaaacacttttatctcttgttactttaggtaccatttattaattgaaactgaaattgttcttagtgaagttggatagatagcgttaggagtgtaagatactgttttaccaataaagattgttggatgtaaaaaagaaagtttttcacacttgtttctccataataattcaagtacttctatttgcatttgtgtcaaattacatccctatacatataatactaaaagacttatttatatgtttacagatacacttggcattgtgtcatactattatatttatctcataatttaaatgttaaataatattgtgtcatgtagatatgctttaatttatgaacttaattccctattgtgaactatttagtttgtgtccattctgtggctattgaatactgcaaattagtttgtttattcagaaaatcctcattcgggcattcaccaatctactattggacactatcccggccattgcatttttatggaagaagcctaacattgaaaagactactgataatgagttccatgggaccagctgttacaggaaaagtagtttttgtggaatattttaggttagtttacctaaattcctatgagaactgtcctttcaaaatattcataacgggctatagaacaaaatctatttattcacttgctgtggtttgaatgtgtttcctctaaaattcaggtgatgcttggctgggtgcagtgtttcatgcccgtaatcccagcacattgggaggccagatctcttgagcccaggagtttgagaccagcctggacaacagtgaaaacctgtctctaccaaaaaaaaaaaaaaattaaaaaataattcaggggttgccaatgcgatagtattaagaggtagggcctttaagaggtaattaggtgatgagagctcctgccttatgaatgggatgaaggcctttaaaaaaaagtcttcatggccaggcacggcggctcacgcctataatcccagcactttgagaggtggaggtggatggatcacttgagggcaggagtttgagaccagcctggccaatgtggtgaaaccctgtctctattaaaaatacaaaaattagctgggcatggtggtgggcacctgtaatcccagttacttaggaggctgaggcaggagaattgcttgaaccgaggaggcggaggttgcagtgagctgagatcatgccatcacactccagcctgggcgacagagcaggaggcttcatgcagccttcatcttcttttgcccttctgccttgagaccatgcagtaagaagccctcaccggatgccggctccttgatcttggaattcccagcctccagagctgtgaaaaaataaatttctgttctatataaattaccctgtctcaggtattttattttagcaaaatggactgagacaccactagtagaatagctatcctctaaaacaattttcatccttttcagcctggcacataactgcaaaacaatagtattaggttggtgcaaacgtaactgtggtttttgcaattacttttaattgtaaaaactgcaattacgtttgtatcaacctgagagcatattaatcttttcttgtttttcaccttaggtggggtctttgaaactagctggagagtattaggtgctgaaaagagtataaggattcagatttgttccaggtgaggcccacacagctttcacccactgtacctcccaggatgaactgatgttggttgaccagcgggagttgtggtaatagttcatacacaagggcacgtttgctctgttgcagccagcaccggcacaccatatgcatgcattttgtaattgttttcgtctgaatgaattaagatatatgttgcatagctgatcattttgaagttatcgctggtaaccattgagccagagacaaaaacaggtgctatcctcatggagtttgctgattctaggatttcttgacaatagggatgattttgagtgttcaagacatcaggctaatgtgggctgctgagtgattgccttctgtgtgggtttatgtgtgtgttttcctctgctgaagcattctatagtctacattacataaaataagatgttccatgtgatttcctttgaagaatgcttgagtaatatagctgttgaactagaagtgctgagcagtatatgcttcttgggatgtcttatgtaacatttggttggatggacctgattttcaaaatgtcatcatcttaaaagttttatttctgctttatggtggcataattgtcaaaaattatatatattcaacgtatacaatgtgatgttttgatatacacgtacattgtgaaatgacgaccaaaaccaagctaatgaacgtatttatgacctcacagagttaccttttttctgtgtgtgtgatggaaacacgtcagttctactctcttagcaaatttcaagtgtccaatacagtgttattaactacagggacccaccctactgtacattaggtctccagaacttatttgttttataactttaagtttataccctttgaccaacatctttgtatttcccctcgctatgacccctggtaactaccctactactctctctcatctgtacaaccaaatgtgtgtgtgtatatatatatatatatatatatatatatatatatatatatatatatatgtatactgtaattgaactatgattcagccatgtgaaaattttttaaaaagtttaatattaatataacatatgtatgtaacacttatatataaaaatataggtatacatgtgttacagcacacataatgattatatatgtgtaacaggatacatatttatatatataaatgtactgtaattgaactatgattcagccatatgaaaaatattttagaaagagtttatgcatatagaagtgctaatgatatataaagtttaaaaaagacatgcattatatgaacaagatgattccaaattcagttttgaaaataaaagcataaaatatacatatatttagatatatctgtatctagctacatcacatttgctctatccatttatccattaacagataaatgatataacaggtctttacaaattgcatatgacatatagatatatatgtcttatttacatatattaaagccttattctgatactatagttatggtacagtgtaaaatctgcatatatgtgtgtgtgtgtgtgtattttttttttttctttgggaagtgtgagtccaagtgatttgaaaatgccagagagggctgggcacagtggcttctgcctgtaatcccagcacattgggaggctgaggcaggcggatcacttgagttcaggagttggagaccaggctgggcaatatagccagaccctgtctctacaaaaaattttttaaaaattagccaggtgtggtgatgcatgcctatagtttcagctacttgggaggctgagttgggaggatcacttgagcctgggtatttgaggctgtagtgacctatgattgtgccactgcactccagcctaggtgacagagcaagatcttgtctcaaaaaaagaaaaagccagagagccaagtgtgacagccctaatacatgttcaggattttagagaggttgtgcatctctttctatgttttaaatctttgtgatatttttaatgagaaatataacatgtagaaaatttggagaacacaacaatacagacagaagaaaataaaagctacttgcaattatgccacccagagataaattgctgttgatatttcacatattttattccattcatttttctgtgtatctgcatatattgttcttttatttttaaaaataaatttggaatcatcctgctcatgtaataaatgtatttttaaactttttatatcattagcatttttatatcaataaactcttttttaaaaaaatttttaacatggctgaattctaattcagttatagtacatttctcttccgataattttgggactatttcatattagagaatcttgtctccttgtcttagatgctattttaccccatgtatccatttttgaataaaaagagcctgtctttaacaaaggtctgttttttttcttgagtactcctgaaatctctccttggatctggaggtcaaattaatatagcaatccctggccaattttggatgtctcatttcttgtatctctcatgcatggctctggggtggatgttggactgagtcagggttttctcttgcttctcttgtgaggggatgctcctgttttttctgtctctgccattccattatatgctggtcctataacccaaggcccatagactccctggtctttgttttttctcatagtttgcatcactgggtgccgtgtgttggtcttgtgacaatctctgcaaagaagctctgatgctggctgggtgctgtgtgttgtgggggtgggaacttatcccactatcttggaaagcaggcaccggggaccacaggtaggcttagattcctagggaaggcagcactaggaccatccaggccaaagttcagggtgattcctcagggattgatacctacttaattggtattttacatcttcagctggtttacctttgaagcttttatgtgttgtcatggatatttctgttggaaaatgtgggatggcaaatggagcttagcgagttagctgtcactgccgcagagacgtctcacacagatttgtcagggacgatgtttgggctgctgggatagtggcctaattcagtaccatgttcaatctcagcctgtgccctggataccgcttaggttattggatggcattactatatggtgacacggacgcggatgcattttatctttggtgagatagggcacagaaactttaaaccttacatgtttgacagcatcacagagtacaaagctcaccgtggctcttttcaagtacagccccattccatggcactgactcaggaagcttgtcatagactgtgccagtatttagatttgactatatgtgtacaagttatcaatgtgctctgcagtgatggtacagaggctaagatgtgtaggcatttgttatgctctttacaagatatctttgttagcatgataattttgcatttgtactctgaacaatcttctgatttttttcagagttaatattctttcaggtgaggaaatgaaggtttagatagacaggcttgctggagttttcccagctagtacgtggtacagctgggatgagaacagagcttttcctctatttagtctaggacatttcctaccattgcaccaatttttaaaacaaaccactgaatcatctactttccagaaggaaatttcattgcaatggatttatgctttgctttatcatttatccatttgacagttctctgaaccatgattgccccagtttaaagaaatatcaagaatgccacacttgatttccctgaatgccaaagtgctttcaatgtgtattgaataattgtggtgtgtaaggatcgttcctagtgagccactccccttaatgtcactccagacagcatgatttatttactcctgaggatggttgataagtaggatacctactcgagggaggtgtcacctttatggtgggacatacaataaaaataattattgaaacaaatgaagttaattagatgagagaagttaaaatatttgaagtcagatgtgcacagaacagcaaagatacttggaaattttatgatagtgttataatctccttggcagatggctaagcattaaattgcagacatctctcttgtttttgactttttttttttgctgcatattttgttttgttgtttacaaagaaagttctttggaaaaagttcagaacatactagaaataatacagaaaatattaggttcacccttaatcctatcatctagacataattacccccatgcttattttctcaatcctatatttattaatcttttctcatttaaaactacgttgtggacatgtgttctggatattagcaaatccagttgcccaccaacatttttaacggcttcatggtgttctgtaatattcatccctctattaatgaacatttaagttgttcccagtatttcactattgtaaataataatacatagaatatccttatacatgtgtctttgagaacttgttgaattctttttttaacaaaaattcctactgggcttggtggctccagctactttggaggctgctgcgggaggatcaattgagcccaggtgttggaggctgcaggatggtatgattgcaccagtgtactccagcctgacgacagagcaagaccccttttgttacaaaatgaaaaggaaacgtagaaacaatattgttaaattaaaaggcatgcacattttaaagtatttggaaacattttgccaaaaaagtaataatactaatgtactaatatgcattccaacacatggaaaataatgctcattttcctgcgtgttaaccatgattggttattattattattattatttgagacgaagtcttgctctgtcacccaggctggagtgcagtagcgtgatctcgactcactgcaacctccgcctcccaggttcaagcaattctgcctcagcctctggagtagctgggattacaggcacccaccaccacgcctggctaatttttgtatttttagtagagacagggtttcaccatgttgtccaggctggtctcaaattcctgacctcaggtgatccacccaccttggtctctcaaagtgctgggattacaggcgtgagccaccacgaccggctgattggttattattattaaccatttttacttgccattccagtagtttttttaaaaaaagcaaaaaaccccaaaacctatttttgcagtttggcttattttttaggtttttaaatatttttttttgacacagagtctcgctctgtcatccaggctggagtgcagtggtgcaatcacaactcactgtagcatcaacctcctgggctcaagtgatcctcctgcctcagcctcccaagtagctgggattaccagcatgcaccaccacacccagctaatttttgaattttttgtataaatgcgatctccctctgttgcttagatttgtctcaaactcctgagctcaagtgatcgtcctactttggcctcacaaagtgctgggattacaggtgtgagccattgcgtctggcctttttttgttttgtattttagtagtgaggctgaactttctccatggttgagtgtatttcttcttttgtgagtttcctacttaatacattatttgcctgcttttctaatgggagcgcctcttctcaatatataacagctgtttataagataagattatttacccttagtgaattaagtacaattgcttttcttagtttgtaatttactttccacgaggtttatagtgtggtgcttttacatttttatgtagtcatatatgtttatctcatctgatctatattttattaaattatttcatatttttcccactgttaggacttaaatctttaacctatctgaaatttattctggcaaaggatagggagagctttaatttttttttccccaagttgttagctaattgtcccaacccatttattatctttttttttctttttcttttttttttttttttttttttttagacagagtcttgagctgtcacccaggctggagtgcagtggtgtgatctcagctcacaacaacctctgcctcccaggtttaagcgatcctcgtgcctcagtctcccaggtagctgggactacatgcatgcaccatcactcctagataatttttgtatttttagtagagatggggtttcaccatgttggccaggctggtcttgaactcctgacctcaaatgatccacccacctaggccttccaaagtgctgggattacaggcatgagccattgtgtctggccctaatcaacttattatcttattgaatgtagctgcatttttcattagtatattgtcttagtccatttgtgtttctataaaggactaactgaggttgggtaatttctaatgaaaagagatatatttggctcatggttctgtaggctgtacaaggggcatgacaccagcatttgtctctggtcagggactcaggaagattctactcattgcagaagggcatagaggaccagagcaggcatcacatggagagaggaaggaaatgaggaggaggtcccaggctctttaacagtcagctctcacaggaatgaatccagtgagaactcactcattactgcaaggtattcatgagagctctgcccctatgttccaaacacttcctaccgggttccacctctgacattggggatcacatttcaacatgagctttggaggtaacaaatatcctaactatatcatatatatttcatatgcatttaattaccataactttagatttcattttaatgtgtagcaagggtagtttcactcaatccatttctctttataatatttcctttgccttttcatgaatgtattcttccttatgaactttaagaataaaatacaacattcattgaatatatttgcaaaattgatgtgagaaatgtacttggaattagattgtattctcatagcaaaggcatcctggagcacgtatatatctaggagtttgaaatggactagtaattttgcaagggattatggtattgagcaggagaaaggaaatgacccatggaatgtgtttctcatatcacatgaagtcaactcggagaaggtgaggatctttatggtttaaattcattctgttctgtggataagaactggcaacttaattctgtcatgtagtatatcttcctttggcctaagaattgagccaggaatcccagggtaaagcaaccttgaaatttgtttttttcccagaatcatttgaaaaacattccaggaggaaaatatgtagcattggcaggatctgagtgagatacagtagtcccgtcctttattctcaaggaatacataaaacatgaaaggagagattaactctgggattatgtggcaacgctccaggcatataggaaaaaaacactatatacagggttcagtactatccacagtttcaggaatccagtggattaagatgttgtaaatgaggattcttactttttatttacctgtgctggaactcctggaatcatatgaagtattttaaaaagcatatttgacttcatatttccttttattatttcatatttttttctctatatttttgcttctaagcaggtattttggtgctatagtaagcattttaaacttatcaaaatacttgtgttgttttcatatacaaataaagagagaaagcagactgggttttgaagaccagcagaaaaaggtttcctagtcttgtaaacttaggaattatataggatgatatatgtaaaattttgctccgtttttgggatatggtaggtactttccatgataatgaaaaagcttctctataaattcatgataaatagtttgggggatcaatactgtttacaaaattcccctccaaagtttcacattttaatggattcatattttagtaagcctagggactgaactttacaggttgtggaaagtcctccaaatattttttactacattctagtaattacgttactaaggttttgttaggttacacattttaaccaattaatatggagctctcacaatgtcatttcacgccagtagtatttacacttcagtttgttctagttattaagtcaatatttgcaactttaggtaaacataaattaacgatatttaactaaggaaataatgcattatagcatcctctatataactcctgtaacaacatatggaatgaaaaatattaatctagtaaaatcatatattaggaccttcaacttaactttaattctaatttttgaagaattttcaggttcatagatgaaagtttaggttcaatattacatctgcatctctatgaattcagtcttttcaacctatgtctgtgtttcaatagttatattgaattcagtattcacccttgaatattgagtttgaaaacaaaattatctatgattttttaaaaaatcactaggctatcatgaattttattaaatcttagaaaagtgaggattccaagccttaagttgaatgttcaattgattttatcttttaaaaagtataatatgggctaggagcggtggctcatgcctgtaatcccagcactttgagaggctgaggcaggcggagcacctgatgtcaggagtttgagaggagcctggccaacatggtgaaaccctgtctctactaaaaatacaaaaaaattagccgggcatggtgggcacctgtaatcccagctacttagaaggctgaggcaggagaatggcttgaacccaggaggtggaggttgcagtgagcgagatcgtactattgcactccagcttgggcgacacggtaagactccttttcttaaaacaccccccaccaaaaaaaaaaaaacaaaaaacaaaacaaaacaaaaaaaagcaagaaaaacccctataatgtgttcaatatactatataggtattgcaatttgaagcatttaagttagggtctgagtagcacatgctgaatgaatagtggcccagtgctttgtgcatagtggctattcaataaatatttaccaaagtgaaggactcttccccagatcactccagctcctccagggtacctgaaatttctgtggctggacattacagtatttagtcccgaataagaagcagggttcttacaaattggaagggctcctacaaaattggttaattgggattagactatttgtatccttgcccaaggaagggtggcttttctggggaggcttttctgatggggacctcgactggtaggacactgagtatcatgggtagagaagtagcctctgacatggagtatttattatattgtaacatcattgcattattataatgtaacctttccctgctcgatgactcaggctataggtagtctacgtgcctgacttgttgatctatgcaccttcttgaggttaggaattaaaacactttttttttttttggtaatttttaaacactgtgcatgtacctaaagtgaccataggaatatttgggaaattttacttttggatatcagctagttgttaccaaagtgctttaggtggtggctaaaaatgtcagtttgcctgactttgaatcttgactgcacatcgcataacagctgtgtgaccccagacttcttttctgtgccttcgtttccttctctgtcaaatgggaataataatagcaccaagttcataggacggcagagtatccaagcagtgtctggtacatggtaagaactcagtacatgtcagcggtggtggtgataatacgtgtatgagttccaaggtactgagtaggcacagtgtgaagtagttgtgtttgtgtcctgtgattagatagtagtgatgactgctgactcgctttactctgtgcccaccagaagagacctcaggttctgtgggatgcaccctgagtatgccccaagaaagagcagagacttgtacttaggatttgtgatttgcagacgcaagctttgctgtatttgttttgctcgaagggcttactgctgtggtattcagaatgtgaaataatagttaatggagacaaggggattaatagcagcatttaaaatcatttagtgactaataactttgtggcttataaaatctgtaccttgatatgcaggggtggctgttctattaacatttctaagctatttaaaagtcagttggatgcttttcggttgcacattcatttttcatctttgcccttccattcaggaaacatcaataaagtttaataattttctgtcatttctggaaaaataaacaagattatagattattaagggttatttttcattttgatggtggataaattaggaggaatccttactgaatgaaaattgtgaattattgattatgatcacaggattaatatgaaaccactcatatatctcgatgtgcatagcttcttttctagtgccattgtagatggattgaggaatactgtgaactgggattattgtgtattaatcattgaacacctactgtgcaccacactgattataggacgtgtatgcattatatctggcctgactttagcttctcaaaataggtattttatggttgaggaaatgcaggctaggagaggttggacaactgacccaagatgctataggttttcagcttgctttctttctggcatactttgccatcaaggcttttaatataattttttgctcctcaaaaaaatttctttcaactttagtgaaatctagcctcgtataggagaaggttcaccatggggaatttggcatttgagtcttgaagtcaaatgctggggtatgggggactacattatttgtactcaggatccagaggggagttatcacaaagccagtgctttcttttcacctctggtttagggttgggctcccctcatacagtcaaggtccagttgaatatggtaatcaaaagaacaagctggggagtcagagagaccttagcctggatattgggtggtacatcagttgggatgcttttggctgtaagtaagagatgcttatttccatttccaaatgcctcatcccaaaagcaatttatcatcataagtccagacgtggagccagtcaagaggtagcggctgacccacgtgatccatctttctgctttccttatacttgatttttttttttttttttttttagctggcgtctcactctgtcacccaggctggagtgcagtggtgcaatctcggctcaccacacctctgcttcctgggttcaagtgattctcctgcctcagcctctcgaatagctgggattacaggcctgtgccaccccgcccagctaatttttttctttgtatttttagtagagatggggtttcaccatgttggccaggctggtctcgaactcctgacctcaagtgatccacctgccttggcctcccaaagtgctgtgattacaggcatgagccactgcacccggcctatactttatgttaatccgtccattcactcatcataggacggctgcaggactttcacatatcccattccgacgtgtcaatgtctggaggacattatggctccatttcttcttgtggctctttcttagaggagaggagcatttttccagaaccctcttgcccccggagacgtctacttaagtcttattaaccagagtttggtcaaatgcctgttcctgaaataattactaacaaagtaaaaataacctctacaaatcagggtgtgatagcttcccttggggcacgtggctgtgttggggaggaatgagtactgcacaaacctgagatcctgctagaaaggaagaaggagggaaaggatataatctcgaagacttaatttcctcctggataagtggagatgataacactttcctaacatagttgtctaatgagatagctactgaaatccagcatcagaacaagagattaccataaatttgaagaagtgtgaaaccaggtaccacagcctggcccctgcttaggcttagttacttaaagctgtgcaatttaaagcagttttggaatctccccttttcatttacttgacaactgtcttttgagaacctatcatgtggcaggcgctgtgccaggaatgacgttcagcacatacctgtcatgtgcatgcaagtacttttagctgtgattacttggtgtatagtatgtttgattggttatgtgttgattactgaacagctactctgatggccagttttaggtgtcagcttgactggattgacagatgcctggatggctggtgaagcattgtttctgggtgtgtctgtgagggtgtttccagaagagattgacgtgagagtcagaggactctcaatgtgcatggtgggcaccatctgcctggctggaagcccagctgggacaaataggcagatgaaagggaattcactctctctgctttctgtctcccttctgagcaggtcactttttctcctccggcctttggacatcccagtccggtttctttggcttttggactccgggacttttaccagtggcctcctgggggctctcaggcctgaccggtggtgtgctgttggctgccttgcttctgaggctgccagatttacactgagctatgctactggctttgagccatgttagcagcttctctgattctctagcttgcagtcagcctgtcgtaggacttctctgcttctgtggtcctgtgagccaattcctcccagtcatccccctccatatataccgtatagtttctgtttctcgggagacacctgactgatacacctacgtttcactctgtattatccatcttgcatgcatcatctctgatcctcacaaaaccttttcagagtagattattttacagttgaggaaatgcctgtaacaatgtcaaatacatattattttcaggaagtactggttgggagaaaacccctcagaattagaaaatattcttgctgtttcgaaggagtccagtatgtcaaagtctacctgcctctttcattaataaatactgggaagctgaggtgggcagatcacttgaggtcaggaatttgaaaccagcctggccaacatggtgaaaccccatctgtactaaaaatagtaataaaaaaatgtagctgggcgtggtggtgggtgcccgtaatcccagctactcgggaggctgaggcaggagaatggcttgaaccctggaggtggagtttgcagtgagccgagatcgcgccactgcactccagcctgggtgacagagtgagattctgtctcaaaaaaaccccccaaaacaaaacaacaacaacaacaacaacaaattggggataggtctgcttgtcttataagtttgtagccaaagtatctcatatgtttatatttttgaaaatccatttcgttcctggaatatgttaatttattgatattctagtcagtaaaagacttgcatggaaaacattgattagatgaaacactgaaacagctaaacctcacttccacttgtttaagacatcaagctgtttaaaggtcagctggatgctttaacttatgaaatgtgtaagcagaggagtgattttctgaagaaagtcgtttatattagaaataatgatttatttaactgtgttttggtcacaagcatgacatttcgaacacagtaaactttatagatatgaagattattgggaaagatttattttaaaaagagagggatatgaaaacacggggaaatttcaggacatctcaaacattgtgctaataacacctgtatttgagttagtcacatgtactgcaaatttttcaagaagaaaaattgtttcaccatttcctttattagctaaattcggaagtcaagttagtagctaggttcatacctagttctttgtttagagtgcttgtattctatttagtaagaagggacatggttttacctctttatcaagggctcactgaggtagtatattctgggtggtggtcaacacagatttcttttccatgtcagagggtcaagctggacctttcagcctggccctagggaaggctgtgttggcattttccatttttgtaaatgacatcatagtctttcaactgaatggctagtgactatgtcctatttttttttaagacagaaatatgtgaaatttaaggaacagctttctctacagctgatgatgtgggaggtttgtgaataaccgttggcaggtcctatgaagaggaggagctagtgttccatggggacgtgtgcacatgtttttatcctgggaatattgcatttgtgtgatatcttctctttcagaatgtatcaaaatagaagcttgggccaggcgcggtggctcacacctgtaatcccagcactttgggaggctgaggtgggcggatcacgaggtcaggagatcgagaccatactggctaacacggtgaaaccccatctctactaaaatacaaaaaattagctgggcgtggtggcaggcgcctgtagtcccagctcctcgggaggctgaggcaggagaatggcgtgaacctgggaggcggagcttgcagtgagccaatatcgcaccactgaactccagcctgggccacagattgagactccatctcaaaaaaaaaaaaaggaagcttggggccagtggacttgttggtgcatattaaatgggttagagagacacgttcttaatgttatggctcttcaaacatactccaaacctctcctatttgaccagccagaatcttatgttattagtgttgctaacccctttttccctatatttttgatagtacgctggaaagaaatgtctgtctgtcttgaggttttcagtctttatttaaggttttgacgatacctgcaacatagacaaaagctaggattttagattgggggaaatttcctactagtagtccagtagtaccggcattttctaaccccaaatttatgtttcttcttcatattactgttttaaatattctgtattggctgggcgcggtggcttatgcctgtaatctcagcactttgggaggctgatgtgggaggattacctgaggtcagaagttcaagaccagcctgaccaacatagagaaaccctgtctctactaaaaatacaaaattatcccggcatggtggcacatgcttgtaatcccagctacgcacgcaggaggctaatgcaggagaatcgcttgaacccaggaggcggaggttgcggtgagccaagatcatgccattgcactccagcctgggcaacaagagtgaaactccgtctcaaaacaaaacaaaacaacaacaaaacaaccgctgtattgttctgtgataggtgagcaggcacttgtgttactttgtaatactgtcttattccattttctgatgttatgacagaataccaaatggaaagaacatatatttatttatcatagttctcaaggctgagatgtccaggatcaaggtactggcatctggttagggtcttcttgctgtgtcctcgcatggctaaaggtgggcaagagacatgaagcctcttttacaagagccttaattccattcatgagggaagaacactcatggctgatttcctcttaaaggcctcaccttttaataccatcacattgtaaaatacatgaattttggagaggatacatttaaaccatagcattaaattaaggcattaaatcaattttggttgcttatgacaaagatctctgacaacctaactttattcctgtagttggtatttttactgtaggcagatttggtcaattaaaatgtaatcttgtgagtcacatgacaaaattttctttcttcttctttttttaaggttatgtaatagagggagagaactcactagtcctgggccataaaaactctgggcaaaggatgtgtgacttctcttctgtcaactagaaattatatggccacaccacaggtttgtccgaccagtctatcgggcagtttacatatcagaaatttgaagagcaggtctgagtaattattgacatgaaaaacaaaaatagaaacacaaagcacttctaaaatatgtgtgtcaaaggagtgcacttccagaattttctccttctggtctgtaaggcaaaactttttcaggtgacagtgcccacaatagacaaatgtgagtcattttcctacaattttgaaattattgttagttcattattcttagggttctactgtagatgtgaatttagagaatggaatctaactcatcatggatgatttcctttttgcaaagcatcttgtgggacaagataatagtattaataacaagagaaatggtaatacagttgaacccttgagtaacgtatgtttgaactccttgggtctacttatacgtggaattttttcaatgaatatattggaaacctttttggggatttatgacaatttgaaaaaaaactcatagatgaactgcatagtctagaagtatcaagaaaaaataaggatggtatatcatgagtgcataaaatatatgtagatcttagtctatttatgtgttaatcaactgtttatgttataccaactgtttagttggcaaggtttccaggcaacagtaggttatttttagttaaggttttgaaaagtcaaaagttatatgcagatttttgactgtgcagggggtctatgccccaacccccatgtcgttcaaaggtcaactctattagtaatggtaatagctattagtaatagctaacatttatttagcttataatgtccaggtactgttctagagtctttacatatgttaataattatgacttacaggctgggcacagtggctcatacctataatctcagtactgtgggaggccgaggcaggaggattgcttgagaccaatagatcaagaccagcctgtgcaacatagtgagattccatctttataaaaacattttaaaaaaaagttaggtgtggtgatacacacctatagtcctagctactagaggggctaaagtgggaagatcacttgagcccaggagttggaggctgcagtgaaccatgattgtgccattgaactccagtctgggtgacagagcaagactttgtcatttacaaaaaaaattataagttactattttcatccccactttacaggtgaggaaactgaggcccaggaaggttacgaaatttgcccacagtttatagttggcagagagggatttgaacattactttcttatttcagatttttttgcttttaaccactatgctgtgtttcccaaggttctgatcatttcagaaggtttgttttctgttgcataactatgagagctcaattttggttgaattctttcaagtggcatcagtgttttgaagtctgagtaggccaggtgaacaacatccattttcttacctgggttctgaagaacttgggaaataaaagaggaaggcagatataagattaaaatatcaaatttattaccgacagagagcttgttcttgggaactgtccccaagaggaagaaagttgaggatgcccacctgtattcgtccgttttcgcgctgctcataaagagatgcccaagactgggtaatttataaagaaaaggaggtttaatggactcaaattccacatggcagagggcgaaaggcacgtcttacatggcggcagacaagagagaatgagggtgaagtgaaagggatttcgccttataaaaccttcagatcttgtgagacttactcgctaccatgagaacagtatgggggaaacctcccccatgattcagttatgtgggtccctcccacaacatgtgagaattatgggagctacaattcaagatgaaagttgggtggagacacagccagaccctatcaccacctatttctaggtttaccaatcagctaagttaagccatctcctgggggtaaagggagtgaatgggacagaaagagccatggagtgggtgggactagagggaattcttcttactggacaccagaagagtgttaaaagggatcccctgtaggcagagcacggtggctcatgcctgtaattccagcactttgggaggccaaggcaggctgatcatgagatcaggagtttgagaccagcctggccaatatggtgaaaccctgtctctactagaaatacaaaaattagctgggtgtggtggcacatgcctataatcctagctactcaggaggctgaggcagaagaatcgcttgaactggggaggtggaggttgcagtgagcagagattgtgccactgcactccagcctgggtgacagaatgagactccatctcaaaaaaaaaaaaaaattaaaggtgtcccctgtaacattagcattatgtgttaagtctggaatctagtgaaaagttcacatttctgttagaacagggaacggaagggttaatgatgttcaggaacggttttatggctcagtgggaaaattgcatgttgttagaaatatagttggattcctctcctgagttcatgcgaaattgctgcgtatttcgcctctcactgattgctggaatttaaaaatgcattcctctggaccaaggtagttgtgtttcctttccatgtctttgaagtgcttttctcccccttaacttgtcagtggcgtggcgtacatgtttttgttactgacagtgtggccaattattgtgttctagaaggcattgttgtctctgagaatgttacatgatatgagtagcaagtctgtttattcagaaaaacacctcagatctcaaaccaatttagagagctcagaaagcagtacttggagagacacttccgagagatagcttagtacatcatcagagtccttattcctgattctaaggccatttaagcatgggtcacactggactgctagttggcatagagaggaagtgattggtggtgaaatctgtggtacttaaaagcgctgacagtgtaggaggccagatttcaatttctagaggtgtcattttagaatggagtagggaagacatatgtgtcacatagtggtttttttggtttatttgtttgttttgagacagtctcactctgtcacccagggtggagtgtagtggcgtgctctcggctcactgcaacctccgcctcccgggttcaagcgattctccagccttagcctcccaagcagctggggttacaggtgtgcaccactacacctggctaatttttgtatttttagtagagatctggtttcaccatgttggccaggctggtctcaaactcttgggctaaagccatctgcctgctttgcaaagcctcccaaagtgctgggattatagacgttgagcccctgtgcccagcctgtcacatagtgtataatgacagttatgcatagagatcgaaaaatgttggtcagagggcacaaagctttagttagacgggaggaatgagttcctattatacagcatggtgactctagttaataattattatatacttaaaaattgctaagagagtaggttttatatgtccccaccacaaaaaaaaggttgattatgagaggttatgactatgctaattagcttgccttaatttcacaatgtgtacatagatggaagtatcatgttgcacagtttttatttgtgaagtatgtctttgtcgtgaaagcagccgtagtctatgctacagggatgggcgtggctgtgttttgataaaaatttatttacaaaaataggaggaggggtagattcagtttgctgatgtgtcaaataaagtaagttttgttcaaaactgtttcatcataacatctatgagaaaaaaatgaaatggattcttggccagggctagtgtctgggtggagtttgcatgttcacctcatgtctgcatgggttttctctgggtactccagtttcctctcagcccaaagctgtgcacatggcattcactggcatgtccacctgtttgcagtgtgagtgtggatgtgggtgtgagcgtgccctgtgatgggacggcggcctgcccagggcgggttcttgcctgacaccctgagctgctgggatggaatccagccacttgcaaccctgcactggaataagtggataattatcttacttttttattaatctttcttaaataaatgtgtagctcacatttattttgatgttgagtagcagaagtgttttggtctttatttagaagcttggtggtgtttttggatcagaaatgtgctgtaagaacttaactcttgtttttgcctttttttttttatttttgatttccataggtttttggggaacatgtggtatttggttacatgaataagatctttagtggtgacttgtgagattttggtacacccatcacccgagcaacatacactgaacccaatttgtagtcttctatccctcaccctcttcccaccctttccccacaagtccccaaagtccattgtgtcattcttatccctttgcatcctcatagcttagctcccacttgtgggtgagaacatacgatgtttgcttttttattcctgagttacttcacttagaataatagtctccagttccatccaggttgctgcaaatgccattaattcattccttttaatggctgagatgtattccatcatatatatatctcacagtttctttatccattctttgattgatgggcttttgggctggttccacatttttgcaattttgaattgtgctgctattaacatgcatgtgcaagtatctttttcgtataatgccttcttttcctctgggaacttaactcttgtttctatcaatcagcctgtggtaaaactggtttccttgtaggtcctttcccttaaggtcgcagtttccaagaacctatgcacaacactaaagatttgctgtacatgtgataaacaacatagcatgctgattaagaacatgaactctgaggttagaccacctgagtttgaatctctgcagcttccttctgtatgaccttgagcaagcgatttaacctttctgtgccttgctttctcatctgtaacatggaataataaaaaccttcctcataagggaaaaaaaaagagtaagaacctgcactgttcaaaatgtaaattaagtgttatcagatgcccattgccaaattctcttccttttcatggtttttgaatgcttgtttgtgtgtagcttgacctagaagctttgggtgatgtgaaaaaaaataggaagaaaaatagtgacagctaacattgtgcacctatgatgcaccaagaactgtgggaagtatcccctatcattgcttcatttcactccaggaggtagggaccattttacagatgtggaagctgaggcctgtggtggagctcctttcccgtggtctcacactaaatggggagagactgcagacctagccctgtggaccagctgtagcatcgcatcttctccaggaaaggagagagggtgggcagtgctttgcttacctgatttcattctggttgaggggataaacctggaaaaatacttaaatgcctatattaactcatgaaaaaaagaaagtattctacaggagaaatgtagcactttgtggccttttatgcatggtggggatgggtggtttgctgttagtattatagtttttcaccttttgggtttcattatgtttgcaccaatgagacttgtcctttaatattacttgaatgaaggacgtcggttaaaggtctgtgcccaaaggctggtttcctgctgccccagcacagcttctggtgacccggaagtgatcctatgatggggaaagttggaaggctgtaaacatcccagagttcctgttggtacattgaattcattggttggtgacccggaagtgaccctataatggggaaagctggaaggctgtaaacatccccgagttcctgttgggacattgagttcattgccatcctgatgctccacacaccaggcctaaagtggctgcgggggtggggaaggtggcattggtgccagttagcatacttctcaggattcacatgctgacaggtgtttattttttcttgatcaaaacacaacagaataaaaaccagagggctttaaactgaagtatatcgtgcccttactgtaagctcaaggacactgcatctccatgggttctaaacataagatctcccaccaaccctgcgtccactctgactccagcacctgatgaccttgttggggttggagagatttccctctcagcatcatctgtgtgtgctcatatataacgttaggctaagaagatagccccccctttttttatatagagctttgccatttgcttccacaatgcaatctagattatttctttggtgtcctcatatgtgttttccattttaaaggtggataaaatgtggaaatagtacgttaccctaagaaaaataactagaattaatcataaaagcaactgtcttgtatttatactggaaggacagaattaaaaacaaccaactaacaaaagaaaaccaaaattgttgctcagataggcaaagagaggggaaatgtaactgtaatgacagattcaatttctttaaaaataaatgttaccaatattatccctaatgctattttatttgcttagaagagaatgctgcattaagcttcacctttatatgccactattataggtctagatttgttatcaaatcacttcctggaaaacagacaaagcaatacctaacaatcacttgaaatgaataatcagatctctcaaaattatactacatttttttttcaaatcaagataattgtaaggaattgacattgaaagtagagacagcttttgtagtattctgtttttcaagaaactaggttatctttttaccaaatgcagacttagcccttcccctgatagttgtcttaatagaagtcagttgtatactgggaatgtttttatttttaaaatgatactcctggctgggtattgcggctcacgcctgtaatcctagcactttgggaggccttgacgtatgtatcacctgaggtcaggagttcaagaccagcctggccaacatggcaaaaacccgtctaaaaacccctctactaaaagtacaaaaactagacaggcgtggtggcacatgcctgtaatcccagctactcaggaagctaagacaggagaattgtttgaatctaggaggtggggcttgcagtgagctgagatcgtgccactgcattccagcctgggtgatagagagagactcgtctcaaaaaaaaaaaaaaggatactcctcaaattatgcctacttgtaatttggagtatggtcgctttttcctgtgcacaagttaaatctttgataatcttaagaaaagcatgattttagcatggagtgaggattatgagatttgtttctgtagccgattgaattgttttgtttctaagtggttgtatatcaaggaatatcaaataactatatctgtcattttcgtgtgtctgtttttccccacttattttttaagccagttaaatgccttgctgaatgagagtgaggggaggaagtgggggtgaaatgaatgctttttagaacttcctcaacacatttagttcttttcattctttctttttttaaatagagatagtgtctttttttctttctttctttctttctttttttttttctgaatagagatagagtcttgccatgttgcccagactggtcttgaattcctgggcttaagcgatcctcctgcctctgcctcccaaatagctggaactacaggcgcacactactgcacccatcttttagctcttgtttgctagatgtatatggggctatgatggagagcccagcattagcagtagagggtagacatggcttattaaaataaatgtcaagccttgcttggattttgttttacccacatcagcaccccttgaggctaaaactttctgtaaatctctctgtaaaacagaacaggattatgaacatagaacatggtttatcatgttctctgatgaggagaattgcatgtggatttagaggaatccccagccaggcagtctgggactcagtggctggtagggggcttaagtttataacactgtggtcatggcctaagcaagtagcaagccttttccacttccctactcccaccgcatcttgttccacattgcttcttcaaaggaggcagcatggatatctcttctttgccatgaatgaaggtggtgatagacaaaccaccacttagcatctctgagacttctgtggacaattgctgtaatgtgtaggtggcaaataagatgaggtcttcccactactgacccagtattctttagcgtttttctagtgaattaattttaggtagcaacttccttattctacttgagaaaatgtgaacagaggagtgatactgtaaaatacatacttggtgttcaatctctttttctggtacataactcctaaaatccttagaatctccaaagtgatgtcttttgtatgctaatgaactgattgatggcttgcagaacctaggtagcttcagaattacttctggtcacctaaaggacccaggcaggaaaagagggttgagattttcagccccacccccaacaccccggggagggggagagggtctgaaggttaagttgatcactcatttccaatggtttattcaatcatgccaacgtaaggaagcctccataaaaacccaaaaggacaaggttcagacagtttctgtatggctgaacatgggggagtggaagtttctaaagggtgacatacctgagtatcagatggtacctccttgtaccttccctcataccttaccctatgcatctctttatctgtatcctttgcaatatcttttacaataaaccagtaaatataagtaggtgtttctctgagtttcgtgagccactctagcaaattaatcaaacccaaggagagggtcatgctccagatcctcgcaacttgaagctagcctgttagaagttcccaaggccctacgtctggactggttaccagtgagaagtagggggcagtcttgggagactgagcccttaaccggggaatctgaggccatctgcaggtaaatagcattagaattgaataggaggacaaccagctggtgtctgctgcagaactgattgcttgcctggtgtgtggggagaaaccctcacatatttggtcacagaagtcttctgtgttaatgatttgtgtggtatcagagcagagggaaaatcaagtttgagtttttcctcactcaagaggacagaaagattttgaatgctggaatgataggaaattatgcttgaatgtgtttcaacatggaagtcatttttgttgactgcatcacccacgggatgttagcagtaagctatgcataaatgatatttttatcagctttgcacagaacgataggatatagaaggagaaaaccaggaagcttacagaaaaagagtgtgaagattgaagaaacaccaccttcacttaggcagggcacctgtgttaagagaaaataccctgagataattcctatgttccaacgaatgctgtaaattagtgtttggtaagtatctgtgtttccattcatttttatgcctaaaaaggtgtttatactgcaagaaacacattgctaaattggaatttaggctgtttttagaagatcatagattgctttttccttcttgcagtttctccttgcacaagctcagctacatcagttgaacaaaactttgtgttattttggggagaggagacatttatgatgtggatgatcattttaggtggatagctttttttttcttcttgatcttatccagcaattttatattagttcttgatggaccctttttaggtgactttttatactctgtttttcttgagtgaattctgatgaatgtttactccatttttgtgcatgttacatggctagaacttagcatatgcatgtcagtcaagagtaatggctattagttttgctattcccagcttggtagtcttattgttattttgaaatggagtcttgctctgtcacccaggctggggtgcagtggtgcgatctcagctcactgcaatctcttcctcctgggttcaagggattctcctgcctcagcctcctgagtagctgggattacaggcatgcgccaccacacccagctgcgatgacaggggcacaccaccatgcctggctaatttttgtatttttttttttatagagatggggttttgccatgttgcccaggctggtcttgaacttgttgtcttgagctacccatccaccttggcctcccaaagtgctgggattacaggtgtgagccactgcacccagctgacaatgtcttgaaattagtcaagggtcaaatttttgaggacctttaagatattgggtctactggtcagagcaagagacatatacatgaaatactgtttaaccaacctcagggaactcgcatggagtatgtgttttccttgattattagattattatgtcctgaagtaacttgaccaaagaataaatcctttattcttcagcaagaatcaagtctctcccatgccattgcaccttttctcctacagacacaaattcttagataacaaggtcatggaatcataagaagtggctggaaccttggaaaggaaccctcgaatcttcctctatcatcccccactactcctttatcaaccctttggctgtgtctagactgaattcataatatttcccagaatgtgcttttggctactagcaaattttggcatttcatatctttatgaaatcttttacatacaaagcctatgaaatatgcaagagtttatatctaaagtatctgttcggtgggagttggcgtgtcattgaatctcaggtgttaaaatacgtttttatatactccatgttggaatgatacaaagtttgttaactgagggaatgagttaaaatatgtaaattgaaatgttgcaaatatgctcataattgtaaaatttctttttgttatgattattaagcaggtggcagattgaaggataatattctggacattagaaaatatttgtagatagttgataaattttgcatagatatgtagaaattaaggtataatacttttttaaattgttctttcatttagcaacattttggggttactattttccaaggatttcagtaaatgtaggggattcaaagttgttgtatgtggcttctgtcatcaagaagcttacagttttgtgatttttttttttaatgcccaagaatctagttaatttttaaagtagctaatggatggtgtggaaaatgtgccctctattgttaatgatagaagtctttaaaagcactgatgtagtaaccccccctggggttcagggtccacttggtgtccctttgaagggtcatgattcagaagcccaggcctcttctccacacttctgactgattgttgaaggagtaagttttgctgtttgatgtcttctctccagttcttctttattgacttttcctctgtgtatagtatttgcaaaagagtagaaaacattctaaagcactgtgatttaacaagaggtacttggctgattttagctgaaggctcttgtcaggctcttgaggtcggatctagcctttcccaagttgctctctcctgttcgctactgcacagctgttactgagttggcatctagcctctcgagagcagccctgaaagtgaaatctggagctagtgttcagctgatggagtcacatggggatttatataacttctgatcttggcattaccaatcagcttctttgtcttggttagttttatggtttctgtaaaccatgggaatgtttctcaaagtggttcccagatattagcctcagttaatctgaatttgtggcacagttccttctgtcgtcactggcaagcacagttggagttggtggagtgaactgctttttgtctggttttccaaacagttggaaaagtttgtgtttgacaattgcaattgcaatactgattgacacccccagcagatgtgaggaaaacaaagttaagctgacttatataacccaagtaacaagtggtcaaaggcagtgatagatgccttctcttcatcttttatggagatactgtcccctcatcctttaaggctaggaacttggtcattaaaatagtttttagagcaaggtgtagggtgcagatgtggcatcatttaaatggacagatattaagttttactgtgtcgtgcatatgtatgttggaggttagcattgaaaacaagccttcatgttcagtgcatactcatattggatgacaacattgttctaaattgtgtgataaggatttttctcaaccctctagtcatcctgtcatattctgaaggaatatggtgcctctatgagcacatacttcttttccacagtacgcaatcgtccatgtatttttcaaaacaacagtaacaatagcaaaataccaaaaaacctcacttacaaattgggaagtgttattactaatgacaaatcaatggctttcattatcccagatctaagtaggaaaggaaagggtgcacctgccctgtttcagacacttgctagttcctgcattggctcacctctcctttgctcgtagcactcattgtgagaaagtagatcagtcaatagtactgagcttttcttggtttgaactctttttatttgcagtgttatcattaatttttttcttaggaagtaccaggaaaagataagaaatttatgaaaaatgcagatggggataaaatctatgtccaaagagttagaatagaggccaagaaatgataccaatctagagtttcaggatgaatattgacatagtaaaagtcctagacatttacaaatttgtcctgatattttattttgtagatgaggaaatttaggtttaggaaaattaaatgattgatacaaggttgtgcagatagttattggtagagaaagtctaaagctcttttcaatattaaaaataaataacaaaaaacatggaagtgagcaggcagcaaactgctgcagtttgctttgggcagtcagcaagagaaaaagaacttagattgagtgtaagcaatttaagatagagttttccataatggaaactcttaataatgggatggcgtgctttgagatatcatgttgaggaattatctacaatataagatatttttggtatggtcctttcctaaaaggtgggagggaaattgttggaggctctatccaaccattgacagagtatcctttgattagtagtgatacggttttgctctgtgtccccacccaaattttatttcaaactgtaatccctgtaatacccatatgtcaagggagggactggtaggtggattctcccatgctgttataatgatatgagtgagtgcccacaagatctgatagttttataagggtctcttccctctttgtgctctccctctctcctgccgccatgtaagacacacctgcttccccttccaccatgattgtaagtttccggaggcctccccagccatgctgaactgtgagtcaattaaacctcttacctttataaattacccagtctcagatatttctttatagtggtgtgagaaaagactaatacaagtagtatcctttgttagtagtatcctttgattaatagtatctgttatttactacagtgttccttgaggatcttatagttcagagaaggaaattattgatgaatataaatgaataataaaattctaagcctccaactgactgaatggacctcgctctaggccagaggacccaaagaaacctgaaaaactagttcatgctatgaaaagaagtggaattggacatgttccgttacactctcctccctttggaattcaggcacaattggccagcatacacattaaaacagaaatctgaagactgacaaaacacactgtagcaataagataccaaattcagacctgactctagtatagcatcacatgacagataacaggccctgaaagaaattgaagcatcttaccccaaaatatatttctttgacatattttgaaatggctctgcaaagctacctcttgtggggaaaatctacattttgtagagaatcccttacccactcctagtcttttccgaattgactaaggtttggcatctttttaggactaataagagacatttaccatctgttatctctgaaacttgctacctggaggcttcatctgcataataaaaaccttggtcttttcctttcccctctcctcctctcccctcccctttcctttttcctttccttttccctttccctttcccctttcctttcccctttcctttcctttcctttcctttcctttcctttcctttccaacagggttttattctgtcacccatgctggagtggcgcatcatggcttattgcagcctcgacctccagatgatcctcccatctcagcctcctgagtagcaggaccacaggtgtggtccacaccagtagctaccacacctggctaatttttgtatttttagtagtagagacagggatttcaccatgttgcccaggctggtcttgaactcttgggctcaagtgagtcttccttcctcagcctcccaaagtgctgggattacaggcgtgagccactgtgcccagcccttaactctttcaatcagaaaaatctttgagtccacctatgacctggaagtccccctcccccaacagcttcgagttgtccagcctttccagatcaaaccaaagtataccttacatgtattgattgaggtccttctgtaacttctgtccctctaaaatgtataaaatcaagctgtaacctgactaccttgaacacatgttctcaggacctcctggggctgtgtcatgggccttggttactcatatttggctcagagtaaacctctttaaatattttacagagcttgactctgctaacataataaagcactgataatcttaacatctcactttgtcctctggtcttggcctccttctccaccatgaagagccgtgatgaggactgtagcaccgtcaggcagactggtcgtactggagttctcttcttttgatctgtggctaaccaacacatccaggtcaataatagacctgtgggtcaccttagatctgtaagagatttgccatggacctttgcagttagtggcttgactttgttttgaattgcatagtgaaatattctctaacatatttactagcatttgtaagtagatcatttgtggaaaaatgacgataaaaggtacgaacccaattagtatgagttaggggcatccaggtgaatgattgttctataccagtcatcagcatcatacaccagtcggactctgttctcactcctctttcatgaagacattgagtgtgctcaggattagaaacaggagattttcccataaaattacatatattttaaacaattaaggcaaaaagttatgatgcaaaagctagggtgaacttttcccatctctatatatgcatatttatatatgtgtatatatttgctattattattccttttgaaaatgcttctgaacttatgcaggtggagtgcccaggcttttgaagcagggttgtttgtctggggtaatacccgaggcttgttgcctcacaccaaggcaatcaaagacacggacatggagtgaggttaagagcagaggtttaacaggcaacagaaagtgaaaagcgctctctcctgcagagagaggggcttccaagtgggtcttctggttccatggtgaaatgcacggggttttatagagtagcttgaggaggcggtgtctgattttcacagagcctaaaagattggttggaccaggtgtgccatttgcatagcacatgaagaagctggccgcctcaccctaatcttttattatgtagatgggttttctacctggcctgcatctccttgcctccttctttactgcacacgtggcaacaaagaaaagggaggagggagcctccatgttgaatatacctggctatctatgtttgcagcttgatttttcaggctgctttgtgttagaaaagaaataatttgggggctgctttttattaaaagggaaatcttaccgaggactctcttacctcacagcctaaataatttctttttagctcctgtatcactttgattatcatacagcagtgtgcttgaacaaggctcttaattttttcagcagtttctggactaggtagtgtataaaccaagagcacatctcactttttcatcaactgtttactctatcacgttgcaaggactctgagggatagttaagatttaaatattcccagcagggagggaagaagtttggataaaagaatatctttccctctctctctttctctcaggattttatcattagaaaagatcattttgctcgatcattaaaactgccattagtgcttaagcacaagagacacattcgtttaccatatatagtctgttgttttcctggtgttttaattccctagagcaaaaaagtatttgaattccaggtattttcagaagttttggcattctgcagatgtgaggttgccgtcgtctaaggcagctagtagccctcttttgccagaagagttataattattagggatatttggagttcatttcttgtccagcttttcaacactacataattctctaatgacacaattctggagcactgaatattccataatccctcaaaaaagtgaatccaaatataattctcattgtgacccttggtttatatagcccccaaacaccttttattaataaagaaatttactgaaactgttttatgcttaagtagaaaaacaaaggtgacacatttgaaatttatatactgttcatggtcctgtttctcactggcttagtggccttgagtaccatactataaaccaaacttattttcacaatgataaaatgagcgtgttctactagatgtcatataaattcctctttgtctttgaaattatgactaaatatttttattttatatttaaatataataagtcaagtgttgtattgccccctctataaaagccaaaaaaaaaaaaaaaaaaaaaaaacagtgggtcagacataccatgtagaggatgctcacattgtttgctaaattgggataaggatctttaagtttccttcctactccaagatttcatgtgaaaggtactttcttcccttaaattatcttatcattgttttcagttggttggttgcttaggatagaaaaacatttcattttatatataagtaaaaccatgaaaacagtaatgctacttttaacattatcatcatcttaagatgatatggcattttatatttttcaaagaacattcacaggtaacattttagatcaaatggaaataaggtcaaatgaataacatggtacatgtatatgccaaactgtaattgttagattcaaggatggtagcattttaggcagaagacaaatctctttaattagaaatgcaggctgctaagcacagccagtaatgaggagagaagagagaagtcacacaggacatagtttgaatgcagtgctcttctgtccagatcagttggtcatactgtaccaggctacggggttatactgattgtacatcagcatatctatggtgtcatccatgtatgaagcatccttaggttaaacatgttgaaacatgataaaacgtgtcttagaattaacgaaatgtaatatatctctagagctaattttggaagccaatgggcaacagtttggcatttgaattactcttggtcaggttaaatgcttcatattaaatattgttggtcactatatttaaatatctctaaatggagaatgtgatatagtgatatgtggaactatatctgtcacagggtaaatctcaaaattggggttcagcccaggaggccaagtgggttcttggcttcacgcaggaaagaattcaagagaggataacagagtaaagagaaagcaagtttattaagaaagtaaaggaataaaatggtggctactccataggcagagcagctccaagggctactggttggctagttttatggttatttcttgatcatatgctaaacaaggggtggattattcatgagttttccaggaagggagtgaggaatttccagaactgagggttccttccctttttagactatataggataacttccagacattgtcatggcctttgtaaactgtcatggtgctggtgggagtgcctttagcatgctgatgcattgtaactacgtataatgagtagtgaggatgaacagaggtcacttttgtcaccatcttgattctggctggtttcatctggctttggctggcttccttaccacatcctattgtattagcagggtcttgtgacctgtgtcttgggaaactagtcctacctcaataaatagttgaaaaggtggatagtagatagaaaggcataattttcttcttgactattttaaggatttgaagtcttcagagaaacaaagaaaaagaggaaaagtcctattactgctagatacactatagtgaatgaaaaagacttttttccagtatgcctaaacagtattttgatcactgttttttttgtttgtttgtttgtttgtttgtttgccaggtttggggcaataaaatcacatgtgaaaaatcctcagagatttttaaaaagtaggagagactttagaaatcatctagtataccttcttcacattactaaatagtaaacagattcagggaagtaaatgctgtatttagggggatatacctaagttattcacaaagctagccctagaacctcctagctcctagaccaggacaattttaggataactaaatgcaaggacagtagaaagcagaaagatgattttttaaaattcttctgaattttaagtcttgtgaagtagatacttttgagccataggatattatgtgacctaggagaaattagagaagatttttaccaactcagaaaggtttaatactcaggacgtgaatccttagcatagacattttcacgttactatgcactaagggcttgagaaaatatataacatgaatattcatgaaagtcacttcagcacaggtccctctgaaatttcctacagaaaatggccttctttcattgaaaaggttttaggcttacagctctgtgaattggaatttgaaagttgtcaatgctgtgttgatttactcgagttactgatgataggagccttttggtgtattggagctcttttggatgtacgtgcagaaacccaactgaaactgacgtaagccaaagtaaagaagtgatgtgttattgactcacataagtgaaaagtctggggtagggctcaagtatgactttttccagggttgcaaactctgccattataactggccccactgtttcttggcagtgtttccttcagtgttggcttcgtatgcaggcaggttttccccaggtgtttccaaaataactctccaactgctattttcccctgctgtcacaccaccacaccatcaacacaggagacttctgtgaccggggtcaggggaggggttccccatacaccaagcatgaaccctagctgagtgtcctcttccaattcagtttcacactatctacctggagatagtgtcagatcccacaggttgggggctcagtccccacaagcccccagtaaccctggacaccagtctctaatccaggctcccagaacttctaaccaactggctttgagttggggttcccatgaccccctgtttggatttaatttgctggatcagctcacggaactcaggaaaacacttatttacatttacgggcttattataaagactcctgcgaagggtacagatgaagagctgtgtagggtgaggtatgtgggaaggggtgcagagcttccatgccctccctgggcaccaccacccaggaacttccacatgttcagctatccagaagctcctcaaaccaggactcttgggtttttatggaagcttcttgatgttggcattcctttccccaggctatagcgtgggaccctatctggggagggtcttaaaaaccacagtcagaaaggttaggcaagattagagtcctgccttggggcaggtgaaaggagggaggagaagatcagagagattctgtttcttgaggcctgctcctggggcggaacacacccaacattataacaaaagacaataggagttatgagccaggaaccaatacatgttatggacaaaaaactatacatatatatttatcataacattataacacaatgtggcaagaaggtcaccagccgctccagtcacacattatgccagctgtgagataggcagagagagctcctccttcctcagtttcattactggtatttattctccttgcaccatcctgggtcatgtccctaggaagatgggaggtatcggtcactggtacagaggtgtgagaggtgcgtgatcacctttatccaaatcaattgaactgacagtctggagagtggatggctccctctgaagaggaatatcaaggtgtctcaccaacagggccagtgtccatagggctgtccaaacaacacatagcttcttccttttgcttagatgtcaccgtttaaggatgttcgtgcacaaggtagtatttagaaatttagaaaataaatcatctttccacattcagtgcatctttgcttccagtctgattttgatacgggagttcagaagaaagtacctgggcagatagtgagggtaggggcatcctcggtaagattttccttttaatgtaaagcagcccccaaatggcatgttcagaatggcggctccatctgcccttctctctatcagtcacgtgtagagtaaggagcagagaagatggtgtccttagagtggaaagtctatttgcataataagattagggtggggtggccagccttctctgcaagctatgtaaaggtcactcctgatggaaccaatgtgttggccctacataaatcagacaccacctcctcaagctgaaatataaaatccagctcatccatcccagccggccttttcctctcggaatcccgtctctatcactagagagggagctcttttcctttctctttctttctctttcttttgcctattaaacctcctctcctaaactcctcctgtatgtctgtgtcctgaattttcttggcgcgagacaatgagccccgggtatttaccccagacaacgtaccgcttgaattttactagtccagtggaggctcccattgtcaaagccctttatagcaaagctcttaaagtgtgtttatttcctaaagtccaaggattcattgtcttattttaaaactaatgtttaatcactcactgtttttatgctttatcagcacttgttaaagataatttggcttgaggccaagagttccagaccagcctgagcaatatagtgagacgctgtctctaaaaaataaaaaaaaaatactaaaattagctgggtgtggtggtgcatgcctgtagtctcagctgcttgggagactgaggcaggaggatcccttgagcccaggagtttgagactgcagtgaactatgatagtgtcactggactccagcctgtgtgacagagggaagctctgtctttggaaaaaaaaaaaaagagatagctaagatagcttgtatttgtactctgatcagcctctttggaagcccttgtagttctgtttgaatgcctctctttggagcttgggcatggcatggcttaccacattgagcaatggcatgagaccatttctatgtaggcttctaaagggaaacatgctcctgttaatgtggaaataaattcagctgtaagtttatgtttgtcagggcccaggaagagtaagaatacagggtgagaacgcgtagggaaatgctcatttccattaaagcatataaatagagggaggttagagctgtcaaaaacaaatcctccccacatttagactgttaatataaattaagaagttgtcaaccgtgtatcaaggtggaaggaaagactcaacaaagataatgttgggaaagggccatgttgattacagaggatttatagactaattttgatttaggaaatgtattatatcaacaattgctgaacattttctttaattctagaagcaaaagcaactttaatctgaagtcactttatgcctgcttgttttgatctgttttttctttttatttttttgagacagagtctcgttctgttgcccaggctggagtgtggtggcacaatctcggctcattgtaacctctgcctcccaggttgcagtgattctcctgtctcagcctcccaagtagctggcattacaggttcccaccactacacccaactaatttttgtatttttagtagaaatggggtttccccatgttgacctggctggtctcgaactcctgaccttgtgatctgcccgccttggcctcccaaagtgctgggattacaggcgtgagccaccacacctggctgatctgttttctttccttttctttttatttttttgagacagagtcttgctctttcgcccgagctggagtgcggtggcacaatcttggctcactgtaacttccacctcctgggttccagcgattctcctgcctcagcctcccaagtagctgggattacaggtgcatgccaccaagcccggctaatttttgtatttttagtagagacagaatttccccatgtttaccaggctggtctcgaactcctgacctcaggtgatctgccagccttggcttcccaaagtgctgagattacaggcgtgagccaccgtgcctggactgttttctttcttttctcggttgttttgtcctgtctctgccaacagcattattgaattagctgggggttgccagtgcttcctttccctttcccatttcttttcatggggtcttgctatgttgcctcaaactcctgggctcaagcaatcctcctgcttcagcctcccgagtagctaggactacaggcatgcacaactgcacctggctttgtgttattcttttttagagaggtatattcttcactttgttggatgccaattttgtttatgaaacatttgaattcccaagtaaccttggtacttttacttattttaaaagtaattgaatcttcctctcctttcatatatttttggcctgattttttgcagcatttgctttcttattatatttgattggaattttgctcagaaataagatttgtttctgatgatttatttttggatgatttgattccatctataggattacatgacttaataactactagcatataaattcactcatgaaatagagaacctaaaacatttgattgtcaattttagtggaagatgcatacaaagtttcgtctcagttaccaccttatttcttgtggtcctacatattattttgcgagtggctattgctattaactgaaagataactttttgaatttttattttgtctagtagtagcactagtataaatattactgtcatctgcttctcattttaatttgaaagaaaacatcttttaatgattcctgccttataaaccctataatgattttctttcctaatttttctatgagactgcttgagaaggacggagaaggaaaagctctcgacactgtgaaatagcttactggaagagtaagcatttaagctcgtgcaaaaataattgtttctttaaaaactgccttttcgctacagctacacttttcttgtcatttccttttgctctccagttttaaattacacagactttcgtagagtgcccactctccctttctcacctattcattgtggaaagattcctgtcagggctaatctttaataagagaggcagttacagtaactatagggcgaagaagggaacagtaaaagttgagcccactcagatgtcatggacctgaaaggtgctggtgggttggaagcttcattatgctcagctgctacaagagatttcctctttttagattgattaagaaaaggggctcagatgacaggttaataggctgcccctcaccagccattgtggctcatccaggagtgggcacaccatgggaagaacacacaaaagagaaacattttgcagaacaaagaccactccaggagtattgaggtaccaggaggaaggtggaatagaaccttgtggcaatgaaggaaagaaaaaaatcattgttttaagagggagatctgctgctggctctgctggaagaaagtagagtccaggatatcttaggtgagtcttaaaactgaaaagtaacactgtaattgacaatagggagagggtgaggaaagatccagagtttctgtccatgctggtacctcaactacaaaacaggaggcttaagggttttcgcagaatctgagtagaagtgatacaaaaatgatacattggccgggcacggtggcttatgcctataatcccagcactttgggaggccaaggtgggcagatcacgaggtcagaagtttgagcccagcctgggtaacatggtgaaaccctgtctctactaaaaatacaaaaatgagccgggtgtggtggtgcactcctgtaatcccagctactcaggaggctgaggcaggagaattgcttaaaccacggaggcagaggttgcagtgagccgagatcacaccactgcactccagccttgacaatagagcaagactccaccccccgcaaccccgcccccccccccccccccaaaaatgatgatgtatcatttgaaaaaaaaatccattggtttcaaaggagaaatactgctttgggttgtgcattagttgctatttgactaagtcatgttttgctaaaagtatcttcaacatgaactctggggttattttcttgttttttatttcccctcatcagtcatcacccagagattcccaggctggaaattccttctttctttattcatatgaaatttagtttttgcttataatatagacttcacactgtttccttcttagaagaggatgttttaatgtaactgggtataagctgtattgaggcatgtaaaacaatgaaggaaggaacccatttttatgatgaagagacaggaaaatagagttgtgacactaccttagtactgagaggttttttaaagatctagtttggatttttgaaagacatacacagatgactagacattgaatgaatgtacatttttttttttttttttttgagatggagttttgctcttgtttcccaggctagagtgcaatggcgtgatctcagctcaccacaacctctgcctcccaggttcaagcaattctccaacctcagcctcctgagtagctgggattacaggcatgcgccaccacgtccggctaatgttttttgtagttttagtagagacggggtttctccatgtcagtgaggctggtcttgaactcccaatctcaggtgattcacctgcctcggcctcccaaagtgctgggattataggcgtgagccattgcgcccggccgaacaaatgtactcttagacatttttttaatctttagattgagcatctttggatatcagataccagctgagtttaaataactagtttccattactagatgaaattttgatgagaacctttagaaggttagtaatttctttgtccaacccaaatgtagtttttatattactcatagtaaatgccattttacattttccttcaagatttgtcttgcttaacagtgctgtctgtcttccatgagtcatactgacccagtacaaggtcctcgtgggtgatcagatctcaccaaaattggtttctgatgctgctgaaactgcatatgaccttgttcatgacctctggtgctactccaagtagcttggatatggatattagtattagtaactatattatggtacttcatagtttacaaagggctttcatatattttacttactttgatctttatggtaattatttgatatagttaaggagcaagtgtagattttttattttttaataaatgagataattgaatctcattgaagtggattattccaaggttgaccatctagaaagtgagagatttgatatttttaactcaagtgttttgactcctagttcagagttctttccactctagcattggcctcaaaatatcaagccctaagaaattctgttagttgcttcctttatttttgtgctttggctagagttttattggttttatttttaaatttgcatctttttactcactcattcaatcatcaaacactcactgaacatctgttatattccagggatgatgatacacacaggtgcagcaagaataagacatgaggctcattcttgcagagtacagtctaagaaagagagagtcaaaagcaagcaatgtgatgagggttgtgaagcgtggtcccagtgaggaaattcatcagtctactcttcgatttacagagtggtttacactttgatcctgtagaaatgcattttttaggcaacttagaacggtctttcttaatatgcctcaggtagtaatgggatggactaatctgtgtgaaggtaaactgaatggcagattgggaatagctctacaggactgtgttacatttaacagctggggagacgggcacactgctcccagcgtggctcttgccttccacgcactgccctggcatcctgatcttttttgtcttagacctgtgttaacacagacactatcatgatcagttatctgctggttccctctaagtggtctctaagtgctttgagtgcccttgttgccaacatttttagaatactcaactcagcatgtccaacttgttcacatgctagtagtgcattttatcttctcagccattcttcttcttccattttctatggtaataccatgcatttccttggtattttagagcttaaagatagtctctcatttaaagggatatcgtccaatgtttaagtcttgtcctcgtgtctaatctcaagtgtgtcctggcagtcctccctttactaaggcagttccctgtctcgtattcctcaaagcccgtcttcccttcccattctcagctgatttcactgagaaaacagaagcagttggaagagaacttatacatcctttcacccgccaaactcccagccactttacctttgctcctatctgaagccaccacctccacctgtgctttgatcccaggtggagatacacctatcccatctcttgcccaaatcactaacttcttatttgatcttttcaggattatttccatcagcatgtaaacatgtgatcatatcttcttaccgtccctcaagtgtatcaaaaacactgttgttggaactttctcctagctagcctatgattttctctctcacaaattcagattatgttagcagagggatcttccctgtatagcccatttaaaatatcaactcccattattgctctgtcctaccctactttattttctttataccaattccccaacagatgtgtgtgtgtgtgtgtgtgtgtgtgtgtgtgtgtatgcatatagatacattgtctctccctattttatttctacaaagacaggagttttgtctgtttcgatctttcctttccatagtgcccaaaatagtgcctgaaatgtcacagacagccccagatatttacttttttgactccatatcgtcttcagctactataccatttctttgctcacctttgtaaaacaagtcaagagttgtctgtacctgctgctctgctgcttctcttctcattcattcttaagtcccctccattctggatctcttccccacagctccactgaaatggcccttgaccagaccaccagtgaacaccacgttgccaaatgtaatggcaattctaaactgccttctcactcaacttccaggtagcattctacctggttgactattttttctctttgtaatctgtttagatcggttggcccctgactttctttctaccttagaggtcattctttataattagcctttgttgaattcctcccctctttccaacctcataatgttggtgtgcaccagggttcacttttagatcgtcctgtctttagttacctattcattcccttagtgatctcagctggtatcatgtctttatatatgttcttcacagggatgagtcctaaatatttatcttcagccatgacatttttcttgaattccagatttgcatatccaactgccaacttgatatctcacttggaagaacatcatcacaaacctaactcatctgaagttggcttcacattctcctcccctatcactaactgcctttcccacagtattccccatttcggtacatggtaccaccatttatccagttgttcagacctaaacccttctaattattctttttcctatcgttatcccacatcagcaaatcctgtcaattccatttttaaaaaaaatatatctggattctgaccttttcccggcacttccacaggtcacaccctaatagaagccaccatcgtcttttgcttggctacggtaacaacctctcatgcccctagcatggcttcctgagtggttcttttagagtgggaatgagtcatgtccttcctctgcttgcaactctctgtggctcccaaggtacttggaccaaactccaaagcccttctcagtcctccgtggccctctgggtctaccctgcctggtctctgcactcatttcctcctactcaactcagcccaccagcccatttgttcttcctggagccgactgagacatttcctactgcagagcttttgtgttggctgctctttcctgcctggaatattccacaggctcactcccagctttatgcagttcttggattagtgtcccctcatcagagaggtcatttacgaccatcctgtaatatatccaccttgatccttcagccctgtcgttagaattcctggcttttatcacgagctgacattacattttgtaactattcatttacttgtttatcaatctcctcccaagtgtaagctccatgggtgtaagaaattgttctgtctcattcacagtcttatgtgttgaatgaatgaatttaatttttacaaaaatagaaatgaggaagtaacaagtattcgtagtcttttatattctggtaattgtttcctgggtactttgttaaaattatattttgattaatcccttgtgacaatcctctaaggtggagatttcagagaggaaaaacattgcaatcccagtgactagtaaaaggaaagctagagagctgggatgcaaaccctgggtgtgtctattgcaaaagcaaatctctttccacttaatccatattctttatttattataaattataaaataatggttgggcacagtggctcatgcctgtaatcctagcactttgggaggccaaggtgggtggatcctttgaggtcaggagttcgagaccagcctggccaacattatgaaactccatctctactaaaaatacaaaaatgagccgggcgtggtggtacacgcctgtaatcccagatactcgggaggctgaggcagcagaatcgcttgtacccggagagggagattgcagggagctgagatcgtgccactgcactgcagcctgggcaacagagcgagactccgtctcaaaaaaaaaaaaaaaaaacaacaacaaaaagtgaaatagtaagtatacagtggatattacaaattattattatattattatttctgtctaatagatgagatcactgaggatgaagtgacaggtgagttacctggggtcatgccactagaccccaccactcatgctggaaaaaggacttcagaacctggttctgatttggcttcagtgggctctttttgtacaaccacaagatttctgcaatgcagatactttgtgtatctcactttatctgagcaacttttacgttttccatccattatattttaccccttgtaaactggcagaggctcacatttgtaagttaaacaccaagcttttcaaaacctagtcctaaaacttgtatcatgattttgcttcatgtgcaagctaacctttgatttctcttcacagtacctgtgtaaactgaatgaaaacagcagttgaactgaaatttgctgttttgcttgtacttactttctcctctgccaatgtacaacctaacttttatcaggaatagtttattgctcaggtatagtttgctggttcatccgttcattttcaggctggagaaaagccttcagctgaaatatctaccaattgcaagaaaagtgaggtaatttacggaaagtctacaaaaatagggagtcatggtgcctggtacaccagatgataatcaacatgttaattaaagaattatgtttataattagcctgaaagaagataatttaataggttggccaattacagagataaattggaggctgaaattgcaaacttatatttcactgtgtttttcaaaagcacatctatgaactgatagataaatgttatgtccatacacacagagctatgaaacccttctataaacatgaaattggggagatacatgtcaaaacatatcccagaaacaagattaaaattacttctgtgaataatgctataccatgccccatgtttttgctgaaaactcattggtgtttattctcctatgatggtatactaaatatctgtccagattactgttattttttttatttagtcttgagaatttgccctgtgtttgtgcaatacaagaaaaaatacacttgctgaaggtcattgtgttgtgcaatacaagaaagaaccatgtcttcaaaatcaccttatcttgaaataatagattttggatagagagatttaggtcttgaaaattgcttctaaaattacttctccatcttttcttgtgcagtatttggagcttatgcaataaaccagtcttttcagtatctctctttaaaatgtgatattttcagtgtccttacttaacatggaataatcgtacacagtggttttcttttcagaattttaacatggtttgtacaatctgagtctggtataggtctttgagaatgtctaccacttgtttattgtggtctcattctttagagaggaggaggatggttttcagcattctaaaatatgcaagcaacggacaccaatctgttatgtgtactctatacatatatttatacttacacatgggtctcatctgctctaaatatttaagcgtggtatgaataaatacatttaatgtttcatagacacataatatctcacagtttgtagaacagacaatgctctctggtgtaattaccaggctgatcctaaggggccagcctgtctggcacttgctttcatctctgaatactttatgcttatggataaaccaggtgacaaggagatgccttggagtgctaaattctgcatgtctcaatgtttgattttaactctttatgtgctaatgggaacactcattttctttaacagccatttctttgggcctgttctactttaggtatgagaggctcaggaaaactttcttatcctcagcacacacattatgatgaagtttaaccagagtcttgataagtgagcaatcttcaatgccaactgggaaattcagatcattcacaactgggaacataggcatagatttgattcatgctattttttaagtggaaaagagaaacaggtgcatttttgttgatgttactgtttggtgaatgtatctgtcgatgttaatctcatctcacatgaaacagacactgaatttgaatgtctgaaatatgtccagtctttttagatctgatatttttactcatatgccaactttcttatgataattgtcaaattaaatgctaaattctgatagctgcttccattggtggattccacatagatgacatctatatccaagccattttaggctcttcacttctttttatctttttctaaaagttaaaacatttcaggaccttacttagtttaggggatttataacataggaacaaaaaaatttcctttgcctcctggtttctgggaatctgtctttctttctttgcttagtatttatcaagaagtatagtttgccatcactacatattagatgacattcatgagggcagtttcaatttttttcacacattttgaaatcaaatttcactagacaatagatgggatctatcacgatactgaaatggattttccatgtgatcatatgggcacattgatcctgactatatcagttcttctgtgattggcactcgattgattgcaggattgtatctgcatccacaaattatttgtgtgatgttctagttgtgctgcttgctataccagtgtgtgtgtgtgtgtgtgtgtgtgtgtgtgtgtgagtttagcttttctttagtaatttcacagctctactattctatggcctgccaagggggacacaggagtgtggcagagggagaagtcagccaggtgatttggagtttattccctgacagtctttagaattgccttttgatgtggtttggctgtgtcgccacccaaatctcatcttgaattgtagctcccataattcccacatgttgtgggagggactcagtgggagataattgaatcataggggcagtttcccccatactgttatggtggtagtgaataaatctcatgaaatctgatgattttataaggggaaacccatgtcgcttgtctcacattttctcttgcctgccgccgtgtaagatgtgcctttcgccttctgccatgattgggaggcctccctagccacatggaactgtgagtccattaaacctctttttctttataaattactcagtctctggtatgtctttatcagcagcgtgagaatagactaatacagtaagttggtaccaggagtgtgagaacagactaatacacctgtgtatggtgattatagaaaggaaaccaaattttcatcagtagattaccatttcaaagctccctacaaagtcatcaccttcttgcctgcatctggggctggctgtgcccttgactccttcaccttccttggttctctgctgctcctcttaattattccgtttcctggattttagggtaacatggaaacttgtgaaagcggtaattgaagaggaagacactctgctggcttctgagccaataactttgttttatcaagtactttaatgaattccaaaggatatggcagatgttaatacattcattcttcctaaaatagcccaaaaaagtaggcttaactctagtatttttccatctctaaaatgcaaagtgagaacggtcgctttctcatcttctgtgctgatctccctcttccactctacttttttctcctttaccaaaaatttgagtgactttacttgaggctgcccttccttagtctaaattttaattacctattcatgatatagccaaccttctctttctcacctcaccattgcatcccactcctccattcaaaccaatttgcttggcattttctgtaaatttgtttttcatgtggttttgttgtcattgacactattcagggtgcatacgataagtctagagtctattcactttagctgtagcctactatctaaagatatttgggaaatcacaggactgtactttgtcttttaatgcagtgatttgatatcattgtaggagacaatatagtcttgaggctaggagcatagattttggaattgtgtgggcccagatttgtctcattcgaccacctgcgcatccatgagcaaatggcttactcttacaatggctctttctgctcatctgtagggtaaccataataatagtaatagtaattaactcatagagctcttcatttcttagccattgaccgtcgcttctgtgccagatgctgtgctatatgataggtataagttgataaataaaactaacatgaacctccctttgctatttcattgagataatgcatagtacctgggagtagatgcttaatgatacacctaggaaggaggtagttctagaatgtaatcaatggtagcttctttcccttttaaaggtatagaaagtatcattcattctttattctccaaatagaggactgaatatctactatgtgctgggtaccagggatgcggtatgaacgaggtcggcagagtctttcttcatgcagtgtgcgtgcttctgttccagaagacagtgagcaaggaaacagttgagtaaactaagcagttatagagtgtgatgcatgttatgaaggaactggagagataatggtgggaaggaaggtagggtgagaaggagaggagagggctaataaggtaagaccttaaaaatgggacagagcaggttttgcaaagatctggaggaagaacaagcaaagaccttgaggtagaaaagggctttgtggccaggcacagtagctcacgcctgtaatcccagcactttgggaggccaaggcgggcagatcacctgaggtcaagagttcgagaccagcctggccaacatggtgaaaccctgtctctactaaaaatacaaaaaaagattagccaggtgtggtggcaggtgcctgtaatcccagctactcgagaggctgaggcaggagaatcccttgaacccaggaggtcgaggttgcagtgagccgagatcgtgccattgcactccagcctgggtgacaaaagtaagactccatctaaaaaaaaaaaaaaaaagaaagaaaaagaaaaaaagaaaagggctttgcacatctgaggagcaaaatagcggtatgtgtggttggattgtagcaagcagagtggagaatgacgtgagaaggtgttatagatggaggaggaagtagatcatgcaatatgtctgatggactgtgagaagctgacttcctctatggccagagtgatgtcagggcaggtaacaggactacaggcagtcaggaggaggaagtcatcaggatgctgcctgggaatctggcattcattactgtttgcttgacagtgccacttatcaagataaggaactatgggggatggcaaaatttggggtaatagacctattaaaatgtgatcattattggtggctattcatgaaataaaggcatatctatatattcttttatgtacctcttggtttctgtgacatttaagaaaagtgttcaagactttctttgaagatggctcaagtttttatttttgctgcttcttagttggcaggaactaaaagtccaggtcactaaagattgctgatggcttgtgaggacagccctgagtgagactgaatcagttggttgacaacagactgtgacagaatgctaaggcgttaatttagagtttattggtgcagtatacctgctcagcactgatggatttcctgatttagtgtattaaagatgaaaaagtaaagttcctttctgatagaagtgtttatttctactaaactgggactagaaaagcattgatgaaagtttatatattcagagcaacattctgccttctgccttctgcttggccagctgccatctctgactgatggaaataaagtgagggctctgacatcatcttgatggtgtctggtatttgggtgtttctgtccagctccctttggctgacattaccaaggcacactgttaatactggcctcacaggccataatctcttatgtgtcattttgtatttaaacttttgcataagagtcatcagcacagaacaacagattacttctgtagctatattatttttgagatagaaaagatactactggaccaggcatggtagctcacacctgtaatcccagcactttgggaggccaaggcgggaggatcacctgaagtcaggagttcaacaccagtctggctaacatgatgaaactctctctctactacaaatacaaaaattagccaggcatggtgctgtgcgcctgtaatctcagctactcaggaggctgagacaggagaatcgcttgaacctaggaggcagaggttgcagtgagtgagtcacaccactgcactccagcctgggcaacagagtgagactccagcctgggcaacagagctctagaccatttaaaaaaaaaaaaaaaaaagagagactaccgtcaccttgtataaaaccacacacacagcataaatagttaagcctactaatgaaatatcctgtcatttcctctacttaatagaaggctacagataggcttatacagtaaacatgtgaaaggtacagttgacttctctgcttgaatttgcacatggggggaattcgttctcttcttttgcccttttcacagaaccgtaaaatgtgaggactgaaggcaccttggaggatgcccagttcatccactggtggggaactgaagactagacagttacacggtagttcaaatgcaatcatatcactgcaattaaaactatgagaagactagattattctgtaatatcaccacattaggaatatgaatcactgtcaaatagcagatgcacatcatatggatatgattgatgtgatcacatcacttcttttagagtctgtggatgactggtcactgtgtattggtttttagttcatgcatacaaggcaaagtgtgtagtgttgttaccttcttgttccccagtgatccaagatttacaaaaaatgaataagtggaaattggctaacagatgaaagtacatcaaagaaacaaaaagtgataacattgggaactggaattccaattgaacataaaggagttctaaaaggatgacctggctatggaaggatgacagtcctgccctttgactgcctgtaaatacgcacccagaggaacttagtgaaagtgagcttattgacgtgtgcaaggaaaatggttctgacccataggatgtaggtgttccagagtaaatgacaccaggtgaaaaacttcacattaaagaaccctcagagatatttcagcacgttgaaagcacaaaggagaaaattcccgaaggtgattcaaatgtaggagcatgacaatttgtccagggatagcaaagatgcttattccactgggacagttatattgtgggatgagtgaaggcaggtcacaagtgttttacaaaggaataaaacactttgatggggtgccgtgggtcacacctgtaatcccagcactttgggagaccaaggtgggcagatcgcttaagtccaggagttctagaccagcctgggcaacatggtgagaccctgtctctacaaaaataaaataaaataaataaaacacgttaattctcaatgtttccagtcttctaaattatagtgtactaagtacatttagttttattatttagaaaatgttgtctatacatttataaatcatagggagtttgtcatgtttggacaaaaattcttaaaggtcatggaacaatgataaacaatgtgaattttcccaaagcttgtctgaagacatttttatggtcctgtactagcatgcaaactgaggactgcctgtattttaaatgaataaatatagactgagtgaaagtccaaaaatattggcttcttttatttggaattatctcagcttattctgttaactacttatttgctttaacaaaaacaaaaaaatagcatagataacattttatttgtctgtatgacataaatgtcaaaagcaatgatgggataaatgagatcaacttgtaagcacttatcaccatgcctgcaacataactggaacttgataaatgcaacgcatatctagaatttgatcatttctctctacttccactgctaccattctgttttgagccaccatctccctccctgaatggttgcagtgaccccccttgggtaactgcttcttccttgcctttctacactctacatttagtacatgacccagtggctgcccatttcccccagtaaaatccaaaggtcttacactgacatcaaggctttccatggtctgggcccattatctctgacctcatctcccacccacttcccctagcctagtctgctctagctgtgaattttctgacgatgctaagtccatgctttcctgcctagagggctttcaccagctttccctctccctggattgctccccctccactggtgctcactccaccgggacggttatattgtgggacgagtgaaggcaggtcacaagtgttttacaaagaaataaaacactttggtggggtgccgtgggtcacacctgtaatcccagcactttgggaggccgaggtgggcagatcacttaagcccaggagttctagaccagcctgggcaacatggcgagaccctgtctccacatcgtcatttgatcaatttctcattcctccttaaagtctttgctcaaaagtcaccccctcaatgaggccctggcaattctgttcaaaacctcaacttcccccaggctagtagcatctccgatccccttatactattcttttttttctttccatagaacttttcaccttctaagattttcagatttttagtttattttttaaaatttgtcctcttctcttgctagaatgcaagcctaatgagttcggggatcttttgtttattaggcaatttagctcttataatatttcctagcatgtattgcatctgagtgaatatcttttaaatgatgaatgactatttgaaaggaactgttgatgttgtttgagaattgttctccattctgtactgttccagcagacttggcaacagtgattgtagaaatcatgtcttatttactcatcacaaaattgtcagaatccagtactccagttctggcctttcttccataaatattagatctctgttctaaagagtttttttttttttttttttttttttttatgatggagtttcactcttgtcgcccaggccagagtgcaatggcactctcttggctcactgcaacctccgcctcccaggttcaagtgattctcctgccttagcctcctgagtagctgggattacaggcacacaccagcatgcccagctaattttttctatttttagtagagatggggtttcaccatgttggccaggctggtcccaaaatcctggcctcagttgatccacccgcctcggcctcccaaagtgctgagattataggcatgagccactgcacctggccaagagttttatagtcacaggaaatacagaaaggaattcaattcaacatatattgactgaacattttctatgtacagttgtctaaaatggataattagtaacttaggttttcactaaagcatttattttcattaagccactggtttccgtggagtttaagctgatgtgctggagagataaccacaggataagatacatatagtgagctttctgagttgatgctaattatggaaaaattctcaggacataacttagaggaccagttacacaaagcctaaacctggaaaaaaatctcggaagactggaggagtaagagtttagggaaaatacttggcatgatgtgagagattttttttttaatgactagagttattaagactatttattgagttttcaagagtataatatatgactgattcgtttagattatgtacacaaagagcattgttttacttaaaataggggaaaaagaagggactgcattgctttttttcagtgatgcattgggttttatattgaggctgtggatgcttatgatacattaaaatttgtcacagcaataatagacaggatcggtaattttcctccaatattgccctatttcctggctgcatgaaaccatgaaatcacttaatgggatcatacaataccagctttgattggaaattaaataagatcttaccttggcagttctaaaaagagactccatctgtcagcatggcagcatgtatttatgaataatcttaaggtggattgtgataagcaatcacttattgagttcataacatttgcaggcacagtgttagacaatagagatgtactggtgagcaaaccagaccttgttcctgctctcacacagatcctaatgctattggaacccatagaaatggacagaattgggtctaagtaactgcaaagaagtgatttctgtctgcaagtaacatcactgtcatggtttatgaattctgttccttgttattaaatatcaaccaggaaactgatgtgaaagtggcatggggagatactaaataaaatgcgtaggctcacccttgagtgcttcaagatgtttgtatgggaggaatggagtatcttttgtttgattcttatttgttgtaatggaaaggcagaagcccctctaaataccacccccttgctgggatcaaattggattagaggtcatctatgtatctatttaatagatattttttgattgagtgcttcctgtgagccagcattcttacaggctttggtgatcaccattagtaaaagtgacaaggtcctttcccttacagaacttgcattctagtgggggaggctcagaaaaatttaaaaaaagcaaatagcatataatatagtgtcaggtagtgataataaaggggaaaaaataagagaagggactcagggtgataggggctgctattttagatagggcgaccgtggaagtggttttctgtgtgtgtgacctcacaggtttgtgagcagcagtcaagctaactttgctcagaattactaaatgtacaaacacacatgcacatgcacacacacacacacacacacacacaggtgcatacacataggctttcccataattcacccctcaacatgtccccattatatccccctcttccactgtcgccacccctgctatccctaagctttgggctttctctgtctcctgctttctacatctcctgattctttgaaggttttctattttctttctcttgttctgggattagccggtgtacagtctggccaagtgtgaggtccctaggcatccctgaatgccttatctactttctttgctaactaaggcttgtatatatctgcattgtagctacagttccttatttggccaatcctcagtatgatgatttggggaaggcaacatttcttcactattgagaaagatctcatgttgagctttgtttttgaactgcaatgtccaaagtgggcaattcaatgaaagggtagtgctgatttagtggtattaacttattacaaattttgggcattgtttgttcttatccattcattcaactactattgattgaggcccttttatatacctgacattatgctagatactggggctataattctaggtaaaaacagactcagtttattttttattattattattatttttttttttttgagacggagtcttgctcttgtcacccaggatggagtgtagtggcgtgatctcggctcactgcaacctccatctcccgggttcaagcaattctcctgcctcagcgtcccaagtagctgggattacaggtacccaccaccatgcctggttaatttttgtatttttttttttagtagagatggggtttcaccatgttggccaggctggtctcaaactcctgacctcaggtgatccacctgcctcggcctcccaaagtgctgggatgtgagccattgtgcctggcccagactcagtttaataatcagacattaataattacacaaatgaatgcatgataacaattgaagaaactaaaagagaaaatacaatgttatgggagcacaaaacaaaagaattaatagcctggtgggtccaatctcaacacagccttgaaaggatgcctgggttgagatttgaaagatgggtaagtattaactagagaagagagaaaggggtttaatagtgcatgcgaaagtcctgtaggagaaaaggcatgaaggaaggttggttggagatattgggctggtgccagaccatgcagtgcagagccttgtaggctgaaggatttttttgattgtttgtttgttttttgagcgggatcttgctcagttgcccaagctggagcacagtagcacaatctcggatcactgcaacctctgcctcccgggttcaagagattctcctgcctcagcctcccaagtagctgggactacatgtgcacactaccacacccggctaatttttgtatttttagtagagatggggtttcaccatgttggccaggctggtctcgatctcctgacctcaagtgatccacccgcctgggcctcccaaagtgctgggattacaggtgtgagctaccgcgcctggcctgctcaaggattttttggcttttatctttagagcaattggaaaccattgaagggttttaagccagcatgccgtatagtacagattgatggtgtggcctcaagctaaagctccttggaagggagtgtgcagtgtggagaaccattcagtggattttgaagatgtcaaaatgagagataattgtagcttggactaaggtggtgagaaattgatggattggaaaagtgttgatggagtagaatccacaggacttggtaactccaaggtggatgtcacccttttgttaagtccttccatttatctgattgctcttgaggtttcttttaagtggttgattatttattatttcatccagaatttgtataaagaaagatcaataaatttgtttcttcatgtttgtttagtaaagggtgagtatttaagggtgctttcagtgcttctgggccaaggtgaaaaaaatgatggtcatcatgtgcatttcagcactcagaaacactattggcacaggcaaccaaaatgcaaaagcaagacatatgaattacaagtctgcacctcagcggctgaatagcaaagactaattcggaagaggccttatgacccaggaagacatactttaattaatatctttattgtcctgtcaggtaggttaaccctctggatcccatcagtatttggcagtgttggtctttattcttggaatagaaactagattgtgtgtgtgtgtgtgtgtgtgtacatgtatgtgtgagcatgtgtgcatgtacacaatatcctcatgtgcatttcatatatatgttacctaccagatgtattacatatggataatcataaatagaaaacattaagctatttatcaaaacctctcaaatgcctactctgcatgctgtcagaccacagtgattctggagaggaagtgtgctctgagatgaatgatggggttaattaaaggcaactggaaggtggcttgtgaattggtgtttggttcattaaatgttcagtatattttactttctgtccaaaaggaaccttttgattactggaaagtaaaatagaagcagctcctgggcaaactggcaaaagctttgatgagtatgtcagattaggttgtatcattcaaagttgaaccacgattgaaagctgtagctatagcctctctccttggtggtatagcagagctctcctgaactgaaccatgattgaaagctgtagctatagcctctctccttggtagtatagcagagctctcctgaactgaaccatgattgaaagctgtagctatagcctctctccttggtggtatagtggagctctcctgaacttaatgttgcttcattaccatgcactccatcatacaatgttaagggactggattgaagtgaaactttgcgtaagtgagttggtctcatacattggataggatagcttaatatagtatttaaatccattcctttcccttagatgattggtacatctcacatactgatgggcatctccacacgagctctaatttctgatttgtccaaagtgcacaggcttattttaatatttgactgttaaagattgtcttcaaactcctataggtttcctatatcatatatcaaaaagatactcatatctggctgggcgcagtggcccacgcctgtaatcctggcgctttgggaggccgaggtgggtggattgcctgagctcaggagttcgagactagcctgggcaacatagtgagaccctgtctctactaagaatacaaaaaatgagcagggcatggtagcgcttgcctatagtcccagctacttgagaagctgaagcaggagaatcacttgaacccaggaggtggaggtggcagtgagctgggatcgtgcaactgcactccagcctgggtagcagactgagactctgcctcaagaaaagaaaaaagagaagagaagagaagaaaagaaactcgtatatttcttaggatccatatattttctgggtccctttctgggccctagatcctcatctaacaagctctcaagtgtggctcatattgagagcttcttagaaatgcacaatcagccccactcaagactttcccaatcagaatctgcaccttagcaggatccatgggcgataggatgcaccttacagatagagaagcactttaacatacatggtaaaatcaattgagtctctagaagcagtgtgggatgggattacagactgaattatctgaatctaattcagatgaattaggtttagtgatcaatttctggaaatatgtctgataagccctctgtgagtaacaagttactttatgtctcattttcctcatctagatatgtgtgggtcctctttataccacaggggtagagtgaggattaaataagttaatgccaggatgggcattcactgtacttttggtaaagacggtgtgccttctcttcttccggggcttactgagtaagctctgttactcccacttgtcccatatatctgtggttttgtttttacctcatcttgctgtcttctcttattctcattcccaaactgtctttagttagttattaataatgtattaaattgtatttagatagcctctagcatccaaaagagtaagagtgtagttacttacccaagagtgtagtttgcatgttagagttagttccatagggtaggtgagacaaaatagtaaaagcctctggggatttgataaggcattgaacacaccagcacaatttttggttctttttttattacaccacaatatagctttgatcttgcagattatataagctccaaagtacttcatgattgtttttattatagccacactgcacatgaatttatattcagatatacccatcctatgggaataatgctatttttttagcagattattttttaaagcaaacaaatgaatgttcactggaaatcagtgagcacctggagggtcagttaggaggtggttgttaaaaatattgggctttgcctgtggctggtgctataagctacgctattaaatattggtgctaccatataggaaataaaggcaaatacagccgggtgcggtggctcacacctgtaatcccagcactttgggaggccgaggcgggcggatcacgaggtcaggagattgagaccatcctgaccaacatggtgaaaccccatctctattaaaaatacaaaaattagctgggtgtggtggtgggtgcctgtaatcccagctactcgggaggctgagccaggagaatggcttgaacccaggaggcagaggttacagtgagccaagatcatgccactgcactccagcctggtgacagaggaagactcttgtctcaaaaaaaaaaaaaaaaaaaaaaaaaaggaaataaaggcaaataaaagcattaccaggattttaaatacaaattagagtggcacctttccaatttatatagcatattctttttttttttttttgtgagacagagtttcgctcttgttgcccaggctggagcgcaatggcacgatctcagctcactgcaacctccgcctcccaggttaaagcaattctcctgcctcagcctcctgagtagctgggattacaggcatgtgccaccacgcccagctaatttttgtatttttggtagagacagggtttctgcatgttggtcaggctggtctcgaactcccaacctcaggtgagccgcctgcctcggcctcccaaagtgctgggattataggtgtgagccaccgcgcccggccatatagcatattctttaggttagctaaaaataaaaaaaaaaacaacttgccgtctgcttttgagtctttattcccatcacctctgccctgccatactaccttggtgaagggcttctagaatatacttgtgtgtcctttttctctctaattagaatggttgatgattatattgctcttttactactctgttatgttttcttttgtttccttgaggttgagatgtcaaaacacgtaaatggtcagactttttaggcccttgccacgtagaacctgtgttttccattttcttactgtgcatttggtgccttttgtatgctagtcattatgtaaggtgctttatcggatttacttcgtcattttagaaattcagtactttgcctcagatcatataacctagtacatggtgagctgggatgggaatccagatcttgcttgtcctaaagtccgtgattcctgcagcactcccactgcctgtattgagtcattctaattttcgtctttccccatgtacagtttcttcagtaaccttgcttaatgaattgattggaaacctgttttggctttcagaggactgaaataaattgtctctccatacatttttaagcaacccaggatcctttctgatatgatcaagcaactaatgcttggttgaactaagatgacttttaccatcactttgaagtgagaaagttctgttattgacctgttttcctgtgtgagttttgaaatgacatgtgtgcctgctattagaatctgttccgttcttgatgatacttggtgtcctagaaatgtgtcagacaatttcttgttaattttgatgactaaaatagtgacgataatatgaaaatcctgtattttacttttatttgttcaggttgcctctggggatcagtcagtacagtcagaaaactactgattgccttgaatggccgtagctcccctcttttcccctactcagttgcctttttgcaaataaaaagtacgtgagggattgattccgtaggggtttcttttggttgtttttttgacagtagtttttacattcggcacagatttttaaaatgcactaaaataatgttcttcaagatatgatttggactgtgcagtcatgtcacgtctcacttatttttccctctctttctccccctttgcaggatgatgaagtggttctgcagtgcaccgcaaccatccacaaagaacaacagaagctatgcttggcagcagaaggatttggcaacagactttgtttcttggagtccacttccaattccaaggtgggatgaagtctttcaaggctattcaaatatgcaagttttactagtggcattgaagttatttatgagctctctactattttctgtggaatacatactatataaatgaaagggatataacaatgttttccatctccattttgctgatttttaattgagtctctcctgggtacaaagaactagggataagattattagcaagaacacagaaagtccttgccccatgaggtttatattctagtagaaaagcaaacaagtaaatcagtgatataatttgaaaactgataagggctaggaagatttaatggattattaagtttgtaaaggaaccaatagtcttaggctcattgtatttttttataagatagactttcaattttccatattaacgaaaagtcaaaactctaaatcccagttcatgtttaaaatacgtaaacctgggtctagatgcagttcacatagatatatctggatttgactttcattggtagaaaatgggatatggcttttttttttcctcaaagtgttatctcttgcattgatcataaagggcaaaggacagaaagattgttggtagtaagtagtcagatactgtaaattatagatatactctttgaaatgagcccagcaatatcttaagctacagaattttaaaatcaaaggcagaactaactttttgagacaatcgctccgaggatatttattcttttaggctgatctttgcctaaaagagaatggttcataatatcagcatagattttcttgcagaaatataaacacttaattctgttgatatgttttgattaattattcctgattcctaattgtggatatttactgtatgttctgtatatgaatgaattttcatctgtgtctctatatttcagaaattagaagttgaggttttgcttttaggaactattcactttgagacagacctaccttgttattattaaaaattcagggagaaatgaagccttatcaaaaaggcatagtttttcatctctttgaatctccacatgcaaccagaaagagctatgaagagggtaaaactcacagccacagacaatacagtatctaagacaaactaagtggcaagttattcctacgtatggtgtcagtaaatgtataggaggaagtgcaagagaggtgacatgatttctattgtctctgaaagtcagtgacaaatccttgctggaaagcctggtgggccaatgtgaaaacagtaaccactccaggcacggtgtctcatgcctgtagtcccagcactttgggatccaaggcaggcggatcacttgaggtcaggagttcaagaccggtctggccaacatagtgaaaccctgtctctattaaaaatacaaaaattagctgggtgtggtaatgcacacctgtaatcccagctacttgggaggctgaggcacaagaatcccttaaacccaggaagcgaagattgcagtgagccaagatcgcaccactgcactccagcctgggtgacagagcaagattctgtcaaaaagaaaagaaaaagaaagagaactaagaggaagcaaaggaaccatggcatagtgaggtgagacgtttctggagtaaccttggccctatggacttttatagctaactatgtaaaactcccttacaggtcaaagtcctcctctgaggagaaattgcaggggcgatagaggcaaaggatagagaaggatcgaaccaaaaaaaaaatagaggggggaagcagaacccatagatttcataagaggccatgtttcaagtagtggggagaaccacagaacaaggagctctagagctgtaaagctgaaaaaaaggctacactctctcttctccctaagagtataagaaaaagcatttcaatttttgtctggacatttgatgtgcttgtgttgcctgtagacattataattttataatatatataattatgtataatttatatatattagtggagtaatctaatttatataattataattatgcttaatatataatttatatgtgtatatattgttttatatataaaaagagaataagaagcagaataatatctaaaggtaataaaggtcaactagttaaataaacataactatttaaaaatgaactaaaagaaattaaaaaaataagagacactatgaaagagcaacatacattcttaactcagaaacaagatgagtagagaacagagatttggaaaagggagctgaataacaggccagaattccaaattaaagaaaaactaattttagacctggagactgcatgagaagggacaccagagcacgtaaacccacagcttaacatctgtagagatatagaagatggaaaagtgaaaacctttgaaaatccaaaggaaatgattttatggaagacgattttcccatgaaccggggctggagggtgttttggggatgattcaagcacattacatttattgtgcactttatttctattattattacattgtaatatataataaattctagaactcaccataatgtacaatcagtgggagccctgagcttgttttcctgctactagatggctatatctgggggtgacagtgacagatcgtcaggcattagattctcataagagggtgtgcaacctagatcccttgcatgtgcagttcacaatagggtttgcactcctgtgagaatctaatgctgctgatgatctcacaggacgcagagctcaggtggccagtgagggggagcagctgtacatacagatgaagcttgcctgctgctcacttccggctctgtggcctggttcctaaggggccactgactggcactgatccatggcccaggggttggggacccctgccccaagaaaaccaaattgcagtacagactgtggcacgaggaatggtggtgagcattcaagacacatttccccaaggaactgagatggaatgatggttttaggggagagtgtcttatggaatggctctgtcctctgacaaggttaagtaagtatgactaccaaaaatgggagagtgggtatagtttataaaaattcaacttcctgattgctttatagatgtagtctaaaagtaaatataactttcaccagagataaataatatattagctatttgcaatattggtcatagaactaagaaatagtaatcaaaaagagaaggtcttaagaatattatttaaaaatatgagtgttagggaagcccaaacttcctaaacaaaagagatatataaaaatatatttatatattgtatattttatgaacatatgtatattataaatgatataataaacataacaaaacatacaagtattataaaatatatattatatatttatattatataacgcatatattaaatatatttatattataaattaatgtacattcatgtttattaagaaatacatatatattttatattatatataatatttataatatattataaatatacctttatattatatatatttaatgtagatatatgataatgtagatatatatgatatgtaggtattacatatgataactatatatttctatttaaatataaaaatgcatatttaatgtacatattatatatgatatgtatatcctatgtatatgtgtatatatgtatcacgtatatacatatgacacagctgtatgccacataccacatatatgacagtggtcccataagatcataatggagctgaaaaattcctattgcctagtgatgtctggatgatttcaatcttgtgtaggcctacaatgatgtgaatttgagtcttagtttttaacaaaaaagtttaaaaagtaaaaaaaaattaaaaaataggaaagaggtgtctagaacaaagatataaagaaaatattttcatacagctgtgtttgtattttaagctaagtgttattacaaaaataaaaaagctaacaaaattaaagtttataaagtaaaaagttacaataagctaaggttaatttatcattgaacaaagaaaattttaaaaataaatttagtgcagcctaagtgtacagcgtttataaagtttgcagtagggtagtgtcctaggccttcacattcacccaccactcactcactgactcaccagagtaacttccggtcgtgcaagctccatttattgtaaggtgtcctatataggtgtaccgttttttaccttttatatcacatttttactgtactttttctattttgagatatgtttatataaacagataccactgtgttacagttgcctccagtattcagtatagtcatgtgttgtacaggtttgtagcctaggagtaataggctataccgtacatacctaggtgtataggaggctgtaccatttaggtttgtattacatacactccatgatgtacacataatgataagatcacctgatgacacatttctagcatgtgtccccatcattaagtgatgcatgtctgtatatatatatcatccatgggtgatgcacacacacacatacacgcacacacacacacacacacatacacaccgcacacataaaatgttttaaataaaaggaaaattttcattttaaataaaaatgaaattatatatttatagtattttttaattaaaatatgcattttaacaatctaggagaattgaggccaaagtgtattgattatataaacaattataagtgagtttgacttacctattaaaataagaacttaaaattataagcatgactacaaagccaaatctaacactatgtatacaaaaacaaaggcattcagaaagggaaaaataaaaggatagacaaggatataccaagaaatgcaaacaaaaagaaagcagatgtctttatctcattatttgacaaggcataatttagactaaaaaactttgagacaaagaaggattttttttttatcatgccaaagggtacatttctcaatgaagacaaagtagtttcatggccccaataacagatacaacttttacaaagtagaaacctcagaagttgcaaagagaaacgtagaaacataccaataataagagacgtaacacacttcaacttgaaaaaaataagtacaatgcttagcataatcaataaggttgaccttatagagatatgtcaaaatctgaacctcaaaaatagaatatacctttctttaaagttcacataccatattaaagaatattgacaatattttaggccacaaagaaaacttcagtaagttccaaagaataggaataatacaaatataactataaagaaactagaagttaattttttaaaaagcaaaaacaaaatcagccccctaaaaaataaaaaccacacaaaagacttttctatctgaaaattaaaatgtacactattaattaaatcttgggtcaaaggcaaaataaaattgaagagtttcttgaacatcatgataatgaacatgtgatgttttagaatgcatgggatatagctaaagaagttatcagaataaaatctatagcattaaatgcatatattcgtattttattttatttttttttgagatggagtctcgctctgttgcccaggttggagcgtggtagcacgaactcggctaactgaaacgtccacctcctgcattcaagcaattctcctttctcagcctcccgagttgctgagattacaggcacccaccaccatgcctggctaatttttgtatttttagtagagacggggttttgccatgttggccaggctggtctagaacgcctgacctcaggtggtctgcctgctttggcctcccaaagtgctgagattacaagcgtgagccaccacgcctggcctcagtgcatatattattaaaaatgaaaatttaaatcaatgaattaaacaaccagatgaaaactgggagaagaacaacaaagcaaaataaagcaacaaaatggtattaataaagataagaaagaaattgctgagttaattctgaaaattggtcctttgaaaaaaatcatcaacatagacaaaccatgaattagcctaatcaaggataaagggagtacaaatatttgattattagaagttacatatgagttggaaggggataatgatcacaaaaggaaattaagtcataagggaccatttgtctaactacatacaagtgaactttaaaatcttcatgaaatgaataatttcaagaaaataaaaatttaccacattaagttcaaacagaccaattatcataaaataaatagtgtggtagaagtattccctgacaagacacgcgccaaggtcggatactccctacttaactatgttccttaaattattccaaagcataataaaagaaggaaaagtttcaaatttattttgtcaagtaaatgtaatttaaatttcaaaattaagaaaaaattttttgcaaaggtaatttatagatcgatttcagttttattgatacagaaattttctgagataaaatattttaaataaaccaatgttgcattaaaatctttatcatgaccagtgaaggttattccaggaatccaagaatagctcaatacgataaatcaattaatataattcttcatattaggaaagataaggagaaaaatcctttgaacttactcatagggaaaaggcactgaacaaaatttaaattctatttatgtttaaaaaataataaaatacctccttaacattattttataagcgcatgtgcacacacacgcttcagttcaaaatcagcactttctttaaggtagtacactagcagttaaagtcaggtgtaagttaaggatgtccagcatgccctctgcaatacatgcctgtgttggaggtatgagccaatgtgattagacactgaagatcagacatggagaggtaaaactatttctagatgtagatgatttgattatatacctaaaattcccaaaaattaatcagtggaaaagctgctataggagtggattgatgagagaaatccataatgtagcaggttataaaatcaatggccacataacctggcaacatagcgagaccctgtgtctctacaaaactaaaaaattaggcgaggtttggtctctaaagaccagaccctgtctctacaaaaatttaaaaattagctgggtctggtggcatgtgcctgtggtcccagctactcaggaggctgaggcaggaggattgcttgagcctaacagtttgaggctgcagtgagccgagatcgtaccactgcattgcagcctaggtgacagagtgagaccctgtctcaaaataagtaactaaataaacaaacaaaaaataatagccttaggccaactgttcacaaatataaagtcattaagccttaacactatgtttatttgctatttttgataatattactaatgtatttattatgtttttatcatgtatacatgtgctaataaattaatttcctatatgtgtgttacatcagtaaatttttgaggatcatagatttgaagtgctgtttctgtttttctttgtggatttttttgttattgttgttttgtttttttgagtcaggatctggctgttttgcccaggctagagtgaagttgcatgatcttggctcactgtagtatctgcctcctgggctcaagcagtcttcccacctcagccttccaggtatctacgactacaggcacacactactatgcccagctaatttttgtattttttttttttttttttttttttttgtagagatagggtttcactgtgttgcccaggctggtctcaaagtcctgggctcaagcgatcttccttcctcagcctcccaaagtgctgagattacagctgtcagccaccgtacctgcctgggaatttttttaaagctcaaattggataagagggttataggaatatattcatctatcatatagaaaagaatatgtgctcagtcccaggaaatagaaaatatattaccttatttatactgttttaattaatgctttttaaaatctgattaactctgggagatagtaggatagaataaaatgatttctgagtaggagataagtgaatataatttgtactcctgagagctggtgttaaatttttgcaacccagttttactcatgggcagacctttttaaaaggaaacacccacagtctgtatgaatttgattctcgtgtggatagtatagacttaagcactgaacatggtctgagcaggtttgctttgctgcttaccagcgattatagtggaaaatcctactcctggatatagcagctctgtaataatagccactgtcaggacttattagggaattgctcttcgtttctccttttcatttataatcactttataatcagtaaaatatttgattaagtggaataactgccagttaaactaatgttcctttgataatatttgggttattctagggttttaagttgaattagatcaagaaacaattcataattggtgttcagtggttacagtcagtatatttaatatacgagcagattttaaataaatgctatatgtttttttcatagagcagaataactttaatccactgaaatggatcagactagtttgagtttcctcttcaaggactgaggatgtttaaacaatgatcataagaaaagcgggctaaataaaactgcctttacacttttctgaaggattgctatagtatttggcttgacagtttcactggggactaatttatttggcttttcatgttcatgacagggtgcagtttataataataagcaatggttaacacaaatcattttataagactctctatactgctgagtctcaccttgttcagatgatctaaaactcatgacaataagtacttaaaaaataattaatatctaattttatactaaattaaattctgatgattgcaccactgtactccagcctaggcaacagagtgagactctgtctcaatcaataaatcattaaatcaattaattaaatctcaaattctactggattattaagcagtgatagtttttaagtgtttgagaatgattattatagaaatttttaattgagcaaaaagttttgcaaaactgggaaagattttagcatcgttacacaaggttgaacctcatgcaacaccaggatttcataggagcacagttttatacagatgaggaccattgttttatgcagatgtgacaattgaatcaatagtcatgcagtgctgcccctacaaaagggacattcattaaaaaacagtaaaagccattcttatttaattatctcactgcttcaagcatagttttctggtattcatcatcgtggactctggatagaggcagtaagaggatctttgagatctgttgcatccaatatttcaattattctgtatttctgagactgatacacattcacagtatgtatgaaacagtattgttgatttttatcaggtttccaaaaaggaagctgggccttgtagatgtaacaatatcaagagctctttctgtttcttccaatttctatggcgtcactttaattaaaagtatttcttctcataatggaacatgatagagcaatactttatattcggtgacttctcattattcaccagcataaataatgcattaagatattaatgatgcataatagttgtgatattccagatgaactgatcttcttattcaagtgagaatttttgaataataaaaatgtcggtataagataaatgctagatgatgtaagaaagattcacttcatatatagtttatgaaccatcttaaacagcagatacttgtttcttgacgatttctctaaaaattaattgaaataataaaacaattataaggaaataaatattaacattattgctgtttcttctctctactttattcattttgactttcacagaattttgtttgtgcaaatgagaggcaaaagaaagaccactgttttgtaaagaatataaattatcaataactatatttttcaatattcttatgtttcagttatataatatttatttcccaatatttttagagaaaaataaagtagatggtaagtgtggcagaaaggaaatatcctaatattttgtgactatcttgtcaatgtagaataagtgattagatacttgaacagagttccgatagaacagaagagttgaaagaaaatatttaacagttttcttggcagattgttgaattggacctgaatggaactgcttgttaaattgtgattcataagttatgtggaaataattcttcttactggttttttttttttttgttttctgagatggagtctcactctgtctcccgggctggagtgcagtggtgcaatctcggctcactgcaacctccaccttctaggttcaagtgattctcctgcctcagcctcctgagtagctgggattacaggcacgcaccaccacacctggctaatttttgtatttttagtagaaatggggtttcaccatgttggccaagctggtctcgaactcctgaccttaggtgatccgcctgcctcagcctcccaaagtgctgggatttcaggcatgagccaccacgcctggcctctttttagtatttttaacatgcatttatgctggtatccagttaaggtagagtggtgacacaaagggcaaagatgacataattgaaattcccaaaatagaaggcattttatggaatacttgaattacatacctaattttatactaaattaaactccagtgaggaatacaacatcagtgtcttgccttatgatgccttacgccttatgatgtgaactaaagactcattctggaaatttttaaaagattttaaagaattctcattgtagtcataggtgagctcctaatttcccattatgtttctcataagatgtagaaaatgaagcaacatgaaaacttaggaaaacactgatgtctaagagatctccattaattataaggcagatgaaacttgttggaaaaaacctacctggagttcacctcttgcacacagtttcatctcaaacactgcaaaaagattggcagatattttaatccacctaacctgtcagcttcagccaaagggggctgtgcttacaaagtgcgtagccagtttttgttccttccttctgctctgctgcatcccgtcagtgcagactccccccagatggtgcaggcattggtaggcagtaagctggtgatgacccattctgttctggaagccttagttctcacaaatacaatgctgagggcttattgcaaacaggaacagcactggtggaagtacagaatagggattgtggttttgatgatggtgtatccattgtaataacagagaacagaactaagggtaggggaaggagaagctgttaattcagatggtcagagctgaattaagtgaatgtttgtgaaaaactgaaaactacacttggagtatatactgcagagggcccgctgccaccgttagaaccctggtaacagagtatatactacagagtgcctgctgccactgttagaaccctggttatagagtatatactgcagagtgcccgctgccactgttagaagcctggctataaagtatatactgcagaaagtatatactttctgaatctaagagtatgatttagccatcactggagtgaacacactgcagcaaatgaagctctaacacagaagttggcgcatttttttttttttctgtatagagccagatgggaaatattttagttttgtgggtcagatgttttctattcagcttggacattgcagtgtgaaagtggccgtggaccatatgtaaacagatgaacatggctgtgttccaaaaaacctgtacttacgggcactgaaaattcaatttcatattttcatgtgccataaaatatttttttctttttcttgcaattttttttcaactgttgaaaaatgtgcaagccattcttaactcttgggctgtgatttggtccatggccatgatgtgcttagcccagctctaacatatggaaagtattatattgctaaagggaaagctagacaaataaaatgggagcaactgtcagagatatgatagaggcaaagtttgctgccaataggttagatgcacttgccctcctaaagctgggaaggagaatacttatgtcaggagctactggtgaagttttatgaaagtatagggatggcatttgagtgggactccttgacagatggtacttaagttaatgaatgtttttgatgtttgaaaggatgagagaataaatgggtaaaatacgaatatagctcaatagagtgtgatatagaaggaagcatttcataaggagaatgagaacaaaggcatagagaagaagcatttgttggtggctgggaactcccaagtgttctgctgaggggtaaagtcaggtttcaaatgccatgtaaccagcacaactttatttgaaagatgaagggagcttctgaaagctttctaacagtggattgcattatttcacctgttgccacttgccaatttgcacacttagacatgcataaacaaccctggaggtataaacctccagttgggttttaataaaagatgacatgcctttggatatactctgttctcgctcttcctggaagacccttgcgcgttcttcacctgaaggaagtctcttcattgtttaggtatctgtcaaatgttttttcctttgtaaagtcttcctgtgtttacaatgcatctccctcctttatgacaaataattctgttttctttcttgcttgcctgtctacctggttgctttctatttccttctcttcctctctttctcattcacttgatcgctttttctctttttcttcctccctcccacgctcctctctttcaagcaaaattaattcctcctttgactgcgtaacttgctgctaactcatgtgtccctttacatttactttggcgtttctcaaattatgaaagcacctgcaggcagagacagcctctcagtcatcttgtatctcaggtacataatacagttttgaaggaagtagagcctcaataaatgtgcattgatttttgactggatttccttatttaggctaataatattgatgtatccattttggcagtttatcagttcatttgactttttatatcctactgtactctccaaagaatacacagccactgtcttcctgtttcaaggaatttaatgttttcaaggttgctggagtaaatattcatatttgttactataataatgcttaatcctatatagattgataatggtcttggtatagtacatttgtagtaatatttaatttactacttggtatcaatttctttttttccgtaagttactggagtacaggtggtatttggttacatgagtaagttctttagtggtgatttgtgagattttggggcacccatcacctgagcagtatacactgcaccatatttgttgtcttttatccctcatcctccttccactcttcccctgaagttcccaaagtcatatcattcttatgcctttgcatcctcatagcttagctcccacatatcagtgaggacatacgatgtttggttttccataactaagttacttcacttagaataatagtctccaatctggccaggcgtggtggctcacgcctgtaatcccagcactttgggaggccgaggcgggtggatcacctaaggtagggagttcgagaccagcctggccaacatggagaaaccccatctctactaaaaatacaaatcagccgggcgtggtcgcgggcacctgtaatcccagctacttgggaggctgagtaatgagaattgcttgaactgggaggcggacgttgcagtgagtcgagattgcgccactgcactcctgcctgggcgacaacagtgagactccatctcaaaaaaaaaaaaaaatagtgtccagtctcatccaggtcactgcaaatgctgttaattcattcctttttatggctgcatagtaatccactatatatacatatatataatatataaaatatatataaaatatatataatatatgtattgtgtgtatatatatagtgtgtgtatatatatattccaccatatatatacacacacacccacacacagacccacacacacatacacaccacagtatgtagtatatatgtatagtgtgtgtatatatatatatattccaccatatatatatatatatgtacacacacacacacccataaacacccccccacacacacagcacagtttctttatccacttgttgaagatgggcatttttttattattattattattttctgcagctattgtaaaaggggtcgagttcttgatttgattctctgcttggttgctgttggtgtatagaagagctactgatttgtgtacattgatcttgtatccagaaactttgcttaattctttttatcagttctaggagttttctggaggagtccttagggttttcaaggtaaacgatcatgtcatccgcaaacagtgaaagtctgacttcctctttactgatttggatgccctttatttcttcctcttgtctgattggtctggctaggacttccagtactatgttgaagaggagtggtgcaggtgggcatccctgtcttgttccagttctcagatggaatgctttcaacttttccccattcagtattatgttggctgagggtttgtcttagatggcttttattacattaaggtatgtcccttgtatgctgattttgctgagttttaatcataaagtgatgctagattttgtcgaatgctttttctgcatctattgagatgatcatgtgatttttgtttttaattctgtttatatggtatatcacatttattgacttgcatatattaaaccatccctgcatccctggtatgaaacccactttatcatggtagattatctttttgatatgttgttggattcagttagtattttgttgaggattttagcatctatgttcatcaaggatatcagtctgtagttttcttttttgggtatgtcctttcctggttttggtattagggtgatactggcttcatagaatgaattagggagggttccttctttctctatcttgtagaatagtatcaaaaatatgggtaccaattcttctttgaatgtctggtagaattcggcagtgaatctgtctggtcctggacatttttgttgttggtaatttttaaattaccatttcaatctcactgcttgttattggtctgttcagggtatctaactcctcctgatttaagctaggagggttgtatttttccaggaattcatctgtctcttctaggttttctagtttatgtgtgtaaagatgttcatagcagccttgaatgatcttttgtatttcagtggtgtcagttgtaatatttcccgttttgtttcttaatgaggttatttggagtttctctcttcttttcttcattgatcttgccaatggtctatcaattttagttatcttttcaaagaaccagctttttgttttatcttttgtatttcttttctttcaatttcatttagttctgctctgatcttggttatttctttcttctgctgggtttgggtttggtttgtttttgtttctctagttccttgaggtgtgtccttagagtgtcagtttgtactctttcaatatttttgatatagacatttagggctatgaacttccctcttagcaccacctttgcagtatttcagaggttttgatagcttgtgtcattattgttgtctggttcaaataattttttgattttcatcttggtttcgtttttgacccaatgctcattcaggagcaggttatttaatttccatgtatttgcatggttttgaaggttccttttggagttgatttccagttttatgccactgtggtctgagggattgcttgatataatttcagttttcttaaatttattgagccttgttttatgccctatcatatggtctatcttggagaaagttccatgcgcttttaatagaatgcagttgttggatgaaatgctccgtatatatctgttaagtccatttcttccaatgtgtagtttaaatccattctttactttttgtctcctttaactgttgttgctttaaaatttgttttgtctgatataagaatagctacccgtacttgtttttggtgtacatttgcatgaaatgcctttttccacccctttactttaagtttatgtgagtccttatgtattgggtgagtttcctgaaggcagcagatggctggtgagttcttatccattctgtggttctatatcttttgagtggagcatttaggccatttacattcaatgttagtattgaaatgtgaggtacccttgcattcatccagccctttgttgcctgtgtacttcattttttaaatatgtttttgctttttaacttgtatttttgttttataggtcctgtgtgatttatgctttaaagaggttctgttttgatgtgtttccaggatttgtttcaagattctgagctccttttagcagttcttgtagtggtggcttggtgatggtgaattctctcagcatttgtttgtctgaaaaagactgtatctttccttcatatatgatgcttagttttgctggatacaaaattctaggctgtttgaggaggctgaagatacggccccagtcgcttctggcttgtagggtttcttctgagaaatctgctgttaatctgataggttttcctttataggctacctggtgcttctgtctcacagctcttaagattatttccttcatcttaactttggataacctgaggacaatgtgcttaggtgaagatctttttgagatgaatttcccaggtgatctttatgcttctgtatttggatgtctacgtctctagcaaggccagggaagttttcctcaattattccccaaatatgttttccaaggttttagatttctcctcttcctcaggaacactgattattcttaggtttggttgtttaacataatcccagacttcttggaggctttgttcatattttcttactcttttttctttgtctttgttggactggcttaattcgaagaccttgtcttcaaggtctgaatttctttcttctacttgttcaattctattgctgagactttccagagcatttcacatttctaaaagtgcatccaaggttttctgaatttttgattgttttttctttaagctatctaattccttgaatatttctcccttcacttcttgtatcattttttgtatttccttgcacggggctttgcctttctctggtccctccttgattagcttaataactaacctcctgaattcgttgtcaggtaaatcagggatttcttcttggtttggagccattggtggtgaactaatgtgatttttgtggagtggtgaagagccttgttttgtcatattaccaggtttggttttctggttccgtctcatttgggtaggctctgtcagagggagggtctagggctgaaggctgttgttcagattcttttgtcccacgaggtgttcccttgatgtagtactttcccccttttcttatggatgtggcttcctgtcagctgaatcacagtgattgttgtctgtctgctggatctagccacctggtgagtctacccagatccaggctggtactgggggttgtctgcacagagtcccatgatgtgaaccttctatgagtctctcagctgtggatacaagtgtctgtcctggtgcaggtggtgcgagtgtgcaatggactccataagggttctttgctttggtggctgaatgctctacttttgtgctagttggctgcctgccaggaaatggcactttccagagagcatcagctctggtagtattgggaggaactggcggtgggcagggccctagagctcccaagattatatgtcctttgtcttctgctaccagggtggataggggaggaccatcaggtaggggagggctaggcacgtttgagctcagactgtccttgggtgggtcctgctgcagctgctctcgggggtgggggtgagatacctaggttactggagttgtgtacctaggaggattatggctgcctctgctgagtcatgcaggttgtcagggaagtgggggaaagccagtagtcacaggcctcacccagctcccacgcaaacagaagggccagtcgtactcccactgtgccccccaacaacagccctgagtctgtttccaggcggagggtgtgatgggtttgaacacttaccccagggtacctgccttccagctgcaaaataaaagggcttggttcctcccctgcctatggagtctggacactagatttgcaccctcccctgagttctggccaggaggcctctcaccccattcaaattgttacaaaggccagctagagatttccttctgcctgtggagttttaccccgtgctcctctcccattggatccctgtggtgccaggcaggtatggggtgcttggggacccagcgagctcccagggcctttctgctgcttcctttaccccctgtatgttgctcagctctccaaattgactcagctccaggtaaagttgtaaacttttcacgcaaacagaccttcggcttctccagtgggggtgtatatttgggagaggagggccgccctttcctacttccatggttggggcactcacagttttaggggggtctcccgggtcctgcaggagcagtccgcttccttcagaggctctgtggatcctctcgggattgctggtttgttcttgcagctgatctgggtctaaaattaacaatgcgagcccccacatactgctctgtctagagctgcaatctagtcctgcctcccatccaccatgatgatcctctactagtttgtattagtcctttctcatgctgctaataaagacctgagactggataatttataaaggaaagatgtttaattgactcacagttccacagggctggggaggcctcaggaaacttagaatcatagcagaaggggacgcaaacacgtccttcttcacatgatggcagcaaggagaagtgctgtgcaaagagggaaaaggaccttaacaaatcatcagatctcatgagaactcactcagtatcacaagaacagcagcatgggggtaaccatcaccatgattcaattacctcccactgggtccctcccatgacatgtgggaattatgggaactacaatttaagatgagatttgggtggggacacagccaaaccatatcatactttatataaaggatacatttttgtaagcatgcttatacataattaaaaaattcagatactttacagaaaaatcattaaaatcgataaataattattgataaatttggtacagaaggaaatgctaagattttttgtcagcataactttctgatactttggcataaaactattttagttgcacatgttttttccagtaggtaatacagaacttaaaattatatttcaatgcaaatggtggtcactttggaaaacagtttgtcagttccttataaaattcagcatgagtttacaatacaacatagtggcctactcatggttatttacccaagagttatttgtccctgtttctacccagagtcttgtactcgtatgtttggggcagttttactcacaatagcctaaaactggaaatgaaatgaccaaaagtgtcatcaactgataaagggatactatgtggtaacaaaaagaatgaactattaatctgtgcaacaacatggatgcaacgcaaaatctttaaggaaagtgacagatgcagggcactaaagactgtataccaaatgattccatgtatatgaaatgatagaaagggaaagctagagtgactaaaagcagatgagtggttggcaagggctggaggaagtaggtgggaatttactgcagagacttgcaaatgtttttattccataaaatagatggaagtgtcctattttgtgattgtggtgatgattagatgattgtagaaaagtgttaaaactcatcaagttgtatacttataagtggtaaatttcattgcatgtaaattatgcctcaataaagctgattttaaagtccccaaaagcacaaactacaaagcaaaataaagatgtatttggctaaattaaaattaaagacttctgaatatcagcaaataccatagtatgtaaagcaaacaaataaaacagagcaacataaaaacagcactaccaccaacaacgaaaatacaaacctcagattgggagaagatattttcaacatgtaaatataagtggataaaattttactatcaaaaattataaagatttcctagcaatcaataagaaagaaagaatatccaagtaggaaaatgttcaatatgtttgaagaaatatttcacggaaaagagaactcagatggcttccaaatattttaaaagatgttgaagattattagttataaggaatgcacaaattaaagctgcattcaaattcttgtgcatgaaattggcaaaagcttttgagtttgacaatggaaaatggtgacaaagatatgaaccaataaaaattctcatgcatttctgttagaagcgtaaattgatactgcctctttaaaaagcaaggtgattatacctactaatgtttaagaaggtcataattgggacccagcaaattcaatccaagaaatatacctggcctaggccaactcttgcacttgggctcatgaaaacatgcacatacgtattcatgtcaatgttattttttgtaatggcaaaaacaagcagaagatcactatacatctatcagaagagtgaaaatccaaaactcagacaacaaccaatgctggtggggatgtggagcaacaggaactctcattcattcttgatgggaatgcaaatggaacagccactttggagaacagtttggcagttattttcatagctaaacatacttttactgtacaatccagcaatcacagtccttggtatttacccaaatgagtaaaagcttatgtccccacaaacacctgcacatagatgtttatagaaccttgtttataaaaattgccaaaatgtgaaagcaaccaagatgtccatcagtaggtgaacaaataaactggtgcatccagacaatgggatattattcagtgataaaaagaaatgagctatcaatccgtgaaaagacatggaggaaccttaaatgcatgtcactaagtgaaagaagccaatctgaaaaaggctacataatacgacattctggaacagtcaaatctctggagacagtaaagagatcagaggttgccagggataaggggcagggagggatgaataggtgagcacagggtatatttagtacagtgaaactattttgtaagatactgcagtggtggttatgtcattataaatttctcaaaacccatcaaatatccaacacaaagggttaaccccagtgtaaactatagtctttgggggatagtgatacctgaatgtaggtttgacatcaattgtaacagcggtgtcactttgatgaaagatactgatagtgggggaagccgtgcatgtgtagggggcagaggtatatgggaactctctgtgccttcctacttttgctgtgaacataaaattgctgtaaaaaaataaattctatttgaagcacaaaacagcctaccaaccaacaagagatccctaaatgttcggcagtagagaaattgataaagtatagtggattcaagcaatgttatactgtatatacagtgaaactgtaaacacacatatcaacaagaatcaattacaggaatgtaaaattgtgcaaaaatgaaattgcaattggatataggcaaattggagatgaacagtataataccatttatatcatgttacaaattaaaatttgcaaaataggtacaaaatattagaatatataaatgtgtgtacaggaaaatcctaagaaagtacacattaatgataaacattaaattcattagtggctcctacttcagaacaggcagaatgaaatcaggcctgggtacctacttagctttgactgtgtgtgtgttagaatatcggtatttattttagaatgtttatatattttgtattgatgaagtactctgtcagaaaatagccatggaaaattatgctggatttgcagccagaaaattttaaacataagcagcaaacactcaagaagttaatctgggaagtttttgatgctgtgaataataattttttgtcttgtgtgatttacattttcaaggttacacgttaaaattctgcagaagaaattgctttcctagatgttgttgtaacccaaagtttgtgttgggggaaggtagttaagctgatgaataggaatgttggagaagagaagagctgagaatgtttgcacgagataactgtactgcaactgtggatatgaccgggctgcactttgcatttattgtctggccagtacttactaaagtctcttagttataagcctccatttgcataaaacttatgctcaaagtcagggttccagagttctgatgaaaaaaaaaaagtcttttttttctcttctcctctcagacaccactcaacacaataattctgataccagatatgtgggggcttatctccacacaccaagcaattctccagcaatactaagtgttctgtaatttaactcaattttgacatcatcatctacctggagatagcatcagattcttcaagttgatgccttggctgcataagactgccctctacttcaatttaatttttcttttttggttgagggatggagtctcactctgttgcccatgatggagtgcagtgacacagactcagctcacttcaacctctgcctcccaagttcaagcgattctcatgtctcagcctctcaagtagctgggactacaggcgcgtgccaccacacccggctaatttttgtatttttagtagagatagggttttgccatgttggccaggctggtctcgaactcctggcctcaagtgatccgcccaccttggccttccaaagttctgagattacaggtgtgagccaccgcacccggcctgcccctacttcagattccagctgcaagtagtagattgtcatctttacttctgtctgactgatttaaatcaggggttcccatgatccccctcctcatgatagagcagctcacataactcaggaaaacagtttactaatgtttacctatttattataaaggatagtacaaagcatacagatgaacactcagatggaagagatgcctagggcaggaaatgtgggaagaggcacagagctcccatgtcctgtccagcgcattaccctccagatacctagttttagttcagcaacctagttttaattctgactcttatctttttgggtttttaaggaggctccattttgtaggcatggttgattccatcattggccattggtaatcaagtcaaccttcagcccctctatcctccatggaggtcaagggtggaatgtgttgggggaaggcttaaagttctgaccccccagttgcattgttgcttcccctggcaaccagccaacatcctgaggctatccaagagcctaccaagagtcacctctttcgaacaaaaaaggatatttttacctaggaaattttaagggattttaggagctctgtgtcaggaactagggtcaaagaccaaatatcagaacagatattttccatattctccttgaacttctgtcgagaaggatattaggagctctctcaggaactggggaagtgagcaagtgtacatttcttattatatcacagtatcacaagagttaattcagtctcccatgttcatggagagactgactgtgcttggcattccttttctaattttcctagacacagccactcagtattttaaaaatgcatttttccaggtagctactaccaatcagtagtacctgaaataaaattgatttgctatcctgatctattcaggataggctaagttatgctttgataagaaaaaaaaaaacccaaatctcaatggctttcaatacagtggctttaattcatgtacatcattgtagttgtttatttggtgtctattgagaaaatggaaaatgactaaaaatgctagtatgaattcagaaacactattacatatttaagtaaaatattttatttgattaatcagatacattttaaaattatacttgcaattgcaaatatgtgtgtgtgtatgcacacacgcatatacattttcaaaatatataaattattcagtatatagataatgcttctggagtgtatggtggtttcattgattgtttcttataacccccaaccccctggcccacaggtattggggattgcaggaagggttgcttaactagatcacaaagtctttgtaaggggagttattgaaataatattaatgggtacagtttttttaggggaggggaataagggagtgatataaataaaatgatgtttgagaaattgtacttataggccaggcatggtggcttacgcctataatcccagcagtttgggagactgagatggaaggattgcttgaggctaggagttcaataccagcctgggtaacatggcaaaaccccgtctctccaaaacgtagagaaaaattagccgggcgtggcagtgtgtgcctgtagtcctagtgattcaggaggcttatatgagaggatcacttaagcctaggaatttgagaatttgaacctgtaatgagttatgatggctccactgcacttcagcctgggtgaaagagaaagaccctgtctccaaaaaaagtaaaataaaaataacaaaagaagaaaccgtacttcagtgtttggaaaaaaaaaaatgagtcaggaaagtcagaaggaggaaggattactttttgcagtaattttgatcataatgcagtgaaaaatctgatctagattggtacaaaagggaaggggcccagaaaatttggagacaaagctgtggtagtcattgatgatatattgcacattgctggtaaaatacagattaaattccttaaatctggagtaacataaaatatgttactcaagacaacttaaaaagacattgaaatgttggctatctgcatttctcttaatcaccgaaaatacaacaattcagaatgtataattaactctatgtaggatttataggtaatatgaagttctggagtattttaaacgttgtaataagatcttttaatatttttaccgctagaatctctatgaacattgtctaaaatgaatagatgtaattgggatcttttaatatatgtgatagctttctataaaaaggaaaaaatattgccataaaattcatacaggtttagtgtatatttaaaatatatttgttatattcacacagtaaacacgctatttagagtgttgatgacgtgctaagcaatgtccaaagtcatggggacagagcagagatcgagacagagtgcaccatctcatggatatttcattctagtagataaagacaggaaataaaccatttagctaataattagtgatgcatgtcatggagataattaaaataagtaaggtgatgggtctgttggattggattggtttattgtagaaggcctctttgctggatagccagaaggaaccagtcattggatgcttagagagagaagcattgaatctatgtagaagagatagtgcaaagaccctaaggtgagaatgagtgtggactgttcaaagacagaaagaggccagtgtgattgaagtccagcaggtgaagggggtaagtggtatgagatatgatgtggaagagatagttgggggctgattttcagggactttgaaagctagaacaagaagtttggattttattttaaattcaatggaaagctgttggatgtggtgtattataggaattgaatgatgtttctaaataattttactccatgaagaggggattggagaagacaagagaatgaagtaactcaatagggatggtagtaaagaaatactttgattcagaagtttcgtcagattggatttaagaggtaagagagaaagaggaattaaagagttttggatttgaggacattgttgagatgaggaaggcagaagtcatagagaaaggcagacttattaagagtcctgttttgattgtgtttgttaggttggtggtatctgagtgaagatgtcaagtaagcagcttgatgttagcttggagtctaaggagacgtcagggctggtgacatagatgtgagagtcattgggttatattatggtatttaaaaccacaggttggtgtgagaatcacctgcaggaatatgtagtcacagaagacaaaggggctcaggtcaagcacttctggcatttagaggcagatcagaggagaatgacctgcaaagcagacacttttttgagtcttctaaaaagataaaaatctttcttggaatccttattgtctaaataaactgaaacaatgggctattcatttaatagtgcattagtacatattcgtttaatatgggcactaaagtgtaagttctatatacagttgtattttagtggtaactctattttgttgctgcaaaaattgaaatgcagatgatgaacacaaaaaataaaatcacaattttggaaatgacgtaacaaatgaatgtatctggaaaaaatcagggatgtaaaaggaacaaaacagttgccaaaaaagcaaacgataaaagtacatatataattattgtcatatttcttatggggaagcagaaggaaaaaataaaactaatagaaaactccatcacagaatgcgagggcaaagattgatttatgaagaaaaggagggaaagaacaagaccaagccttgagctgatccatgaatttatatatttataaggaaaggtgatctttatgctccactataacaaactgcaggaacagataagctgtccactcttcagtgtgtttaacacgagtaataacttctatgaaagttaaaatcatcgtctgccatttttgtaataccctacccacaggaaagaaaagtaaaggtgggtattagacttaaagacttcagtacacctttagaactcaggaacaatagctatttcaaacagtttaaaaacattttttgtgaatccacatcaattgggagtataatgtgatggtttgatgcagaataagcttgaacaatatttaggcactgaagtcttctcagtttctaaaaagtactctgcaactcacattgagagtttcactgtaaaagagtattcctaatatattgggagcgttcacatataagttcagtgattgacttctttgaaaaggccatggtttgtgttgacataatttttttttgagacatggggtcttgctcttttccccaggcaagaatgcagtagtgcaattatagctcactgcagcctcaacttcccaagcacaggtgattctcccacctgagcctcccaagtagctgggactacaagcacgtgctaccatatctggctaattttttgtattttttttttttttgtagaggtgtggttttgccatgttgcctaggctggtcctgaacacctgagctcaagcaatcaggccacctcccctcccaaagtgctgggattacaggtgtgagctacagtgcccagccataatgtttaaaaatattacaatgatgctactgaggaatgggaatcatttgttccttcagaaacaagttacatcattctcttaaccaaccacgttattctttgtcatcgtcactcattcatcactcaaccatgggtgcacattctcattcatcagctctcccatcacctggatgcaggcattgtgcttggtgctggcataggaagattaagatgcagttcctgaactcaggagggcggagtttcatgcatggactctagtaatccaaggatggcctgcaagactccattctttgatgttatatccaaaattatttatcagcatatagatttttaaaatcagattatcaatgagatgtgtgtccaggaagatgaaaagacaaagaatcattggtgtaggctttacagatggaatgtgtggctgaaatacacagtttttattgttttcaaattattctaaattctttaatcctctttacttagggtgtcaaaatccttaaccttggctctattagcttcatttggatttctgtgagcttccatcagcaccaagagaccagtaccactgtagcaacataacagagttatgttacttttttatataaaataatttttaattttttctatatgacagaaaaatatatttttttaaagatttattagctggatgcagtggctcatgcctataatcccagcactttggggggctgatgctggagggtcatttgaagctgggagtttgagaccaatctgggcaagatggcaagaccccgtttctacaaaaaattagaaaattagccgagtatggtggtgcacacctgtagttccacatacttgggagtctgaagtgggaagatcccttgagcccaggaatttgaagtgagctatgatcatgctactgtgctccagcctgggcgacaaagtgagactcccctctctaaaaaataaacatttattattattttgcttttgtatcatatgcatgcctctgttaaattattcaacacatatctaaatgtgctcaatgttatttttcctgatcaaattatgaacagtgcaattcctagagtctttttttttttcatttcatttcatagttctacataggttttggcctaaatgagaaactgagagtaaatctccgcttaaatccttaaaatgctattgccttttcttttccctcttctttattctcatggtagaattaagagttatcattgaccagagtgttttcactctactgtggctcccagacagtgactttctgctagagagaaagagctggagatgaaactgaccctatttgaatacggaagaataaaattataaggttgagttattcagtgggttaataagagaaggaattatacaaaataaaattataaggtggggcctttgaacaggaaacaactatcaaagctctgcaatagagaaaattctcaatactgtaaagataattttgatgtgctggacttctgggccagaagaggtttcctgagacacccaagatgcttttcccacatccattagttcaaagttacaaaatagtaggggctggatctaagtatattatccctgagtggtgggttatactgccggctaataaaaagttttatactttgacatgttctgctaagttttattgtgggttgtaaatgtttaatatcctcctaggggcttttaggagaatatgttttcacagcacatgtggtgctgttatactccgaaccaatctaatgggctttaattatgccaaggtctgtggatcccggagatgctgacaaattcataatgtgttttaaattgctaggatggaaagtacaaatcaaaagtttaatctggagtagtgtttagaaaataatttcctttgctaagatgccacctgtcattctcctttctcaagttgaagaatgtggttgagtcattcattcatgaatctcatgtgacattcctatccttaccatggagcagatgaaatgctgaagttgactttaggaaacccagatttgaggcccgagttttcactcactttttgtttgaatcggtacaagtcacctgatatgaaagacttcattttccatgggtctaatataggggagtgctgtaacatgggaagactgacttagtattattgagagaatcaaataagatgatacacggaccaccaggaaacatctgagagggctcttccttattgttttggttgagggatgtttaaatcgtaactagcaggcctgctagaagttctctgcttagttgggaatctagttgattctgttaatatttttcccttttgatcaacattgcaatcttctaagctactgcattcccttattctattaacatggctatcttgggactataccgtacttccttttgcaacccagttgacatgcaggtatacgtaaatttggtatttgcctgctttcttagttctgaaaatgggagaggaccaaacactactctcgtcattcaaatactgagtaaagctctgctccagtgataaacttttcagtgatcctgtatacttgctgactttcatgagttgctgatgatctgcaagacaaaattagatcttcagtgctgagttaggcaaagcgcttcgctcctcatcttcctgatgacacccctacagtttgccatcagatgcagatagtgatgatgatagtagggcattaactggtgcttcaaagcataccggtgacctttccacattttttataaaataaatacgtccgagtttgctaggggattccaatcttcactcccataatgctgaggacagcataatatcaatgaagtctgttcagctttctgccagtcagaccaatgtggaaccaaatatgtattactgtcttacaataatcgaagtgaatttcatggaaaagcagagttcctggtacattgtaaggactcactagatgtttgtgaaatcgaattgataagacctttcattctccaagcagaaggaagttgttgtattataagtagttatagaaattatgaacacatggctttaagtatatgctgactttgcagtgcccagtcaagtgccaggtaatctttaaatactgataaattgaatccaatagttaattaacagactttaaaaaccacaatctcataatgaaaattctacttagagactgaaaaaaaactctatgctaatctctctttatgctcatccaagatcatccctgattgaatacataccattcaaatctgtaaaactcaagattgcaagtattagtattagaatatgtagtttattgtgttttgtgagggttataaatattgtttgtctttttttaagaaagataaaaaagttgtgattagcatactgtaggaacttcatttactatggattcataaagagtattaccagtcactgtaggaaagtgtttgtccttacaattgcaaaccttccaagcactgtagttgataagagttcaaacagtcacgtaaccccttttctaaatacagagcttcctgctacaagtttaaattttcttctttaagatatttctcctaaataaggtattattaagcagaaccagtttcttagtaatgaagttaataaaacaggccagtctgatgatgacttttgtgtctttctaagaacaaaagacaaaagcaatctaataatgactttagatctgtagtctatccagagttaaagtgcttgccttttcttttccctcctctttattcgcatggtagaattaagagttatcattgaccagagtgttttcactctactgtggctcccagacggtgactttctgctagagagaaaaagctagagatgaaactgaccctatttgtctatccagagttaaagtgcgtgtgataaaaccagtagcctcacctgttaaggcccattgatctaaagaaaaatctcaggtgcagtataattgtgtaattgttgctaatattgttatcaaattatttgacactgttctctttgaacaacgaactctggcccatactacttgaattcagacataatttaaatgaaatgtgaatgtgtaaatatattattgcaatatgtgttttcactgcactcataaaacttagagtgatcattaatgacatatttttaaaaataccaagcctcaaacttccactcaaaagcttttctgttattttactgattcatacatttattttctgtcaaacaagcaaacactgaattaaaaatgggaaacttttacatattttgcttccctttaccatcaccttaatggcttaacataagtctttaatgtgataggaaacatacgagtgcgactcacaattatggtaaaaaattcaaatagggatataccctttgaacttaagaactctaggaatttagacgaaagatacaatcattataataagagattgtgagagagtcattacaagccttgatatatttacaatgtccattcttataaccagttcctagaataggttagttgtattggtaaactggtgtccctgaattatacaggatattcctctcactacagagtgagctaagcatatccttcagaagttaccttcattttaggttggctcttacaggcttaggaaataacaggaacattgttaggctaagagaatagaatctaaatttatcagacagacatggaagccagaataccttcagctaaaatcccagctctatcatttatgtatttgtttgttttccattttttttctacttataaacaatactacagtgaatattcatatatgaaataaatatctctggacactgttcaacattgccttagaataaattcctaaaaatggaattctagggtaaagtcatgtactttttagggcttttgatatttactgtcatattgcccttcagaatagtttacaatcttctgagctgtgtttctacgcatccatttgcccattcttacatctgcactgggcatcaaaataagaaaaatcttgctaatctgaaaggcataagatctctgttttgaaagaattgtacttctttgattagtggtgaggctgacctttccctgttcataccctttgcccattcttcgagtatttgtcttttttggcatatagctgccatttatacacgtggtcacaaaccacatgatattgcatgtatataacaatttccagttttcctgataacatattgctttggttattaaagttctaaagggtatatgtgttaataatttatatctattcatatgaagatagctctgcggttatctttttttttttttttttttttttttgagacagagtcttgctctattgcccagactggagtgcagtggtgcaatgtcagctcactgcaacctctgcctctcgggttcaagtgattctcctgcctcagcctcccaagtagctgggattacgggtgcacgccaccactcctggctaatttttgtatttttagtagagacggggtttcaccatgttggccaggctggtcttgaactccttaccttaggtgatctgcctgccttggcctcccaaagtgctgggattacaggcatgagccactgcgcccagctggttatcctttaaaatttaatattttaaaatagttatgtttatactacctgaaaaccttgtgaattcattatattaaatatacatatgtacctttttctcactttgtcctggcaatcatataaattgtgacagtctttgcaatcacattgagaggttttctctagttgtttaacatctgcctcagtgataactcaaatacatttggaggatgctttactttatataattatcttattgcttgagaatacagattcatgaggccaaatccaagaaatacattttatccaactggatagtcctagttatcagataattcagtaattccaaccaccacagccttgttttcctttttttgtgtaaattttctgtcgggtgtaagagatttgtgtctcagggaaatcttgacttagtagagaatgagtggtatggagagatacagatcactctactgtaattccatctcagcagttaatgggcccagctttgcaataggatgatttctgagtgtgatatgattcttttataagcagtaggtacaagttgactacatggatgagtcagactttaaaaaaatgtcatctcccctgctttgacagtgttcatttcttaccttggaaggcaatctagtgctgaggaaagcctgctggctagagatcaggagccctagacttgcctgtaagctcatcccatttttggcaagtcccttcagcttcttttgttttctgagttctgaagtgacaataataattctatttcctcatccattataactgaacatcatataaaatatgcaaattacactgaaaatacagaaagagctacacaaatgtaaattgctcttaaagaggaaaatctctgattattctgaatctctgtacgtaaactcagtgcccagaagatgcatatatgagctgtcacttgggccgtctgtttcaaaggctacttattgatgttgttatgcgtcctcaagctattatgccatcttccatttctgggtgtggggagcatggaatcaagttttcaaaagaaaggtggtgaaggttttctcttggcatttatttatatatgtattaatcttacatatagatagaaaggagaatcatttcatccattcaagagccatgaactttatatgaatgtcatttcaacaataaagcaaaaactacagactgtctaaggaaaactccgttttattatttggtttgttacttaccaaaacatacaatttaagacctgaaaatatctagaatacatagagtattatggtcaatcaatacaaaagtgacaaccaaatagaaaaaatgacagatgcatttcacagaagaggaaatgcagatgatcatttataatatgaaaacatcagcctcattattaattgtagaaataaaaattaaaagcacaacgaggtatcatttcacagattggaatgtggagcaggaggaactttcactcactcctgacggtataagcactttggcaaactgtaattatttagtaaatttgaagatacgcgtatattgtaatttaggattgtctcttaggtatatattctagcaagacttttgctcacgtgcacaaggaaacatacataagagtatttgttgcagtattgatgggagaaagaattggaaatagcagcagactgcagaagaaattgagctatagtcatgcagcggatgactctgagcaataaaaatgaatgggccacaggagtccacatccacatggattaatctcaaaaatataatattgcatcaccaaaagaattacagaagaatatacactttataatacatattttatgtttctagttatataaagggcagaactcagcaaattttttatttttgagacagggtctcactctgtcacccaggctggagtgcagtggcacaatcactgcttactgcagcctggacctcccaggctcaagcgatcctcccatctcaacctcccaagtatctgaaactacaggcatgcgccaccaagctgggctaatttttgtattttttgtagagatggggtttcaccatgttgcttgggctggtcttgaactcctgggctcaggtgatccaccagccttggcctcccagaatgctggcattacaggcatgagccactgtgcccagccaacaaatttaaataacatactgtgtaggtctacataaatttgtggtaaaattataaagaaaaacaggagaatgttgtggagagacacagaaagctccaaaattactcataatattgtattcttcaacctggttgatggactcatgggtgttaattttatttaaaatatgcatttctttacatacatattttggaatatatgatacaaaggtatttcaataaaactatgagggcctagaagatgttggtttggactcagtctgcaaactctgaacatagcctacagaaatgttggcaatacatgaaaaattatgtcttaactacaattttactaatgcttcattaataagcagaagagtttgtatatagataaggaaatgattgacaaactgagaagagaaagaaaatacttactaggactagattattaaataatcatataggtagctgataggattaataccatttaataattttctatctgtttaccatcctaaaaattaatccaaagaagtcttgtgttcagccacaaaatgtaaattttactgtggcctaaaggtaatctatgtgcctgttaaacatcaaatacatgagttcatgtatttttatccttggattggtcaatgacttagcaatcaatgacagatagtaatctggcactattttaaaatactcgtgtatgcagtctatggactattctatcatttaatctatttatgatagcaagtttcacttatgcacatccaaaaattttgaggacatttaaattgatttctttggatattaatgagaatggaaaataaccagtcaacattgttctctaggctgtactttatattattgacatttaaataattatttgaccttttgtgtgataaacatctttctcctgatatcagctttgacttttttcgtgtgggttttagttttcatgatttaagttgtctttgtggcattaaaaaaccacagaagtagatttgttaaggatgtaaccaaaaagagctagaaggaactttagaaataattttacgtcgtctgctggtttcatcttgaagaatttggggcatgaaaggttagataacctaacaagaattagtccttttaatggtagaatcaagccttatttgggccttctgagtttcagttcatcgtttctactgtatcccctcttccttaatatgatgattcattgtaacacaaatatacaatttaattagtagaaagctgattttaactcttacgggtacgtacttatactactttcagtaacttgttcctaagaaaactgtaatacctcgatgagtcatatttagcttattttctccattatatgtcctctgtcacaagatcccatttcgtgggctgtatttgagcttgtattttcttttctacgtaaaagctctaggatgataatgtcattaccactttttacatgcacctggtgtatcagagactctgctaaggcattgcacatacgttttttcacttgctctttacatcatgaggaagaatctaaactttagagagtgtaggtgatttactccagatcacatagctgctgagtagcagaaccaggattctaatccagttccttctaactacagcatgacaaattgtgcttagcatgaactaagcactttgctcagttgtgaattcacagatgttcttaaactgaaaaggaacaaggaatgctagtctagatttttatagtatgagatagtcacattattgtacattattgtaaaaagtagaatttttacaataattctgtaattccttttgtaatatgttcagtatgattttacttctacatatattcattggcttatctactttttgaaatttgtcatttatttatcaagctaacttgagttttgtttttgtttttcatatttgttagcattctgtgaaacttcagggctcctgaaatattcagtgctttgacccttagagtctgttccattccttatgatatttatgtagatcctgaaaattatggctctcaggcctaaacccagtttattgtgactttacatatatgtaagttaatttgggctattaatagatgcctttcaagtatgagccttcggtttgctgtacttaatatttttttaaagtatacaataacaacattgtgcaataaagtttgcataatattatcagaggcattcgagccagagcgactccattttgagtgaaggctaggaaaatgaggccgggacttgctgagactccatcttgactgagggctaggaaaatgaggccgggacttgctgagactccatcttgactgagggctaggaaaatgaggccggaacttgctgcgctgcattctcataaagtcaggcattcctaccctctagatgtttattatggttaagggaaaaaattaataatgtttaaacagacccagacttaggagtgtccagatatcctgatatctagagaacaatggcattcctaattttgctttaaagataataatatcgattcttgcaaactatagtaattaagaaaattaatcctttatcacaaaccattggagcagaacacatctccccatatatacaagcattgtacctagggtggacacgttcctcctcttactttcaggaacgtcctactctgtctatgaagtagctgccctttcaccactgtacgttcttaataaacttgcttttgctttgcactgcgcactcaccttgaattatttcttgcatgaaatctaagaatcctcccttggatctggatttgtgtctggaattggtgggttcttggtctcaatgacttcaagaatgaagccgcggacccttgcggtgagtgttacagttcttaaaggtggtgtgtccagagtttgttctttctgatgctcagatgtgttcggagtttcttccttctggtggattcctggtcttgctggcctcatgaataaagctgaggaccttagcggtgagtgttacagctcataaaagcagtgcagacccaaagagtgagcagcagcaagatttactgcaaggcgtgaaagaacaaagcttctacaccgtggaaagggacctgagcaggttgcctctgctggcttgggcagcctgcttttattcccttatctggccccacccacatcctgctgattggtccattttacagagagctgattggtctgtcttatagagagctgattggtccattttgacagggtgctgattggtgcgtttagaatccctgagttagacacaaaagttctccaagtccccactagattagctagacacagagcactgattggtgcatttacaaaccttgagctagacacagggtgctgattggtgtgtttacaaaccttgagctagacacagagtgctgattggtgtatttacaatcccttagctagacataaaagttctccaagtccccactagattagctagacacagagcactgattggtgcatttacaaaccttgagatagacacagggtgctgattggtgtgtttacaaaccttgagctagacacagagtgctgattggtgtatttacaatcccttagctagacataaaggttctccaagtccccactagattagctagacacagagcactgattggtgcatttacaaaccttgaactagacacagagtgctgattggtgtatttacaatcccttagctagacataaaggttctccaagtccccactagattagctagatacggagcactgataggtgcatttacaaaccttgagctagacacagggtgctgattggtgtgtatgcaatcctccagctagacataaaagttctccaattccccactagactcaggagcccagctggcttcacctactggatcccacacaagggccgcaggcggagctgccaccagtcccgcactgtgtgcccacactcctcagcccttgggcggtcgatgggaccaggcgccatggagcagggggcggcgcttgtcggggaggctcggacacgcaggagcccatggccggggggaggctcgggcatggcaggctgcaggtcccgtgccctgccctgcggggaggcagctgaggcccggcgagaatttgagcacagcaccggtgggctggcactgctgggggacctggtgcaccctctgcagctgctgccgcaggtgctaagcccctcactgcccggggccggcagtgccagccagccactccgagtgcgggacccgccgagcccacgctcaccagcacaagcgccacgcgcagctctggttcctgcccacacctctccctccacacctccctgcaagcagagggagccagctccagcctcggccagcacagagaagggctcccacagtgcagcagcaggctgaaacgctcctaaagcatggccagagtgggtgccgaggccgaggaggtgctgagagtgagcgagggctgccagcacgctgtcacctctcagattgggagcgcttttctgtaacaatatcattattgtgctatttaggagaatggatgactactgtaggtattatactaatggtatctactgcttttgtagattcaaagcaattcagtgggttgtgggaatataatgtgaaaggaaaataaaaacttgggtccccaattcactctgccaaaaagaaaaaattaaactacaagctgagtcatgcaagaagctgcctttccttttgtacctaagcagatagctacagataaaaggttaaatatctccacaggtagctactttatgttcacctgtcttaggtaaacagctgatttacctgtgaacatgtaattgactattatcctacttgatccttttcttttgcaacttgtggattaccataccctacctctttcccctccagcccactttacccctttaaatattgaagcccttgaattcaactttggagaaaggcacacaccacagactgtttctgtgattctgtgtcattttcttctgggtgtgtctttaaccttggcaaaataaacttctaaattgattgagtcctgtctcagatactttttggtttacaataatgtaatatctctttatatattatttttatccaaaataggtaagaaagaaacaaaatttcattaatatttactacacagtttgactctctttccctcagttggtctgaatgacatttggttacacatcaccataatttgttgtctaagtaacacaagatattttgttagtagaagtttcacagttagggtttccttgatttgagcatatcgtgacaaaatatcaatttagtaggtatctatcctatataaacttcccgatgaagttactagatggtgagtgtttaaaacaataacaggcagagtaggcactaattgagtgtcagcattatcattattgattatattattattaagtattctggttctatctgaattcactcaaaaaatagttggctttaagagtttctgcagagatacacaagttgaaaattatactggttatgtaaacacaaatggggaaaatctaaacataaaagctgatatttctccattttctaacacaaatactttgccagctacactatgagctcaaaaacattcaagtctatcaggaaggtatatatgaatttacattattgttaattacaaatcttatcttatggggtctattgtgccttcagatataaactgatgacagtgtgaagtcattacagtgagacatttaaaacctaaacatttagaacatgaagtttgagtatgatatgacatgcaatgacctgagaaaaaatcctttttttttttttttgatactggatctcactctgtgacccaggctggtgtgcagtggcaagatcttggctcagggcaacctctgcctcctgggctccagtgatccttccacttcagcctcctgagtagctgggactataggtgtgtgccaccacaaccagctaatttttttttttaagtagagttgggatttcaccatgttgcccagtctagtctggaactcctggggtgaagtaacccacctgcctctgcttcccaaagtgttgggattacaggcgcgaaccaccattgtcgggactgaaaaaatctttagaactgtcttttgtgtcttccttaatagtggaagataaaaagtcatagtcatttgggaaaacacttactcttatcatagaagtggctgaaataatactgagaaaccatattatcacatgctatattgcagttctatgtcagtaaatattcttaaaaaacatgtggacaacattgctgaatatgtgaaagaagtattaggaaaattactcggtactgggagatggactatagaattgcactgattctgtttcaagaatgaaaatcttgaagagctactttttatgaggctctgaaggaaacatagagacaatagattgtcaggagtgagcaaattctttggtaaaagcaaggatttgggggaggtggttatgaagggtgttcataaagagaaataggtaaatataaccactaatagagttggctgcttgactggaaataaaataacaatccccaggtaagttcacaaaactagctccttccgtggaattcattatttcataggcaagctgttgccgcagagatgttagaacctgaatataaaatctgaatagtattttataatgagatgtgcaatgactttactgtggactgtcttcttgtaatcttgtggccatgtacttcaaatgatgaattttacaaaaagttaagtgtcccgcacttgcagtaataatctggagctttttatagcgtactcccttggagatatttccagggcgaagatgacatttttaacaatgaaaaactacctgctttctggtaaccttaccttggagagaatattttgaaatgaatgtttggatatgttttctcattatacaaatatgtcactgaaaatgatgtaaacacatcatgtataaaatctgtgacatagggagactataaacttaaaagcagaatttcctaatcaaataaagagcttagatgagatttgaaatatttattagaaatatgaaagtgaaatgtcatgtggttagtttgtaagaacttagtgaccatagggaaaattggaatttactattgctacctgaattgcaacaaaatctttttgtaattggtggattaaaatgaaaaataagagtcattttccatttgtgtctatacatttttgtaatctttctttttcggcctttgaagaccattaaaacaaaacaccaagatagactgaacttgaagccagtcctttatattattgactcacaaagttttaatacaagatatttaatataagatatgaagcatattcagttgcatagcattcataactcaagcaaaatattatctgttctattaaaatataaaatgtagacattttttcttatttttaattttaatttttaaataagatatgtaagtattgaagtacagatatagttaaaataattttattaatatgctcctttttgcaaatgtgtgttcaaatatttgcttatggagtatgtcgtaggctgaattatcctcaaagatatccagtttcgaattcagggaacctatgaatgttgccttatatgacaaaagggacttggtgattaagttaaggattttggggagattttccttgattatctgggtgagctctaaatgtaatcacaagtgtgcttataagggggaagcagagtgagatttgactgcagaagaggagaaggagatgtaatggctgaagtaaaggttggagtgatgcactttaaagatggaggaagggaccacaagccaaggaatgtagaaagcctttagaagctgaaaacagtgaggaaacagattctccctggcgagcttccagaaagaatcaatcttgatcatatttttactttagcctaattacactaatttcagacttctaatgtctagaactgttagagaaaaaaattatgttgttttaagccactgttcatggtaacttgttacagcaatgttgggaaaataatactaggtatgtaggaaaagaaatttgaagaccattatctctactttagtttctaacttaatgaaaatgcttttgctaggggttactgaaagtaaccttagatgttttatagcatcctgttttttatttattgacttatttatttactcactcactcacttgctggctggctgtcattttgctgatttccatgagtttctggaccagatcctagtattcaacttccaataacattttcaggtgtttttttttttttttttgaaagattacatgaataacgtaatggcagaatcaaatttagaaactcagcaaaaaaaaaaaaaaagctttgtgtttcaacatgaatttctttttttttttttttttttgagatggagtcttgctctgttgcccaggctggagtgcagtggcacaatctcagctcactgcaagctccacctccagggttcacaccattctcctgcctcagcctcccgagtagctgggactacaggcacccgcaaccacgcccagctaattttttgtatttttattagagacagggtttcaccatgttagccaggatggtctcaatctcctgacctcatgatccacctgcctcagcctcccaaagtgctgggattacaggcgtgagccaccatgcccggccaacatgaatttcaaaggcaaaaatgctttcacatatctcaattaggcagccttgaaaataaaacttaagaagaagctctcttttaaaatatatttatagctaaaggtttaaaataacatgggttaaaaagtggtactagccttccaggtgctcaggttgctaatctgaatttgtatatgctatgacaaagaaatggttcattttattgagcacatatcaattgaacatgagctatttaaggtggttagtattacaggtgcatcgtaaattgaagaaggttgagcagttaaatgcttgaagatgagaatgttcttttgaggagagatgaaggctttcctgaagtccgtgatatattatattgcttgctcctcacttgtctttgtgtcctagtgctctgtcttaaagatatttaatttggtttcttcaagaaatgagattggtttaacaaaaatgcacttcagcaggcaccagacatttaccagattcattcttgaaccactattgccataaattgtggcacaatgaaattaacataaactgggattagcttggagaaaagagaaggctgattattttaatgatggattatactattaatattaaatctctttatgagaatcaaaactaacagaaaccattaggttctattatggtatttgccaaaaaaataaaatttagaagtatgtaattttttcaccaaagaatttgactcctgtaaagatccagtggatctttccggttagtaacctacatgtgaatgaataagatgagtacatgtgtgttttctttctcctctttgtcctttgtcgaatttctaagccatcccttaactccaagcttctacctgtatgtgaacgaattgggtgtatatttcctacaaggctgcactctgaaataatgcagataaattctgtgcaagatagttttaacattttaatgtttgagtctgaagatactatgttttttttcaaaaccagcataaaccaaaatttttagaccatcatcaagtttttacattattttaacaatctactcttgaaaaatcatatctacattatttaaatatataagttattatttttaaataattcagtttaaaagtatttcttagggcttatttacaaatattttttggtggtccatttgcaatgagatgataagtgttgtcctttcacaaaaattaggtttttctgtaatatactttgaacaggaaacacatgcaacaatgaagaatatttaacaaaatccatagtgaataggtcctgtggaggatcacaaagccccagtagcttataaagtcaggtggaaaatatgttgtccataaatatgtgtaatacaaggcagtttgagtcatcaagaagtgtttcatggatgagtccatatctgagcttggagctgagggatggtagaaattggacaaaggacaaatgggagaaatgaaaatgtgtttgtgaaaagcagagttatctagtgtagtttaatagtaaccattatgtccaaactttataccaaaaatttaagataccagatagggagtttggacttaaatttttaaacagtgggattttttttcttctattaaatctctgacaggtctaacgtgatcttgagggaagtctaatttggtggtaataagtagaagggactggagatgaagagatgggggcagggggatcaggttagagagatgacatctaggaaattagagaagacaatcaggtgtgacgattaggaacattaccaagtaaaataaaaacaactaattttagaaattacattgagaaactgaatttaaagttcccttttatgtcagagtttaaagagtttttgcttgatttccagtatcagatatgggtattacagcttcttctttaggacattgatgctttaattaaaaatatatatgaatatattaatgacaccttacagcatttcttggctttcagatacttttatacttccatttgcagtagtttcttaaattgtcattctacatctgttattgttacgatacagaaaactcaatcctttatagcacttttgaaatagattcttccccttctactaaaattgtttccttaaatatctctggtgatatcttagtttcagatccaaaggctctgacttcctcaccctatttgacccacatactgtgatgtgtttgctctcgacagatgtattatcttcctgctcaaatttgtttctcctcctgtgttccttacgtcagctgatggcagcaccatctgtgcgttgtttcaggtttaaaactatggatcaatctccagttcctcctttaccctcagtgtccagttagttttcaaatccatttttcccttcccttgaatactctacatcacatttcattttttccctagtttaggttcttcttagctgtattttattttttaaagatgttcattttacttgcttctttcctgggactattattataagagacagaggtctgatcatcttgttcctattttttatggacctggtatagtctgtgtggacttcctggatgaccaacaaccacaaaccaattcactgtgccagagagaaactgcagccccagcttagagtgaagggggttcgtgtgggtcacagaaggactggtaggcattttctaaatttagatcatttccatgactattggaaagaaccctacctccccacctccacaaaaggctgatgattgtgcttcaaagtaaatggaagtggaccgaggagtatttatttatttcctgagctgaaatcagtgttgtccatctcatttaaaatgcaaaacttccaattcaaagaaacagtgtatatataggcaaaaagcaaagaatgttttgcattgtttgactagctagtcaaagcaaaaccgaataactctacctcagaagtgtcttcacttaatggtaagatctgttcaaaggcacgtcaacatggtcaaaattagttatatagttcttctgagttttagccaaggactttaaccatcctgatggggaaatgatacaaaagtttaaacatagttgcagatattcaatgtcttgattatttaaagaagacataatttattttcttactgatgctattatgagtgttcttgtttttctaattccatgtttcagatgttcttattagtatataggatagctgatttttatgtattgatctatatgttgcatccctgctacactcatttattagggccagtagttttttggtgggttacttggtgtttccaatgtatgcaatcatgacatttggaaatacggtttaacttcttttccaatctggatgcctttcatttttttctctctctctctccttcccttccttcctttcttttatgacctaatttcactttcaataataacagttcttgtctaaaaatcttttttgtgtgactggatgtagctgtttcacctcttacggttaatgttttcatcatgtgcattttttgtgttcttttacattcaacctatttgtagtttttaatctatgatgtgtctattatagagagcatacagttagatcatattttttatcctgacaacctctacattttgatagaatgtttagaacatacatattttgtgtgatataattggatttgcatttgccatgttgttttttcatatgcctgctgtattttttgtacctgtattcctccattcttgctttcttttgtgcagaatagtgtgccattttgaaacctctgttgatttctttactatgtattttttgagttatgctcttaattcttatgtactcggggattgcaatatgtgttattttaattcatctaaaatcgtaacttcacagtctacttcagaataatactcatttaattccagtaaaagatagaaaacctgctccaacatagcttcatttcctttcccttccttcatactctttttttgtgacatatacacccatacatcatacatatatgttccaaacccaataagatactattataactatttaactgtttctttatacattcttatctcttttaaagacgttaagaaataaaatttttacagtcttttatgttaatccacacattttcaatttctgacattttttatttatttctttggaattgaaggaagctccttcagaactttcttttgtatttaactgtgctaggaacaaattctcagtctttgtttatctgcaaatgtctattttgccttcatcttttgaaagatgggatatgagattcttgattgaaaggttttttttcttttggttctttgtcatctcactgccttctgtcttctcttttgtcagatgaaaagtcagccattaatcatatatccatttgatgggatgtgtattatttttctcttactgctttaaatacttctatttttgtctgactgtcatgcaaacaatttgactgcagtgtgtctgggtgtggatctctttgtatttatcctacttcaggtttattgtgctacttagatgtgtaaactaatatttttcatcaaattggaagtttggggccattcattatttgtttaaatgcatttttctgaccgcttctttctctcctattcttctgagactcccattacacgtatattgatgtacttgacgttattccactggtttctgaggctctgtgcatttttttgtcaatgatttttttttctgtgtacttcagattgaataatttctgataatctatcactgattcttcttcaatctgcaattgaacctctttagtatatttattattttagttattgtattcaaatacagattttccatttgatttatttttgtaatttttgcatcctttttgataatttctattggttgattcattgtttccatactttaatttttaaagcatgctttcctttagttctttaaacatatttataatagccgccttgaagcctttacctgctaaatgcctttgtcaaggcactcagagagtttctcaagactatgttttccccacagaatgggttacactttcctgggcttttactgtctgtgtcataattttttgttaaaactggacattttagataatataacaaccctgaattcttttatgtctctattgaaggttattgttgctgggtttttttattttttctttgtttagtaaattgtctgagctgagtctgtgacatgtctctccttgatgggtggccaataacgtcattgcttaatgttttaaaaaaattattcttatttttattttaagactagctttctagagactttgctattccttcatagcttagagttcaggtaatgatggtacagagattgtgctcagacactttgaggagtaagtttttagtcctctaccagccaacctgtccgtggataaggaaatgtataagaagttcaggtcattttcaagtctaccaagatttacttcctgctggttcctaggtgtctttcttgtgcatgtgcaacttcagtcaaaaatatactgagttagagctggtagaggatcaccaggtgtgtgctagcagatctgttggacctccctgggatgtgtcactttcatagatggtgcagtgtgcatggcatctgctccaaatcaagtgagttccctttgacaaggtggcacagctactggtcttcacagctagcccatgtcatgacatggtagaacctccacattagtcgagctgtggggagatgggagtagcccaggaaagaacaccacagatttactgttcttacccaaattgtggcagtttttaagcataaaagtttcttatatttttgtatgcctttggttaatttccacagctctgaaagtgttatttttgtcaattttatccagctggctttttaaggagaagatttgccaaccttctcacttggtcatggggggaggtgcatataatttatttaaaaaatgcagcgtataaatatttttatctatcctgaattgatccttcaacataaaaaagtgttatgttatggctgtatcttatcaggtgctcagcttctagagttatctttcaaaaatattctttgatttctttgtattacctataaactccttcagagccaaattatgtgttaagtgagatggactttttggttactgtattttttgtgttccattagcttcaactataggtttatcatctgtaaagattaataggactctgaagtacctccagatcacctgctgttaagtcagagtcacatctcacaaatacagctctagtttcagttccatataacattccttggcctcatatccaaaggtatataccctgacctagttgtttaattacaccatatctaattctatcatcaagattcttcaaccagaaaatattgtatctcctatggaagtggtgactcacctgcagtcagcaaaggaaagccctctgtatttaaatatatctacagcacatccatccagacaggatcacagtattattgccttccagcacttttgctcctgctagtacattcccagaggagctcatgtgaggctaccagcttctaaaatggcccttaagccaaagtcgtggagtatggggtattcatgactccattctctctgtgtgtgtgtgtgatttttttagagcaggctcactgtcacatttaggtttttttttttttaaatcaatcacaaatgttaccacaaatggacagggcaataaaaagaaaacaactgggaggcaggctgatatgaccttgtggaaggcagtctggtatgagttttaggctaagcagataggtcttttaatagtttctggcttagggcatgtcactcagttttctgattcactggttactcatttctaaagtggggataataatacttatttcatgatgagaattaggacctagcacaaagaggacccttaaaaagtgatatagctattattacttgtataattgtctctacatttttttatattcttgaaactgcatagaaatttcatgctagtacaattcctggcaagaattccaaggtgttgaatgtctcagtctgagtctgcttggagtttctagattttattatacttcattgttttttaaataacagatttcttaacttggagcccaacttcccagaacatgattccgatatacttctgtgactagaatttatgtgttttaaacacaacttaggaaagtgggccaaggatgttggtagaggatcactaggttcgatgtcattgagtgataacagaccagtacacagaaatagtgggctttggagcagagaaagagtttaataattgaatggcaaccaaatgaggaggtgggagggaacctcaaatcctcttcccagagggatactggactaggatttttaaggggattttggtacatagagggctgaggagcttagggctgctgattagttagggcagtggggatgaagtcataaattgtattcttatgttgaataagttctttagaggggatcttcagactggctggtgtcagtggaatacaggatctgaaaatatctcaacatgagaaacatgaggcttcttaatgttaaggatgttatctacagaaataaggaccttgtaacaggggctatgtgatttttaagcagtaagtacctataaggaagtggactatagggcaggctggttaatgcttagctatgcttctactcaaagtgtatgcttttattgaaaaacctagcaatttaattttattaattttataagaacagtttcaatgttactgagttgatttcagcttgatttgttcaaactgatactgagtaattaatttagctcttgccatttcaaattaatttagatgaaattaatccagctcattttcagagaatgagacacctgcaaacagtgagatggttggtatttgtatggttatgcctgaacgaatctgcactatattacataattaattgaatttgaagacatcatcttatcacctacacaactttaattgtggaagccatacttactgtcttcgcttttctcttctccttttgacttttgtgaaactctagacaagtcggaatctgttggttgccctcatctatgtgtttgtgtgaattatttttccttcttcaaggagggcatgagacaaggaactatggctgttgtggcaaaggtcatattccagacaattaagttgacctggttactgtaaaagatattttttgtcccagatactatatcaggcaagaaacctatgaatggattctacaaaatatccctgtcacagaactccctagagacaacactgttgctcatcagaaatgttcactgaaggctctatcaagtgtgttcaatctgtggtctactgagatcctgcagacggcaaagctgagatattactgcaaataacaagtatttgtgactaacaaatacttagctcatacactatttttgtcttagttattgctgatccttgttatcatgaataggctaacatgtaggatatttcctacatacgtaataaacacacacacgtgtgtgtgtgtgtgtgtgtgtgtgtggtgttaatttttttttaaaaaaaaaaaccttttttgaggaaagagtgaaaatgtgctccaaagtaattcgtggctagaggaactgcaacagtgtttcaaatatttccatttatatgtttgttctgtggtgtgttattcgtccatttattcatacatttattcaaacatctctaaactctgaatttagtagtaagactccataactcttcaaatagtagatttctcaacctagagctccacttttcaaaacataattctgacatacttgttcgggatacttgttttccagagagttggtatgtggagcttttattgagattgtgattttttttatcatgaataaaaagatagaaaccagtctgcctgaagtgagtttgaattagcaatgttgagaggcaggaacctacatcagaggaaccattagtttgcatatatgactttcaagatacatagtatcttgaggctcaattcatagcagaagtctcttttctgctttgtctttgagtggtttgcttgcaaagttccaggtaattgtatgcacatcaacaatggctccctctcaagatatatgtgagctgatgtgatgtaagccaacattagaattagagaggtatgatggaatggttcatccaatgagtgtaccttctagttttgcactgacacgtctgagtcatttgaattttaaaataattgtaaaaatcagatgaattggcctatctacttaatattaaaggatgttgtattatgaaagatgcatgtcaaggagcaaaatgaacaccgagcaaaccatatgggatgctacgaattcactagggattttcataattagctgctaagttggcacagctgtgggtctttgtagccgcaatgtactgctaattaccactcatttaaacgtgctgctatatcctctctcacctggacctttctattggcaagaatgccaagggaatgacttgagtgtttctgaagattcaaaggatttaagaccggggaaaacccagagacatcagcttcatttgttaggatcacatttagccttgtctttcaaaaagctgacctgaacgaatgagttgacacaggaaaaatctttccttcttggaggcaataatgttaacctctggcgcaaagtgggatgaagggaaaaagaacatgacaagaaaaactacccagaactatgaacagaggtgtgaagctctggaaataatatttccaaactaggaacatggtgtaatgttatgattggggttttgaagcaatgtaaagaggaaaaagtgaactaagatttttcttagatcttgcctgttacttcctttctacagtatttcctacgagtcaatgggatacaacaccatggttttttttgtcactggagaatatataaacattttaaaggatattattccccatctggtaagtgacattttgcctggttcatgtctctagttggtaaattaaaacaacaaccaccactttatctttcggaggacatagaatttgatatctccatcatttggggagaagtcgacactcaacagttacagtgccttcctgaaggccacacagcagatgggcgcctaagcaaaaacaaacctgcctcaacttcagaccatctgctctgttttaaagtatactgttttcacatctcttggtggaagaacagcttttctcttaatttatatctctctgattctgagctctcaatctgatttagggttttcttaaattaggcagataaaattataacttattggcattgtccaggttatcatgcattgattttcttctttcgatctctttgaagtcggataagtatttttccacttcataggcagggaagctcagcccgactcccctgaggtatcttggctagttacccatgagatctgaattccatgttcctggtacggggatttactgctgtcaaactgtcaacattaactacatcattcatttgcaaaatacattttgagatacctgtgttatgtcaaaggtcacttggagcccaattgaaaggcagtgtgaaaagcataattaacttgtttgcttttgtgctggaaacctagtgttaacaaaacagcccaaccaaaagcagatttgtcattagggctctaactgcctgtatccctatagtgtatgtgcatctgtttgattttccagaaatagatgaaatcatagtttgaggttagttcatcaaacatcgaacattttctttgtgtaagtcattgtattagggctgctgctggtggtggcggtggtcatgaggtagagtgggatccaagctgagtgacagtgttgcgtggcagaacacgttgattaatcttcagcaggaatatggtgtatctagattctgtggcagtcatgccaatgaagtagaaatatctttgctggcagacagtgatctccaggatatatcagtaaatttaaaaatggtaatttatatagcgtgaacccattaatggaaaaagctaatctatatatttctacatgccatgaatgtttctactgctatgaatacatagcatatgtatacatgtaaatgcatagaaaaaggactgcaaataggccaggcgtggtggcctgtaatcccagcactttgggaggccgaggcaggcggatcatgaggtcaggagatcgagaccatcctggctaacacgatgaaaccccatctctactaaaaatacaaaaatttagccgggcgtggtggcgggtgcctgtagtcccagctactcaggaggctgaggcaggagaatggcgtgaacgtgggtggaggagcttgcagtgagccgagattgtaccactgcattccagcctgggtaacagggccagactctgtctcaaaaacaaaaacaaaacaaaacaaaaaatatattaaaaaaagaaaaaggactggaaatatgcacactataaagggaaagtgagtataattaaatttggaaagagaattttcagttttccagtgttgtttgacgtccctacaaggagatgtttttatgtgtgattttatgtgtgatttaaaaatatgaaatagtgtgcataggtggggaccttcacgccgagggagaaaaaaatataagcaaaggcatcaggatgtgaaatggagtagtttattagtatgcagtttttacacataataatgagaaggatggtggcttaatgtggcttatatagtcctaaattattggttgttattcagttaaggtaatgacatgtttcagtaggtttttaagtgagttaggcagatacaactctggaagccaagtagttgatggatactttggttggaaacctaattgatttttacatagcctctccagagccagcaaagccagatgctgctttgtggttattcttgagatttttttccccctctaagactatacagtgtttgccaggcaggggaggatggtgaccagtttgtatttaaaaaaaaaaagaaacaagaaaaggcacacagccatgctgctggcttaaagtctgttacctttcccaaagtatatatattctgataaaatcggtgttgtctccatatgaaaagtattattaccctcctgcaagcttgctttaggcactattctgggtagaatagacagacacagatgtttagacagactgaatctctttctctgatttaattttgcattacaggtaaacgccatatgtaatgtgtaagaggcgggtaggtaaacatgctcaactgcagtttttggttttgtgttccgatgtgatctgagtatttcgaagcacttataatgcagagcgtactatatgaaagttctcatgatttgggagcacactcatagtaagggcaaggaacgttctttcacattgaagttctaaaaattaactgtctcagtaataagacttaagcaaaaacaaagtaagactaaggaaaagatgataattttcaaatgcttgcaaatgggagcctctactccccatgtttgtaaaatgttttaccttatcttccattcctggcattaggagtcattttggttcggggccatttattgaagctgatctttaatgaatgaatgagaccctttattttccagtgatgctgctttatttttgggaagtgggaacaaaggcctgacatgctaccatgggtataactgtacaaatttcaatgttatttgaagaaatagacatctaaatgaagaaatacttttagttgttgactttaaaaggtacaaattatgctgatgattctgtttaaaataactagatcatttttctttagagcaaaacagacaacactacaaatctctgatgtgtattaagttttcctgaaaggtaaacactatttttttttttaactgtctcagcttttctattacatttgtgtgtgtagggggagctgggtacaaagagaaagcatggtgaagatgactcagaacaaaatgggtggcgtttgtaagacacagggaattgcctttgaagattgttggcgtgtttatttatgctaactcccacgatctgaaaaaatagctgtagcaggctcattactctgtggaaaaataaaattcatttgacaggattaattcatttgaaacccatgtggttttcaaggatctttaaaataacatgagatattacagcaatccttactttaacattttgatctaagcaaaggcatgaaacaatttaaatacacccagaatatgaagttttaaatgttaccggaaagtgtcttttcttgacaatactggaacattttggatgttatgaacaggtgcaaaattatagatttgtgttttcaaacactatttgtgcgaagtagaatccatgcaagaaccgattttaagaaacaagtggtgcttcatcatttccagaaatggagaggaattacaatatgcaaaactaatgataatagctcacttattttaagttctttttatattcttgacactgtgataagctctctacatatattatttcatttattcataacaaccctatgagaagggtataattattatccaattttttttagggaaggaaaccaaagattataaaagttaacagctaataagtaatgaggccagtatttttgcttaggtggtctgtgtatagaatccatgctcttaactattaggatatgctgattctaaagcaattaataaatgttggtctgaaatcagtctaatggcacgctggaaacagctcttagacactgccaagggttgattgttagatattttggatttttgtaagccaatttgtaaactttgatactttgaaatcagcagtgattggagtatttacaccacagaaatgggcaaatgctacaaatcaaggcattttttttcaagtcagttcaccagcacaccatttgataacatagcgccctttcagcagtgccaaagtataagccctcacattttaaatggatataaatgaaataaacacttacattaacagttttttttacattagcatttgtcttgatctcaagaggacagactataattagtatggttagaactttaaaaatgaaatttaagagtatgtattcctaaattccagagtagaagagagtccttttcctagcctttgaacttttatatgaggattttagaaagaaagcccttgtctggccaactgcagactttaaatgcagttagctgtgccagatttgagaggactctttgctggctgaaattgtctgagcaggaatggaaagtgattgggttgggtaaacaggagcccatgataggaggatggcagaagccagagaaggaaattttatttaaaaaaaaaaaacaaaacagaacaaaacatgggaaccagtggggtttgtgtggtctgagtaagctttgtggccttattgtgggcatcatttatccataaaataattttagctttaatttgagaactctagtacttgatttttccttgtaaccataaagcatcattttatgctgtgatgaaaaatcattccaatggtagaggttcaatttaataaaaacttaaaacagtgtaaattgtaatgtggatgcattgcatcagcttatcaaatttatcctcccagtgttctttttatgaagaaagcgtaacttgcttacatgttgtgtttaatgtatttgtaatgttcttctgatatgaagatcctccattgaacatttgcttgtacctggttggactgcatactggatcctgcttgtctaagcgaaagcatacatgattaataacttacggttctaactcaccaatcagttctttttcattatttattatgatttattggaaaacatttccataaactgaaagaaaagaaagaaatgcattcacaatttaatcatccaaactgaattttcttcctttttttcaattttatttttattttttgagaacagggtcttgctctgtcactcaggttttcatacagtggtgtgaccatggcttactgcagcctcaaactcttgggcccaagcattcctcctgcctcagccctctgaatagttgggactacagccatgtgcctttttttatatttaaaaaaaattaaggcctggcgcggtggctcatgtctgtaatcccagcactttgggaggccgaggtggggcggatcacgaggtcaagagatcgagatcatcctggctaacatggtgaaacccccatctgtattaaaaatacaaaaattagctgggcttggtggtgcatgcctgtagtcccagctacttgggaggctgagacagaagaattgcttgactccaggaggtgtaggttgcagtgagccgagatcgcaccatcgcactccaccctgggaaacacagtgagactccgtctcaaaaaaaaaaaaagaaattaaaacatatatatgttaatatatgggaaggacaagtactgctctcctacgtgcatatattgtgtagtggtaagtctgggcttctagtgcacccatcacctgaatcgtgaacagccagtcaattcttatcctggttccttcacctcctgagttgtgattttgagaatctgtggtgtattgattgagatagcggtttaagagaaagagaaaaaaagaaaacagatggaggatgaaaaaataaagcaatacagatatacacagaacaggaccaagttagaggcaaaatatagcatccaacttgaataaaacaaagtaatcgctactttgtggataaggagaaacctgtgtttgggaatattttatactaattcagttttatatttgcttatctttaatattaatttgagacaactattatttttctgttctttaatttttttatcagcaaactgaatggtaagttagaaatgaatgtatgagagtcagagaaatctggattttaatccttagcgtgaaaattttataactctgtgactttggaaaaggaatctaacttctctgtttatcctgttcacacgagtgatagtaataatccttactatagatgaccacaggaattatagatacagctcccagggcaatgcgtatcagagtaagctgtgtctccttacattttcagagctgttattgttgctcaataaatggcagctgttgttatctgtgtttttgttgttgttgttgtttttgagacggagtctcgctctgtcgccaggtctggagggcagtggtgtgatcttggctaactgcaacctctgcctcctgggttcaaactattctccagcctcagcctcctgagtagctgggattacaggcttgtgccgctgcgtctggctactttttgtatttttagtagagatggggtttcactatgttggccaggctgaactcaaactcctgacctcaggtgatccgcccacctcggcctcccagagtgctgggattacaggcgtgagccaccgcacccggccactatctctggttttttaaaatgtattaaacatgaggagtaatgacagtgtttcttgatgactggggaacttgcagtagaaagttgacaaatactgtttctatgaaagaaactggagcctcctaaggtaagctgggtctggatgcttgatgaagatgatgctgctgactgctcttcctctttctgtgcagaatgtgcccccagacctctccatctgcacctttgtgctggagcagtccctctctgtccgggcgctgcaggagatgctggctaacaccgtggagaaatcagaaggggcaagtacccaatttatgtagacttgtagtattttaatgagctcagctactataggaacaatttctttcacaggtgtcagagattttctttttgctaaaataagtccatgcctttcagttggaatgtccttaggtttgactttctgctttatctagcatatttgtggtgtcttgaaaactaaaaaaatatatccaagcttgatgtgatctgtgtcactaggcctcgtgcttatgtctgttgtttaaaaccgacctttctttgagcgtttctgtgtttcattacattttcagagctgttattgttattattttaactcatagctttatgcatggctatttgtcattaacctttatttcattttcaaatgtctgtcactatgtgactatgttctgagctttttcatggaaagtaaaatttcatggcactgttatatattttaagtaaccaaattttggtgatatggctttaggctattgtaattttgcaaacagctaatccttctcctctgaaaattgaaatttttcttttcttttttttgagatggagtctggctctgtcacccaggctggagtgcagtggcgcgatctcagctcactgcaagctctgcctcccgggttcatgccattctcctgcctcagcctcctgagtagctgggactacaggctcctgccaccaccacacctggctattttttttttttttttctatttttagtagagacggggtttcaccatgttggccaggatggtcttgacctcctgacctcgtgatctgcccaccttggcctcccaaagtgctgggattacaggcgtgagccaccgcgcccagccctgaaattgttatgtggtttcctaatgcaagtatttttctttcaaagcctatttggttattttattttcaatgagacttcctgtgactgatatctgggctgttacccagtcttaaccaatttattaaagtttagaattaagcaggaggattaatggtcaaattttttgtttccaggttttttaatttttattttttggtatggtaattactgcagtgtatggtttaataaagtgtagtatttccagagagaaaactgaaaattttattttgccattattgatctatatgttgctgttgttattaatcattactctggtctggataaataaagagattaaaaaatggtaatatataaatgattatccatagaaaggagtgatcagttataacgttattttcatcagccttgtagtttttaaaattttagtgtcatgcagcttatgactttagttgatttgtgcattaattctaaattaaatttcagcagtgtactattaagtagggaagagaaactttagtgacttttgatattagactagaagcttattttacaaaagcttagtattttagtttttcaggttcattttttgtttacaacaaagtttgaaattattaaaatatataaagtttcttttaaaaatttctattctttcatgtaaaccttctcagttatgcttaagttatgaaagagtaaaacaattctcaatttagtttcatttctacctgaaataacccctcctgatttttaaacatccctgagtcatatcaactttgatatgcaaatcagcttttataaagaaagatcatttttatttggcattagcatttaaaaaatgcatcttgccatttcatctgtctttatagataacaacttagaactaaattgccataaatttaatttttttattgttaagttgcgttttttaaatttaacaactttgagaagatcttttatcttcttcaaatcatgaggttgggctgggcaaattctaaagtttcttgaaatataggaagtaatttgaaatactgttttaggatttatggtttttttgagatggggtcttgctatatggcccaggctggtcttgagctcctgagctcaaacaatcctcctgcctcagtctctggaatatctaggattacagatgcatgccacagtgtacccagcttctaggatttatgttttcaagacatttattagttagaatttctggatctcctcaagtatttttatttagctgaatttagttttgaattgttcactctctagaatgtctccatcacagataaagtagtaatttgtgtgatgtgttgaacactattttataaagcgcagtatagttaccataagacatgaattaggaagtataatttgaggaaaaactgctacaaggaataaacacattgcatgaagctgaaacctatttctggttattagtaacttttagaaagaaaccaatgtcaaatagctcaacggggtaccgtatattagggaaaaatgaaagtttctctcatactgctgagtatttttgattatacccagaaatgatattcattcctagcttgccacaggtgatgccagttaatgagcacagccccagccacagcgttggaggaggagttctggaggcctctattgtatttatggatttggaggtagcccgagcaacggggggtgtcctggaggacccctggggtggtcagggttagggagcactgtggggacttgcggcagcaactgtttaccaagaaggatagatattttccacttaaccattttattcataaggatgtgcaccagctagatatcatgtctgatgatatgtgactcatggatgctgctggcacttgtaggaaccaagtcttctgaactccaaatatcatcttttctagtgccttataatgtcccctttacactcattatggaactctaatggggaatttttttatcaatcaaattactatctccaggttaataaatcatgtgtagtttgcttaaatgaagagccacttttcctaggatgaagtgtgtcaggaaggtaatgtgaattttcaagaaatcatttctttcctttcagatgaacagtgagtcaaaaagaacctcgtgttgccctgattcccaactctttcataatcaactttctttacgaagccctgttcttttttatttaataattcttctttaatttcttacgtaattcagtaaattaaacaatacttatactatttcatgtccaaaatgttatatgcacatagcaatacaaacacacttgatgataaggaaaatttttccatttagaaccatgcctttgttttttgtggttaaggaccattttgctagtattcttgggtcatgaataaatacatggttttcataaaatggttaaggaaacttagcagaaaactcccaatgtcatttgtgacaaagtaaatcatgaacattacgataacagaagaagatgtgtaagatgaaatgggagaaaatattacctaatgtatgaagttttggttccctaaaaagttgcttattgtgactattagtaaaataactcatatttttgtggcaccaaaatcattctgaaggatttcatctaagtggattttctaaaatgtctgtttaattaaaatatatatatatatatatatgttaaaagagagacctagatccagtatttatataattacattgactatcatttagcttttattcttattaaaatcatgtcaatagtaaataggccaagacctgtctatctcagtagctgcccacagaagctttcagatcttgaggatggagacagtacacaggcaacgagaaggagaaggtgtctgttgagcagcaaccatctctttggccccgttttctctgggcgtctgcctatgcacattctggcttctgctgttctttctatttcccccactgggttttctgtggttctggataacttgtcgcttgcagatctacctctgtattgctcttcttgctcttcagatctattttgcgtatggatgatatagcatagggttaaaaacaggggtttattgtcttagagaactgcttgagaataccagttctgccatagttagctctgtggctttgggaaagataactttatcatcaaggcttagtaattattaaatgatggtgcatgttattattgttttatttattcttttttgtatacttttaaactccctgggttggactgctattaattcctgactgccttttctctgggcttgatggctttcttccttctctgggacatagccagtccagttcccacttcctcccctcgaccccagtattctcatcaatcctggcacatgtagtttgccgatttaatgatgccgcagcagtgttagaatagagagttgatgatagcatttgcttgtttccatgtgttttgtagttaataaagtttcataatttaagtaatattgtgcttttggctattccttttatcttaattcacaaaattatgatagacacttttctctcacacaactttatttgtaatgccaaagttaatttaaggatttcatctcctatgagcacagatatcaagtgagaggtgacgtagtatagtagaaagggctttggttttggagtccaggaaatttactgaaagttctttttcaaataatatttataataattatcatctgttgaaaaggcgttgctttggtttaatgccatgagtccaatatatggcttgtatattctgttgaggacagcgtattttaaaatacacgttgagtgtcctttctgtctttcgggtgaattatttctggggggattgtaggaccctgtccttttcaactttagcttatggccacttgactgggtccctttattattagaatattgtagattgaactagagaaaaaattaaaattaatcattctttgctccttacatcgtgctctttgatggagtaatagattaacatttataattcaggtgattatgatttggatcattcattcatttgctatataatcctcatgatcgtgggtattggtagtttaccgctatgtaagttatggatgatactttaaaaatctataaaattcacaatgtaatgttataaatattgtgatgagcaaataatattgaaatgaatattaaataaatccaattctaatcatttggtgctttttcaacatttataaggtaacttatatcttataaaggttctatgtatagaaatttaagtgtttttttgtcatcaatgagtttacaactgcagggatagaaaaacaattatagtataatttcatgtatgttatagaagtatatataattatcatgttggcatgaagaaggaattgtgtacgtggaacttgttgttcctttacattttcttggcactttttagaatcatttccaaaactattagaagtaatattaaaactattaatagaaaaatcatttcaaaattttttccaaggaacaatttgagctcattaggcaattccttaaaattttaatagaaaataatacttgtcaggaagacaatccaaaacatgtccagagatattcttaaaatgatttttatgtttcagtttagtaaaatggcttattgttttataagaaactgtaatgatgtttcctctttctaaattatgtactgtcttcaaagtacaaaatattacaatgacttaattattaacagaggtatagatcagactcagacatgtccagcttttatgaaaaatggagctgtagaatgtggagtagtaaaaaacttgtgttggctgggcacggtggctcacgcctgtaatcccagcactttgggaggccgaggtgggtggatcacttgaggtcaggagtttgagaccagcctggccaatgtggagaaaccccgtctcttatgaaaaatacaaaaattagctgggtgtggtggcgcacacctgtaatcccagctactcgggaggctgaagcaagagaatcgcttgaacccaggagatggaggttgtagagagcagagattgcaccactgttctccagcctgggcaacaaagtgagactccatctctaaataaataaataaattaattaattaattaaataaaacacttgtgtcattctttttataaaacccctatctctttaagacatgtactctaagaacattcaaaaatgcatggggctgggcacggtggctcacacctgtcatcccagcaatttgggaggctgaggcatgtggatcacttgaggtcaggaattcgagaccagcctagccaacatgttgaaaccccatctctactaaaaccacaaaaaattagccagacgtggtgacacgtgcctgtaatcccagctacttgggaggctgaggcacgagaatcacttgaacccgggaggcggattttgcagtgagcccagatcgtgccactgcactccagcctgggcaacagagcgagtatccatctcaaaaaaaaaaaaaaaaaaatgcagtgggaagcaactggctaaatttactggtaaataaattaaaaaaatacatttgtgaagcactgaagccccataaattactttttaaaagtacatttatcaaacactgaagctccaatttcacacaagtaattgcatctaagatcattttatataaatgcaagagcaaaagatgaagaagatctgtgtattatctcatagtggttaaagctcatagattatagtacaaactccctgagttcatttcctggtaacataagtgacttaacctttctgtgcctcaattttctcatttataatgtggggaaaataatagcatctccctttgttgtgggaatcaaataatataagtaaagtgtgtagaacaatcgtggcatgcaagaagcactatgagtatgctgtcatcattgtgatggtctctgcattgagtatgcctgagtaagctcctatcagatctgatccttctgaagaaaataactataatctctggacaaaatacaaaaacaaaactacacccacaataataaaaccttcaattacctgaagcccctagctatagttgctctatggccgcctttacaagttaccgctaagttggtggcttaaaacaacatacatttattattttctagcgttagaggtcacaagtctaaaatcaatctccattggctaaaatcagggtgttggcagcactgcattgcttccagggactctagggaaaaatctgtttccttgccttttctagcctgcattcttggcttgtgacccatcctccaccctcaaagccagcagtgacctaccatgtcacatcgtcacaggtgccagggattaggatgtggatggttccggtgtgccattatgtgggctaccctatcatggatgtgctgagctcgagtaagatgttattgacaagatcaaatggaagtcagaacaatctagttgaaaaatgactgaaaagtctactttttgatttgacaggagcctgattttcttgcaaaccgatcaataggaatttcagtctgtcttatgtacataccaatttatagattcacatacattttgtatttaacgggcttcattctctgaaggttttctgagtttccagtagttaatcacatgatttagaatttaaatttaagtatattttcatattgcatgcatagtagacactaattacttttaacaataacattaatcaaaaataactaaaaaaatgaggatatatataaatgcaatttgttgagttcctatcgtattccagacaggcatcttcctaagccatgaatacaaaatagtgagtgtggtattatttttctttgttaatagcagcctgttcagtctttggctatagtctcttctgtgtcaggtaacagtatttgaagtatggtcacagttccaacagtagatcttcatatttcttttacatcctcattcttctggtattatggtatctgctcagaggcactacatcgtaaagccttttttgttcaagctttagggcagatagatcaaggatcaaaatgaaaagagttaatgttgtgtccacgctagttgagttttatattaatgatttctttccattaaagcacattggggtaatgtggaggaaaaggagttgatgaattttgtagttcatatgatataaattgtgttctgtatattattaaaagtaaatttctcaaatggcagggctaatgactcactggaaaaaaatgaggtttaacacttgatgttcatccattttcaaatatgctctgtatgagtctccattaagtctctgtataagtcttctgtattttaattctgtaaaatacagaattaaactccattaaaatacagaattagtatgtaaaactgtgaccatactttaaatagtgtaaatgtagagatacctgccactgaagagactatagccaaagaatgaacaggctcctattaacaaagaaaaataataccacactcatcatgttttatttgtgtttcaggaagatgcctgcttggaatatgataagaactcaacaaattgagcatttatatatatcttcatttgtttatttagttatttttaattaatgctattgttaaaagtaattagtgtctattatgcatgcaatatgcaaatatacttaaatttaaattctaaatcattgaaatgttttatttttataacagtaatatatgagtataaaataaaaatgccctcttcatagtcctcattcccccctaagataaccacagctaaaagattagtatatagccatctataactttatacataaaaatattattatataaatggaatcatatactgtcttgtcatcttttaccacctaattatatatggtttttaaaaaatcaggacacaaaatgtccagaggaagagaagattcagatttagttgatccaagctctaggtgagatttctgtagttctctttgccctgttctgtgtttgcttggttcacaggctagcttccctcatgattacaggataccttgtaggaatttcagggatgatatccaaaggcaacatcatctataggcacaaaaaggagctgactttctttatttctaaaagcaaggcactttccccaggaattccctggcagaatttccctcatacccattgtcacacacccatagctaatttatttactcgcaagagaaaatggggccagcacaactggctccgaccatggggatggcaatagggaaggatactttgaagaactaggttcttttattgggagaaggaagagaactgcatgtgaaaatgaaggtcagataatttctaacattgtctgctacatcatatagcagatacatagttagcatctgtatgctttcactggaaatgtttatatttgggaccctccatgttcttgagccaaactaggaccaacaagtaaaatctttgcctatgaaaacaaatccaactctgtgctcaggtgtctccatgaccaagaaatagaaagcgcatgtccattctccacctgtctcattcgtacagtgttcattcaacaaaaatagattgagttgcttttgtgcattctggagctagggggacaggtatgaataacaatgcctccttgctcttgagaatcttagcaatctaataataaagagagaagataaatataatgtggtatgaatctgctttcatagtaaatagttcaatcagagagcagagaagagatctaattacctacccaacactctccccttgtacgtcctcataactgtgaaatgctgaatggattagtgtgtgtttatattgtagacaatacgatgctactagctatttatatctgaaacttctattctcaaatatctagtctaacttaaccttattttaagaggctgtgttctgttacctacctattgaagaacatccttggtaaagcataaatagtacttcaataattagattataatgccaataaattcacaaatttactaattaatgtaatatttagccagcatcttgtccaaagcctctgtatataaatatttacctacctgtcatctgcaaaattgatgcagtgatgtaatggtgaatgtgattataatctcttgaagggttcatagctaaaaatattcactgagcaacaattatccatctgtcacttaggtgaatgtggaaatttgtctgtggttgaaagatgcatctttcagttttactgcctttctgtttctagaaagacaactttctactcagaagccaaggatattccatatttctaagtatttgaatgacgtggtttccagactctgtcatcaaactcaataaagacgtcaatttaagcaggatgtaatttaatcacagtggcgtagttaggcactgttttagattatgaatcttaaatgtatagattattttatttgattagtctcattcaatttggacatcttcctcagctatttgtgtgtgtttataatagaaaaaattttcatttgtaaacatatgatagcaaataaatgacatggcatatttctgattcaatcttaataaactattctgcaatttatgagtgacttaaagatatgtggaacctattgagtcagccattctcaaacatttttcttttttgagatagagtctcattctgtcacccaggctggagtgcaatggtgcaatatcctccccaaaaaacaaacacaaaagcaaaaacaacaattaacactccttcctgcatttttttggtgtgttttcttcaaagcactgaacaccttctgaagactatgtattcgcggtctgtttattgccttcctatccccattagagtgtaaatctcaggaatgcaggtctttgggtctgtggtattcgcttgctataccactaacatccaagacaatgcatgttatgtactaggtagtaaggaaatatttgctgactggagggactgcaagatggaatttatagaccaaaatcaaggggctgaaaagtaccaaaaattctgtttctgctactgtagtaacagttttgaacatatgatagagcttttttgtctgttaaatacagctgtttttgaattgcctctctattgtgggagaaaaggaatgtttttgaaaggaaaagtcagaaaataaccttttgggttcggtaatcctccatcctcatttgcctgacacagtccaggttaatacctgtggtcacagcataatcactattagttccccctttcgttgtccaaagtgtcccagtctggatgagaaattacatggttatccctagtcatggtgtctttgtgaatcagataaaacttatagaatctatttacagaaggcaatacaaataatatgcacgcatacaaaatcttgtatttcatctctgatttgaagacttaaaagaagtcttcctttttgttgagttaaataacttccttttttttttttgagttaattcttgctctgttatccatgctggagtgcagtggtatgatcatagctctctgcagcctccaatgctgggtctcaagggatcttcctgcctcctgagtagccaggaccacaggcacaagccaccatgcctggctaattaattttttttttttttttttttggtaaagataggttcttggtatattgcccaggctgtccttgaactcctgaccttaagtgatcctcccaccttaacctcccaaaatgttgggattacaggtgtgagccacctcaccccactcatacaacctctttagtgattgttgcagtcacacattctgagaagatacacttttttgcaagtaatccctgaagtgtgagagaagggcaaagaccagcaggatctacataacttgaggattacagagaccagatggaacattctgagagtgagcatgaggtcagtactcgtagtacaaactgattactttcatgtggcttctgagatcaggccacatgtgacccatgacttcctggtgaagcattaagtcttaagaccacgtggaactgtagaagggtcctttgctggaaccagaaaccttagaactgtccttagaccactgaaaaaagtacaaagagcagcgcagcaagaacacacagaatgggcctaatattgccgcgcactgatttccatagccctggaaaatgtgagccatatgtgagacaagaagaacatattgaaagccttgcagtatctgacaaaagagaaaagtaggccaggcgctgtggcccacgcctgtaatgcaagcactttgggagtctgaggtgggaggatcacttgagcccaggagtttgagaccagcttgggcaacgtggtgacactgtctctacaaaagataaaaaaaattagctggacatggtggctaatagccatagccagcatacctatagacccagctacttcagaggctgaggtggtgggattgcttgagcttgggagatcgaggctgcggtgagctgtgtttgtgccactacactccaacctgggtgacagagcgagatgctgtctcaaaaaaaaaaagcatcccaaatctcacacaacaatgaatgagattggacaatgcaaagataaagctaaatgaaagttaaataacacgagagatcacagaagaaacagcagctaaaccagcaaaattaaatacttcataagctggtgttaattgcatttgttcactctattgatatatgatgagtaaccacgttctagattctgtgtagagtaaatagtgagagcgagctgaattgctacagaggcctcttccagaataggacataaatggagcgtgtgcattgtagtgtataaacactcaataagtgattttttttttcagatgaagaaatagaaacaatgtaccaaggtcagcgattaaaaatagtgattatctttacacagtcatggactggaagttttgtttctaatagtttccagaatagaagtatttgtgtgaatgacaattatatgacatgtaaggaaattaattatatcatttattgattcttgaggtacaggctctaaagctccagcatggatttgatgtggatggtactaatgatacagatatttaagttttgttgatttgtatgtagtttccccataagaggttttttgttttttttttttttttgagacagagtttacttctcattgctcaggctggagtgctatggcatggtcttggctcactgcaacctctgcctcctggtttaaagcgattctcctgcctcagcctcccaagtagctgggattgcaggcacccaccaccacgcctggctaatttttgtgtatttttagtacagatggggtttctccatgttggccaggctggtctcgaactccttacctcaggtaatccgccggccttggcctcccaaagtgctgggattacaggcgtgagccaccacgcctggcccccataaggggtttttagttcctcgggaaactattcaagcattggttaggaagaaatatgtgcagctgggtgaatccagctaatgatcggattattctcatggcgttttgccgggggctgccttgatgatgtcttcttggatctaggtctttaacttgtctgtaactattgcacgctgtccctccagcagaccgttcctaatttaactgctatcctgtgacctcagttcttacaaaggaatctaaaactgtaacctttctttatttctggctccaattagttctttatactattcgttctctatccaaactgaactcactccctgaatatgctacacttaattcaggtatatattctccacattcttactacactaattcctcaacctagaattctgagcctttcaaaagtttaccacccctcgcttctctgcaaatgtccaaggagttgtcttccttaaacactttcatgaagctcccagccagaagtaatatttctactcgtagagttccttatcactgggtgttcacattttcttatttttgtctctcattttatatagtgattatttggtatgtattttatacattttatttacattagaatatggttttgttcaatgtccattctttaaccaacaccacattgtcttgattactagtagctttatagtaagtcttttttatttatttatttattttttgagacagagtctcgctctgtcactgggctggagtgcagtggcaccatcttggttcactgcaaccaacctctgcctcccggattcaagcagttctcctgcctcagcctcctgagtagctgggactacaggtgcgcaccaccacacccagctaatttttgtatttttagtagagacggggtttcaccttgttggccaggatggaatccatctcccgacctcgtgatccgcccacttcggactcccaaagtgctgggattacatgtgtgagccactgcgcccagcctgtagtaagttttgaagttacataatgtctgtctctgactttgttcttctccaatgttgtgattattgtgggtcttttgccttcccatataaattttaaaatcagtttgtaaaaatctacaaaataacttgctgagattttgattgggatgcactgacttgttagaatgtgtaaaaatttttctgtattcctctgtgtacctgccagtttttcatagtatatagatctaaaatgtaagactttattatatgaaatttattattcataatagatctaagcccaggaggtcaaggctgaagtgagtgctactatattccagcctgggtgaaagagagagactctgccaaaaaataaaaaataaaaaataaaaaataaaaaaaaatatatatatgtactatgtacatatcctgaggatttgaacaaattcagaaaacactgaaacagtattacatgagctggaatttatttaagagtagtaatcaacttgatttttttctattaattttagctaagcaaaagttccatcattattcatgactgatgatttctttccttatatttattgtgatgactttttaatcatacatttaaactaatacacattcctagaggtggtactctaagctgaatattttctaacaaagtctatctattattatgtctaataccacatttatcactgtattttagaaatgtttaatattaagattagtccccctcattcttttcccctgacccccaaattgttcttattcttcttgactatttatctcccaaatgaaattacttgtggtatttaatttaacttagtaattctgataagtagcctccatggaagagacttactgtattatttacttagcacccatccatccacttgaatttgttaacattaaggtttatgcaacagccactttaacgtattctgtacttagagaaaggagatattgataattttgagttagtgcatatccaggctgggtgcggtggctcatacctataatcccagtactttgggaggctgaggtgggcagatcacttgagcccaggagttcgagaccagcctgggcaacatggcgagactctgtctctacaaaaaaataaaataattagccaggtgtggtgcaacgtgcctgtagtcccagctacctggaaggctgagaggtgggaagattgcttgagcccgggaggtcaaagctaaagtgagtgctactactgccactatactccggcctgggcaaagtgagagggtctacctcaaaaaaaaaaaaaaaaagtgcatatcctgaggatttgaacaaattcagaaaacattgaaatagtattacatgaactgttcctattctaaagtaagattaatttaggaagtagtagctcttagttctttattacctagtttaaattttaaaagaaagcatttatacttaagaataaaatttctaaaccctttccttgtattgagttgtatgtgtgttagtgtatgagattgctgagtttattgtactgagtcggcttcattgtatgacagatctaaaaaaactgggagagttctgcctaatactgcaaaaccagagtaaagttaggaaattgggctaatgtttaattaagtcaatcactggccttacttttgtgcttcatttgctcaattacacttatggtaaatttctttctcgaactgatggagaaaagactttgtgatctcatgccgttaaagtacataatcccatatgatattacagtatggagagatgcttttctttttatttataattctcccacattaatgtcatgtctgtctgttctaatttagtgctttgtatttttcattttaaaagtacctggtctgctcctgtgaacatttaggtagatacctcagtttgaggtcctgtgagtctgtgattctattatttgtaaacatgtatgaaaatggaaaagaggttgggcatggtggctcacacctataatcctagcactttgggaggcaggaggattgcttgaagctgagagtttgagagcagcctgggcaacaaagagagacccctgtctctacaaaaaatttaaaaaactagctggacgtggtggtgcgcacctgtagtcccagctactcaggaggctgaggtgggaggatcactagaacctgggagttccaggctgcactgagctatgattgtaccaccctgggcaccaaagtgagaccccgtctcaaaaacaaacaaacagaaaaaacagagagggaaaaataaagaaaaatacatatgtataataataggttctcaatatatattagtttctttccctttctactttcgggatgaattcactgcttgttgaaatgtaattgactgatctaaatgctgatgttttaatgaaaagtatataatgtggatttcatttaattctgtcctaaatgacagtttgacgacatacttaacaaatccctaggcaccaaggatttggggttttgttgggaagaaaacatctaggccagaaacgatgtacttttaccttgttttgaatcttttattgtttggatcagacctcgtttaaaaatgtagaggaaaaatttaatagttccatttctacctggaaatactacctagaaatagtattagtctattagtagactaatactccagctgtgggaaaaacaaaaaacaagcaaaacacccaaacctcccccaaaccagaagttttaaaaggattaaatttaaaggatttaatcagaatatattaaatttaaaaggaaatatgattgaggcattagaaacttctgaggtagcgaggacttgaagagacctaaatcccagcagtaagagaagtgcactgaggtaggtctaacattttttataccacttttccctttggggcatttgctgagtattcatttgggcagagattaaggcagaggagcctgcaaagtttatgtaatctctggcctgacaacgtaggcagaatttgaggatacaagatcttgaaggaaaaagagaaataaggcttacactctgaagaggctttccccttgaggtatttctctgttggtggtgacgtttttattattattattacgagacagggtctcattgtccaggctggattcgaactcctgggctcaagcaatcctctctcaagtagcttggataactggcatgcaccactattccagatcatttttctgttattagcctttgggaaacaagctcagaagcttagcagaaagcagatcaaaagctcagcagtatagtaagatgtgactatcgattctatgaaacaatactaataatgtctcatgaggcctaatcttgtgctggggggccaaaaattgtatttcagtggttgctaaggaggaggggttttgataatcattccaggctctcagttggaatccttggaagttatgattactaggagagagggtgaactaaagtcttgctaagtctgaaaacctgccttcaatctactcagctcacattgaattggtgttatctgcccatcatctagctgccagccgtaggtacatcttttctggaggaagaaacagaattagcttgtatacaaattttaacacagtatctgatgtgcagtcaaacgtgttattaggcatgtaaggagtcaggatcaagagaaaaaagatctgacagtagaaatagacccataagtgatccagatattggaattatcagtcacagaccttaaaacaattggggaatctacaatgaaaaaaatcaaatggaaattcgaacactgaaaaccacagtaagtaaagtaagaactcagaagattagtttaacagcagctgggacatagttgaagaaaggattcatgaactgaaaaatagattagttgaaaatatccagactggcctatgtggagaaaagaacattaagaataaagggaaaaaatcataaaagatgcattaactgtagtaataaaatctaacatgcgagtaactggattcccaaactgtgatggatttggagctacaatagtgagattcaagattactgtcaatcctaaggaatattaatacttataaaaccacactgggttaccatagtaaaaatgctgaaaactagaaaaataaaaaatcttaaaagtaactggaggagggaacaaaatttaaaagctgtaataagactgatacctgatgacacattagaaaaagttgaatcagaagacaaaggcatgatatctttaatgttgtgaggaaaaataatcactaactctgtattatagccagataaaagtatacttcaaaagtgagagtgaagtaaagacatttccagacgcatacaaattgagataatttagatacaggagatggggttcttcaggcagaaaggaaatgataccagactgaaaagagtaaatgcaggagggaaagaagactaagtaaatatatggccaaatgtaaattaatgctaactatacaaaataatcgtattaatgccttgtggggtttaaaatatatgtgcaattaaaatgcataacgataataactcaaaaggtggaagagtataaaattgtcaaccatgttcaaagatcctttttctggaacaaggtgaagttactaatttatacttataatgaaagagttaatcacaatggaagattattaaatgtcatggatgcccatgcaacctctagggtactaaccaaaagaataagaaagaataaccaacaactttccagagggaaaaatgcaatatcaagatatttgattaatgtaaaggaaggaagaaaggagggaaaagaagtaacatatgggctgaatctgttcttaaattagattatggtgatggttcatagctgtgtaactataccaaaaagcattgaaattgtgtaccttaaataaatgaactttatgatatgtaaattatatttccataaagctatataaagagaacatgagaccaatataatacaaataatatgaaaatatgataaatataactaataaatataaactcatattttaagaataaaactaaatgttaattgactaaatacttcaatcaaaattcatggattgtcagattttattaactgcaattgtatgctgctcaccagagatatactttaagactgtcttacagaaagagtaaaagctataggatggtaaagttgtatgtgtggtaaagttgaatctaaagaaagctggtataactatgttaatatctgagaaaagggctgggcgctgtggctcatgcctgtaatcccagtactttgggaggtgagtggatcccttgaggtcaggagttcaagactagcctgaccaacgtggggaaactctgtctctgctaaaaatacaaaaaattagccaagcatggtggtgtgtgcctgcaatcccagctactcgggaggctgaggcaggagaatagcttcaatccaggaggcagaggttgcagtgagctgagatcgcaccactgtactccagcctgggtgacaaaagtaagactctgtctcaaaaaaaaaaaaaaaaaaaaaaaaaaaaaaaatatatatatatatatatatatatatatatatctctgacctctgagaaagaatttagggcagaaagtattgcgagaaatcaagatggacatttccctatgttaaaaaaagtcagtttataagaaaaataaaataattctgaatttacatgaatctaatgatatagctttcaagcttataaaaacaaaaattgacaaaattatcaggagatctcaatcaacaatcaatgtataagaccatccttctcacagtattacaataatcaggcaaataaatgaatgaggatatagaaatctgaacagtatgattaattaacatatgtattgacatttatagaacacagcaccatatgctgagaaagtacacatttgtttcaagtgcagatggagcatttaccaaaattgattatggaggaagtataagcaaatttcaaaggtttgaaataagagtgtattcctttctcatcacataattcagtaagaaataagtaacaaaaggaattgcaaatccataagcctatgaatcaacgagttaatcaaaatggcaaattataagatattttaaattggataatagtggaaaacatggatacagttaaaactgtggatacagttaaaactgattagaggaagttattcggccctaaatacataagaagaactgaataatcagttatctaaatatctcaagaagacaaaaagaaaatattaaacctggaaaatgtagaaagaagaaattatgaagtagaatttatgtagaaagcagaatttatgaagtagaaagaaatataaatcattcaagccaatagctggatttttgaaatgactaattgatgagcccttggaaagactgaatacgaaaaagagagaatataaaattaacaatattagaaatgaaaataggaaatcactgcagaacctccaaacaatgaaaagataataagagaatactgtgactagctttgttccaaagaaattaaaacattctagaaacaatatagtgttagcgaaatacagtttaccaaccctaacactagaagtgggaaatatcaactgtcttatatttattaaatgaaatgaatttataattaaagccttctcacaaagaagtccaggcccagatggcctcactggttaattccaccaaacatataaggaaacaataataccaatcttaaactctttcataatacttcccaactgattttatgaggccaacataaccctgatcctaaactatgacaaagaccatgcaaaaaaaaaaaaaaaaaaaaaaaaggtatagactaatatttatcagggactgtaggtgtagaaatcctccacaaaatattaaaatattgggaaatccatcccattgacatatcaactcaatagcctattacaaccaagttgggattcaaaaccaattattgtcacttaccttattaagataaaaaaatatttattttaacagatactataaaacatttttaaatattaaacacctattcattgtaatattagtaagtcggcatgtaagaaaagttacttaaactgatagaaattatctatcaaatgcaaaactggtgaaatattgaattctttcaaggcagtgttgaataaagttggggaaagtggatacttttggaattaaaaatgagcttggcaaagtcacagctcactataaaaattcagttatatcagttatatttttatattctagtaaaaagcaattacaaaataaaaataagtgatttcacttatattagtataatgaaacaacacatacctaggaataactctaatacaagatgtgtaaacctttacacagaaaattgagaaacattttgagaaaaataaagatgaccttaaaaaaaggataaatataccatgttcatatattgggaggctcaatattacaaagatgacagttctcttccaattgatcaggtagatcaatgcaatctcaatcaaaatcccagcaggttttcttttagtgtgcatgaaagttggaaaagccagttctaaatgaagaagagcaagattatcaaatacaactttgaagaaaagaacaaggttagagtctttgactcctggatatcaagacttattttaatgttacaataagaccgttgggtattaggacaaagacagaaaaatagagcaggatagagttcataagtagatctgtacatttgtgtcttgatgcattagtaagtgacaatgcagtgctaatggggaaaagatttattttttaataaatggtcatttggataggtatacaagggtgggtgaggagacaactcttaactccctccctaccatcttacataaaaaatcaataccaggtatgtcgcaactttcatgggaaaggcaaaataatgaactttctagaaaatttagtagctttagtagcttcgtgtcattttattttgttgttgaagatttgcgtgtgatacatttatatgtcatttgttttctagtatgtaaaatgcagataataagattacatgtaaaatgtatggctcaaagcctgccacatggtaactgctttaacttaacagaattatccatcttaaacagtaaaataaagttaatcaatttgaaagaagcaagcaaactttttttaaaaaagtttatggaatagttcatgtttatgtgccctaaatttgtaattaaaatatgaatgcacgagatgggtggatcacttgaggtcaggagttcgagatcagcctggccaacatggtgaaacaccatctctactaaaaatacaaaaattagccgggtgtggtggcgggcacctgtaatcccagctatccaggaaactgagacaggagaatcgcttgaacccaggaggcggaggttacagtgagccgagatttcaccactgcattccagcctgggtgacagagtgagactccgtctcaagaaaaaaaaaaaaaaaaaaaagaatgcaaaaatagagatgtcatttgaattatctgactttcatatagtgatataatttaaaaataattacttttatattagattcttatgtcctctctgctaaatcaagttggtgtttaaataactgttgtttcttttaagggaaattttgtttttattttgaaattttgaaatgaaattgctctttttattagtgttaatatgatagatatttaatgtaatttcctgcagatattaaaatagtcattttctttaataaaatccacatatatttttaaaattccacatacttgattcaagtttttggaaaaaatgttcctttgtcttatatgttttatgggtttgtaattgcgtaaattctaaaattggttaagtttactgtgaattttatatttccttgtcttgattagctccatttgaatcattctccttttcaccgtttgcaggaatttaaatgattcttgtcaacaagaacaagagacgtgtcatgaaatcgttctgcattgcttatgcataattacaactttattgtatgttagtcagtcttttaaccctgtggaccatttgtcttgtcttgtgtgtctagctgataattcactcccagcaatgctgttgctaagcttttctttgggtatttggatattctgtttgttacattattgctcctaattcttgcgccttgaagaactgtgtcttttgtaatatagaacattaaagagctcctgttactatcattagtaactatgactcttgattataaattctttcttctgaaaaaatcccataactttatctttgcactgatgggagtgtgtgtgtgtgtgtgtgtatgcatgtgtgaatgtctgacatgcagaagtgaacctgataatggcaaaatacaatgtctttgataatcgttgatagcactaaaaatatgcactaaatatgcactaaaatagcaccaaaaatatggcatattctattttcctgataaatattaaaaggaagtcatttaatttttttagatttttttggggaagagaataaatataaaaattcgcccttttagaggtagaaaagtgcacaattgcactgtgctggacatgccttttttgcttctgtttgccccaggatctaaaggaatggattcatcactccgataagttaatgtttaaaaggagatcttcagctttatctaacaagaaaatatcttgaaaaatgtatagtgaaaatcaggcctttctgttcagtcaagtgtttttcttaaataacaacagtgtgtttgtaaaatgcaaaggaggaagtaagtttagaacagatttttctgaaaactaagtaaattacaaaagaaggcaaaatgctctgttacaagtaacctattggatttcattagggcttcataaaattctgcctgtttatttaggctcatattttaaatatcactttataacatttttgaaataatcactctgtatgttgctttttatgcatattgcttcccaaaagcttgcttgccagagcattggagattcctagctaatagcccaagatttctgcctaagtagcattagcttcttacctaattaatgagttttctaaggaaaaaaaattacaaataaactttcatacatgaagggtgtgaagcaagccacaattcccacaggacaccaattatacattctatagatgggaggtgagttaaggaaacttacctttgagattgagtatgtctctcaatgttgaaattttttattctgatttatttgcaaggaatcctagggcgttgtagagacagtctttgttgacatatggcttttttgtttgttctgtttacagtgtgggtatgattatagtcacttaagttttaaagagccacataatgattaagagactaacattcacttataaatacaactttaaaaaataatttgattcccacataacttcagaactatttgttaaggcatgcctttatattgtgaaattgtatgaaatgctagaaagattagagtaagagaaattttactttaagtgtcatgagagaaactgtagttagacactatgtctctaaattgatctttttaattaaatcagtttttataattagaggagagtagtagttcttaaatcagaaggcctattacgtttgagaattagagaaatgttcatgtttgcttttaaataaattggattatcattattttatgtacctggtgcatttccagcctaatgtctttttgagttctgattgctaaattaactgaattctttttgtttggtgagattaaatgttgttaatgaaaaacttgaatacaattttttatgctttagaattggaagtagattgtggtgcaaggaccaaattgatatcaattcatttaaatgacagtaattgaaacattgctaggtatttgtttgtttgttatttattttggctttttctttccacagcaagttgatgtggaaaaatgggtatgtgtttccatgtatttgcaaagaaattgtgatctaaaagtgcatgcttgctctcgcctctaatctttcattttgcttcctagtgtggcttgtactattagtgttcaaactaactgcttcgttgtaatgaacacatgttttacaggtctctaatgagaaccttatgtttctggttttgcttcatctgaaatggggcatattaaagtactttccatccctagaaccacatagtttttatataatttattttgtaattattatgtgcttctggccaacagaaaggtgtttattattcatactgtctgtatatcttctgcaaaaaaaaacaaaaaacaaaaaccttgactgtttaatctcaaaattccactgcttagtccttatatttctgcatgtactgtagaagaagacaattatatatatagtcatagaaagtcatagaacctttttttttttttggtatagatggagtctcactatgttgcccaggctggtcttgaactcctggactcaagtgatccttctgcctcagcctcccaaagtgctgggattacacacaggagccactatgcccagccttatataatctgaagcagtgaaggtgaatgaccatgtagaaaaacgcagttacaggattctggaggctaattcttagagcccacattgtcacaagttgtgcaaaaagttacattgcttcttttggtctcggtttccttatctgttaggaaaaaataaaggagagaggaaatacaccaaggtaccttccaatacttaacacaccaggattctgaatggaaattaaagtctcctcaagactgatattcctactccactttctcccaagagtgcaaaacagtgaggcttttcattattgaaatgtttttgtatttgctctgtgacttatatgaagaatcctttaagattgacttaactgatggctttattttatcttcattatttttctggttttaggatccaactttcttgatgcaatattttgagaattttgccatcttttcagtgccctttcagtagtgttttccaacaatttcatgttctcttgtctttttttttaaattttttttagccctttaaagacaaggaaacttgttttttaatttaccatttctgatgacctttgaaaactatgacttgtatgttatattgctgagaataatttgaagtcttcatttctctttataaccgaactactactacttttgaccaactatttgtttttgaaatttcctaccttcctctttggctatagttaaaatgctgatccaagattcacatttttcttgtcttggtaagggaagcctgcttccttctcagaacacgtatgacacctctttgtcctgcacttccctaatatcagcatcctacaacatagccctctgtcttttcccatccttgcatcccttcacttccattacactatttctgtgccatatctggattggtattgaccaaccactcaagctgcttttacttactttgtaaatagcacttgccagtaaataaaatcaccttttcaccattgtctaaaagtcttcccttcagttcctctgtggatttggttacttttgatctgcctgtgtaatttttttctttcttattcctataataatttatttttatttgtattaagtttatttgtaaatcattgcagtagagattgccttctagttctaaggaaatatctctgatattttctgagctaaaaaccttgaggcttagtttgccaagtgactggctttataatcttatgtagcctctttattggccgtaatctctttgtctgtaggactagaatctgctttactccttttttcttaagtattactatcatgtcagtgctaaaacatattgatgccaaaatacatgttcatttggaagtcatataataaaaagattctgctgggttttagaacacggatgatcactatgtgtaaatgttgcagcaaattttagattggagctctttttttctttgaagacctatccagttcatgtcttatgctttggccattagaagtttgaaattctactgttacaggtagactttgaaggccaacagaaagtaatttaaccctctacccacctaacccaggactattgagactcctctgtggggctggtacttctctgccccttgagttaaattagaaccggtcccttgacctttctcgtattccaagagtgaaataccccacagacatttcaagtcatacagatctcatttcagtaattaaaatgcccaaatctgtataataggtgaacttgaagctaattcaagttaacttgtcaggaatcgagctggagggacggatatctgggaagctgtttcttgcttgccccgccgggttcctcacgccctacttggtacctggagagtctgccactctcaggtgctgtgggaaggagacagaagagaaagcttggcaggaaaggtctgctttgatcatagtgtcatgcactgggcttgccaggtttctaatgctgactttctctgtgggcgcttggcattggtctttcggggagcttctatccccagaaaactctgacctgagcttctcttgctgcagacaaatgcgtgtccactagctggtcagtggcaattccttactcttcctgggagttcttggtggcctctgagacaatcccaagctggatctgtctagtatggcccccatttgcttgttggcagtgtggtcacttcccagttgcagccctgtaggactacacccagccttttgcctctcaatctccaggcatagtaagacaccagtctacagtgtcccagctcccagggatatcaggtatccctgaagctacccttgctaggcttgaagtgagggcaagcttgggaggcaggcaggattccaggcccacctgcacttctctccaagaaaccatttctttgctgcctggcctctaataatacactgggggtgggcagtcagctaagggcagccagtggatttgcagccaccctctttgacatccctgcttaggtggcataacaatatgttttgggacgtgatagtacaggtgctcctccagttagggtgaggttatatcctgaaaagcccttcagaagttgaaaatatcgtaagccaaaaatgcatgtaatacacctaacctacagaacattatagcttagcttagcctcccttaaacgggctgagaacacttacattagcttacagtggggcaacatcatctaacacaaagcctattttatactaaagtgttgaatatctcatgtaatttattgaatactatactgaaagtaaaaaatacaatgattgtatgggtaatcaaaatacagttcctgctgaatgcaaatcactttcacattgtcgtacagttgaaaaatcataaatagaaccattgttaagtcagggaccttcttgtaaatccccttcggagactggtcattgttttgttttgggacagtgacctgttttaacttctgttatacttgcttgtctagggtgcgtttaccaccaccagattaagacctttgggagccttacaaacttaaatatatatgaaaattaaaatggcttctgtataaatcttctgataacattattctggatagtttcatcaaaggtccatcaatcactttctctttctttctcctttctccctcccctctccatccccttttccctaattcccttcctgccttcatctccttccttctctccatcatcactgtctctttgagcagctgtgcatctgtttaatcacaagcccactgagttatcaaatgctgctctttacactttaaaagagaataaaactcctgagtactggataagaaagtaactaatggtcatttccatctactccactcctagcccttttctaacctataccattggtttccaatgtggaggcctaggaatcaggtcatgagtggggtgaagaaagcaaaaggatgaaatagactgtgagattgttgtctatgaagcattgtctatagactgagtgatgtcttacacatgtattttctcttaaaaaatatgatgatgctgttgtaattgttaaaatccataatcatttcaaatgtttctacctggagagttgtttaaaaatgcattttaacacacgactgctattatgtgagaacctgcgaaatgctttcaagctatcaaggttcattcatgtttgaaatggtttttaaaaatatatggagtcttctgtattctgacatgggcaattttttatgtgtaggtgatgatctgaatagagggcaggctttgtatgtcttcaagacatcagtatccatttgccctctgtagaaatcaatgtgttgcttttgatttagagaaattctctatcgagacaagctgggaaatgaagaaagccctagatacctcttctatttcatgttttaggcatttatgcagctctttgctttataaacctgtcacagagataaagtgtgagaacttatagtagcttatcggaatcatttatttttctttacccttctaaagaagaactacataattgtatgtacatatatatgtcaaatttattatactcgaaagagaagacattccatttaactactgtctgtacagagctgtttataggttgaaaaagaacttgctacaaatctgccgaaaaatagaatgaattctttttaaacatatctgcatctcacataactagattccagtgatggtcattaatatgagtgacacaagggcatttcaatagaatgtattattatgtgtataattgctcattcatggactggtggacaagcctctttcagatgatttctgtacctgtaatcaatatgtctgtcttttcagagcatcttggacatttttagcaggggaatcctggaaagtgaagcatttccataggatttatatagatattttttaagacagggtcttgctctgtcacccaagctggagcgtggctcaagtgatagtcccacctcagcctcctgagtagctgggactacaggcatgtgccaccatgcctggctaactttttaattttttgtagagacagtgtctcactatggtgcccaagctagtcttgcactcctgggctcaagcagatactcctgccctggcctcccaaagtgctgggattacaggcatgagccactgcacccagacacatattttcatcataagagcgatagttgaagcttttcaacctcatatgctattaggtagtatatattgatatttggaactcagaattgttgttaatttttttattctaaaaattattgggactatcattaattaactatagctacctagaaatcctagtctttggtggtgaaatcactttgttttctcaacataatgaagtttacctgatatttcctcacaaaggagaggttaccggttggagacttatggagaatcctagcatcttgatacgtggagaggaaaagatggcgaaaaggcttaaatttgatgtatattttgtgtacagagtagggtattttgcctccttaatggaaacttcacgctagaatgacttctgaggctattctgaaattgttgcatttgataatcctttttaatggcaagcctccaaatgtatggtgctttgtcactaaatccttatctatataatttttgaggagacatttcaataacagtttcttttaaaagttctaaggtaggtttttagaagcgttcctttttaaaaatcagtttttagctcatgaaactgaaataccagttttaaaaagtcaaggttgaactgaaaggcatcattataatagaggagctttgctacattacctgaattattgtttccttctttgcaccaagaacagattaaatatgcattctcttgatatccagtatttgttagcaattttcagagtaaagtattgctatttgatttgtttttctattcataatcatttgcatttgctaagagagtgccttaggtcttttagatctactacactgagtggctcatgcttacagacgaaagatgattctgcttctttttgtcatccatttgacacccagggccgtctatgtgttaaaatgtagcaatagcaatttctcttcctggcttccatgttaatgtggcatgtgcccccaggttttgcttgtatttggagctccatctgatgtgtcaattccggattaatctaaacctgggacactgagttactgacatctgcagttttagcctaaagaactaaaatttccacctttgtgtttctatgcaaattaatcatcatccaaaaaattctaagacagcacgttggaatccatgctgcgtgcctgtcctataattgcccatatagtcatcccttactctattttgtgtaatgaaattttagctcttgtctattgaacttctcattagtgaaataaatcaaatagttaatttatttgctaaacttattgtaagcacaaaaacgacattctccacacccaaagaggctgctttcttcaatatttatctttatgtgtttcttttttctactttccatcatatcaatttttaaagggtttttgttgttattctttttctgtttgttgcttttatcatacagaagcagtgcttacattgaattaaactaatatactcatcttttttgttttaatgcgctttgctttcttcttttcccttaaacgatccctttgaatgtctcctgatgctataattttggtaatatctagcacttaaaccaatttgaacaagaaatggtttgtacagaaagttattgtcaataatgccactaataccacaaatctttcatgttcttgattatcttttgaaagtgatgtttgtgtcttacatctgctcttctttctcattctgcagaaggatatttcagcatttgctatttttcagtattcattctattttgtcgtgtatgcagattgctctcctctgtgtattattcttcctacagtcagacatgacttagcaatgccgaatagcagacctcggtcacttggctgaccactcttttttttgttaatacctactacatttttaaagtggttcaacttagatacctgacaaaatcaggctgagaaaattgtctgaaggaaaatctcccaaacctagcttaattaaaaaaaaaaaaatctcatgaagaaagtatctcttcacaaaccatgtgctgtaccaaaatgttaggtttttgtgtttctttgaattaaggcttaataatgattttgcctaattctttagtgatatctctaccattagtgagtcacatgtgattggtcagtttaacatggaaagtaagtttcctgatattatgtatgattaatatcagttataaaaaggtaactaaacagcctgtattttctaagccaaggatgaaagcttctttacaatttttccttgaaattgtaatattgaaaatgaaaaaattagtctcaacagaatttccctttaataatatacatattactatgtaaatatgtttcagggaaaaattgtaatatttacaaatatatatattggaaaacttttccttgctgtttttcttacaactagtgtctctatggtatcttttctccataggacttagacatcaacctgacaacaaattcagccctaagtttggaaatatatcattgttttctttttcatactctttcatctgtgtaactctcctaggaataagtagtcaaagaaactttagaggtgtaaagaaaaatgaagttatttgtaaatttgcatatgcacacacatacgtacacattatgttttgtagaagaaaaaagagctattatataatttatgaaaggagactgtgtcattttaagagaaaaagaaatgtttttgtgatttttctgtgaaattcacctttcacaatattcagtgtctaagaaattgcttactgttattttgcatgaaacgagagccgctcattgcagcatattagtttacgatctaccttacctgttttaatctactgtttttattaaaatgagttgggttgctgtttgtttttatcactgcatttttatgcaaaagatgcaagttggttttttaaaaagcatttgcagaggatcaatttttaagatgataccttttttggtgcttaaataggttgtcaatggaatcactgaaagtagagcagcatgttttcacagaaaaaggaagaaactaacgtcaaaacatttttaaagagttttgcttgctacggcttttctctagcatgtagttgatactaagttttgttgcgataacatggtgaatgtttttttttatgtttattgtttacatagctccatttaggataacggagtctttataaataagagatatttttaaggaagtctttgagatcgtgtctatttaatgtttcctctcttttccttatgcccctacagaaattcatgatgaaggtaagacatcttaatatatatgctatgtatatatatagcagatatattactatatatggattatatatgtatgtatctgcatattagtatagctgtattatatatatgacagatatatatattactatatatcagctatatatatgtggtactttgtatgttttctgtatggttatacacatttgttttacttttgaatccatgtaacttttcttcacatgcttttaaaaggtttttaaaaatcaagctttggagcttttaaatttagataaatcacgtttagatttaacaactcaacaaacaacatttgacatttttgggtcatattgtaacattatatttaattagctaacattaagaatttctcttattaaaacaattttagtagctctccatttagaatattcactctggggattatgttgactttgcatttatgcccttttgcatgaatacaatgggaaattcttccactgggaaattaggggaggcaccaagaaactacttctacttactccaggagaagtgaaaataattcagccagccccttattcatttctcaactaaattggaaaagtgaaaatattgtaaaagtagacaaatgaaaagagtaaagcatgtggacatgtcatcgaaggaatatgtaagggacagacaggaagagtagactatggttattttaggatatataatagaaaatttttgtttcatttttgtatgcccactacctttctcctataacatttatggggtttaatttttttatcttaaaagccaagaaacaatgggtaggtagaaaaattgattgatattccattaataaaggcttaaaagaatttatgattttgaaagaaagagactgtgagaaatattaaatcaaaattccagatatagatggaaaagattgctttgaagaaaaggaagcgcgttcttgtcagtctgttgaattttgtggttaaatccatcatgtttaataaaactgaaccaggtgcattgtgggacaccctaacctggacctgttcactaccagtgcgaattcggcgttttggatgggatgacagaacagagtatttctttgaagccatctatcaaccaggacgtggaacatcttccagaatttcaaataactctagctcttatttttcagtagaaaatattatgatcacattttgaagagaggacgttaatccctaaattagacgtatcatgaaacaagagtttgggttggaaaaatatttaaaacaacagcaaaataggaatatttcctctctttgcaaatactgataacttatgatttggggtttgagaaaatttagtttttcctgctaaatctgcatttgctgtattcattttatcatctcattcttaattcaactgtacaatattgtatggacttccccttgggaagggtgaatgaaatggtcgcctgaaacagacatctgaaggtctcttgtgagaacaaatgcatataaaaaccagtgcaaatagaaagatgatgtagaattagttaaaagcaggtggtatgcctaaaataatttaattaggcccccagttcttttaacttcgaggccagaaggccaatagttattttcacacttgcaatggatgatctggaaaggttagaattggattaaggggagggcatatgcatgcaattacagtaatttaagtcacgtaaacagaaaaacatgctgaattttatctcgctttcacctttcaatcatcatgctttgctttgggtttcatacggaaaaggcattaacttcttagaaccagatggatgctttcttgttgtgggagcctatttctgctggttggtgctaaacagtgatgcattaggactgtcctaagcctgatctgttccctgaggagactttccatgaagacaccatcccaagtaagccagtccatgtcaaatggatgtcttgacaatgttaaactggcctttgcaggcacctttatcttcaactgaggccaggattctcatggattgttacagtccttcggtgaccctgttgtgtgattcactacttattttattttttaagagacagggttttgctctgttgcccaggctggagtacagtggcatgaacatagctcactgcaacctggaactcctgggctccagtgatcttctgggctcagcctcctaggtagttgggattacaagcatgaggcactttgccttgctctgggccaactgtatttaaaaaacacagagccaaaaaacaaaaaaagcaaaccagaaagaacaaaatatagagccagtaattttaatgtgtgtgtaaacctctttagtcacacacacacacacacacacacacacacacacactgtatatatatatatatgaaatgtgtaggccaagctttacggtaaaaggagcactttctggttaacttcaagaccttgtccttcacttttaaaacattttgttttgactagtgtggctgtcaagtgttattaaagttcacgtggattttatagctttggaacataaatctggtatgaaaaggtgagcttctatcaaagtaattcaaaccagacaaagtaaataaaattgttcttggccacaataaatcaaatgcattatagaaaaaaaagtgctctctaaagacagcctcattctctgaaggagtatagtttttcaaagtagatttttcccttttcttctcagttatgtgaaaaaagtgactgttttgttttgtttttgtttttttgtttgtttttgttttcgagatagaatctcgctctgttgcccaggctggagtgcagcggtgtgacctcggctcactgcaacctctgcctcccgggttcaagccattcttctgtctcagcctcctgaaagtagctgggattacaggcgcccgccaccatgcccagctaatttttgtatttttgtattttagtttcacagtgttggccaggctggtcttgaactcctgacctcacacgatccacctgtcttggtctcccaaagttctgggattacaagcgtgagccactgcgtctggccccccaaaaaaagtggtttttcagcagtttttcttattttaataccttttaatatctgtttttagaatagttctgagttttttcaaacaaaacataaagttattttgagaaactatatggaacaacaagaatgtgatatttgtttaataaaaaggttgtaataatattggatattaaagcatctttctgtacttcttaaggcacaggtcagtatcatcactcttattctgaaaatttttaaagacctccttttcctgcaaaaagaattacaaacttctcgtcataatattttgtaccttccatggtctttccctgatctaattttataattcctgtgaagtttttctgtgcaacccaacactaaaattccatgattgcttcctccttcttacacaccttgtgattatataccatgacccctttatacatactccttactcagcctgaagtgagcttccccatatccagtttttcatttgacagttgtttactgagtacttaccatggcctgacctcacgctcatagctggaggtgaaatgataatcaggacagcgtcattgtccttcaggagttttcagtctgatcaaggggaggagggttcttgtgtagagtgtaaggccaatgtacatgtgtatacctagggctgcaggaggatggggagagtgagtagctttgaggaaactggatgaggcttcatagagaaggtagtctttaatcagagttttaaaaagtagagggagaaaaaaatctgagtataaatggggctgtgcaattcaaacctgtgtcgttaaagagtcacatgtacataaaatatgtaaaagtttcattccattcttataaaaactttattaaattataacatcaatacatatttattctatacagtttggaagttacagaagaaaaatccttcaattacactaatagaaaaaaactactggaggctttcctattaaaaaggctttataaggcagggaagactagagagagggaatgttgtattccgagatggggcagcatgaaagcagtatggcatattcagggaagggaaagtgggtatgtttggagcacaggatgattgaagatgaggctagagatgagtgagacaaatgtctctctgtgcttctcaaagtagtctctggaccaacggcatcagcatcacctggaaaattattgaaatgaaacttctctgtgtctaccccagacctactgaatcaaaatcccagtggtaagggccaggaatctgtgtttttacaagctctccaatttaagaagcactcttctatttcatggaaagggattgattggactcttccctataagcaattgggaggaatgagaagtttttaagcctggaggcattatgatcaattttgtgttctaggaatactcattcgttgaatcaacgtttatttatttatttatttatttatttatttatttatttattaagatagagtcctgctctgttgcccaggctggagtgcaatggtgcaatctcagctcactgcaacctccacctcccgggttcaagcagttatcctgcctcagcctcccgagtagctgggattacaggcaggcatcaccacgcccagctaatctttgtagttttactagagatggggttttgccatgttggccaggttggtctcgaactcctgacctcaggtaatcgcccgcctcggcctcccaaagtgctgggattacaggcatgagccaccacgcctggcctgaatcaacatttatttagtgcctcttgtatgttccgcatgcaggtaggcacctggaatacaatggtgactaaggtaccatggttcccacccagtggaaaccataatataatgggaaagagattattattaagtacattatgagtaaataactataattatgataattatttactgataccaagtttatttttcaagaactagataaaatgctaatcccataatagaggttacattaactttactccaatgtatacattatttcaacagcactttgcttgtctgcaagagctcttaatacattctttcctactaacgttcctttgagagcaagagagtattttatcaacttggttaagttactcttttgtgtttttctctcttgttctccttttttctcttctctctaaagactgctcaaggtggtggtcatcgaacactcctctacggacatgccatattgctgcgccattcctatagtggcatggtgagtaggcatttgatttcatctccctgtggtcatgctgatccatttgggggtacatggtctgcaaatgctggtagcatcatttctgcaatggtattaatgagcttggatgtttgtgttctttcatatctttgtacccttgttagtttctcatgtaaaagatgaaagtcagctcagatgacttttaaggtcctttaattctatcattatatgattaccatcttcagtatcttacttttgatagagtagttttaggaggagagaggtgtaagagtcaaataagagatattttcttttctgattttgttttgaagagttcatttattagagaaataaggtatctttattgaaagatcagatttaagaaaatctacctgtgagctccaatattaattgtactcaccaacttctttttcttcttcaccaggtttctcttttaccacatctgctcctcctttcacccagttattcactaggcttctcttgggcacagttttcttattctttgcctcatgtatatatgcacatatatatgtgtatatatgtaaatgttttaaatatatattttataaatactttaatgtattcttagctattacatatacagctgacccttgaacaacacaggagttaggggtgccaatctccttcacagtaggaagtcacatataacttttgattccctcaaaagataactattaatatccccctgttgaccagaagccttaccaataccagtcaacacatattttttgtatgtattatatactgtattataataaagtaagctagagaaaaaatattaagaatatcgaaagaaaaaaatattttctacacataaagtggaaatggatcatcataaagattttcattctcattgtcttcgtgtcaaataggctaaggaggaggaagaggaggaactggttttgctgtctcaggaatggtagagggggaagaacatcttagtaagtgggcccgtgcagttgaaacctgtgttgttcaagggtcaactgtatataaaatatgttaaaaatatgcaaaagtttcattccatttttttttttttttttgagacggagtctggttctgttgcccaggctggagtgcagtggcgcgatctcggctcactgcaagctccgcctcccaggttcacgccattctcctgcctcagcctcctgagtagctgggactacaggtgcccgccaccacacccagctaattttttgtatttttaatagagacagggtttcaccgtgttagccaggatggtctcgatctcctgacctggtgatccgcctgcctcggccttccggagtgctgggattacaggcatgagccaccgcgcccggcctcattccattcttataagagctttattaaattataaaagcaatacatattctatacgatttggaagttgcagaagaaaaattctgatcacactaataggaaaaaactgttggaggcttttaaaaaaagttttaatctcttctgtccttaaggctttttttttttaaacataattgagatgttactacgttaccaaatttatatcattttgttttttgagatagggtcttgctgtcacccaggctgaggtgcagtggtatgatcatggctaactatagccttgaactccgggactcaagtgattctcttgcttcaacctcctgtgtagctaggactacaggtgtgtgctaccacgcctggctaatttttaaatttattgtagagatgggagtctcaccatctttcctaagctggtcttgagctcccaggctgaaacgatcctctcgccttggcctcccaaagtcctgggattacaggcatgagccaccatgcccggcatgattttcttttccttttcttgtaacataagcattttccatgttgtttatattgtcaacataattttagtggcaacatgatagttcaatatctagaatattatacaatatctgtaataatatacttgatcattccttttaaaaagtagatgattcctgtattatgtaaattgttctaaagcagaagactacgtatcaataacactatccaactggattaagaaaatgtggcacatatacgccatggaatactatgcagccatgaaaaaggatgagtttatgtcctttgtagggacatggatgaagctggaaaccatcattctcagcaaactatcgcaaggacaaaaaaccaaacactgcatgttctcactcataggtgggaattgaacagtgagaacacttggacacaggaaggggaacatcacacaccggggcctgtcgtggggtggggagagatgggagggatagcattaggagatatacctaatgtgaatgacaagttaatgggtgcagcacaccaacatggcacatggcacatgtatacgtatgtaacaaacctgcacattgggcacatgtaccctagaacttaaagtataataaaaaataaaaataaaaaataccactatccaacaagggcacacaaattttcaatctcaatcatggatatttatgtgataatttgattttaattgtctatttaatgaaattcaaaagtataggatgagaagtataggaaatacatggacgtgattttaatgatgatttaataatatcatttcttttaatgtgttacatcacatgaataggtcagataagaaaacttgtgatcatgttagcaagtgctggaaaaggtttttaataaaattcaatgctcattcttaatgaaaactaaacattgattaattcctcagtgataaagattatcagtgtcagatcaatagtgaatattgtaattgtgaaatgctgaagccattttttaaatcaaattaactaaaataagaatatgttttatctaccattgctaactaacattgttctggaaattttggctgacatgtcaagatataaaacaacataaaacagtttcataaagtggttggatgtaagaaaaatatgtaaaaacaatttgtatagagcaatcacatattaaaatttaatgaaaacaattccacattctacagcaatcaaaacacatgaactgcatgagctaataaatgtgagggtttcttttaagacaactactctctatacataatagttgggttaagagcctcaacttggttgttagatttggattcagtctgtttgccacatgctggacagcctgggatattttgcataatcaagcctgtaattacacctgaaatttttatacattcattaaataaatattatttggcatctactatgtgctaggtactgttttaggtcctggatatagtagtgaataagaccaagttcttgctctctttaattaacacttagtagaataatcatagtatctacctcagagttactagaaacattaaggagaaagcatatgttaatagttataggtacagtgcctaatactgtacttgttattgaaaaaattacaaaagactttaataggaatcacttcatgtttgtctgggaagtctgattattgcaaagttgttacctttttaaaaaataaaggcagatgttaagcacaatttatatttaaagtctataaacataggggattatcgtgggctacctgtcttgaggtcagactgacatttctgctgtggctaaaaacaagtttagggaccctgggagcctcttggctataaccttgggagccatttctttgtagttaagagtcagaatcagaatctgcaggtcaatttgatttcacatccccatggcactgaattccacctaacataccagcatatctgccaccgattggttcatctgccttctcacactcacagacacacacctagctggatgggccctgtaccataataagacatttctagcctttgcattatttttccagtgattctaaagggggcttgctggcagtgcacttgcttcgtgatggtagtgtacttcgagttcctaccacattcgtctttgtatctctgttcttacaacacattcatctttgtgtctctgttcttacaacactttgtggcatgggggttggggagcagtaggcttgaaaaatgatcctaaactttatgtccaagaatatacagttaggaacacgtaagggtgggaagaataaggagatgatggtgttgcaagagtgattactcctgtggaaatgcacgtgtatgtagacacacaataaacctcattttagtgcagtgacatgctgtgcaccaaaataaattctaggtggatttcaaagagttaaacatttttaaatggaaacaaaactagaagataaaagagaatagtcttcaaatttgtttgggagaaagatttctaactgtcagactacattgtacttttgcagatgatcatgaatatcacatgaagtgagagatgtacaaatacatccccagttacttgtcttcctgtactgacagagaacatttcctttgtcttttataagggaagaaaagactacaattcctttaggatattgcccctaatgcatgctgttctgcctcacagacatttaaaaatctgggctttgtgcagaagcatccagattttcaggaaaacagtgagaacagtagggatagatggatgccaaattacaggtcagaataagactctgctggtacaactataaaccttaacgatggctggtcactgtggctcatgcctataatcccggcaccttgggaagtggaggtgggagattgcttgagtttaggagtttgagatcaccttgggcaacatagggagatctcatctctatggaaaaaaaaaaaaaattaaccaggtgtagtggtgcacacctgtggtcccagctacttgggaacctgaggtaggaggatcacttgagtctaggagttcaaggccagcctgggcaacatggtgaaaccatatctctacaaaaaagaaaataattagccaggcatggtggcatgtgcctgtagtcccagctgctcaggaggctgaggtgggatgactgcttgagcccaggaggttgaggctgcagtgagctgtgatcacgccactgcacttccagcctgagctacagagcaaccttgtctcaaacacaaacaacagacgaacaaaacctctacttacaactactgattttgtactttgtagtatctgtgctgcctgtccacctcccggtcttcaactgataagctggcttttgatgttggcttgcaagaggacaccacaggtaagcatcttgtgctgcgggaagccaggttcagagagaaccctgcaggggttggattggaagaagccgggaaatacgatacatgggatgaatgttcttatggatggagtcaggaaagaatgttctaatgaaagtttttcctagaaggggaaagtgtatatcattcctcttggttattcccacatcattagttggatgttcaaactaggcttcaaaccttattcttcttgtaggtttggatagaaaattaatatttactacatgatttactgggtgttagccatattaatgtacactaattagtttgtgaagtaattctacatgtctctctcaaaaatgtttttaagtctgaaaatataacatacttgatgccaacattcaaataaaaagataaaaaatgaaagtctccttaatttctctgcccacagggcattattctacatacctgtccaagcagacatgcattttcagatttgtgaaacaaaaatgtatatattaacacttttttttggagaatcaaaataggagaacacaaacttgatgttcttctcaatactctgaggactttgcattgactttatatatccctataaaattggactgttttgtcttttacaatgagcatgcatcactttgtaattaaaaataaagaccaagtagaaaaaagaatggaaggaaatagttcaacttttattaagttgttcccttcaagagtgagatcaagctatcctctcactccactccccctcttaaaagtatttacccatatttactaaatcttttacaaacaacaaaaaggtgaaaacaaagctatgtttaccagcctcataaactttttaatagaccaatgcatcgtcttataaaagaaattccaagaacccctggcaccagaaagataaataaatatattattctgattttgttttgtacaggctctatcattcctctgtatttttgctagttttttagttttcttattctagttaatgtatttcagcacacagttaaatgagaaagttgtcagttctctcttcaaaagaagtaaaagacgcagtctagaatttgttttcatacattgagaagattatgtaatagtcaaaacaaaacaagtcagtgttttctccctgcgtcctgatttccttatgctactctgttttttcccgtagttccctacctcttctgaattcctcaattatttattgtatttattatttgttgtctgcctgccttcatcagaattaaactcacaaggcagataattttttcttccttcttttttgatgtatcccagctactaaagcaatggttagccaatagtgggtacactataaatgtttgaatggatgaaaagctacctgcaactgtaaaaatgtgaattggatgaatgaagataaagaattctgccaggtgacattcaggttagattatggtttgtgtaagaaaagcaagttagactatggtttatgtaagaaaaaacacagattacatgttgactgtaagaatacttacaaaatattgcttggtaattcacttattcactcatgcaaaatgaatttgtggtgagggcctataataggctagcaggagctggagaaacctcagtaaacaaaacataccaagtcccactgttagggacttacattctggcattgaggaattaggaaaaaaaagagttatggaaacaccataaagttgagtgaaggtaaagaatggtaaatgatgacggatatcatgaaaacactcctctgattttgggatagaagttgcatttaggttttcaaaggtattatgaacagaatgaagaatggcatgctgaagcttctatgttaggtattgggaagaaagagtgaagaagagacatgtggctcatgaggcttatgcttgacttgtgctagaagaaattgtttggttgatgtaaaccaagatcttttataattcatttttctttagaaggattctcttatatgttacctttagattaatagaaaacaccacattttaaaataataaagtagaaaggggacaggatagtacaatctttagatgataatactttgcatccttttttgagtcagcatccaaaaataactactgagaacattttcaaaaaattgttacaattgtcacgtcacaaaaccccaagtccttatgaaaattgacaaaaaacaagatgattttatagaaaggaattggacagtataatgacatgtgagtgtgtaaagaatgaaatcagatcagtgtgagtggtgaatttagccttagatgagtataaataaacatcgctttaaagcaattcttagtggaagaaaaagacatcaaccttccctaagtgtcacacccagtttctaggagaagaatcttattttatcctaagctaaggcttaattctttctcttttcatggtgtaagagattaatttgcattaattccggatttctgaaagttgtgtgttgggaatcattggcaaagaaaatagattttaattaagaggaactttttcatgtttcacatatccgtatatctgcaggggaggcttgttggtggaccatacaccctgcctctaagcagcgatcagaaggagaaaaagtacgagttggagatgacctcatcttagttagcgtgtcctctgaaaggtacttggtaagtgtggaaagtaggatcatgtatctgctgatatgctaaatgacaagtcaataaaatgatctctttaaggtttatattgtaaattatctatgaaaattgcttataaccattcctctatctctattagattaattataaataacttcctaaacggaagaataatgtgatgtgggtgcaaatatagcttatcaggttgttcaggcaggcttccctcataaccttgatatgcatgttcatgatattgatagtaccttttaataaattactttattgatagaatgtaaatgcagtctaatcaggaattaaaaattctatggtctttattttgcacctgatgaaaaggctatattaatgaggttgtgattacctattctgatatttatgaaagcaaattattatgtgaggaacacatgccatgttaagaagggagaaatagacaaaagaagaaatagtttgaagtctatcattgacactgcattgtttcaaagagtaggggctggaaatgggagaatgaaggaagaagtttgtgtttaatcatgaaatgctgtcttagtctgttttcatgctgatgataaagacacacccaaaactgggcaatttacaaaagaaagaggtttgttggacttacagtcatggtggaaggtgaaagacacgtctcatgtggcagcagacaagagacaagagcttgtgcaggggaactcctctttttaaaaccattagatctcatgagacttattcactatcatgagaacatgggaaagacttgacccccattatttaattacctcccaccgggtccctcccacaacatgtgggaattcaagatgagattcgggtggggacacagccgaaccatatcaaatgcattttgaacttttgtggtaaggtcaatatgtatttaatttaacttatttagtaagttgtagttttgccagagagtagtccaatacagaagtttacagtaaattgaaatgaagtaagttgaaatgaagatgtgaaggatgctagagcaaaatattcattttaaggttgaaaggtgactaaataaatataaaatggggcattgtaaactttatatgaatattcacatgaaaaatcccaggcatcacagtgtgtgatgattgaaacaaaaatctgaaatagggcatgtggcaatttagcagataccgggttatagaaagtattttaccactaccataaatcaaaatgtagttcatgtgttactggtttaggattaagtaagtagttgataccccctttgttctataaacatgaaatagggtaagtttggggatgttgtaagtcagttttggtttaccaatacatttaattccagatttgaaacatttctaggaagattggttttgttttgtttcacttgccttgtagaagaggtaatgatgaagacaaggaaatggtataacagtgtctcgtgtaactgacagaaactattaaattaaatggagtgtctgatgttgcgtagctatagggagacctggagcatttttctacttttgtcccttaaccaatgtaggtagaaatagtcaccatgcgaatttctaggacaatacaggtgtgcagattgtaaaataagcattaattaagctcttgctatatgcatgtgctatgtatgttaagatgatgtattttgatcagatatgcattttgaattgtagttgtacctggaaaccaatagcagtagaaataattcatgcacacttttaatatataaattatacacatactttatttagattttgacataactatgaattttttcttgttgttgttgttgttttacaatttgtacttccgctacgtatcagagtttatttgacaggatggcatcattatgcactgaaaaatggaaaattcagacctcacagggccaggacttctaacatctattctacaactaactacctgagaaagtcatctaattctctgaactctggctttctcatctgtaaaaaatgaggttgatgctgataatcatgcatagtgccaaggttattgtgaggaagcaatgagataatggatttaaatatgggcagaattaaaaagcactacacaagtgaaagcaataataatgatgataagtgaggtttacctcctatagaaggaaataaacctcatgattaattaaaatttacaagtgatttccaaactacattttattgttttttttattttattttatttattttttgagacaggatcttgccctgtggcccaggctggagtactgtggccatcatagctcacagaagcctcaacctcctattctccccagtcagcctcccgagtggctgggactacaggcatgagccacaccttgcccagcctgtgctacatagccaattatttatgttctctttcctggtaatcttttatatggagctataagagagcagccaaccaggttgttaaaatttcactttcatttgataatgaagtcgttgcttttattgttgatctctatggacctagcatatagcagaaacaacaggaaaggccaaggacacatcactcatgctttctaacctcaaataattagtggagaaaacaaatcaaacacatacagagctgtatgaggatattgtaagacagtaaatacgcattacagtatagcttagagatgctgaaggacattcctatgggtatagagatggtgaattattattttacattcccaccatggtggatagtagcgggtatatgaagtactatggtgtggattcaaagacttatttggaggactcagtgaaaaggatctagagaaactgaaagatcaagaagtgagttcgtgaaaggactttgggataggcagagggagttgaaataatctatagaataaaccctgaataactaaagttgggctgtgtgtatatatatgcacacttgccttgtagaatacacaaatatatatatatatatatatatatatatatatatatatatatatatatatatatatatatatagtaaatacgaagtctggtgagtatgaacctgggctaatcatgtaacctttagaaaccctcagttccttcatctggagtctggggaataataaagaacttaactcataggggtgttacgggattaaatgctggaatccaacaaggctcgtagttctgtgaatggcacataaaaattatttagtaagttactgtcactatttacttgggagatttgtgcctgttaagaatggttaaagaagttaggcatggtagcttatgcctgtaatcccagcactttgggaggccaaggcgggaggatcactttaggccaggagtttaagaccagcatagccaaaaagcaagaccctgtctctactaaaaaatacaaaaattaggccaggcgcggtggctcatgcctgtaatcccaacactctggaaggccgaggcgggtggattacctgaggtcaggaattcaggaccagcctggccaacatggtgaagccccgtctctactaaaaatacaaaaattagccaggcgtggtggcaggtgccagtaatcccagctacttgggaggctgagacaggagaattgcttcaacccaggaggcagatgttgcagtgagctgagatcgcaccattgcattccagcctgggcgacaagagtgaaattccatctcaaaagaaaaaaaagaaatgatctgggcttggtggtgcacacctgtaatcccagctactaaggaggctgaggcaggaaaatcgcttgaactggggaggcggaggttgcaatgagccgatattgtgcctcatgccactgcactccagcctaggtgacagaacgagactccgtctcaaaaaaaaaaaaaaaaaaaaaaaaagaatgcttaaagaaacagcagatatttaaccagaagaagagatagttgggaaagaaacagtgaaaggaacattataggtgatattaactaaagatctatcatgtgaaagcaaggttcatcttctgaagagatgctggtgttgttaaaaataagtaagtttaacaatgtgtctgataacaaattagttaaaactaacttctaaaaataaacatttccagtcattgattttacaactccttggtgatcagtgtctattgaccgatgagcgatttttctttcactaacagcgatggttaagctaagattaaactaatagtgcatggggtacactaatacaactattacaatgctaaattgatgaaagctggttgagagggttggttttcaccctgtcctctgagaacatgccttgtggacagaagaggatactgtggacagcacctgggattgctgcaccgttgtctgctttatatgttgaacattggggctcaattctgaggtataaagggtcttaagctctaaaaatggttgtaaacgcctcacccagataatgtcttttctcatttttgctgttttatgttctgaggtaaaaggatatgttaatcttcttttcaaaaatatccaaaaggaaagaattttttttgctcattgaaaatcttattttcttttaaagaaggccttagcaaagcaccttaagagaaatatacaatttaaaatagaaaaaacatggccaagtagatattactgactgaatttatttcaaactaaacaaaatgaatcttacaaaacaatttttttctgtgtgttaggtgtaaaaatcactccagtaagcccaaatgttttcaatctgtggattggattgtttgcactggaaatgtagatttccaactgattttctactgatcaggttacttaatgaaacaggccaagtttttcggatctgtgaaaacattgccaaataaacaactgattgaaaatatattaggaaaagcagaatgcttatctaaagggtgatggaaaatgcttaagagaaagctattctacagttcaaaaaatttctttctttcttacccaactctaaatttctttttttattttttattgttattttttattatactttaagttctagggtacatgtgcacaacgtgcaggattgttacatatgtatacatgtgccatgttggtgtgctgcacccattaacttgtcatttacattacgtatatctcctaatgttatccctcccccctccccccaccccacaacaggccccggtgtgtgatgttccccttcctgtgtctaagtgttctcattattcaattcccacctatgagtgagaacattcggtgtttcgttttctatcgttgcgatagtttgctgagaatgatggttttaaatttctaataaaaaatatagataattattgattgcataataaattgctgaactgcctcaagttgtgtgaaaataatgataaaagagtgatcataaatattttcaagtgatttattatatgaaccaattcatttttgattaatttgctgtgagcctttctttcctctgtggctcaggtaatggaaccataaaatattacatttggaaagaacatctatttctctgcccctcatttgtttttgttttttttttttcagaagaaaaaactgatgcctgaggagtaatgtgacttgtttacttgtgtttcctgtccttaaatgacaatttgttcagaatgttgcatcaccagggccgaagtacctgaaagtttaataaaaaatgaataaatgaatgaataattgcatcagataagggttcaattgagagattcttggtacgaagtttttgtaccatggacttccattgcaaattgataaaacttattgacctcatcataaaaatggtgaagtgcataaaataaatacgtaggataacaaaggaaactaaaggtattgaagtatagtctgtgtactccagctaaagaactcctggaaggtgatttatcgtgtcccttccatttctgagatgttgcacttctatcgtgtaatgtcttgttactcttggatcagcagtcttgattgacaacccctgcaactactctgcattccaatctagatttttttacattttcttttcttttttcttgttttttttttttttttttttttttttttttgagacagagtcttgctctgtcgcctaggctggagtacaggggcacgatctcggctcgctgcaagctccacctcccgggttcacgccattctcctgcctcagcctcctgagtagctgggactgtaggtgcctgccaccacacccggataattttttatatttttagtagagacggggcttcaccgtgttggccaggatggtctcgatctcctgacctcgtgatctgcccgccttggcctcccaaagtgctgggattacaggcgtgagccaccgcgcctggcccttcaatctacatgtttaaatacaatatcctctgaagattcatgtgcctattagagcttgaaaatcactagtcctgggatcaaagtgagacccgggtgcccagagattggtgcccaaagcccttgtactgctgctggtggactggtgctactatatttttgtgtaaatcctgcagtggttacatatttcagcctaaggccgacttggctttcatcctctgccagtgtctgtttttgctttaaggataattcatctcagtttcagtaactgaaactgttgttgctttctgaatattgcataccacaagcctgacgtgatgtagtttttacccagacttccctttgctgtttaagcagcaaaattggaagcattcaaattagaatattttcttcagaagagtagaccttatttagagaactttatatgactgtaatatgatcttaaggacatatttgggaccttttcccacagactgaaattttcatatgcttatggttctctcatatttattatttatcttcaggcatagatatgatttggaaattgcctttttaactccgtcacctattttattactgctgtaaactccttattacctaaaatcaaggtcgttggtttggcgccagcctttgtctgtggacctatcagtcattccacctcttagcatgtgctgtcagccccaaagacaaagctctcggctgtaatgtatgtccccgtatctccacctttgtgctcacgctcttgtcttcaacacattccccttatcacacattccccttctcagaacttcttagagggccagggggcccagcccacttctgatagcaaggtttctggtatgttaaaaataaaaatccccaaatggtttacaaaaatttttggtatgttttaaatatttgcacatagcgcattcacattactaatctacatactcaaatccaatgtatgtagacacttgtttggggacagcaaatatataaatgtgagacacaggccaagtgatcctactggctccctcaaagcccccaacccatgagaaactctgctctcattttgttgtctgcagtgttctctccttacaattcctgtagcacgttgattatgatttacacagcatttttaaaggctttttcctaccttccatatccatttatttatttattattttatttttttttgagaagtagtctcgctcttttcgcccaggctgcagtgcagtggcgtgatctcggctcactgcaagctctgcctcccgggttcacaccattttcctgcctcagcctcctgagtaactgggattacaagtgcctgccaccatgcctggctaattttttgtatttttagtagagacagggtttcaccatgttagccaggatggtctcaatctcctgacctcgtgatccacctgcctcagtctcccatagtgctgtgattacaggcgtgagccaccatgcccggccgtatttattttttaatttaattggtacataatttattttattggtacaaaatatcacatgtagcccataaatatgtatatattttacatatgcatatacatacacaaaatacacaaaatgctgtacctcagtatataaaaagtgttgtgtgtaatgtttgaggtgatagatatctcaattaccctgatatgatcactgcacattgtatgcatgtatcaaaatatcacatgtgatatgtttatatactgaggtacagcattttgtgtatgtattttactctatgagattacaagcacccttggggtggagaatgtgtactattaatatacatagtacattcagtgaacccatgatgaattaacaaatgatggtaatctacttatcataatattacatgagctttcacttggacacagatatgagcacgggtattttgaattattttcagagtttggttaaaatcggtgtcattcacatggatttgtatgtgtgtgtgcctgtgcacgtgcttttttttacactaggttattgaaatacgagtatttatggaacagcttaaaatgtgtgtttttatgtttatgatactttgattttatgatttttgttagcttctccacatacgtgtttactggataacattgccagatgctaggaacacagctgtgaacctgtgtcaggtagcttctaaaagggaaaaagaaaataagcccaagaatttcactgtgtgataattgctttgaagggaaatatattctgcttgtttgttaaagcagatgggatatgatttatttgtaaacaattaaacagttttaacatactggagaagaaattgagtcaataaaggaatcttagctgggattacagctaagactgtaagaatgacagattgaagtaaagaagaaattgtacaaaagcaggcagctagttgaggttgaggagaggaataagagcaaattattgccaagtcttatgtatcaactggtaaactttcaatcttattcattggaaaaatgactgataaacactgtgtacatatcacaatgtttaaagtttctttggttttatttttaagagaaagagagtgaacgacctcttcttgatggtgacttgagaatagtatctttatgttaaagagacccgtaggatgtttaaaaggcctgtggagtacacctaaggtgactactttaggcgtgactgatcatctaaataagatggtcaagatttctgggaaatttctggtctgattaaagtctgtgaaaacttaggctgtcatcagcattggcaaagcattgcagaaacattgcagggatattggcgatgtttactgagaagactccacgaaaacaggtggttgctctatgtatgtttgaaattctagaggcagccaagttatgatgagtaaaataagcaagtaattttgtttttcttagttaacatttgataattcagtcttatggctctaaaagatattaagtatgttttattttaatgtgtttctatttttaggaaggaaaatctgaaatgtgctagtatctgaatttcggaagaaatgtagcttggttttagatagctgttaggaaatatcgccatctaatggcttttgcatcaaattgcagataacagttcctgaaggactccataaaagaccccataagacgcctaaggacttcataaaatgaagactccataaacttggtccaatagatttcacttacttcatcatcaaaaagctgtcagagtgtgatatgtagaaaacctaattataattttaagtgctcattttgttcatcaaccatcgttaaaacaaaaatagtatcttgttacaaataaacttatttagtgtattcatttatgcatattttgattattgacttaagtcagtaactgttagaatgaagtttaaaaatccgtaaattcagagaggaacttcttttcttctgactagttttttgattcttgaatgacaggttgaaacagatgttctctatgaacataaccaaatcagcaacgttaagtttgcattcctagaagcacttacatgttacagcttaccagagcctgaagtgatgcctccttttgcctcttgatacagcacttgtcttatggcaacggcagcttacacgtggatgccgctttccagcagactctctggagcgtggccccaatcagctcaggaagtgaggcagcccaaggtaaaaactccacttcaattagagggcctgtccttgctgcaaagttgacagtcatctttggaattgtgataatgagctgattgttaattagagctttttgtctgtgtctaaatattctgtaatgcagatacctgacatttgaggatcttgtttaaactgctattttaacagtgaagcttgggtgaagattaatcttcccttatttttatgctactgtcagctttagtttatttgtgtatgctttatgtgatagcttcctatggattgttttcttcaattttttgacctcagagtattgcctggttggactaatgtcaagatttcttattttctgaggtcatgccttatagctggaatacgaattttacaaaggagcagggtttcctagggaaatatctgtatatgttctggttattccaacttacataggttcacatttgattctaaatgtgtttgtatgtttaacagaggattttatgtgtctgaggtcatgcttttagtgggaatatccctaactgtgggactcgggcacccaggactcagagggaacagcaggcactgtctatctctgtgaccttggccaggtccttaagactcactagacttcagtttctttacgaaagtagaagattggaccagatgatctgtctggctatcagcacctgacactgacagtccagacctgaatgattttttatccttacagggtatctcattggtggtgatgtcctcaggttgctgcatggacacatggacgagtgtctcactgtcccttcaggagaacatggtgaagagcagcggaggttagtacctgagctcattgcattgagacttgcactcttttgccttgatgtaatgttttaaaaactagggatctattcattcaggccagtagcatcatacaagatgggctactgacattcattgattcactgaagtgatccatttgttgccccctcttagctttttctcatgttatatttctattacctaccaacagaagaactgaaaatttttgtataattaaaacatattaagaaacactgaacaaaattaacgaagtgagaagagtgaccacattgcattaaactacttagaacttcattaaatgctcattagttttgattaattttctttttagaatgtttaatctcaaactcagttttgaagtcagagttctcaaattgcgtacaattttaggaccctttgctatgacctctcatttattgatacagatgatagaattgatcactttctctcatatttaatctgatataatacctctctcatgttaatttatttggcactgggacaagattacaatagtatgaatctactgagaaaagtgcacaaatattacaaaaccataaaaatatttagaatagtttgctactgctctaccttacaaattaatcaatgaatgtagtaagatgaatatgtaaataagagattgcagtgagagaaggtactgtgtggatggtttgttatgtatctttaaatcttttagtggacatttttcatattaacatggacacttaggtaactattagttaataattatttatttttataatttaataaaaatacatagggaccatttagaaaattaagagtcatttaaccagctgcataatctcaggaaaagtccctctgagacctgggtactgggtcttaacctctgttcccaggcagacctagataatggtcaagagtgacataagtcccctggaaacattccgtaagctaaaactgcctctttcagtaggtttaggaagaagatgtcgatggtgtcagtagggtttgtataaaagataatggagattttaagacacttggataaggaattagtttcaaacagaaatataaacttaagaactagagagatgtcaagcatattctgggaatagcaattattccagagtgattagggggaaaatggaggaaaaggtggaaagtagacaagagaaagatccttagtgccattcccgtgggctggcttctattctgaggttgttaggaagggatgtggggatcagagtggaatagttagttctcttttaaaataataactctgttaggcaaggagaacttagattagaggtggggagaatctgagtcacggaaatgaaatgcagtaattcgtgtgacaaaatccaagaacttagcccagataatgccatcagaatggagaggtttacttgcatcatagacatttagataaaagtgatgggtttaggggagaactagacacaggctgtgagagaaggtatctaatccagcgccatctttttttctgcctcaggggaagacagctggagctaaggattgcaggagatggtacatgtttgctatgaaagatggagttaaactttggttacagatgagtacagtctatgagacgtccagtaggaaattgggatgtctgagtctttaacttaacaaaacttgggatgggtgcaaattctaagtgtaagggggatatttaaaggaatggggtctatcatatgttcatcagatggagagggaagagctgggattagatgtgtttgtcgattgggcatggccttatgaaggctgtaaagacctggaatagcctaatcaggcagggggctgaggatggattcctacagaatgctgatgtttaggatgtgggcagagaaataagagtcagcaagagagtcagagtgatagtttagtagggaaccagggaagttagtcattgaagtcaaaggattgggttgtggatatgttaaatgctatggtgtgtttatttggagttagagcttataagagaccatgccagagtctttggatcctcagtccctgatttgttaaatggaagacagactaagtgtttcttagagctttttcggctgtatctacagacactgtagagcttcgtggttaaggtaatggactctagaaccagacagatctgggattggggttctgctctgccacttaccagttgtgtgactcatgtaggtgacatagtttctttaaacaatggtttcccctctttgtaaaatgcagcttaaatattatctcctgctttatggggctattgaaaagactaaataagaaaatacacgtaaaatacttgatgcatattgagaaatcaacacatttattgttattatttagtctgttgctattatttagtctgaagaggcagcatttagccagatatgattgaaaagtttgagggactctgggcatatggatgacagaatggcagagcatagactttgtaggaagagaggccagactggatccaagaggatcctttcgatggctagttatgattgcagagaaatctaggggacatttcaaagatattttaatcatgttctggacccactctccctttgcatatatgttgaagcctgcccctcctttccaaatagtcttcttgatttcatgttgataatttcagttcaacttattcttagtatgtaattagaccagcctatcaggactcttggtaggtagtgatggtggtaagaacgcgtttgtttgtgtccctttttatagcatatttacatgggtgaaattagattaaaatggatgtcagattatgactcgagggagaaaatgagtcagcagtaggcagcatggagctgaagggatgttgcttaagaaaaaactatttgtgttggttatactgggattgagcaattatttgaatagaatgataaaaataattccttgaatttcacaattatatagcacttcattatttctaaatcttgttaataccattgtttagaaagttttcaacctccctctgttatttccctaggtcattgtaaggaacttgggggaggcaaaggatagctcaccccggaagcagcctttatttatttgttatcagtctgtactgggggagacatgcataatgatcatctaaaaatatacttttttcattcattaaacaaagaagtaaaagtaatttgatttttgcacagtgacatgaaagctagagaaggtcctgggaaatatgtaaaaaaaattttttaccttataattctttcctgtaattatgatctggctatactcattaattgtatgctgttgttaacgttaaataactaaagtccaatttactttgttaggagacatagtggaaactattaaggagatggccagaaaagatgtttacttctgagtgatttaggaatagtctggtcataaatgctgtgtttctacatggatttgtgcacctgttcctgctttgttctattgacagttatttaatatacataactgtaattgtagctattgaaaatccacctcaataatgggttttatgattctggatatcagtagagttacctttaccttcctcttcacatttagatatgtatgtgtatgtggttacctattcattctcctaaagaatgttaataaagctcttagaatgaagagcatatagagctattcagttaagaacaactgaattggagatgatgcctatcagagttaaactaaatatttatctttttctcatgcttcctgcccattttgcttttatggattgaatcctgacgtgttcatgaaatacagcatcattattgttttaagttacttgagatttttttccgaaagacaaatcgctctaaaatgactagtagacaacttgtctaaacaacaacaaaaatagtaaaaatataacctatagtagttgtgagcagtcaggtataagggagagagctcattagtattaactatagtgtcgtaactttttagttcttattaaactcttcaattagtgagatagaatgagttaaagagaagcaagtctggtagttgggaagggatgtgtcagtatcccttgtcaatcatgttttaattattgctttaaaaataggcttttgcacaacagggtaactatagccaacaataaatttattgtacattaaaaaataactaaaagagtgtaactggattgtttgtaacacaaaggatcagtgcctgaagtgatggatccctcatttaccctgaagtgattattatgcatagtatgcctgaatcaaggcatctcatgtaccccataaatatatatacctactacatacccacaaacattaaaaataaaaacttaaataggctttcattctggaggcttgacatttgactactaaattttatttcaagcctgacatattttatgtggagagtattttctgttctagattttgtttctagattgcatctcattatttccatccaaaattttatgtgaatataataaaatatcaacaaaggcatttcctttatgtgcacatagacttatttatggatttgatatgcactatgtgaataaactgtgcatacttttatattgatacattttaaaatggatgcattggggaagattatttggggcctttagtttggaaatctattaaggaaacattgtttgaaaagcattatttatgttaaaaacaggtttgcaatgtcgaaactttttattgattcaataagaatgtgtagaatgactatgattttctgggtgctggggctatagtagtatacacaaagttacaaagtttattttctcaagaagtttacattctagtgggcatatgcggcaataaatacgtttatttctaaatgtatacacttacccacatatacagagatgaaatgcattaggtgatgataagagctaaggagaaaaataatgcatggaaggggatggagagtgttcatgtgtgtggtatgttttgtggggtggtatgacggagaggtggggagagaaggagagaaagcttgttcttcttccaccttatctggcattgctcttggcatatgcttgctgtgtcttgttactttcaaatgcaggccaattaagtcatagtttctgacagtatctggaaataaatgctacatttgcttcccaaaatgtgactcagcaggaaaaagctatgccatgtgtatgcatgacaagatttttacctccatgcccccttttaatattatgatgatttaatgagctttagttgtaaataattgataaggcatgagatggattggatgtaatgaattaaatgcctctccatctggcttagaaagagatgcatagtttatatctgtgtacacaactggatgactgatatccttgtgaggatatttgtatgcctttggccaccacctaggaggaagctcttaaagctattctgttgttctccaaaatggtcaaggataaagtttaacctatgagggtttttcttctttttctctgtcttcaggtcctgcatatatcttttcagcctggaactgagagttagatgagttagctaaacagtcttgatggaatagtcagtacataaaggagagctactttctgctctttgcctcttctcctttgggagagattcgctttttaccccaaacttaaactccttgctgattgcagagagtgcagtagctgctgtagtttgtcatgtgttctggaagcctgacttggtctagagccgcactctcaaggcaaggactgggtaaaatgactgcttcaaaaacgtgggcttctaacacaagattaaaaacattcataggaatttgagctgttggatcttggcaaaaatgaaaaacaatgagacatttgatgcatttagagtatatgaatagaaaaacagacaatagattaaaatcaacattatacaaaaaaatctctcgatgattttctcaattaaaatttaagaacatgacttgtctacactgggtttattaacttaatctatatgtaagcaatatctttcagaagaaaaaaagaaagagaagcatcttcttttgtaaatttccagatgcctttatggttgtattgtgttctgcaaagcaatggtaacaacatgtattttgttgtttttctgctctagtcctacctacatgattctttcaatggtgattcaaagtgtaagctattgttgtttcaaatctgtgctgattcatttacattttatgcagaggtgtcatctcaaaacatacctattttcccttgtgcagcaacttgaatagagctattgtggcaaactgagctcctgaataaacaagtaatgcttcttgggatgctggttaggcaagtacttcttgatttgttactaggaagagactcctgacagctgctttagcacctgcctgcggctcagctgctcagccacatgctcccaaaggtaccagcagcagaaattctcctatgaaaatgtgtcaactgaaacgcttataatttcactctgaaataaccttttaagactggatctgcttttcaatcacctcaactcaattcttttaatatttattgagggacttgtatagcccagacatctttggcatgtgctgggtatgaaaacatgtctaaggccctgccactatctttctggaactcaccgtctctattagtctgttctcacactgctataaagaaatacctgaaactgggtaatttataaagacaagagtcttaactggctcacacttctgcaggctctataggctggggaggcctcaggaaacttacaatcatggcagaaggcgaatgggaaggaggcatgttttacgtggctggaggaggagcaagagagcaaaggggaagtgctacacagttttaacaaccagatctcgtgagaactcactatcacaaggatagcaaggggaaaatctgcccccatgatccagtcacctcctatcagtcccctcctccaacactggggattacgattcaatgtgaggtttgggcggggacacaaatccaaaccatatcaccatcttttaagatctcaacaacactatattcaggatgaagtgaatgttaatctgggagaagccatttataattttggtaaaacttagatggtagaaaacatattttaccattcaaccatgtgagaaagatcagccaagtctttgttgacctttgattttgaaggatatttttgtcagcctataaaaagttaacaaaaaagctttgcttttctctaattagtttgaacctgctattcaatatcaactctaaatgggaattgcaggtgagtaattgtgggtgactgtaactatttttcagacgattcctacatgcattttaaatacgagggtctagtcatacacgaacacaaccaaacttgattgaggacacgtccgctagtaggactgtctttttttttttttttttttttttttttttttgagacagagtctcgctttgttccccaggctggagtgcagtggcgcgatctctgctcactgcaagctctgcctcccgggttcatgccattctcctgcctcatcctcccaagtagctgggactacaggcacccgccaccacgcctggctaattttttgtatttttagtagagatggggtttcaccgtgttagccaggatggtcttgatctcctgaactcgtgatgcgccctcctcgatgtcccaaagtgctgggattacaggcatgagccaccacgcccagccaggactatctttaacttccccacactttcacttcccgcatcccatagtgccactgatcacacgtgttggtctgcatattcatctcttccattcagttttcagccagggctgtgccattcatttcttgcataccttttgcatagtgaggtatatatgggaatctgcatacaaatgctattgtttcgtatttgtgaaagaaagaaacggagaaaaaataactcttgcactttaatgtaagtttggttaaggatggctgtatagagaatcacccttggttgtgaggtcccccatttatataattttgacagttcctgaaggattgttatctgccagcaattaggggcggggaaagaaagccatcttaataaatcagcataacaacctgagtgagtagaaaacattttgaggactatgaatgactccagtatgcttggctaagtcatctatattgagaataccttgatttcaagtgagtaactctacatacgggaagagtctctggaccaatagaataggaatctgaacgttgataacagtgatttaaaacaaaagcatttttggggttgtggatatctttgagaatctaatatatgctacagattcttccatagagaatttgcatacttgccaacatgcacaatttttgtgatgttaaattatgttttctcccactattttctcttatttcttcccatttaagcagccagcagtccctgtgtttctttgcctgaggggaggtttgagacttggcagaaagctcaagttttctgcaaggcatctctcttcctgactctcagtccccaaagactaaatctaaggcatttgttatgcttaatgtcttgaacagaaaggaaagagggattcttcagacagaaaaaggagacgttttccccagacttaaaagacattcacatggatcaactggacttccaaacatacacaaaagagaacctgggcctaaacttcacattttatatcaaatctaattccaaatagatcacagacttaaatatgaagcacatacttttaggaaaacaaacataaaagttttaagggaaaaaaaatcagaaaaaaatctttgggatcatagagttcttaaacttgacaccaaaagtatgtctataaaagaaaaaattaggctggacgcagtggctcacacctgtaatcccatcactttgagagactgagacaggtggatcacttgaggtcaggagttcaagaccagcctggccaacatggcaaaaccctgtctccattaaaaaatacacaaattagccagctgcttgggtggctgagacaggagaatcgcttgaacgcaggaggtggagattgcagtgagctgaggtcatgccactgcactctggcctgcctgacagagcgagactgtttcaaaaaaaaaaaagaaagaaaagaaaaaatgataaattgtgttaacagagaagacaaaaatctatgaaatattttacagaggttaattctaagccgatatgagtgactgaagcccagggaaaaacacaaactcaagaagccttgagtaaatggtcccgaggccgttatgtcacgactatgttttatacagtctagggaagtagaagttacaggccaagtcataagtgaatacatggaggtgatatacatcagccttgcctaaaaaggtgggatatcttaaagtggcagcttacaggtcataagtgggttcaaagattatttaatctgcaacttgttaaaggagcaatgctttgcctaaaaatttggagtcagcagaaagtaatgtttaaggaagtctgttaaccagtaccctgggtctgagtgacctgtaggggtaggggacttaacacttgtatggcctggccttacaccctgtttataatttggtatctttttttttttttttgagacagagtcttgctctgtcacccaggctggagtgcagtggcgccatctcggctcactgtaagctccgcctcccaggttcacgccattctcctgcctcagcctcccgagtagctgggactacaggcacccaccaccacatctggctaattttttgtatttttagtagagacagggtttcaccatgttagccaggatggcctcaatctcctgacctcgtgatccacccgcctcggcctcccaaagtgctgggattacaggcatgagccactgcacctggtctataatttggtatcttgttgtcatgaagagtctgttctgtcagtcttctgagatctattttaacatgaatgccggccagtcattgtgtctagactccaaaaggaagggagataatgaaatgtgtctaacctcttgtctcatcatggccagaactcagtttttcaggtttctctggggtcctctcagccaagagaggaactgctcagtcagttggggggcttggtatcttatttttattttacaattgaatctcatcaacaggagaaagtgtgttttgctctgtaaaaatccacgtggagagggtaaaaagacaagctacagactgagagaaaagatttgcaaaccatatctgataaaggactagtatctaaaatacataaagaatcaacagtaaaatacaaacaattcaattagaaaataggcaaaaaccatgacagctatttgtcaaagatgacatacagattgtaaataagcacatagaaatatgttcagcattatgacccattatagaaatgcaaattaagaccacaatgagataacactgtatgcttatcagaatgactcaaacaaaaatattgacagccacgtgctggtgagaatgcagagaaactgtcatatattgcttgtaaaatggtacagccactctggaaaacattttggcagtttcttaaaaaactgaacctgcatgaccatgtggcttagcaatagtactcctgggcatttattctaaagaatgaaaactgtgttcacacaaaaacttgtacacaaatacttggtgtagagcaactttatttgtaataatcgaaacatggaatcagctgtggtatgtccatagcgtgggatactactcagcagtgaaatggaatggtctattgaaacgcacaaccacctggctgtacatggtggttcacacctgtaatcccagcattttgggaggccaaagtcggtgaatcacttgaggtcaggagttcaagaccagcccaaccaacatggtaaaaccctgtctctattaaaaatgcaaaaaattagctgggcatggtggcacatgcctgtaatcccagttacacaggagcctgaggcagtagaatcacttgaactcaggagttggaggttgcagtgagctgagatcatgccacttcactccggcctgggcaacagagtgagtctctgtctcaaaaaaaacataaaaaataaaaattgaacacacagcaacctcaatgaatctccaggcaattatgctgaatggaaaatatcaatccccaaaggttgcatactgtgtgattccattttcataacatttttaaatgataaaattttaggaatggaggacagattataggccatcagatgttagggaaacaggggagggaaatgagagggaggtggatgtggatataaaagggcaacttgaaggaactttgtggcgtaggatcttgcctgtgatggtgaacccagtgttggatataaaatactccaggaataaatgctgagtgccatgaagtaaaaccagtactcaggaaaaagtttaatgctctcagcaaggcaatctacttctgcagaagggtgtcactcacatcaatcaagttcgcaagtgcacacagaacaaaggagaccagggggtttttatccttaacgcagcccctatctctgtgtcactcccccatgggctagggttggaccgcacaatctgagctgactccattggctacttgtacatattttcctaaatatagtgggggaggggaggggaggtacagaagtggagtgtgtgagacgtgcagtttcgggggaacaatgggtataggtaaccaagtgaacaaatgtgagttattgattagagctgatgggaagggggtagggtgtttacggtaactaggggcaaggaagaacaaaaaagttgagtttgagaacaaaggataaagaagttaacaggctaaaccctttgaagagaaactcagaaagatttcttgtgtcttacaccaggatcttacacaaatgataaaatggtttagaacttacacacacacacacacacacacacaaatgaatacaagtaaaattggaaaaatctagtaagtttgggagattgtatcaaaatcaaaatctttgttgaaaaactgtagttgtcaaactcttactatagaggaaactagacaaaatgttcaagggatttttattatttgttacaactgcacatgaccagagtgatctcaattttttaaggcattcatagagactggacaaagagcaaagatttctggggtcccctttcgggataccaagcactcagctcccgacagccttctcctccgcattccatcctggcctctaaggaggtggcaagaggtcagaagggaatgactgtggagatttttactttagcacaatgtcctgtgtctcccaggtggataaaaagcagtggccctcagactggaagggggcatgtaaagagagaccctgaatataggagatctagcaagcaaattggtcctgcccaatatctgatattaaggtactgctttaccaagaatgattagggcttgatttcctcactatcctgatgggagggagactcaaagttggaaatagttatattttaaagataatttttaaatgttatattcataataatagtagacattatttataataattgttgacattatttcacaccaacctccccactcccactgagaaaaactaataaaggtagacactctcctttcccccgaaagtagagagtgaacaaagcagtgaagatgtagtattgggtcatagtcccaaaaaggaaggagatcagggaaatgaatttagtgtttggagcagcctcttctctctaggcagttgcaatgtctgaagggcttagaagtgaagcacaactgttagaagaatcataggatggaaatggatcaaaaattgtacaaatctccctaaagaagaggcgtgtttggtgggacctcaaagaactgtatccctaaaataattgtgatccagaaatagaccagaccttacaagtattgagacccagcatcaaataatattaattgccatttgggatttgccataagacaatatgagattactatggccctcgtctgtcaattctgcaagaagcaaaagtaaacctttagggagaaaattacatataaaactcaaattgcctatataattttatatatacaatgtctgataatcaaaattaaacaggctattttgtttcagcaccaactagcatactgcggtatatttctgacactaaccacctggagttagcacagactgcacaagttatgggctcagttttctccaaaactgcctctatctcagataccaatcacaaatgggatccccagaccacttgcggttctgaccaactggctatacatttagaggttcccataatccctttagattcaataactcactagaatgactcacagaacacagatgttatacttatgcttgcagttttattataaaggctacacatcagaccagctaaatgaagagatccataggatgaggtctgggagggtcctgaatgcagagcttctcgttccctgtggaattaggatattttaccctcttagcacataaatgtgttcactatccaggatgcttccttgagcttcagtgcccagaatgtttgagtgcagttttattatgtaagaatgatgcattcgatcataggctacatgatggaattcaatctctagcatccttcctatccctagatgttgtgctggatcaaacctctacccctttaatcgtgtggtttatctttccagcatggccagctcccatcttgaagctatttaggggcccaccatgaaccacatcattagcataaactgaggtgtgatgtaatgggctcatgaataacaaagccacttctattcacttggaaaattccaagggtgtactgtcttccaggaatgaaggacaaagatcagcctacttacttattatcaaacatgggcacagaagatgataggacttgactaaagatcaagagcatatacatagtactgaaaaaggcacatagatattagacacacagataatggagtttaattaaaaatatttatgattatctggtggggtacagtgtttctataatctcaacactttgggaagccaaggcaagaagatcacttgggcccaggagttcgagacctgcctgggcaacataaagaggccttgtctctacaaaaaaaaaaaagttttttaattagctgggtatggcaagtggagagctgagtatagcaagtatggaggagagcttgagcccaggaattcaaagctgcagtgagatatgattgtgtcactgcactccagtctgggtggcagagcaagaccctatctcttaaaaaaaaaagaaaaaaaaatatatatatgtatgattattatgttctaagaattaaaagatgcaacaatttagtagagaactggaaactataaaaaatgatcatatagacattctaaaactaaaaaataaataacttagaaacaatggatagatttaatatcagcttagaactagctgaaaagagaattggtgaactggaaatcagatcagaagactattcagactaaaacactgacagtcaaaagattgggaaacaggctgggcttggtgtcacacacctgtcatcccagcactttgggaggataccttgaactcaggagtttgataccagcctggacaacatagtgagatttcatccctacaaaaaaattgaaaagccagatgtggtggtgcatgcctatagtccctgagactcagagtcttactctattgggcaggctggagtacagcggtgaaatcatggctcactgcagcctcgatgtcctggcctcaaaccatccccctgcttcagcctcctgtctccaccctccttccccccaaaaaagattgggaaatatagaaaagaacaaaaaagatggtaaatgatattatagatggtctatcctacatgcatgtaattggagtcccaaaatgaaaggacaagggtgggagagaggaagcagccaaggagagaggaaagatggatggagggagacaaagagaactcacaggtgcgtggagtaaaggaagtatttaatacaattgcttgaaagttctccaaaattgactaactatattaagctactgattcaagaaaaactatgacccctaaataagacaaatcagatcacaggtatgcacatcagaggaaaactgctgaaaagtaaacacaaaatgaaactcgaaaagcaaaaagatatagtacctttaaaggggcaagagtaagatttgcagttgatttcaactcagaaacaatgggagacatgggatgtaagcttaaaagtgcttaaagaaaatatctggcaatctaaaattttatatccggtaacacagtgatactttatttaatttactttgggacagggccttgctccggctagagtgcagtggtgtgatcatggttcactgcagcctcaaccccctggcctcaagcaatccttgattctcccaccttggtctcctgagtagctaggactatatgcgtgtgccaccatgcctggctaatgtttaaattttttgtaaagacagtatcccactatgttgcccagggtggtcttgaatttctgatcttaaccagtcccccctccttggcctcccaaagtgctgggattgcaggcatgagctactgcacccagacctagtaatacttttagacaaagttgagggaattcatcaacaccagattcacattaaggaaataccaaaaagagtttctttgagtagaagaaaactatctcatatgtaactttggaggtatagaaacggaaaaaaagccacagaaagataaatacgagagttaaatcagaggatactgagtgaataaaataatgataatgatgattataaaaacagcaaaaacatcttggattttaaaaccatagagaacaggctgtggtggcccacatctgtaaacccagcagtttgggagactcaggtgggtggattgctccagtctaggagttcaagaccagcctgggaaacatggcgaaaccccatctctacaaaaaatacaaaaatcagccaggcctggtggcatgcacctgtagttctacataatcgggaggctgaggtgggaggattgctggagcctgggaggttgaggctgtagtgagctgtgattgcaacactgctactgcactccagctgtggtgacagagggagaccctgtctcaaaacaaaaaattatagagaacaactcattacaacactggcacatgagtcaaggggaaagtaacttgaattaaatggtggttcttgcatggtctggaaagtggtaaagttactaattagatcctgttataataagccaagaatacatattgtaatctgtaatcactgcaaacatagtaaaagaatgtaaaattaaaggagaaaccataaaaatataatagtaatacttaatccacaagaaagcaggaaatgagaataagaaacctggagtaggacaaatattaagaagaccaaattctgatgtggcctcgagattctcaccccagctatacacatcctgtatataattcctccctttttgtgtgatgggactgggtatatgacggacttcattcccatgactagattacattatttgacaaagctgaaagaatgttgcaaatgtaattatggcccctaatcagttgactttacgttaattgaaagggagattctcccagggtagtcctgaagtcttagcttcaaggtgtgtgagattcttctgccatgattgatgaagtgagctgctgtgttttgagagggactgtttaggagactgtattgcaaagttgctgagagccctctccagctgtcagagcgcaatgaaataaggccttcagtcataaaactgcaaggcactgaattctgggaaccactggtgagctcctataagggcctgagctccaggtgggaacccagccccaaccaacactttgatttcagcctatgagaccctgagcagggaacccagctacatcatgcctagacttccaacctacggaatggtagaataagaaatggtggtgtttctcagccatgaagtcaggggtaactgattacacaggaatagactaccaaaacattctgtgtgacatcaccttgggaatgaggacatatagtaaaggactgaccctaaattgtagagatgaggagcatctagcaaaggatgcaactgccagtgatgtaggaggaaaacctggaaagagtggtatcctggagtcaaagcataagattgccaagggcagtggggtgatcaactatgtcaaatgcagttctcccctcaaatatatccacaaatggaatgcccttgaaacaaaatgttttcattcttttctttcttatagcctcaacgatgaactttgtgaattactgtcaagtctaatccacagactcattctcctgaacttctatcctaaatgttcaagttcttattgcgtatgtctgcgtgaatttcacttgagacagcaattcaaatatatcaaccttaatttaattccatcagagatgttttccttcttacagcccataacttggttatgtataccagtctactatgctcaaaactttgccttgacttttcttttaccttttatgaaacaagagaaagaaggattttaggtcctattgattttattgctaaattttttctctattagacttgtttctcttgctgatgtcaattttaagggtgcaccttcctgtttactgtgatttgagggttctgttgtgctgttgctttcagattaatatccaaagtctttatctttaactcctttttatccttgtggatttgtgaccaccattcagaaaagtaggtgaaaaaactttcttaactttatctcttcatcccaccatcaaccactgaggtattcttgcactttgaatatggcagcattctacttcatgattctgcagcctttctactctcactgccacgctctcattcctcatatcctcattcttttctttgcatgctgaattcttactcagctccaggagtgaacccaaatatctccctcatgaaaactttgcagagctcttcttgacaatttatgtcctttcatcccctcccctccccttcccttcccttcccttccctcccctcccctccccttcccttccctcccctcccttcccctcccctcccctcccctctcccatctctttatacgtagtttccccatactactacctaggctagtttttggtgttcgtgtctttcttaccatgtcaaactgtacattcgtggatacaggaactttggtgttttatatttctttttcctaaaatatatacctatgtgtctagaatatgaatggtaaacaattagtgtttgtttttggctaaatacaattatatttctatatactgttgtttttacgaaagaatagaaagataatagttcttcatattatttacttttgcaacatttacacatacacatttgtagctctccatccttctcttttaaagagaataatccaagtttatttgagatagcctggtgttattttgtatattctggagaaaaaatgccctaaaaactacctccttttttccctgtaatatattcctaatatatttgtattactatattagtatttgttgagctagaatacctaatgatttttaaaaaattaatagactttattatacacttttaggtttacaggaaaattgagcagaaagcacagagaattctgcctcaccagttttcttgttattaacatcttgtattagtatggtactcttgttataaatgataaagtaatacggacacattattcttaattctctaaattaggcttactcagtgttgtacattctatagactttgactaataacatgtatccacaattgcagtatcacacacaataatttcactgctctcaaaattccctgttccccatttattccttcttccctcccctgaactcctgaaaaaatatttattttactgtctccatagttctgctttactcagaatgttaaatagttggaatcatatagttatgattccaaactggcttctttcacttagcaatctgcatatatggcccctctatatcttttcatgacttgatagctgatttctttacatcactgaaaaacattccaatggatgtgttacagtttattcacattttggctgcttccaagttgtggtaattaaaagctactattaatatttacatgcaagttttgtatagacctaatttatttgggtaaatatcaagaagcacaattggtgaatcctatggtaagagtatgtttagctttttaagaaactgcaaaactgtcttccaaagtggctgtatcattttgtattctcaccagcaatgaatgggaatcctctccagcatttaatgttgcagtattccaggttttggccattgtaacatatgaatagtgatacctcaagttgcaaatgttgacatatgacattgagcatctttttatatgcttatttgtcatctgtatatctttgatgagatgtcttagatcttctggtgatttttaaattgtggttgttttttttttttttttttttaaattgagacggagtctggctctgttgctcaggctggagtgcagtggcatgatctcggcttactggaagctcaatctcctgggttcacgccattctcctgcctcagcctccagagtagctatgactacaggtgcccaccaccatgcccggctaattttttgtgtttttagtagagatggggtttcaccgtgttagccaggatggtcttgatctcctgacctcgtgatccacctgcctcggcctcccaaagtgctgggattacaggcgtgagccactgcgcctggccaaattgttgttgaattttaagagttctttacatatttcggatgccagtcctttcccagatatgcgattgcaaatattgtctttcagtctctggcttgtctttttattctcttaatagtgttttcttgcagatcagaggtttttaattttaatgaagcccaacttaccaattttttatttcatgaattgtgctcttgatatctaaaacatcattgtcaaatgcaagaacatctagattttctcttatggtattttccagcagttttatagttctctgtgttacatttaggcctatggttcattttgacctaaatttagtggaaggtgtcaggtgtgttctagattagtttttctacacatgtgtataaagttgttccagcactgtttgttgaaaagactatattttctccattgtattaggtctgtgatccattttgagttaatttttatgaagggcgtggtctgtgtctagattctttatatatatatataaatggatatccagtcttttcagtactatttggggagaatgtccattgacttactgattctttgttagagatcaatgtgctatatttgtgtgggtctatttctaggctctctattctgttccactgacctgtttgtctgttctttcaccaataccacactgtgttgaatactgtagctttatagtaagtcctgaaatcagatagtgtcagtctcccaacttcgttcttctccttcaatattgtgttggctcttctatgtctttcacttctcatataaactttagaatcagtttgttaatatctacaaaataacttgctgggattttgactgtgattgctttgaaactatagatcaaattgggaagaactgatgtcttgaaatattgagtcttcctatccatgaacatggaatagctctcaatttatttagattttgtttgactttttaaatcagaattttgtagttgtctttatttagattttgtacatattttgttagatttgtatttcagcatttaattttttggtattaagataaataatatttttactttaaatacgtgttgttcattgctggtatagaagaaattgatttttgtgtattaatgtcctgaaactttcctataattgtctattagtttcaggagatttttgttgttattcttgattctttgagattggggtaaataatcatgtcatctatgaagaaaaagttttatttcttccttctcagtctgtatacatttaatttccttttcttatgttattgcattatctagaacttctgttacagtcttgagtagtagtggtgaagagaacattcttgatttggtcctgatatagaagcaacaagtttcttatgattgagtatggtgttggctgtaggcattttttgtagatgttctttatcaacttgaggaagttcccttctattcctcattggctgagaatttgtattattaatagacactggattttgtcaaatactttttcttcatttattgatatgatcaatgatttttttctttagcatgttgatatgatggattatactatggttcagtgatatcttaattaccttatgtatacaaaaggagaaaatattcatttttgctatcatacttgtattcaaacagcacattccttttgaaataaaaaacagtgatttctagaaatacctgttatgacatttataatatattttgtttagattatgaaataactactgatttttgaagggagaattgaattctgtggtatatcacagaaattctatggtatattcattgaaagttgagtttggataaatgaagtagtattttattacttccctgcattgcagtaactaaaatacattgatatggcttcttctttgtccctattatattctacagaaacatgtaattataatatgaattggcaaggaaatcttcagagcctggtaaactgttttctctacttttaacatatgtaatggattcatgatcaaaatttgatgtgactgattgaattgtcttttattattatttacctcttctggtgttcagtatttgttatatactctaccctttttcttgacaaaaaatgaaaccagaatgttatgtattcagaaaataggactctgaatagttctgtatcatttccccattgctctaaagtcatggtaaatgtaaaaaagagaaaaataaagttcacttagagcccctctcaaagtgtccgtgatactgtagtaataatagactatgtaagctattcagcattactgcactaaccttgtcagggctttgttatgttgaagaaacaaaagtagattgaaaaatgccccagctgttctttcatgtggcttttttggataagccaagtgctctgaagcgctgtgaatttgtctatatttctcttaagggcaaaaaagatctgtcacaatgtagatatgaattctagatttagaaatgttattcaagatagataaggtaagacatttccttcaatttatgaaagaccctagaccctggattttatccagctagctttctctgagattaaaatgaccaataatatgggtagaatattctagatctaaggtcaaccaatcaaggcagtaggtcaaatccagcccactgcctttttttgcaaataaaattttattgttacacagccatcctatttttaaaaacatattgtctatgtttgcttttgtatgataataacagaattaaataatgagacagagaccatatggctcgcaaaaccgaaaatatttactaactggccctttacagaaaaagtaggtctgctcctgttttaaaccaccctttcatggtggcaatgaaagtcatagtggtgggtgtcaagtccaacagttctcgagacagtggatccctgtgctggagctacagtaagggtgacaaagcaggtgacttcagaagaggatttaaataagagagaaggtaggaaaagaagtattcttttaatctatataatgtatgcattcttttcagagcttgaattttttatagtgtcattttacaaatgtattgcgatgcatacacaatagaatattatacaacctttaaaaagaaggcaatcctgtcatttgcaacaacatggatgaacctggaagacattatgctaagtgaaataagccaggcacagaaagacaaatactgcatgattttactcatgtgtggaattcaaattcatggaaggagagagtagaatggtggtagctagaggtcacctccagtgactacagccctagctaacaacttgactgcaacctcacaagagactccaaggcagacaccaagcaagaagcacctagttaagatacactgtattcctgacccatagaaacagtataaaataatgtgtttattatttttttaaaaaaagaatgctgagatcctgccattgaattgcaggaggaggctagcactgaagtgactgatttatgatgaagctattaataggtaggcttcatttcctagttacgttgtcccgagcgattttataatttagggactttgaatatcaacaagtgtataatatgattgatttagcaacaatccattcaattcaggcaaaatattattgaatcttaactccctatatggaaggattgaatataaattatgaccacaatcatggtcatgatcatcaccatcaccatctgcatcctcagagctgacatttgttgtgcaaggacttttccaagtggtctacgtgggttatattactcattcattcttcacagtaacccagtaaaaattattcccattttacatatgaagaaaatgagacagagaggtcaacagcttgcacaagttcacacaaagaagtgacatcttaagaaagttaataacaatcaaatgtgaaagtgagtcatcaacttttagttgccctgcagaacaaacaagagagtaactgtgatgtcattggttgacagagccctgtggcagcactcacaatgaaaggaagtggtttccttgcaggttggaggtgtcgcttacaatgtgcaatctttcattaataatgtattttatgattctgtactaaagtccactaattagaattgtgtgccctataaaattttattgtaaatatatgcccaactgtcaagctatgaagaactcgtaaggatttgtgcttttattaatatgctaatgctagtcttttctgggccttagattctaaagatgagctatcctagctgtcaaagtgcctgctttttaccgagaaacaagtggcttgacaactgagataagactcaaattgtgttttatagccaaaaatacaaaaataactaattttatatcagtggacaatattataatacttatgagcagcggaattgatggtttactgggaagaatttgtacttagaataaccttaaagggcctcttcaggcagttttatgcgatcagcctgaaatatgagttcctaaatgaaatgtattatattgtgggataatgtgttatgtaggcataacttacagccttaagtctggaatttttcaaagtactgttgaacaagctcatactgctggttattatatgtgcatatttttaacattcctattcagtgaaattacagtgactttgactttgtctggtttatgagattaaagtttttaaacaaaattctgttcaaaataataacaatgtccagttcttttagcacatactctttttctcagtagctgtaacactgttttagtacattgcaaaaatagtctccagttaacaaagagctgcatgagctcttttgtattttcatatccgtcgaccttcctgaattctggcatccttcctgccatttgcattaaaatcccttgtgatgattacctcaaaaggtgctgttgctatcagtctgtgtaatttcttagagaatctttctcccttttcagtcatccagctggaaagggcatttgctctgagtataatcgtttatttgtatgagttcaaagttggtaataccatttggcaaacttgttggtctttagaacaattgtcctcctagactctgatttgatacttgaaatgcattgcagggaaaagggacaatcccttaatggagcaggtgtattcctctaggtgggctgatttctaaataagtttgagtgtccttaaagtcctttatgaaggactgaaattcctatttatttaagatcttgatattgtggtgccaattttcagtctgaaacagcccatgaagacttgattagacaaccattgacgctctgcacatgccgtgtaatttacgtagggaactatgtaatagcaaagattccccgcctggcaataaataatcaaaagaagtcatcagattctctatacctgccaatgaaacttttaaaaaaatatgaagaggaacaattcagggcacaagaaccttcaagatagagctaaaaatatttcaggtaggaaggaggattcaactttccttttgactttatatttgtcatgtaaaattttaataaaaataccattagatttttataaaagatcattgttaaattcaaaaggtaaagttgtcaaagtaaaccatttgcgtgataattcttcactttattgtataaatccatataactttacaaagatatattattcatgctatttgtatcttagagaccttttaaaaatgttttgaacttaatttctgtataccttattaccttatgtaattgttcctctaacgtaattaatgctaatagtttgatgttcattatttgacaactttctccatgctcatacagatatatgttcacatatgtacatatatgatagatttttagtgataacttgcacagaaaatgtacataatttacactcttgcatcttattgaacagtatatcattgagtttcttcctctattttctgttggtttattttgttctctatatgtcttcaggcaattctttatttacatgttttatttaataattaaaggattgcagattaaaagtgttcaaagtttacctgtgaatcatagacttgttaagaagtgcttttctcttcattatattctagatagagtataattttgtttccctctttgacccatgaattatttagaagtttcttcattttccaagttgtcaatttcttttcttttcagtatttgtttctaatttttttgtttatgatcagaaaatacgatgagtaaaagtctttaaaaatctgataacattttctttgtggtcaagtaaaagacccttattaaaggtcaaatgtatttaaaaagctgtgtctttgtgtgagtgtgtctatttatatatgtgtgtatacacacacagacgtgcacaatgtctatattttgtcattcagtcttacttaatcagtctgagtgttatctgtacattggactttttaaagctttccaggtgattctaatatacaaccaaggttaagtatgttgccaaaatgaaataatgggtctagtcaagtggttctcaaaatatggaccatcaacatcacctgggaatttgttggaactgcagattcttgggcctcaccctaagatgtggtcacttagaaactctggggatgggtccagcaatctctttttaaaaaattattttaattagcacataattgtacatattatggggtagaatacgatatatggcacaaaattatttttaattggcacataattgtacatatttatggggtacaatatgatatttcaatacatacacacagtatagaatgatcaaatcagccgttggcatgtatatcaatgcaaacatttataatttctttatgttgggaacattcaaaatcctctcttctagctatttgaaaatatatgctaagttgttaactatggtcatgctatagtgctatcaaatactagaacctatctctccaatctacttgtaatttttaaatgacattctgtcattcttagcaacatggttgagcctagaggacgtatgttaagtgagataagcaatctgggtcttaacaaaccctcaaagggagaggattctacctcaccgaagacttgagagccgcttacctatgtcagtggctctacactgagggtgattttgtccccaaagggacatctgacaatgttggagaactcttagaactcttttggttgtcacagctggtgggaggctactggtggcatttagttggtagagggcagggttgtaaacatcctgccatgcacaggacagcccaaaagagaatcacgcagccccaaacatcaacagtgctgctgtggagtaacttacttagactgtactttccaaggcttggcttcccattgcaaccagcgagagagttttttaaagtcctgactccagatctgtttaatgtcattggtgagggtgcacataaggatttctaaaaactatccatgtgagtactttatgcagcgacagttgaaaatcactgctgtggacactggttattgatggcaaaaactgcaataacttttgcaccaacttactacctaaaactcttaggtcctaatggatggattagggtgatcccaaactaactgattaaattttatctaaagaaatagacaattatgtacccctgttgtgttataatgggaagtagaaacaccaatttgtgaaatgttcttgccaaaaattcaaacttggacaagcttctagatttctagatctcactaccaatttagaggtatgtgttaaaaaacaccataggaaggctgttggccaaatctagaatgtagaaagtcctccaggacatatggtacagactgattatcaccaaataaatggcaagaagggaagacaagagaggaatggggactattctagaataaaagaaacttaagacccctaactgataagtgtatctcttttggaactggatttgaaaaagcaacaggggaaaattaaaaacatctgtgaggcaatttgggaagttcaaacacagactagatatttcataatatcaaataattattttcagagttgcatgtggaggggtaagtagaggttacaggtaaaacgcggttgtccctatgttgatcattgttgatgtcttctgctaggtgtatgcggatttattttaatattctctttacgtatatttgaaacattccacaataaagatagaatgagaaggattatctaaacaggtagggaacggcaggtgagaatggtgttagaaaaactttcaagacaataggagtttccacagtgttaaaaagaaagtaagtctattggatttggtaacatgaaggtcacttgatgactttagcaaagtctgtttcagtggagaaatgggtctggaagcaagattggagcccactggaaactgacaggagtagacatggtattactgctgtctgtgaggcaggataggctttcatgtgtttacataagacagaccctatagagaggaagacagttaacactcaggaaagaaagagggcatgtgcatcagctttggtttccaaaataatctcaaggcgttggtgcagtcatgaatttggatacttacagcaattacttagcattatgtatggcatattaacacattattttgagggttttggaatttgggtgcatgtgatatgcatccaaagaaattccttttttgtgactttttggatattcatattttgatataaattgcagattgctgtgttaaaatattaagaattgtgttcttacatttctttaaaatgctttaaataatctaaaacagaatttggaagtgcaaatatttatatacatatgttgaaataatgatatattaaactatacctaaacttatcacagagtactttcatggacctaagttagatgagtaaggtgaaatctattcactgggagggagggatgggaagaaacacacacacacacagagagagagagagagagagaatgaatgagattagagggagaaaatggcaagagagaatatgtttaaatcattgtttattcagggaaaacttaggttgatcactgttactgttattttggttatttttatttccagctatactgtctcctgccaaaaaagtataactttaactgtttactcacaggccatttgcttttctctcctaattagcttcaaaaaattagagtccaaagaatgaaacatgtttaactcacatttgggcttttgtttgtttgttgaaacagaactgttcattatgaaggtggcgctgtgtctgttcatgcacgttccctttggagactagagacgctaagagttgcgtaagtagaacttctaaacacagcctaatgcaccaagtgtaccaaatagctcagcgttgtgcttctgtgtcagcctgtgatgctgaaaactacagcaagcaagcgaacaaaggaaacaccgagaaagtggtggacagtttctcttttgtctatttccttccacctacctttatcattccttagcctcagttcaccagctagcaaacctgagaaataagcaataattttgtacagtctgcttttgtctttagcctcatttgtttttctaacatcatctcatcccagaccatgcatctcttggcagaaatggctactaggacagagtgatgtaagatttggagacacgacaagttctttgcaagcctgtcgcacatctcagatctgacagactgtggatttaaccttctaaaagtacatttaaaacaggaaacttgaacatgagcgtaggacagagtcattactggaagtcactatatttacttaaaaatcacttgatagctaagtacaaatctgcattgcaataaaagtcactgtgtattcattatagtaatgagagtttttatatattaatatttatgaaacataaatgtataaagtatttttttctgatgacttaactgtctgaatatttccttttagttcctgtaaatgaatacaatatgatgataaaggtgtcattttgaactattttaagtagaattaaaatttttaaaaataattcgaagctttagtcctttgcctaaaagcagtaaattttcaatgtgtttacttcctagtatattgggttttaaagactttattgatttaggatgataattgatttgtattgggctttaaagacattattgatttaggataacagactctatgggtgggaatgagggctatcttactctagtataactatatttaattaattaatttatttatttattttgagatggagtcttgctctgtcactcaggctggagtgcagtggcgcgatctcggttcactgcaagctccacctcccgggttcacaccattctcctgcctcagcctcccgagtagctgggactacaggcacctgccaccacgcccagctaatttgttgtatttttagtagagacagggtttaaccgtgttagccaggatggtctcgatctcctgacctcctgatccaccagcctcggcctcccaaagtgctgggatcacaggtgtgagccaccacgctcggcctagtataactacctttatagacattttattttgagattattgcctgtctaatggtgatgagaatagtttagaggccttcagtcgtttctgctcctgtgtcccatgcaatgattttgaaaaactttgtccattcttgaacactgtgaggttgacatagaaatcctttcattatcagtttagatgcatagaatataacttccagtgtattttaaatagtgatactttaaaataaaatggttacatcacccttttcaaagtatccaattgactgtaagtaatgctgtggtttaatacctttgtttattgaaaatggtcttctttaacaataaaaatatatattattcagtctttccttttcactacatcctactcctctgcaacaaaaatatttatataaatttatttcttatatttcttatgttagtctgtaactttaaaaagctcttctatattgtcattaataactaattgaaaacattaaatgtctttgatataaatgcacaattgatcaaatctacctaaatattaaaacttttggtaactaccaaacttaaaagaaaatttttattggaaatgcatatcataatgagatggaaaaagaagagacagacttctaaggcaaacaaaggaaaactcatagcttttatatattttgtgattattcagataatttaaggaaagggattttaagtattactcatatttttttacattgtgtattataaaaatgaaagagtaaagaagtgtttatacaaattaattgtatacataattactaattatatatgtaattaaattgtcactataagtgcagtttcgagaggttgtattgaccttgtaaaacagattgaatatgtgttttcaaaatttagagacatacctatacttcatgattgagtgcttaaagaaatatttatcttttttgtagagagagaccctacatctgtcttatttttggttaaaaaaaaaacatgaaagcttctgaaaacctgataggactttgtttttattgttatcgatactattgatgagctgtgactacataaatctagattattcttcaaacttctgaattaagtagtcttgatcctgtctctctactgttgcttatgtttgtattttgaaatagaagtttggagtttattttcactttgattacagataatcaatatatagaaaggagatgatcttatggtcagccactggggaaagggaatgctacttgcttctcatagtccagatgtcactgaggggaataccacagagaaggcagagcaggtagtttttcaaccatttagcagcttaaagagagatgttttgttcttctctctgacccttgattaaatttcaccttcctgtctagcagtaggaaagtaggagattcatatgtacggaatatcattattttaagaagtttttcagattatactgactctttaaactactttggctttattgtagatatgtaaattaagctacattcagtttaggagcttttatttttttaattaaatccctttcattctaggaagtttacatgtcttatatgcaatggccacataattactaattttgcattatatttagcaatttatagtgaagatcctgcttttgtttgtgatagaactatattgcctaatgccaatgtttatattcaatatttgggatactcggtcttctcttttctccagtgagatcctatactatatatttgttgtagttgatgtggcccattcattatatattttatactgcatactcttacacatgaaactattgtcaaaagtttttcagtatcatggcctttttaataaatggttttaatgtagggagttaaattgaatagaaaatgctctcctatattttactccaggcaaaattatagggatattgtaagtgagatatgtgttagttcctgtaataggaatactcatggaaataaaaactatgaattacatagagttcaagttctattttttatgttgcaaataaacaaaattaaagggtgacatatcataaagaagtactcactattccccaattccctttgaggtaattttgagtaaatatcgataatacgtagggcacagttttttgatgttaccataggaaattgctttataaaactccattactattgccaattttagtttttactacatatgattttcttgccttgccctctcatttgggaggaggtgggggtctgggcatgtgagaccaggctagtttgagtggctggaaatgaaagcaaatgtgcttagacttagactatgcagtggttttgccaaaaactggccacattcattccatttctaccagaatcctcttagagacttcaaaggagcactggtacatatgagttctattgaatagaactgagcccagaacatcttccagatacgctagcaaatagtatatatctggttaaaattttgtgctgttttgaaaatgaaggtgtgttccatgatgattaagatgaattgttattcagaagtgattcattatttacaaatatttcattgtttttccaaataatggaaacaaatattaaacatatttccaaatatttcattgtttttcaaataatggaaacaaatattaaacataattgtgaccgggcacagggtggctcacgcctgtaatcccatcactttgggaggctgaggcgggcagatcacaaggtcaggagatcgagaccatcctggctaacatgatgaaaccccgtctctactgaaaatacaaaagttagccgggcgcggtggctggcgcctatagtcctggctactcgggaggctggggctagagaatcgcttgaacccgggaggcggagtttacagtgagccaagatcgcgccactgtactccagcctgggtgacagagcgagactccgtctcaaaataaaaataatagtaataataataataatgataattgtggttttcatagtatttgcaaacaatacacttaattttataagaggaggattttaaaaagcttgtttatttccaaaatagaaatactttaatgtgctattattggtaacaaactttaatttcatcttaagacaataccgtgttatctggttttattagtatacggttattaacttaattggggggcttcccaaattaattgtctttataaacaaattcatgtgaaaatgaacttgttataacattctactgctaattttctatgctaacatctcaagtcaaaaatccaggttaggaaaacaacattaaattgatttataatttactaaaagattgctagctttgaaccaagtactctcaatttgtagaacacaaacatttttaataagtctgtatgaacccaagtttattaaataataagattatattgaaaatctccatatatttactttttctttgactcattgtattttgacaaaatcatccagtgtaaactgtcttttaaaaaattatccttatgtttcattttctgcttgttgttgacatatgaagctttacaacattcattatttttagagtatacactttttcttcataacatatctggctgtataccttttgtgctttttggccttgaattggaattatctaatatcaaatttgtcatttccttttgaggtttatttgcttgttgaatcttttctactcattcgtttttagttttcttgcgtgctttgatcttaagcttgtgtcttatcaatgatatatatggcctgtcctcactttgcatggtacggtgttaagggaaagtcatgcacgatagaactgtgccatcactctgcaccttagcatggttaaagctcctaaatacacaaccttcagttaacaaggtaatgtgcaaagcaagaacagcttgtattttgatttttctattttatcctacctgaaagtcatttatttatttttaatatacaagtgataatcgtacatacttatggggtacatagtgatgttttgatacaggtaatgtatagtgatcagatcaattagcatatccatcatctcaaacgtttatcatttctgcgcattaacaacattcagtatccttcaaagcaaatttttaatgatcataacttatcattttactgaaacattctatattttctgtttattacattttttcctgacttttttagaattttcattttcttggcttatcttttttgttcatcgcgttctaataatataattgttccacaatattaaaatgtaaagtataagaatacatttcttttgtcaggtaaatatagtctaactatagacttcagtttatatatatgagttccaattaatcatacttagacgttgaccacaatactactgtttttcaagtctgtgcaaatacagcaacagtttttaactagtaaatgctaaaatattacttggagttatacttcctgcattatttgcattagagcttgactaatctgtattagagggtgacttggagcacaagttctttgttatctttgcatagaatagggcgctgtgtggatggtacggcatttaagtcagaacaccttgagttacatttaacttcttcttactataagctttgcgactttgtgtattacttatcattctgaatagccattttgttatttgtgaaatgaaattaatatcactaatatcctaagttttttgagaacattaagacaatatatatgactgttcattgtccgacatatgttttaatagctactccttctgtgattgtgggtgctattggatcaagtcctaactgttttcattaggtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggtgagacagaaaatattttgggtttcctataaatgttacccggtcatatttcctttgatgttagaaaggagaaaagaaatgagaaaataaatgatgtaagtatgtcttatgtgtatttctaaattcccagtttctcttccatacattcctctctggtaaaactgacttttctaaaccattaaaacctgcctatagaaacaatctaaatgtacaataaagggtaatgattacataaagggtaatgattgcataaatcatactgtatacatacatattgggatagtatgaagctgtcaaaaatataaaacatgaaaatacctattatacgtcatcaaatgaaaggtgtttcatgtcgtttacagttcttaaaacacatccatccagctccttcctgttttcttaagcattgacagtatacagtgaccacagatattgggatgtttttgggttacagtgtgaggataaagcacactggaatctgtgtctcaaagatacatttatacatccattcttatatgcggaccttcatccttaaccctattgaatcatttttatgataattgctatattcgtccattttcacagtgctataaagaaatacctgagactgggtgatttataatgaaaaggagtttaattgacttatacttccgcatggctgggaaggcctcaggaaacttacaatcatgacagaaggggaagcaggcaggtcttacatggaggcaggtgagagagagagcaggagagtgagtgtgaaggagaaagcgtcaaacacttaaaaaaaccatcaggtctcacgagaactcactcactgtcaggggaacagcatgggggaaactcgccccatgatccagtcacgtctttccctcgagacgtggagattacaaattgagatgagatttgggtggggacacagagccaaaccatatcaattgcatatttctgttcataatttaatgaagattgtgaaacttgggaaagatgattggaacaatattaaactactaactagctttcatcttagaaaggcaaaactttgttcttttaaatagataaagatttgactttgtatttctgcaattactacatactcatctaggtataggcatcttcacagtgttattcagggctcattgaaaagaaaaaaacgtattactttgttttttcactgctaggaaattcttagtattcaatcgcctttcccatattttgtatgctggcccaattcaagttggatttttgataacaatgttattagatgaggaaaagatgttaagtaccatgtataatatattcaaaacaaggtcatgatttggcttagtagaactacaatacatgcactacaatgctttttcaatactggattaggtttaaatttttactttgcccctctctagagatctatatgttaggtaaaatcttctaaatattttacaagcattaacaaatgattatttcctatttaggtaaagcgtttaccctaaaagaccaattttctgtatgcttaataaattccattttattaatcttataatggtgtcctgtcacagcataggattggcagcataaacataaatatttattgaactttgaaggtgtcccacagaacttctatttgcagttgtcactggaggccactgaccactttatttctacagtaggtctatggcctggattgctccagtgagtgcaggaaatagagaacattaattttgctaattatgaaaataaactatttcactatactcttaataatgtatttcatataaataatgtctaacaagaaaacatattcattatttagagtgataattgtaacaaaattaaaagtagttatttacaactacttaaaagttttttagtgctttaatcatatttcatttcttctgattttgaaagcagtacatgttggtctttgaaagtttagaaaatacaaaaaaaagtaggagtaagaactacctaattatgcagaatatcaacgttttgatgaatttccttcctaatcatttttcttttgctgtgtaaacgcacacaaccttgcaacatggggatatagggatcaccaacacccctcccccatgcaattgaaatctacattttgactctccaaaaacttaactactataaagaaggctgggtgtggtggcttacacctgtaatcccagcactttgggaggccgaggcaggtgaatctgaccaacatggtgaaacctcgtctctactaaaaatacaaaaattagtcgggcgtggtgacatgtgcctgcagtcccagctactcgggaagctgaggcaggagaatcgcttgaactcgggaggcagaggatgcagttagctgagatcgtgccactgcagtccagcctgggcgatagagcaagactctgtctcaaaaaaaaaaagctataaggaagataaaatatattttctatgccttaggtggaagtggaccatcaacaaaattggtccttgttttcatgttgtgtaggctgaggaggaggaggaggaagaagaggggctggtcttgttgtcttaggggtggcagagatgaaggaaaatgcatgtataagtggacctgcacagtccaaatacatgtcgttcaagaatcaactgtacattacaaaatatgactatagtttggtgttctgctttcatttgaggatgtatagtaggtatttttatattttatatttttgacagattcatactatcccaatatgtatgtatacactctgatttatgcgatcattattctttatgtaatcattaccctttattgtacatttaggttgtttctatagttatatacatatattcatatatatatattattataaataaaactcaaaccaaaataaggtgtggggagaccagaagtaattctgaaaagacagtatcctgaatgaacattcccaatgcctttctctttcaactcctgttctgggttataccgaatggtagcagatgcctctgattctatgagttaactggagagctccaggaaagacagtcagggtaggtctttattctccattgtgaaaatagagaggcacagctggtaaaacctcattatccttgcaaagcatctgtatctatatatttgctctgtggactcttagagggcctctacagtgggccagaattgctccttgtctctgtaactggaaagcacaattaatcccattatggggacatgggcttctttcttaaatctagctagcagaggggtgggaatttgctagtttatctactgatagcacctccgtccagaaagaaaaaagttcaacccactaaagaagaaccaattatttgatggtagaaacccttttcaagtaaagaaggtggtacctattaaaatggcattcagcttattgacaataaattagaaaaactagaagaaattgatatccttccagcaaaatataacatacccaaataaaatctcgaagaagtagaaaaacatgaaccggtacatcacagtggaagacattggaatgatttgccaaatttgagtattttaaaaagctgggagtctgtggtgggaggatctcttgagctcaggaatttgtggctgcaatgagctatgatcatgcccactgcattccagcctgggcaacacagtgagaccaagactttatagaaaaactaaaaataaaaaaattaacaggcaaaatacatctaacgaaaattggaggaaaaagaggaagagtgaaaggtacggtaggtgctccagttgccttctatgaaacaaacatcaaagatcttcttaagattgaaaactcaagtaatggaagcataaatacttaacagccaaaaaggaaacactcaaatataataccatttactaaaacaagatgatggaagagagaaaagttggtgagagaaagaggaacacgctaccttcttcatcatgcgtaatccagcctaataaaaagaagtaaagtgttactaaagagtcagagacataaacacagatgcaggcatgcagacaatgaggaaaatgagaccacagagcgaatggctctaaaaaaaggtatgaaaacagaaaacctaaaatatgacacagtgaaaacctaaaatatggcccactctatttgcttatcaatatatataaatggactgtatcacaatttaaaattaaaataatttcatatttgggcatgcagcataaattatgctgacattaagaggcacatctaaaacaactttatttggaaagattggaaataaaaagatggctagtggaataccaagaaaatacaaacaggccaggtgcggtggctcactcccagcactttgggagaccaaggcaggtggatcacttgaggtcaagagttcgagaccaacctggccaacacagtgaaaccctgtctctactaaaaatacaaaaattagctaggcgtggtggcatgcacctgtaatcccagctgcttgggaggctgagggaggagaattgcctgaacctgggaggcagaggttgcagtgagcctaaattgtgccactgcactccagcctgggcaacagagcaagactctgcctcaaaaaaaaaaaaaaaaaaaaaaaaaaaaaagatatctgttcttaatatcagatgaggtggaattcaggcaaactaaagcattgcaggagacaaaaaaggatattgcatggtattgaagagtgcaagatagtattcgtaaaacaataaaaagtgggcaaggaatatgaacagacacttttcaaaagaagatatttatgtggccaagaaacatgaaaaaaagctcaacatcactgatcattagataaatgcaaatcaaaaccacaatgagataccaactcataccagtcaaaatggtgattattaaaaagtcaagaaacaacagatgctggtgaggctgtggagaaacaggaacgcttttacattgttgttgggaatataaattagctcaaccattgtggacgacagtgtggtgattcctcaaggatctagaaccagaaatacaatttgacccagcgatcccattactgggtatatacccaaaggaatataaatcagtctattataaagatatacatatacctgtttattgcagcactattcacaatagcaaagacatggaataaacccaaatgcccatcaatgatagaccagataaagaaaatgtggtacatacaccatggaacactatgcagccacaaaaaggaatgagataatgtcctttgaagtgacatggatgaagctggaaaccatcatcctcagcaaactaacacaggaacagaaaaccaagtgctacatgttctcactcataagtgggagttgaacagtgagaacacatggacacaggaaggggaacatcacacaccagggcctctcggtggggcgggggtgcaaggggagggagagcatcaggactaatagctaatgcatgtggggcgtaaaacctagatgatgggttgataggtgccgcaaaccaccatggcacacttatacctatgtaacaaacttgcacattctgcacatgtatcctggaacattaaaaaaaaaaaaatacaagtcactgaagttgtaagttgttaaatttacataacaaataaatatagggtagtactagtatttataaaacaaaatctccaggagctacgaggagaaacaaacagaaaatcttagtattaggagatatcaagtcaccttttctcagttcatgatacgcacacacaccacacacctcacaccactgagggctttatggtgtgtggagagctgccgcagaagccctacccttaattggacattcattttgttcactcaggaatattgcagggctgacttgagcgggactgggaactgggaacatgccaacagttagtgccctcagagcttgggagggtgttcaggaagcagggaccctgtcctcccacactccttggctttttaaataaaagaattgctgccattctgtgattccttgtaagtcagccaacagagctgagcattctctctagttgatctcactgagtatcaggacccccattttacagatggggaaaaccaacgcagggaggatgagtcacttgaccaagtggccgggctaggaacacagaagaatcggtggacacagggttatctctgcaccaaaacaactggccagggtggggtggttacatataactgggctgtagctttccaggctggctggttcactcattcagttcaccccaggctgtaaggactgccatgggagcctgaggcagatgcttgtcctgtcagggcctcacccagctaaagtgtcaccccacccctccacagactgctgcctgaccctgtgtctaactgtgatctctcaaaatcctccctttcctgcagaaagctgaatagagtccatctttctcatttgattctttctctagtaatcctaatcctcctggaggttgatgaatgcctgtgacaaagcaggtgattcacatggaaatggaaatgcaaaaagggaaaagtatattaacatacttcaaaaatattcttacttatatagcctttcatctgttgatctatgtatttttaagttgtggttgggggtgggagggtactgtcttagaaaaataaagtgaaaacttgtaggtaaaaatatacgtgcaagttaatttcatctttctttgtcatgccaaaaaaatggaaaagtcacacatttgcaataaagattattctatatctataatattaaatggtattagctgtcaaaatatattaatctggaaagatattcttgtaaatattgttgaataaaacaacattttattggaagtatttttcatggctatctttccagatcaatatatatcaatatattgttatatatatttccagatcaatatatattgttaggtatataacatatataacattcatatatataacatatatgacatctatataacatataacatatatagtcatatgttttatatgttatatccataacatatgttatatgcataacaatatatgttgaatatgttatatacataatatatattgatctggagatatgtataacaatatattgatctggaaaaatatccatgaaaatattgttcagtaaaatattgttttactcaacattttgagttgtaaattgtaatataggtattgcaaatcttatgatagattttaatgtaatctattgttgtaatattaaaggtattacaaatatttttgtaattaaaaagaaatcttcatacttgtgtttgtatatgattttatggtagttgtggaaggatatacactaatcatttaactcacagtattttagaaagatcaaaatggaagctgtatgagaatatgaagacagagagaaattttttctttaacttaaaaaatgtatctctggattattttggctattacaatagtcatatttattttacaatgaaatcagttaaagataaaaaccattgcactgacattctgggacataagttctgtgcacatttttgatttgtttatttaggatggattcctacaaatggaaatagtgacttaaaagctgtgaatatttttgaatgttcttgatagagattgcccaaagcaatagcttttgaaacctttttctctgaatatccctcctaatattctctccatgttagaatagggctcatatttgaggacttttgactctccagatccttctgtgatttctgctcagggattctgtttctggaatttggcaattgtgtaatgtcacaggttgcatggaggtagagaggccgaagagcccaactcaactcttctttaactgagcaatttagtttctctgaagctactttcctgcctggtgttcatggaaccactcgagtgtacaggttaataacgcttccatgcttccagccacttcattcatacaggtaatttcatatgatgaagtggttgaaggcagtgaaagtgaaggtgagatttcaagagaaatattttttaatcacagtatatttttaattttagtatcactggaagattagataataaattttttcccatgaactagagacactaactcttccaattatttcttttaaaatgacttcttctattatatatttaatgcatagtcattacagaaaaatgtaaaggtagtacaaagatggagaaaggagaaaagtaaatccatcactcagaaacaacctcttgtgtgtatttgagttgtaagcaaatattacatattttgatgatgaacagtgttaattatatatgattttgggcctaatttttatttaataacatatactactatattctttaatagaatttggcaataattcaacatcttattacatagatttatcataattcatgcagctactttattatatttgaatatttagcttattttcaatttttcacttttaagctgaatatttttatctctgaatatttctatatattgctgactacttcttttttggaagttgtactatttggtctaaaaatgtgaagatttcaagtgtttggtactggaggctctcagagggcagaacagtatctgttttgttcaccatggatagtgcagtgcctgacacttagtggggattgctaaatgtccctagtgagtgaatgcacctggccaaagtactcttcagaactttgcaccagtatttattctaagcagcagggtatgaaactttacatttctgtgcgactcatcaacagatgattttaaaatctgataattttgatagatgaaaaatcagttatatcttattttatattctgtgagtaagttaacctctttaactgtaaagctcctatcattttagaagcaaattataatgatttagtattcccatgaatgaaacaaatgccacagtaagcaatttttagcaaatggtcttttttttttattcatttcttggaacgcatgtggcttttacaagcagatgaatttgaattttccttcccttcattccatgtatcccagagcaatgactttaggctttttttaaaaaaaaatgccttttacagtttaatctcgagtgtacttcagattattcaaggcatttaatatatcttaaatatatatgcatctcctaatatttcaaatgagctccgaatcataacttgtagggacagaaacagaatcaataacaacaatatgttttcaattgggaacttctgaatgtactagcaaagctactctaagactgggcataaatatattcagttgggaatggaaagaaaattcttattatctggtgagtcgaagtggtatagggggatttgattctcctgactcagtcttctctgggaagggaagggatggacattttttatgcccacttccaaattcttcgaaattctgctcatgtcctaacttgagctttctgtaatcatggttagtgtctttccaattagggctgtctctggatattacaaatttggaatttaaaaaatgacttttgtttacaacaatgcctgacatccaagactatagtctggagctggtgattcaaattcctatttcgttggttaaaagtagagcagtggtgtctttttcttacatctgtttttctgtcatcactatcattatcatcagcatcattttcttaaagcaaattaatgcttctggataacttacttcctttagaatgcacaatactctttttgttgtttttttttttttaccactgtattttaaattttctaattcttagatccctgattttcagaagtttgtagataccaataactttataagaggagagctataatttaaataaatttaattaaaactatctgctaattaaaatgtttaggtgactgtgtgtgggggggggtatcttaaagaaaagaacaaattagtgtgtgattcttgtgtaatattttacccaattttgattggtagaaaattggttttaaaatagaaggcatttctgatactagaaaagtagttaaaatccagctacaaggtacagaaaaaagggctgtggaactaacataatttgatagtttagtttcatttaaaataagttacaaagcacaaataggtatctcaggaaaaaataaatggcacagaaacacatatctaaaactacactcacatatacagacgtgaaaaattagagtaattgatagtgctgattatatttataatagaatcttgttttgattggaagcccaatgacataaaaatccattcatgctgaaaagtattttctgcaattatataataaagcagcattgaacttataattattgaaacacaataaaaagagaccttgattaaagatgaaaatatatatatttttaagatattgtttcacattgtcaacatttcagagaaaatagaatagctcaacagattcacttaatccctttgttagtcatcacatttgatcatggtctctgttctttaaaatacatattggattcacttaaaggtatatttgatactttttccccacctcagtgttactggtaggttgaaaattcttgccctctctttacatacttctgccacatttcccatgaagaagagttatactgtggaaggcaaacactttttaaaaaatgacgtaacatatatcttagaccttagatcttagacatgtatcttctaccatatttcccatgaagagtacttacattatgaaaggcaaacacttaaaaaaaatgatgtaacatatatcttagacctgaggtatactttgagtatgcaatagtgaactgactgctggttgacataattactgtgttgcaaatcaagatttattactgatggaaaatcaaacttttctaggtcagttgcaaatctcagctttcatctgggtttaggagttttggttttgaaattctgaaaagaaaatcaattcttgtgaacccttgcatttacctgagcagtcccttacccctaactgtgtgagacggtattgaaagtataagtacatttggaagattttataaatcattaagatcattttaactttagattttaaaggtgagactggctttaaaattccatgttgctagttgacataaggagcatttcctcaattgtcattggggtgtctttgacagtaatgtgaacattcaccagccagtctcaaatacaggatttgagggaagaatcaacaattgctggcaaccctatatattcagaaaaaaactgaataaaataggaaatcatttataatgtaacctactttggttttcttttaaggaaaatatcttacataacgaagaatgctatttgataaatgtagattttcttagaaatattcttcactttctctattcctagaagttgtaaccattgttttcaagtgtgttgaaatgtttgttttaatcataaggcaggtcttgccaatcatatgtgtatccaatccccaaccctccagataaaattttttagcttaaaatgccactgaaacatttctctgtaggcgatttcctctggtttttcctccctgtgtacaatgaatagaagtcttttgctatggaaatgatggaataacagtttcaaataagactgtcaatgagattacaagaattgtggaacaaatgtaaaatataaaactttttttttgagacagagtctctcgctctgtcactcagactggagtgcagtggcaagatcttggctcactgcaacctccacctcccaggttcaagcaattctcccacctcagcctcccaagtagctgggactataggcatgcaccatcacacccagcaaatttttgtagttttagtagagacggggtttcgccatgttgcccaggctggtcttgaactcctgagctcaagtgatctgcctgcctcggcctcccaaaatgctggggttacccaggcatgtgctacgatgccagactaaaacattttaaagacatttttactatattatttttatctggattttttatttttcattcagaatatgtttcagatgttttaaaatgtacactttcacacagtgaaaataaaggtagaggtgaataacttactatgtgtcaaacaatgtgctgagcacctttcatgcattatcttatttaatcctaacacaactgtatggagttaagatgctgtttttttatctttattatgcagttgaggaaactgaggcttagacaagttatgtggcagaaccaaacttaactacatagtaagactaaaaccctctttagtaagaaaactaaagattttataaagaacttgtaattttttttcttatcaaaacagttatacaaagttacccatggagatgaattttgcatttacttgggattaaattcaaaagaaatttttgcagtagtcttttctcaaggggcattgatacactgataaaatagtgccaattatggttttacagaagatagagaaattcagttatagttgtatgctggtcttttttaacgactgtaagaacgagaatgaacccattgaagccttctgtgattaacatatcataatttgatagtttagttttatttaaactaagttacaaaacacaagtggttgtctcaggaaaaaatagatgacacagaaatacatatctaaagctacattctcatatatggaaacattgtgacgaattagagtaatcaatcagggttcagccagagatgcagaaccagtggagatatgtatatattaaggcatttattatataggtttgcttaatgagattgtgagggctgggtaagtaagcctgacacctgccgtgcaagtggtctggccaggatgattatgatcaggctggaatccttaggcatgggctgatgctgttggccacaggtggtaaggaagagagaaccaagagcagggtagagtcccatggaaactagctgtagtttatgtgctcagggaaagcctgaaccctttgaaagagctcacctggttaagtatcatccaccttggataatctctcgtttgatttactcatagtcaattgataaggaaccttaattacctctacaagatcccttgacctttgccatctaaggtaacctcattgcaggagtgatatcctgttctattcattggtcccacgcacactctaggggagggtattgtacggggtgttagagggctgttatttaggcactgtgaccttaagctttgtggctacggctgtggaagcccctcatagaccccttcagcatgagaaactttaaaaatcctttctttccacaaactcacttaccagagtaacttctcctgagaagccgagggataatgtgtgattttccttttttttttttttttttttttttgcatttctgtcctggaagggctaactaagcctggcctggcctgtcagtaccagtcgtttctcttaccacgtaacatttttagactttcttttcacagtgaccaactattctgggctgcagtgcggcaccataaaggagcaaataaaaaaattcttttgactttttaatttttttctaactttaatcattatttgtcttaaagagacctggctattaagaaatcaataaaaactccatcatctgaggatctattagttacctgatagagtaatttggatagacatacggatgattttaactatgctagaagaattcctctgaaccgcatgctctgtattataagaaataattctataggactagttttagtcttttactgagtctagttttatatatctagtatgtatatatcacttagtatatctatgtgtataaggccacagttcttcagaaataggtatggcttcattatgagtcaggttggtatacccaatgccaaatattacttaatacttttcagaccaatcgtttttacatctgggtctattttatttatttattttttatttttattttatttttttgagatggactctggctctgttgcccaggctggagtgcactggcgcaatctcggctcactgcaagctctgcctcctgggttcacgccattctcctgcctcagcctcccaagtagctgggactacaggcacccgccaccacgctcagctaattttttattttattttatttttagtagagatggggtttcaccgtgttagccaggatggtcttgatctcctgacctcatgatccgcccacctcggcctcctaaagtgctgggattacaggcgtgagccaccgcgcccagccacatctgggtctattttaatattcatttgaaaattagatgttccaagcacttacgaatgggattatttgaatgctcataatgggagtagtttgtcagcacagtttttatgggaaatctgaagggatttccagaaattcatcaaggatctgacatttgcaggctgttctggtcctgaggttatgtggggtcaggctggaggaatcagacatatgattcctgctgtcaaaaaggtgaatgatagtcaagtggaaagaagacaattgaggaacagttttaacaaagtgccaacatttccctgatagtgaaagtacaacatgctatgagagtacatgaatgaaaagagaaaatatccatacgcacctcttagactgaaaaagcagtgcttgcaataattctagactgtgctgaaaagagtcattttatctttgagtatttttatagctcttaaggtctcaagattattcttgcaggatagaagactataaaagttaaaaatttacaggttttaatgaataagataatgcttataagataatgctaagattaggaggatcttgacattttcttgattaaatgtaggaggcataggaattaaattttatatagtcttttgaaggaggtttccatttaatagcaaaatacttaagctagagtgttttaatggcaatctgatctacagattgaaaaatttctactgattaacttttaatttcattaactcttttttatacaattccaatctgatgctaagctgacccagttaattttgtatttaaattattttcatttttctatttcatttatttttgtgatgtataatttagctctattcattatgtatgtgttttcctttatatttttgaacatattttatatttataatagttgctgtaaagtcctcgtctgctagttgtaggatctgggccatctttgcattgatttgtattgcctatactcttgttgtttttgtttttccaaaaaatatagctcacatttctagtttctttgtatctgcttatttttgacagtatattggatattgggaatgatatgtagtagaggctctgaatttcaagtttttttctgaagagtgattttggttttgcaggcagttaaccttgttgggttgaaacttcagttttctctcttttacatgaggagttgcttatatttttactcaaatctttcagcttccatctgttgccattatactggactttcctccagcatacatagtcagcagaatttggataatttttttacaaagattttgtagataactttgtgtccaggatttagcccatctaattattttgttgcttgtggtccctgaagcatatcctctgatacctcaagcccataaagcagcagattgctgctgccagagtagcagacagattgggcactgcatgccccaaggcaaaaggcagccacctaccaatcacgcaaggtgctatttgtcttttgagagatctacttttcaatttcttcctgcttttggtccaagtgcctttaagtcaattcttaaaaggattttttccaaattttataatagtttctataggagaattcactccagtgaattacttcatcattttccaaagtagaacaactcaaaagaaaaataaaatttaaaagctgatgccaaaattaaggccattaatatagatatggtacagctaatacagagttttagtaagattattacttgcctaatctgagcactttatttccagtaatacaggctactattctgttggatgcttttactagatgtcacatttgttgttcatgctgtacttcagcttacggtcattcaaaggatctagattattttcatctgaatttctcctaagcctgagctacagaaaatgacaggagataaagaaggaaagaacatggatggcctttggtctttcattcagcaagtgttctcacttattttttctaatgtaacttcagcattttttacctcactcaagggtcatagtaattattaaaacagtcatcggccgggagcggtggctcacacctgtaatccctgccctttgggaggccgaggtgggtggatcacctgagttcaggcgtttaagactagcctcaccaacatggtgcaatctgtctctactaaaaatacaaaaattagcagggtgtggtggtgggcgcctgtcgtcccagctactcgggaggctgagacagcagaattgcttggaaccaggaggctgaggttacagtgagctgagactgtgccactgcattccagcctgggtgacagagaaagactccatctcaaaaaaaaaaaaatcatcatcacgatatttcacaattaaatcttctaatccagagacggatgtgaaatacatcaataaaatacaaagaaagcataatttcacaattaatgtttacgtgacttcttaatatataatccatgcacccataaatagtctagacacaaaccaatttgcttgaagaaaagaccaaaaaaaaaaaatgttagaggctcactgttctattctgaagagataattacagtgttctatttttatcacagaatttaatttttctattgacagggttggtaaaagtagattagtagtttatctaggttgatagaatgaaattggaatggttttattgtctgttttattacagatacttagaatagtgtttcaggttatttgcataatgattgaatcaacttaattgataattatatattttcttagttgaccttgacattttgtgttaaaaatttcaactcattttaattttaattttcaattgtttatggagtgttcataatcattttcaggtcattaattattaatacattatgcaaatgacatgaaaaatctgttaaaccttggggttattttaaaattgttcgtttttgtttagcagacatacattttactctgactgaatcttcaaaacattcgtttaactataattctaaataaaagtcataagaccaaagacatagaagacacgtaaagtaaattaacaaggaaggttagaccaaggaagaaaaaagaataagagactaaagaaaggaggtacctttggctttttcattgctgctttagggactgtacaggactttaagacatagtgagttcctgaagatcacagctatgcatgggaggaaaaatggaaagagtatgttggaggaggaagtgctgacataaacagagatttgaaaaaaacatttggctggtgtcagaggatggattgctacttcctaggagaggaagcttggcatagtagtcctttaagagtgaatacctctgtagtctgagttggaaattgcagtagtagaaactgaattttagctttgattagttcaaaataaataatcattttaataggttcattaacaatcgttgtcaccgttattattgtcaaagttgtcaaaaaattttgaagtgtttatcccggggacactattctgaaatctacatgcattatcttaatttttttttgatcctatggagaggtaccttattagctttatttatggatgagaaaactgaggcttaaaaggtttaattaacttgctaacatcttagaggtaatgagtggcagaggctggactcaaaattaaatctctctgtcccccaaatctatgctcttaatcactaataatgaaaaaaaaaaatccacaaaaacccaggaagtatgtttagcttaactactgattttaagatctctggtttggagttggccattatgcaacataaaatttaaaaattttacattatggcaaaaatagtgttttaccaatgtgaataattcaagcataagttagaggtcgaactgttagagtaaaatatttggccattatttcaggggacttcagagggctgaatttttcaaggaacatatttgcaataaggcaaaattctattgccatacactagtatttttgaaatgtttactgacctttttttcctcctctccccttaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggtaaggtgatagaaaaaaacataatttatagaagtaattttttatgaatacacaagcacaagtcaaaaataattggctgatctttttagtcacctgcaaaagttcataattttgcaagtgaaagggcagattccactgtaatagactctttagctttgtaaagtgaacagagttggatgttacatcactcatatataggattatgggatgcgtgcatttaaatatgaagtgaagaaatatacagtgccgtcttctggattctagtttagtaccgttcactttgtcctccatgctgtgacaaagtccgttactgacatccccttgcttacaggaagaggcccactttttgaggtccccagaagccaacaagccagaaattaaactaaacacaatctaaggagggggcggggtcagaaaggaaaggaagagttaaaggtgtgtaattgtgacttattctgtcttcattactagactctgagattggaaccaagtctttgatttatgtatattcagcatctagcagagtgctgaaaccatagtaggtgctcaataaatgtttcttgaatgaaaacatgtattttcaaggatgtggagttataattgagttggtgagattgcccatgcacctgctaacttggtcttcaactgcattagctttgcagaattatgagccagggtgagctgggttagcattctcaaggtgaacacctaatgttgtcgaaattgtggcagaagaggttgatttggctttaaagcaaatttttcttttgataatgacgtttggtcatggttcttctactagatttagcagatgttatctttttctttttttcttaatattttacttataaaaatttcaactataaaaaagttaaaagactaaaccaataaccatccacatacccttgaattagagtcaacaattattatagttagccagatttgctttcctttcctcctgtctttcttttctctgtgtgtgtgtatgcagtcagacatccacagtacagttacatagcattaaggtaattctattacatcattgactatcctgtttgtattcatatttattctgttatctcaataatatcttttctagttgattaaaatcaggatgcaatcaaaattcatgcacttatttatttttatgcctttcagtctcttttaatgtagaacaaattctcagcttatttttttcctgtagcatcgagtttttaaaaaatccatgccagttatagaatgcctcatgttctggatgtgtctgactttttttccccattgcctatgctcttggtaattcccatgaacttgcagctaggtataaggctgtgctgtccaaatcagtaactgctagacacatgtggcaatttggtatttgtatataactcgaactagatgaacacaatttttagttttgtttaactttaattaaattttaaaaacgcacacttaaattgttggaaaacttttatgtatgtttggaacaagttgggtatgtgaatctacttttccaaccatgtctttggttcctgttttcgtgccattttagtctgctggtttctttctcaggaacatggctgtctttcctcacagtgttctccctgaccttttctctacacttcgcttctcaagtgtgtcttccaaagtactcatttttttctttggtgctgttctgttcgtaagccctttctgtacctttaaaattttagttttcatgctttttttttcttgtctttatctcacccagctcacctttttatctcagcttgctgttctttcatctggtctgctggtttattatctcagcatattttcccattgtgaatttccactcctattttatcgaagtcgtaacttgcatcctgaggacagttgaaattgtttttatgtttaagtagcctcctgctatttcaattttacttagctttttaaaaatagcaatgattactgaattttattaataaagaagataaaaatcatgtgttgtgtcttttaacttgttgataaaataactaagttaccagacctccaattattaaagagttcttaaattcacagagtaaaccctacttgaccatagtgtatgattcttttgaaattctactagatttaattaattaatatgttattcagaattattacatgtatatttacgggggaagttaatttctctttatggacattgaattttgaatttcatacaatctttgtgtttattaatttttatgtgtcacaaaacaccattctactctggtctttttttcaaccatttaaaaatgtaaacaccattcttagctcatgggctatacggaaacaggtgatgtgctgtagtttgccaatccttggtctagactagtctgccatgaaaggtagctgttctttgaaactttatcacagctcacctgtgaaaccagctggtcctaggtcttttaaatattgtatattaaattatcttttcaatccttttctaaagaaactggtcaaatagagttggattccttttgattagtcttatttggctaaaaatctattctattcccctggaatacccagttttgtttggttggttgatttttggttttgccatggagttgcacacagtattgtattattgtaatttcccattctttgtgtttttactttctgttttatctttagcctggtttgtgagagctttgttttatttatcatcacaaggaatcaaattttgagtttataaatcttttctagtactttatttgacttctagtttagtaatttcacttaatcttcattagttccacttttcaactctctttgctgttctatttttaggacatgaaaaccgcaagttctttcattttagtcattcttttctttattaatcagggcacttaaggctataatattttgcctttgaatatagatatatctgtgtctcactcattttttatataaggagtttcctctttacattgctttctagataatttatagttccagttcctagatttagttcagtacacctgggtaggtgtattaaattatcttgctataaatgttgaatgaagataagcacagatgggaacaaacggttctacttatatatagtacacaactgatctgtgctgtcaaaagtctgcaaggtggtgaaccttgtgaaggatagggataggaagagagcactaaggaggattttgagataccgtaatgttttctttcttgagctgggtgttggtcatgcaggaatgttcacttgtgaaaatcatggaactgttttcttaagatttttgcatttctctttcctaacattatagtttcatagaaagttcaaaaacaaaaaactatcaaaagaaaagaaatatatgtatacatttttatcatttagatgatttataagcattgttcagtgcttattattgaccagtctatgttcagaactactgtatgactggtgtgccagtgcaacgttagctttgctgctttgtaccaagtttgcttaggctgaggatcagtcgttcaatgtagatatgtgaaaaggctctgctgtttgttttactcgactcattgcattttttgagtagttctttaaaatgataactgagatgggcaaggtgatgggggcttgtaattctagctattcaggaggcagagggagaaggatcactgaagcccaggagttcaagaccagcctgggcaacatagcaagaccccatctcaaaaaaatgaagtaataactaaatgaataaatggaatggctaatttgtatagggagctgtgcatatgattttatctgaacgtaacagcttcacagtcccctgtacctgccttttgattctatctgttgttatggctcagctgtttgagtacacatctccctaactctagtttggaaaagagacgttgggagtaatggccttatttttgctttcttacaggctattatgcatcatgaaggccacatggatgatggcataagtttgtcgagatcccagcatgaagaatcacgcacagcccgagttatccggagcacagtcttccttttcaatagatttataaggtactttttcttttgtaggcgtagttgtttgatacttcattttcatttctttattggatatgcaaatagacaatttaaaagtatgctatgatggtaataaatctcatactgtttggtaagtcagcagaaacgttaggaagtgttaatgagatgatttaatgtctttcttttaaataaacttttaaaaagaatatggttttggaaattggatgtgtaatttgtaattgataggtatagattaggatgatttaatgactacttttccttgtactgaacctatttagttcctttttcttttccttttttctttttgagacagagtctcacactgtcatccaggctggagtgcagtggtgcagtctcggctcactgcatcctctgcctcctgggttcaagcgattctcctccctcagcctcccgagtagctaggattacaggtgctcaccaccatgcctagctaatttttgtatttttagtagagatagggtttcaccatcttggccaggatgaactcgatctcttgacctcatgatccgctctccttggcctcccaaagtgctgggattacaggtgtgagccaccgtgcccagcctagttcctttttcaatgagggcagtgaagcctatatagctgcggagttttgatatgtatttttttaaagtaattctcataagaactgttcttccacctaataattgcatatctatagactaaattaaacttgtgaccaacatgttttctggtaacattataccaacatatgctctgacttgcgagagattgcatttgtctctttaaactttgctaatttgatgggggaaactttttgttgaccatctttcttcatttattttttcttttgtgtttaatcctattatttgttaatatttctgttaagttgttctgagcttttgttatgtttagagatattcatttcctgtcatcataagttgcaaacctttttaccagtttattggtttgggaaagaatttgaaaggatttttgtagtagttgaattggtaaattttttttttggctttacagcataaaacaaatctcccctactcaagattatattattttctacttcttttataaaccatctcttttataaaccatacacactgtgtgtatatgtgtgtgtgcctgtatgtaaccaaaaaatgtgcacagcatttggccacacatcctaagtgtttagtccatttttctgcctcgtctcaactccaagcctcatcagatgcagtaaagcttaaatcgaatggggtatgcaccacatttttgtattttttattacttgtattacttttcagtattatttgtattcttgtagtttaatatagtatttatttcttacagtaaaaatttattacattttaatgcattataaaactagtcaagaagttctacttggaaattataacttattttggaaacaaacttagccttttcatatcttgttcttcccactagtttttctttactagagctgatcaatcctatgatagggattgagcaaattaatcataaatctttgaaattgtcgattttatatttagtcaacactgacttcttcaaatatgagggactttttaaaattcaatttgactgctgtagagtattcagtggcactgcagagataccatttggtaggttaatttaatactagaccaaaaactggttatttgttttgaaaactattttgtgggaaagctactatctcagtgttatagacataatgtagtgctagtataccataagtgacatttttttatgctggctgaaataccaaaattcatcttgaatgtgatttactttagcacatctgctctttggaagaataattttaaaatttaactattacttttctgattagatagagtaccaagtatgagaaatttggattctgtgataaaaaatgttgaattatacactttctgctttattaaatcttgaaaattattttttgtctgggctatttgagtgaaattcatttgttatacctgtcatgataaaataggatggttacattaacccctattaactatgaaaagattttctgattcccagtctcattttttctattttctttcttcttgccttgctctcttttttctaactttataagatgaatgctgatattattgagacctttgttgacataaacatttagtgttatacatttctgtttttagtggtacctcacaccttttgattttcctttcttctttctttcttttctttccgtctgtctctctctcctccctcctttccttccctccttccttccttccatcctttcctccctccctccctctttcccctccctccctccctcttttcttttttctttccttttcttttctttctttctgtcttttcttctttcccctcccctttcctccctcccctctccccattctgctcttcactctcattctgtcgcccagactagagtgcaatggccctatctctgctcactgcaacctgcctcccaggtttaagcaatttctactgtgtcagcttcccaagtggctaggattacaggtgtgcatcaccactcctggctaatttttttatttttagtagagacgtggtttcaccatgttgcccaggctggtctcgaacacctgatctcaagtgatccacccacctcggcctcacagagtgctgggattacaggcgtgaggcaccacacccggcattgatatgttttctttcagtttcccctttgatgacttctttgaccaatagattttttcagtttccaaatattcggggatttcctgagtatttttctgttactaatttctaatttaatgccattatggtcagagaatatactttgtgagactgatcgctttgaaatttattaagacttgttttatggcttagaataaactttattttggtaaatgtttcatgtgaatttgaaaagaatgtgcattctcctcttgttgggtcgtgttcaaaagtgtcaatttagtattatttagatctttaatttccttacgtttttcagtctctttgttctactaattactgagagaaaggtactgaaaagtgtctgactgtaattgtggatatctctgtttctccttgctgcttgtcaccttttcttggtgcattttgaagctccgttattaagtgcatacctgtttaggattttgttcttttgatgaactgacccctttatcattatgaaattaccttccttaactctggtaatattcttttctatgacatgtactttgtataatatgaacatagcccctctagtttccccccaccccacctttggtattagcatcctatgacctttaacctctttgtatctttacatttaaagtgcatttcttttaagcaataagtagttgggtcttgcatttttgtcccatttgataatccctgttttaaattgtattgtttaatccatttacattaatatgattattgatatagtaggcttaagtctgtcttcttcctatttgttttatattcgtcccacctagtaataggataaagaggagatacacacacacacgccaccaccatcaccacccttacacgggagcgtgagagcatatgggttacaaaaaataaaccacctaagaacactttgtcattgtcccatttcctcctttttcttccttcttttggattagctgagtattttctattatttcatcttacctcctttttattggtttattagctgtaatattttgtttgtattttagtggttacttacggattaaagctgtaatactttatttgtattttagtggttacttacggtttatagcatgtatctttaatttgccacagtctacctttaattgatattttgtcactctatgaatagtataagaacattataatagtatacttccctcccagttttcgcactttgtcattcattttacatttatagatgttattaattccacactatatttttatttaaaatcaattagtttttaaagagatttaaataacaaaaacatctatatttgcacatgtagttatcatttctagtgctctttttgtgtgtgtgtgtggatctgtattttcttcaggtattgttttcttctgcatgaaggactttctttaacatttcttatcatgcaagtctgctggagatagactcttttggcttttgtacaactgaaaatgtgttttttgccttcattttaagtgatatttttgctgtgtacagcattctagattgacaagttttttttttctttgggttgactaattttactccctattgatgattgtattttatagttctttatatgcctggttatttttgtttagttaccagacattgtgaatttgttaggtgctggctatttttatattcctgtaaatattcttgagctttttcctgggatgctgttaagttacctaggaagagtttgatttgtttggatcttgcctttagaattttctgggtgggaagagcagtgtttactctggggcaagtgattccccactattgagacaagaccctctgaatactctatccagtgtcccatgaattgtagagttttccagtctggctgctggggacaggcgctgttttaggttctgtgtgagggccagttgctgttccctctaatcctttcaggtgattctgttccctgccttgagtagttttctcatgacattctcatcagtgttctgctgaatatttgagggggaccttctgtaggtctccagggttccctcttgtgagccctctcctctctgtgtcctgtgaattctagcaaccttggtctcctggatgctcagcaatatctcttcaactcatggagactgtcaggccacacctgggttcccttcctgctccatggcctggaaattctcctaggcagtaaactgaggcagctgtaggactcacctgatttgtttccattcctcaggaattcctgtcctttattcattgctctccagtgtcttgaaagttttcgtgtttgtttggtccctgccccgccactccccattatactttgtttttttgggttgtttcagagggaagggaaatcctgccctgtcactttgtcttggccaaatgtaactcacatctagttgacatgtgcaatgcttatttccagatgagattccttgttccccttgggaaatgtagcctagaacgtctttgctaattctgcattgatatttttagctatcctcctcattacaaacccatcacaaatttgccatatttttctgagttatctaacatctgcttttaacaatgtctctcccttgtgatcacctgagaagtgccatggataaacacaattaacctttctttctcttgtgcttaactgaccttaatcatgtattagctttttcaaaaactaaattttaattaagctttcgtttattctccttgtttcttttctatatttatcctttagttgtattatttaactccagtaatcatgtttatattgcatatatatttatattgcatatatatatatccagtaatcatgtttctattgcatatatatataaacttgcaagtttcacttaaatgcacaggagtattacctattataagtcccaaatttaggctgggcacggtagtgactcgcacctataatcccagcactttgggaggccaaggtgggtggatcacttgaggccaggagtttatcaacagagagtaaactatattgtattctacgttctatacaacagaatgctacgcaaccagtaaaataataagacttacaaagtagcaaattgggctgagtgtggtggctcacacctgtaatcgtagcacttttgggaggctgaagccggcacatcacttgaggtcaggaatttgaaagcagcctggccaacagggatgaaaccccatccctactaaaaatataaaaattagctggatgtggtgggcatgagcctgtaatctcagctgttctggaggctaaggctcgagaatcacttaaaccctgaactcaggaggcagaggttgcagtgagccaagatcataccactgcactccagcctgggtgacagagtgaaactctgtctcaaaaaaaaaaaaaaaaaattgaagtcctgaatttatataattttttaatatatttagaagctttgaaaagttttacatgattactgagcattttaaagagcatatgcttttcagtaaaatattttattcattttatcacattcatgaaagcaccgtctttaaaatctcagtatttttacaatattttcacccatgtatttttcagttatttttttactattaattttattaatgccaatttacttattacatattaagagactaatttaaaaatttttaccttttggaaagaaagtcaagatagttaatcatttgtgtttttcttatgtggtttatgttctgtgatccttctgttctctctctcccaggtcacggtggttgtggtagtactgtgtgtgtatgtgtgtttgtgtgtgtgtttgtgtgtgtgtttgtgttgtcttcagggaagggagctctattcttttggcctggggtggggaatatatataaaattttgtgtgtgtgtgtgtgtgtgtgtgtgtgtatgtgtgtgtatacttctaatagtaatactcatgagcatttaagtaatatataatgtgtgtgtatacgtggaagtgtttaaacatacatattatatataattatatgttataatggatatattatgtagtatattataatgtatagtatagtatatgttatatatactatacaatagcatatataattaatggcatatattagtatatgtattatatgctatactacataatagtataattaacaattgtatatattacattatatatgtaaagtatatattatacattatataatatagtataaactatatactatagagtatattatacattaataatatactatatcagcatatactattagtatatactaatatatactatatataatgtataacaaatatataatatataataaatatatataatatataacaacatatatcatatattttatatacactatatatgttttcatttttcttctggatatattaataaatatattcttgaagtagatgagagaggggaggaacctgtatttgttaggtaataatatagtttaatctttaaattacaaaatgtagccacaaggttaatagctttcatttttactctagcatagtgtgattctactatctttggatttctggatgattttttttctccttgattcttgattatattttttgttcttcataaattaagatgatatacatctttgtattagaggaaagccctgaaacataacataattaataattttagaagtttggacaacatttcttctgacaagagacttctcttacaaagtaattgaatagttacattcctcatggtagatatgtttatttcaatgtaataacctaaaaactgacatttactgttgttttcacttatatttgaaaatgtggatactgaatcgtttttgaattttattcacttattaacagttgagtttgaatttgttatacatttatttatgtttaattggagttaatggggtaaaatgtttagaaaaatacttcactgcatgtgaattaaatgggaaaaataattttctactgaaaagtcactcttgcattttgggcacagaaaaacttatagaggcgataaaacttgggggtaggtaggtgaattctgttcatatataattggtatagaatttcaggcaaaaactttaaaatagttgtacagttttactgtttctactgtttgataaagctgaaatcaaatattccaaaatcattagcaatctttgtggaagtgatgacatattttaaataattttttaaaactataaagttcaaagctaattctcattaatgagtattttattgttttgtaatgtaagttccagcatagtcagaaaattagtcagaaacatttgcttgaaataaaatgttaccatacagttttgctaatacagagagcaggaatggaagtgtaatatttctatgcattaacaacttgtcatggctatagaatattacaatatcaactacagtagagatgttgtcccattcttttattgtatgcattgttttaaaaaatatttttattttgaaatacttttgatctgtagacatgttataaagttcttttcagatacattcaaagctatgagtttaaaaactgagaatctcagtaagctcaacaaatgaacacatttacatgccagtaatatatctttcttccaaggctagaaaatacttcatgatatttttgttagtataacttttaaatgcatttctttcagataatagaaaagcattttaatatatatttaccgtttcataagcagattttctaaattaacatcattagaatatatttttgaactcacaggaattaaacagaatggcaagctagggtccatgaaaacttaggaattcctttttgaagacaaaccacaaggaaatgtcagaattatgaatctgggaagatgaagcctgaagccttaaagtgtgtagtgctttccaatgaaaatcaactggtttctgaacattcctactattggttttgtagacactgttcctgtagcctatgaggttattctctgggtgagtggccgtggatactgctttttataacataacattgcacagtttctgacttgaatcagaatccatgatcactgcttttggagcaggaggacctttctgacatgtcccttttacagtgatgtagggagagagattaatgcctgaaatcatctataaatggaaaaatgataaaattgtgaatcactgacaatagagaaatgtttatggtttattttaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagaggtccgtttctatcaacactcatttctcttctgttattctcttgtaaaaacagcttcttggttgggaaaattttccatctattttgaccatctttgcgttttgcaatatagaggagaaagtatactactgaacaggagaaacaggccttagagaaatctcgacatgatttttatttatttatactatccatgagtattaatttaaaaacatgaatcttttcattctcctggcaagagacatttactgtctgctcagccctcaccctggtcttttgcaagcactatagttctcttcatgtgggttatatcaattaagaatctcaaagtgtctgtacgaatacaggctttagaaagcatcagggttttcaaactattcagcaggtgctccttggaaatggcccaggatctataggaagcttcgtgttggggatggaagctgtcaggagagggctaccggagtaggctgagctccaggaaccctacttggacagagcaaccctacccttctcctttgcatctattacatttccatgtatgattgtattgccccaaaagtttcactgctaaaaagaactcaagtgtcatattttacaaacaataaaagaaggaccaaatgatatatctcatgttctaatatagtcaggagcttcgttggagactacgagggttgatgggataaatcaggcttgttcagctggattcccattcttttcaatgcatcttgtatgcagaataatgatttttttctgaataaatacttagctttgtaaaagtaacaaaaaaggttattcattgagtacacatggacacaaagaggggaacaataaataccagggcctacttgagggtggagggtgggaggagggcaagggtcgagaaactacctatcaggtattctgctcactatctgggtgatgaaatcatttatacttcaaaccccagtgacacgcaatatacccacataacaaacctgcacatgtaacccccaaagcctaaaataaaagttgtgacacagagaaataaaactaaacaaacaaaaccagaaagggttattactaggttctcataatccctgtctacttttaaagctgtgttctaatatctcatcagaaacgcttgaaactgacataactttttgaggacgttcccactgggtattcaaaagagatgacctatctagagacctcaacggcacgaaagcaaaaaagtatcaacataaaccaataataacgtggactagtttcctgggagctttcacatatgccaaattgttaggctcttttacaatgctgcatttatttaatatctggaagaagtaacattaaatattggggtgtaaaaattaaaatagtaatttagtttttttcccaacttctcatataagacaatctggatggggacttggaaatgttcttaggtccatggtatctcttaaattctgtgtgaaataagttaattggtttagatagtggtttatatagctctttatgtggttagatagctctttatgtggtttgccacgctttttacaaccttgatctaccaataataataaaaataaagcataatttcaaactcaggctgtatcttacaaagttcacgataatgcaaaaatgcattacagcatttttgatttgctttaaaaatatcttttcatgagctttacctgatatactatatctttaagaataataataatgcctatctaagaataaggatctgctcttatggtcacttaacaatagaaggccataagtatgaagtacatatttttaggttattcttccactgctatttgatgatggcatacagaatttaaaatctgcttgaactatctgaagaacatttcatttcacatgcaaatgtgtgtcttcctgtcctttgaatgatcacagttttctttatgattagtagatgaaccttcagtcagacttctatttttaaatcaacttagcatttttagtctgtaagcagaatgacagttttggatgtctgattgtgattttttttttttttaacgttccagggaatgatcaacctcgtgcttgagtgcatagaccgtttgcacgtctacagcagtgcagcacactttgctgatgttgctgggcgagaagcaggagagtcttggaaatccattctgaattctctgtatgagttgctgggtaagaagcatgattgggttcatagcaacagagttatctatttaaaatgtccataaatggactaggtgtgatggctcatgcctgtaattccagcaatttgggaggctgaggtgggaggatcatttgaggccaggaatttgagaccagcctggacaacatagcaagaccccatctctacaaaaaataaaataaaaatcaaacacaaaagcaaaaaaaatcacataatagctacagcaattttataacatgcctcctaattgagacttaatttttaatttactgtgccaaatcaaatggtgcttagtattaaaatccatctctgagtgagaaaggtagctagagaagtagatttgcctttggttaaaggaggagaaagtcattcagggtgcagtctttgcagatgaggggcctttatatggatgtgtgttaaatatttcctttttgcttttggagttagttccgcaagggtccctcttaattccttacattcccatctaatcaatgatctgctccagtcttctctctattctttatatgatctctgtttggcaacttctaagtacacctgacattgattaagcgacagttgctgtggtttaccctgcattcctgtgggctctctgcaaacacagctcctcattatttttgacctcctgtagcttctacttgtctcttgtcaaaaactaaagggtctgagatttttaccctatttgcaagctagtaagttagcctgcagttagggtaaagagggacagtttagtagtcaaagaaatagctgtagagattggctgtagtgccaattctctgagccccagttctcaaaggacaatgtgaaggggacagatgacacctgcacatgcagctagttgagttacagaaaaggaatcctgagctcagggagtgtgagttagttacactggacagaaagcctgcctggcctttgctgtggatggagacatctctctcttgcatggcctcttgctgcaaacatcttggaaaagatttcctgaaacaaagccttccaatgacaaatttgcaagatgtgcaaaaacagagaccacggggaatggtctctttctctaccctaaccctcgcctccaaaatctcagattcatcctgtatgtcacaactgttacatcacttccctgtttagacattgttcacatttctatatcattctagaagataaagttcaccttgttgtcccggtatatgaggccccagttaacccttccagccttctattttcccagttcccttatccctacccccttacttgagccacatcacagtttcctgaactttccatacacatcacacctctgggacgttgtctcaccttttccagaattgttgtatatccttcaagacccagttcacatgtcactgtcttttaaagttactcttgataaccgggcacagtggctgacacctgtaattccagcactttgggaggctgaggcagccagattacctgaggtcaggatttcgagaccagcctgaccaacatagtgaaaccctgtctctactaaaaatacaaaaaattagccgagcgtggtggcgggagcctgtaaccccagctactcaggaggctgaggcaggagaaccatttgaacccgggaagcagaggttgcagtgagccaagattgcgccactgcactccagcctaggtgacagaatgagactccatctcaaaacaaaaacaaaaataaagttattcttgatgtttctcccaactcttaagtataattgaaccttccttctctggtttcttgccactaagtttcacctgtattttatagcacttgtcacatttcttatttagttataagtgtgattgatttctaaggcaagaatagcaccattctggtttttgtatctgctatttaactgaatgtctggcacataggagatactcaataaatgtgtattcattacgtgactaagttctgataaaataggaaagcatacctaagtatagaaaggagataatgcaaaaaaagttaaaaaaaaaaagaaaaaagaatgcatttttaatgggaagaatttagtcaaaatatttgaaaattctttacaatctaattaaatgtcattaaaatttatagagtcataatacaacctagcaaataaaactcttgtgcctattagaattgttaatatgttttcattaggtgggctatttgatatttattaaaattaaacacttgcagtttggaactttcagactaaaaggtgacatgcggctgccatttctgagaacaggaccagggatattgaggctttataggaatttggattcatcattttacccacagtaacgattgagataaagattttgtgttgccaaaattctaatgactgcatttctttgcaaatgcagaagttatagcactaaatttcataatatagcagagactaaagtgtggtgatgtttttaacactacatcctaccttcttcacttggtataagatgaatttcttggataaactcgatgcttaagtaaagagttgcatcacctagcctggacagcagaggaaaaccctgtctctaaataataataaaaactggctggatgcattggctcatgtgtgtagtcccagctgcgtggggggctgaactggtaggattgcttgaggctggaagtttgaggccagcctgggcaaccacctctaaattttaaaaaagaagaatttcatgtatgaatgtttgagggtagaaagtgttacgtgcagaaagaacattgttttttaggtaaatctagaaaatatgcatcttttattttcatatcaactctttttatagtctctgttcattggtcccttcaacaggtattgtatccatgagtagcaaaaatgaatagaaggaattataattttttatataatcatagaaaaggcccattgcagcaaagttagcacttcagctttatccttctgagctacttatttctcaagccaatcctccctttacctccacagagttatttggggattaaatttgattattttagaacctacaaaagtaacattaatagactttacaaaatgttggggacttggtgggtatgaacacggttcctgctcctaattagttttgaggttggcttttactggaacatggctagaagtgtgattttaaaatggcttacctatttaaatagaacgagaaaggagctcttgaaggtggagcaatgtttctattgggatgtgttcagttggaaataacagaatacccaaacccaaactggcttcaaaaacagaggggattttggggcttgcacagctcgccgtctaccagtgggtttgacacaatggctccatcttatctccagaaccagctgctttatgtctccactctgccttccatggagtcatcttcctctagtgcggccttttcttgatggtctcagctgtctgctgtcagctcctagtactgcatactttctttctgacatgggaaaagtgaaagagggcttgttccagaagttatcccttgtgaaagagtgtgctatttcctaaaatccccaaatacaacgcttctcgcatctcattagcccaaattgtgtctggccattcctgaaccagtcgttctggcaagagtagggaaattttaccaacattggtcttgactgatcagggatccactgttgaaactgggtcaactccttggactgcctatctgtcatatagggaatgaatgttatagaggatggtggccaagaagctgaagtgtccatcccaaatgttgactcatctacttcctcaaagggttttatgaactgaattctaatcagaatgcttttattcactacctagcactatgcttgaatagagtaggcagtcaataaatatttgcttgaattatttaataaatacgttacagagatttccattgacttttctgtagcagggtgcatttggctatcaaattagtgtattaaaaaccagtggaactcttactcctctttcattaggttcctttcttgaaaaataagcacctgaactttcattcaggcatatagcaagtggcatctattgttactataaatattacctgtaaaatggcaatagtcattcccctcataaggttgttgggtggcttaaatgttataatatatagaaaatgctcagcatcgcatattgttgttcttcttatcattattcccatttcttttggatgtttgttatcatcctttcccttgttaacatagtaaaacttttgtctccaacctcttgcttcattcttattattgttgttttgcttttcaaagatgtcctagaaaagaaactttacttagatttgttggatatagcaaagaatgttatggattagccaatagagcacatagaatcataattattgtaggtgtatactggttcttgttttcctcatcggaaaatggcaggaacaaagtttgctttatcactatccccagactgcaaattttatattctattattctacccatttttgaacacagtatcgcacatctgcatctttaccatctggtatacagctaaatacttcagatctcaatgacattcatatatggtaaaatttgtggttaatctctttacctccactccttctcttctccagtctttactcagacctcagggagctctcacacacttcttatgaactttcatagactctgtgaccttgtttacacccctcttttaagaagaagggcctggtctgtctcttcctttcaccagcaaccagatgttgctggtctgtctctaaactctctgtattgcgttcttttaattcttggtccggtctgtcccttcttttcacctctgatgtcgctgattctgtctagttagcgggctacaacttgggagagagatcttgatattatatttttcattattctgaatctattaacatgcattacttttataattgaaaaaagtagttaacatatatctctaatgccagataattgatagcaaaagtaaaaactgaatgtactaattacagttgagtaaaaaaaaaaaaaacatttatatattagtgcaaatgaagagaatctcttcccataatctacaaggtaattttagtgggagatggggtgtttccactggatagaattatgagagtttttttaatgtttttgagttcttatgattttctttttgtgttatagtgagcatcaatttcatgaccagaaaagggtaacaaatacaactttatattgaattttgacatgcaaaatacttcagaaccatatgctgccaatattttttattgaattcattgtaatcataagatagccacatatacctaaatatatacttcagtttgtctggaaaagtctcagatctgcagcaataattggagtcctgtaagacatgtgtatctacctttccttctttatttggctgtcaaaacctttggttcaaatattaactccaaatttgttaagcctccttcccgttattcgaaataggtagaccatagattctctcctggggttatatgtgaaataagccactgtctttgtattttttcttcagtgtgtctattttgcacagagagaaaaccaagaaggtgggaataagaatctataacaattttgcattcgacatggatatatttcatgtgttttaggtggagaatgacaaaggtagatttgtgagcctactgtttggaatacctcaggatcttagaaacagcgatactcatagttggaaaagcatcactgtggcatgctttcatacatcttttctgacatccacacgattaatctgtgggatgcttacaagacagaatgattttctaaagatgtctgagaaatggccgctgggcaaactttcctatgaatactcattttctgaagattcaaagtatgaaaccaacaaggatagattgctgctctttgagtatggccaaaatgaatgtttgaagacttggaaagaatacagccattagccattatttctgcacattcaaaccaatttcccagtgtctcaaggaggcagatctccctaaatgccataaaacattgagaaaaggcagtcaagaggtgaagaagaaggaaatgggctttagacatgcacagatcggtgttattctagtgtttgtgcatctagatagttcgatcttgttcttcaggaagtctcagaaacgtatcgtataaacaagacacatcctttaaaatttcagcttggtgatagtctcattgtcccttactcttgcaagttcccaggtaggagtcctcagactccagtttacaagatccccaaacacagggacagctctccaagctctccaagaagtttcaatgcattatcttcttagattcttcagtacattctgaagtgttttgttttgtttgctcgtttgtttgtttaatgggttttatttttttcaggcttaggagcatctacttgttaatctcaatattttgaaaaatgtttctagattttagtccaattagcccctcatttttctgtgctgcgtagggcctgttcacttagtgtttccaggctttgaatgtaaattccaagagggatgttgtttcatttcctctgtacctccagcacctagaacaatgcttgacacaaagcagggaatcagtatttgttgcataaatttttaaagtgaaggtaatttcttggaatttcttttaatctaaatttttctgtaagtctcagatttttttagtcttttgtgaaattttgagtccaagaattcaaagacattgaagcatgaagcctccggggataggatgatactaataaaacagatgaatattgcatgattccacttataagaagtatctagaatgattaaattcatagaattaaagaatggggccaggcaaagtgactcatttctataatctcataactttgggaggccaaggcagtgggatcacttgaggaagggagttggagaccatcctaggcaacataaagagaccctgtctctacaaaaagataaaagatcttaacttagtctttaattaggcagcaattaaagagtattgtaaagttttagggagggacatttgtcttttgtttttgtaccttgacgcaccataccaagttgccattgcacttcgaagatgacagtggtgctctgagacatctcataatgaaagccactacagatactgatggcatggttttccgttttatttttggaaaggcattaactttattgtactatttggtattaaaattaatacattttagataaggaaagaaataagaaaaattaagaaggcagaaactactcttaaacttaaccacacattttgatctataacctttacaaatgttcctttaaatatttatcacgtaatacatgcagaaaacattttgcacacctgcatgcgtgcttgcagaataacacgtgtgtacatatctgcacatctttgcagcaagacatcacctattccctcctctccttgaagatttgctcatcttgctccaaattccaggttcatggactaagatagtcaaaaggctttcctttgatgttggtacattttaggggcttatttggttacatttttttggacttccgtgcttttttattgtcgtctattttttctctaagagtgaaagtgtagccacagaacatctcttcacatcctaacttcacatcctaacttccattctcttcacatcctaacttccattcttattgagcatttgtgatttttttttttgacagaatttattgctggttcaaagggtcactgtgaaagatcatattacaggacatggcccttttttttcctctcctgggtccattcttcttccaccttattttggaataagaaaatgtacctttttgacctggggaagcagtcccactaatatcaatcttcctcaagctctctgtttctatctcagtcccttatcaagatatttcccccccaaatatcagcaatcattctctaagaaatttctaaaaaacacagttttctccatgctatacatgtacttatattcagtgtatacatttactttacaaaaatggaatcatgctatcaatgttcttttatagcagatgttttcaattaattctacattgtgggcctctatccttggtagtaactataaaccttcatcagactttagcagatgtacacttctgtgctgaggtaatgtcaccatttacttatttaggcacatttaggctattccagtattttgctgttataaagagtgctgtgatgagcttccttgtatttctctgcatactttttcattactttagaaactcacataactgatatcttcttaactgactggatgaattataataattcacagactccatttatctgtaaaatgtattggtacccatgacatgcgcctacatacacacacatgcacacacacacacacacacacacgcatgcatgcacgatgttcaggaggtactctattttactgagttaatttttttcattagaaatgtatatattttcgtagtatattgagattgtttgatcttttactcattaacagatttcctgatatatttttgtctctttggaggaatgaatctccacttggatgaaatgttgctaatgtattgctaaatttgatttataaatactaaatttatattgctaaatttgatttattaatttcattaatatataaacttatataatatttttggatttataagagttcctcttgttttgtgatgtgtgctttgatatcaatgtcactgatactgcttttgtaaaatcagggaagtttccttagttttttggctttggaatacggtcatgtgtcacttactcatgggaacagttctaaggaatacatcttgcaaacatcatggaacttacacaaacctccgtgttatagcctattgcacagctacgctataggggatagcctactgcacggctatgctatacgggatggcctactgcatggctatgctatacgggatggcctactgcgcggctacgctatactggatggcctactgcgcgtctacgctatacgggatggcctactgctcctgggctacataacctatggctgtacatttgtacagcaatatgtacagcaaattaccatactgaatactgtaagcaattgtagcacagtggtatttacgtacataagcatagaaaaggtacagtaaaaatatagtcttatggtcttaagggatgatcattttatctgattcattgttgaccaaatcattgttatgcagcatatgaagtagtgtagaaattacttatttattgaatatgtgcgaaaaagcttttggtctttgacatttcaatattactcatgatttattattctgtttagatgttttcccttctattgcatcagttttagtgaaaaaatacatatctatatatctatgtatctatatcttgagaccattttacccagatgttcaaaattacagtataaagatgtataaaattgttgtgtttataattccttttttgagatagggtctcactccatcacccagggtggagtgtagtggtgatatcatggctcatggtagccttgaccttccaggctcaagcaatcttccctcctcagcctctgaagtagctgggaccacaggcatgtaccatcaaacctggaaaaattttttaaaaattttgcacagactgggtcatgctatgttgcccaggctggtcataaactcctgggctcaagtgatcctcccaccttggctcccaaagtactgggattataggtatgagccactacgcctggtgtaatgcccttttcttaattttgtccttttttccttttctttttgattaaagtagtagttggtagttagcttatatttaaaaaatagtccttgaatgtattcttgatcaatcttactattatataaattatttttatttctaatgtattaatttctacttttattgcgatttatttttttctgttttactgatgtttatttgatgttcttttcctctatttcaaaagacgtatttaccatttttcacccaattgcttagcaattaaagtgtttatttaattttgccttgagtacacttttggccatttaccattggttgtgttaggtagtattctaatttttgatatttattagatattttatattatgatattgattccatcattgacccaagagttattaaggagagagtttaaatttttatatgctttggttttattttcattcctgcttttcttactaaattctgacacggttctgtcagagaacatggtttataccatgtctgtttgcagtaaatttaatgaacttttctttgtggcttactttataattttcttaaatgccccatggcttattaaaagagttcattcttacactattaatttctttcaagaatcacttatgttatatatatcatatatataattttagatagataatatgataatgatatatgttttcattttagatggataatatgataatgatatatattatatatatacctatataattttagataatacaatagtttatatataattttagatagctatatataattatatattatatataaaattagttttacaaaatcagaaataaactgaaaagcatgagttaagttttaaacaaaagggactcttaaaattcaaaaactttatcatgtcctttttcccagttgctattgttctaaattgggaacagatattcttacagaataaaattagttctgcttagaacttagtacttctcattcctctgctatattccacccctatcttttgtcccctgtactctgcagtctgtgagtatatctcgatggctggctcttaagggaggctgctggacccagagccagaggagagcctgagtaatgagtgtattagctcttaatctctgtacaaatgtcacagaggcgctatacacaaaaaagctcttctcatgaagttggcgtcttttctgtgtgtttcttttcttactctcaggtcagataataactttatttctttatttttggaaagaggaaacatgaaggacatctttaagtttaattgtacactgtaactgtagggtctcttccctcctgctcttaacagggaggttaacaggcggtagcctcaaacttcactacttcaaacgcttgcatcagctaccagattttctctgcttttttttttttttttttgaaacggagtctcacactgtctctcagactggagtgcggtggcacgatcttggctcactgcaacatctgcctcccgggttcaagcgattctcttaactcagcctcctgagtagctgggattacaggcgcccaccaccatgcctggctaattttttgcatttttattagagatggggtttcactgtgttggtcaggctggtcttaaattcctgacctcatgatccgcccacctcagcctcccaaagcgctgggattacaggtgtgagccaccacccctggcctaccagattttcaatagtgattattcttatagagacatctttctctctttaaatatcatattgtctaaacatcttgccatcctcttgtaagcaattatactgtttctgaataaacttaggggtataaaagtagaaaatatttaccatgcttgctttgaaagaatttaatgattttgaaaaattaaaagtttaaaagtgagtgtataaactaggctgaaagaaaccagaaaagtcacataggagttttatttaaaatgggttgttcaatcaaagaagtgtagaaaacagtagtctaagccaagctagaatcagtttctttactgcagaatttcaggtctttaatatacattgtgaatctctaaatccacggaaatgatataagaaaataaaagggtttcaaagttagtggctattggtcttctcatccattatttaatgtaacatttagttatatctctctgtatacctgttagagttataattactagttatatctcctagtattttgtggttcattttcagaaaaactgatttgctctttttattctataggtaagaaaattgggcttgagagagaagaataatttaatctcatggctaattaaaagcaaaggggattagaacccaagtgagggaactcccaggagactgtttttccattaccctttactattacctcccaatgtgaaattcactttccgaaattacattccttctaatgagcagtggtttgcttcagtctcaattaataattattaatttgtctttaatgtctcagtgttgtatatgtacgtgtatgtatgtttgcataagtttttagatgtaacagaggatattttgttcttgatccaatattttagggctgcatattagcttatctcaattttcgagctagaaaatcacataaaggtgaaatctatttcttcttttgcagcggctctaattagaggaaatcgtaaaaactgtgctcaattttctggctccctcgactggttgatcagcagattggaaagactggaagcttcttcaggtatgttttctagttttttccttgttgtgatagatcactcctatttttctttgcttcgtatcctttaagacaaaaaaaaaaaaaaaaaaaaacaactttgagtgaggtgtggtggtgtgtactgagtcccagatactcaggaggctgaggtaggaggatcacttgaggctaggagtttgaggctgtagtgcactatggtcactgcactccaacatggacaatatattgagaccccatctttaaaaaacaaaaagaaaaaactctgatgtttggtgtaatataagtgttttccttttaaattatgttaagtatttttatttcttgaaaaatcattagtattttcattagtcatttctgaatagtcatctaacaatatcatgtccatttatatcttaaaaaacctatttataaagccctgaaaaccactaaagagccagaattctcattctttttcaaattgattactgctagtctattctataaataagaagatcagtttggagttctcattgttttccttgtattcaaaagattatttggatagattggggagacagttcattttccaaatcctagagtgtaatattttatttaaaggaaatttagtaaatactaacaaatggtctgtataatagtaaaatatttataggcagtcaacccgatacacacatctctaataagatgttagttttatttcagtattgtggagacttatcaatgactgtgaagacttatcagtgattttggacttaccagtattaaatcagttatttgaacttgttagagctctctagctcacacataattgacctctctagtgccatagattgcctcagtgacacccaaatgaatctactgctcttccatctgtttgcacagtatttcattatttgcctttctttatcactaatgccctcttatgttacttatttttcctctcagtttccttcattagtaatgaacttcttgaagataggggcatggtttcattcatctttgttctttccggatctaccataccatctggcacctataggtgtctagtattgtttgttgaatgaatggatggatgaacattaaaattcactcaaaaaataccactgtccatacaaaatagttctgagacttttgcatgataaagacccactcagggacaggtttgttggaattgaatagagacagagaaacaaccatgatcagagagagtaattttaagtcacagagaaaaatttgtagagtttagatagtggaggacaaaaatgtgtagagtttagatagtggaggacaaaaatttgagtcatagtgagttcttgggcactgctagatcgttgggcagcagaagtaagatagaaatggagattgttgtaataaaaacaaaaataattatgagatgagggtgttaagagtatcataacatgaatgtagtgactgtgcattaattgcagaatatattaaggaaaaacctgtaacttctagcataaagaagtgaccaaataagtggtactgaagcaaagtcattgtctggggtaaatacctgagattcattgtcttgcaccaagaaaattaaggacatggacacacacacaaggagtgagtttaggagcagaggtttaataagcaaaagaaagagaaaggagaacagctgtctcaaagagagagagggagagatagggaaagagagaggaagagataggggcagagaggagagacagagagagaggaaagagagagagagagagacagagagagatcacgattgagaaatctggcctgcaccagagtgcaccagattttataggcaggcttgaggaagcagtgtctgatttgcatagggcccaaagattggttggactcggtatgacatttgcataggaaggctggccaggaaggctggctgctccaccctaatcttatgcaaacaggctttccacttggcaggtgccatgttgcctgctccttactgtacacgtggctggcaaggagacgggaacatggagccgccattttgaacatgcctagtcccaggtggtcttttcctattggcacaactgctggcattcacccgtggaagcttccaacttgcttctctatgtctgcagctcgattttgcaggctgctctttgttagaaaagaacatgattttgggactgctcttcattaaaaggtaaaccttaccaaggactcctgtaccctcactatctgcctaaataatttctccttaactcctgtatcagtaacaagatggtggcatagattacaaaaatggataaatgtttagggccaagtgtccagaatcactggaaagctacagaagacatttaaaaaatgctcatgtcttctgctggacccagtggtatctgtaaagagataggtgcagggcagcctcagagcagagtgttaacactggctgaatcaactgcacagcgaaatgcttaactggaaaacagagagagaaaagacatgaacagagccaagcatcctttaaggtcaaccaagtacagtccagtgttttcagagtcttcagttttgtcagttacaggcacagtttcatcagatacaaattattatttgctgttgtctttttccagtcaatctgttgattgcaggcattcctaatgaaaagggaagccctgtgctcagagataacataatgaaagtcaagggaaagaaggacccttagagtatatttaatctaacattcttactttagaggaaaagaaactgaggcaaagaacatttaaatgactgactcaaaatcttagaaaaattattgttactgccaaggttaaaactcagctccctagcatcagacttgcaatatgaccatgatactttgtagctcttgttttttaagtatctaaaatatattttgctgaacaattttttctactgtagttaacatttatgcttttaatgaactgttttttctccagaggaagtggtgttgcttagtttttagaggcagtaacaatgatgagatgcacatgtgtatgtatataacttatttcaattgtgctttgctctttacaaagtgcatacatatgcatcatttttttcctctctgtaataagtctgacgttgctgaacacacactctcctcatctcgttagtgccctagctgcagattcaaactgaagaattcttgagtagaaaagggatcaaaagtagggttaattgtcttcctgggatctagaccattctagtctttactgccttggcaggtccccagtgccttggttgttttggttgatggctggcctgaaacacctcgtttaccattgccagatgcagaacaatgcctaggattgccttaaaaaacaacattggaaatgaagtgatgaatcataggtgaatagttaaattatattacaacaacattttcagctatattataggtattgcaaagaattgtttagatgtatatcctgaaatagatttagaatatatttttaagtgaaaattcatttttagaatgtgtgataggatatatttttgtaaaaaaaaaaaagtgaagatgaaagtagaaagaaataaatgaaaagaggaaagaaggggcaaaaaccctgtgtaatatgtatatatgtctttgcacgcataggctgtagaaatatgtacaccgctgtttactttggtgaccaaggagttcaaattagaggaaagaaaaagagtaaaacactgggttctctaggacagggaattgcttgtcaaaacttgtgataaatagcaaatgggaagtcattagacccaaaggatagagaagaaagggtctaatgaacagtaacaccaattattttttccaccttgcttttacttttttttttaaattgctttttccattattctttacattctaccactaatttagtggcagggacaatagtgttatctacccgatagggctgttagggggattaaatgattaatatttgtaaagtacataaaaaagtatttggtgggcgggtgtggtggctcacacctgtaatcccagcactttgggaggctgaggtgggcaaatcagctgaggtcaggagtttgaaaccagcctggccaacatgatgaaaccctgtctctactaaaaatacaaaaattagcaaggcatggtggcaggtacctgtaatcccagctactggggaggccgaggcatgagaatcgcttgaacttgggaggcggaggttgcggtgagccgagattgcacgactgcactccagcctgggcgacagaacgagactccatctctctctctctctttctttctttctttctttctttctttctatctatctatctatctggcatatatgtacttattaaattagatctgtccgtccaataattccagttagattcatacaaagttgcctggctgtagatattacatattgtaagaggccttttatcaacatggtgttcagctgcaaataagggaaagttctactaccctgacccaaactaggaaggagcggggcagtcaacagcacttgagttccatgccatcgaccacccaggctcctgccatttctcctttcctcagtgccccctgcctgtgcgttgttttctctaatgctggcagatggctgcagcctacaggttgctgcatctttactccaggcaagaggattgaggtaggactcaaccgacggagatactgataatgacaagcattacctctacatttacatggccaatagacagacctctctctaatattattacaaacagtagtatcttttcaacatttcatgaatttacttccaaatatgattttacactgtcatgaatcatagctcctgtcatttctgttgccaatagtgaggaaaaaaagctgatgaatatggaaaggggaaagacgtgtgagtagaaacacaaacggcaaagctggagtagaggctccgggagttgacaggtgcaggaagctgagctgccgtcagccctgactgtcagctgtgtgtaggtgtgtgtgagggccacagaagggagttatctatacataaatatgtatgtacgtgtgtatatatgtgtgtgtgtgtgtgtgtagatctatacatatatatgtatagatatatacatatgtatagatacctacacacacacacacacatatatatatatacacacacacacatacatacatatgtacatgcatacccctacctgttgggcaaggggtttgaaacagtttcagttttcctgacaacgtaattggttttacctcaagcctttcccactcaatgttctatatatgcctgggaccacagtgattaagaagtcagagtgaatacctttacagacaaccagaaacatatttaaggcttgtgaagaagattgtgtagattgcctaacctagtgctcttgaaccacattcttccctcccttctttagttttagaagctgaaaagcaaaattctcaaaatcttaacctcacttaaaactgcgggtgcccatgttgccccattctggcctgtaatatcagctaaactccctgggagagctttgcttcccaaagaaagcctttctaggagaaagactcaggccctacctcaatctcttgcctggaacaaagatgcagtaactggtaggctgcagccatctgccagcataagagaagacacctcacaggaaggagggactgaggaaaggagaaatggcaggagcctgagtggtcgatggcatggaactcatgtgctgttgactgtctggctccttcctagtttgagccagagtagtaggactttcccttacttgcagctgaacaccatgttgataaaaggcctcttacaatgtgtaatatttacagccaggcaactttgtaagaatctaactgaaattactggatggacagatcacatttaataaacgtgtgtatgccagatactattttatatgctttacaaatactaataatttaattctaacaactctataggttaggtaacattattgtcctgtttaatagatgaagggactaaggctcagagaaattcaataagtgagctaacacagaaccagctcccggagccaggcagtttggcatcagtatccttgatcttaatcaccccactgtgttctctaaagattcttactgactatgagattatgaatggaaattaaaatatgtatagttatattgatggggtgttctcttattttggggttctgtttttgtggggttttttaatcttttaataagctaaaatttctaagcaggctttcataggctttctcttgatcttaatttctttgagcctcctggtgtaatcttaaattccccaattatatttacatttttaaataccatggtgagaaatgatctgaggccccaaagttaggaaataagaaaaagtgtgggtggtggtagtaataaatcatttatagtggaagtggaagcaaaaattatacagagacacattagcaacaccaagggagttttttaaaatttattttaaattgacaaactgtaactgtatagatttgtgggatacggtgtgatgttatgatgtatgtatataatataggatgattaaatcaagctaattaaatatccataacctcagatacttgtcagtttttgtggtgaaagcaccagtgacaccagtcactatgtatactaagagtatctgatcagttcatacgcatgaccactctgaattcatttggggaatgaaagataaatcacatattttccctgacttcaagtgtgtctagtgattatgtcgctgggccaaagttaattgaaaagacaaagattggtatgagtaagtacagttgattgagttgatgtatttcagaatggtggcattttcttctggatgttctcagtccttgaaatacgatttgggggcaagagatagctgactaaaaactgctagtcaggaggctacagagtatttctgagtttgactttttgtgtagtctgttccctgcacagttttgcagtgatgaaagtggtctctctttggcattcctgccatttcttcccctctcttagtaagtgccagtgagtgaagtcctgtctgggtttaagccaaagaaggagtctttgaggctggtcgtggtggctcatgcctgtaatcccagcactttgggaggctgaggtgggtggatcacctgaggtcaggagtttgaaaccagcctggccaacatagtgaaaccccgactctactaaaatacaaaaaattagccaggcatggtggcaggtgcctgtaatcccagctactcaggaggccgaggcaggagaatcgcttgaacctgggaggtggaggttgcagtgagccaagattgcgccactgcactccagcctgggtgatagcgtgagactctgtctcaaaaaaaaaaaaaaaaaaaaaaaaaaaaaaaagaacgagtctttgagtggtctccagatatcaaagcttcatgctcatgtacagaacaacttgtggtacctgtaaataggatggtttaaggcttccaaagtccttataattctttcttgcagagtataagctcatcatttttcaaagatgaaaaagttgtaagctgtgaaataaattgtgccataatcttgtgtagcaggaagttttcctccttgatatttacttaagtgtgggcaattgaattagaaagaacaagagctcacatgatatttattgtctgagatccattattagtgatgcagaaatcatagctaactgatttgagtagtaccaacaattcaggcaacactattgactttctccagggttagtttggaggtgggataccagcaacctgtgctcattcactacttttttctgattttattttccctttgcatagccctttagggtggcattccacaaaaatcttagttagccagaggaataaaagaggaagtcttgtctcgtaaaacccaccaaatccattaagggcttacttgagaaaaactgcttattagaaaacaaaatcagccgggtgtggtggctcacacctgtaatcccagcactttgggaggccgaggcaggcggatcacgaggtcaagagatggagaccatcctggccaacaaggcgaaacctcgtctttactacaaatataaaaataagctgggcgtagtggtgcgcacctgtagtccctgctactcaggaggctgaggcaggagaatcgcttgaacctgggaggcagaggttgcagtgagccgagatcacaccactgcattccagcctggtgacagagtaagactccgtctcaaaaaaaagaaaagaaaacaacatcacaagcagtgatgtgatttgcactgcacatccacctggcctgtttctagtctcctttgggaactgagcttaagtttcattgtcagggacagaactgaagttttggcttttaggcactgttactgacagatggctatttattaccattgtctggtctgattgcatcttgctcataccattctagttattaaatatttttagcatcacccttggtcaagtaattgcattgtgtcacttgctttccgtcaagtttaagtgtctgttacctacctaaggtacattgtcatggcttaaagcctctgtgtgggtctgagttcagaggtgcttctctgcattgtgagtaacttagttcaatcttctcaagccaacttgcctcttgatggcccttttagtcctaagcttttaaagtgggagcatatgaacacagtagtcaaaagagggaagtcatttgccacccacccaaatgttccatctgcagtatcgaggcagggtgcaccactgtccaggcagtcccctcagggtcagtgtgatatagtgaaagtagtcttgatggatattagccgaggtgctttggcacccatgaaaggtacctgctctggagagaggtgaccaggatgaggtctcagagtgtagtcagcccattaggatacaatgtcctaattgtgggcaatagggcctgttccaaagtttcctactatttcattatcaaaaacagggttcatccctaccaagactgactcatcagaaatggcagctcattttaaaatcattctatttctatcttctttgctgctatgtttaggagaagcagagctcataggttacaggtatggattttagagttggactggcctaagtccaatcccagctccaccgtttatataatagctgtatgaccttgaccaagtcgcttagctcctctgtgcttcccgttttttaacctgtcaatgggaatggtaaaaatatctgcctcaaagtgctcttagtgacactacaaatgtgcttattaaattaaatgtataaaaataccacagtacgcacctagcaccttttatttttggatttagcagttgttggtagctacaagattaatttgatttattaaaagcaaggttttcccatgttcacactgctaagatatgatatggagaatttcagatggaaacgcataataatagcaaaggctgatacaagttttactatgttttggatactgttctagtctctttaaatatattaacttacttaatctacacaataactttataaagtgaataatattagtattcccatttcacagctgggaaactgagacatggtgaaattgtctttccaaggccagacagcatgtaagccaccgaggcaggccttaagggacccccctaccctcgcttaccatctggctgcaaatttcatgctctttcccttcataatagataatgtctcagttgggggccagcgggatggatagtgatggaatgagtgtgcactgtatgttatttgaatgtgatgaagaaatagaataactctctcatgtaaataggcaagttcaattgttgcagatctgtagaatttcagtgaaagtgaaagtgttttctggaggcttcgtaacccacctagcctcccttgtggctttactacccctctcttgagttacattgggtgatgcaggcttagtggcgaatgattcaaaatactactcttcattaaatcacaaagtgttttggtcttctggtagtactttctcatattctcaggtctgaagtgatttgctcagttttccaaaaatacatccactttgaaatgcattaagttgttgtatttcaccctacacatactgatatatctcacaactatataccattctgcacacagtgccctatctaaaattgtgctttttgtcaatgtattgcacaacctttctccttccttccccttactttacacttgctaactacaacaactagactattctatgcacctttatttgttttctttgcgatcactgggaatgatgcgcttggtttgtctttatactgcaggagaacttttaaaattgatgtaacgatgaagctgatgctatgctcagtttacatttctgcccaaaatgatagctctcaataaatatttgctgctttgaggtacacatcttttggaagaacttgctccaggggatccatcttaaaaaattctcaggtgtttatgtcttgtaaacctttgagtaaggctttagagcaaacagttacatctgccagcatttctgtgggtactgacgtttcacagggagacccagagtcttagacttttgaacattataatgactgcgtagtttttaattgtgcaacgaaggaaatctcaagtgaatttagggcactgtgctgacagtgtcatatgcattactccactggatttccacagttactctataaggtaggttttattacaatttccatttacaaatgaagaatctgaggctacacagctcagatgtcaccttttcaaggtaaaaggaaactaatgaacctaggaatgaacctctgtagtctgtctgtaagctctatgagagcagggatgaggccaattttgctcctcattttgctcaaaccctggacctaacacagtgaatggtccatttgatgtactcagcgatgcatgaatgaataaatgaaagagacccccagaaaaccagaaccatgattgttaacagcaagataggcatatctggcggggcatggtggctcatgcctgtaatcccagcactttgggaggctgaggtgggtggatcagttggggtcaggagtttgagaccgtcctggcccacatggtgaaacctcgtctgtactaaaaatacaaaaatcagctgggtgtggtggcatgcgcctgttgtcccagttacttgggaggctgaggcaggaggatcgcttaagcctgggaggcagaggctgtagtgaaccaagatcatctcaaaaaaaaaaaaaaaaaaaaaagaatatcttgaagtattaatgatttcctatctggcattcaacattttcttaggttttgagatgtggcaatttatacaaataaatgtttgtatagcataaaaattctaataccgttacttgttgtataatgaactgcttttagttgacattctcttttcttttaactggactttaacttctatagtttgtctatttttttataaatcatggttccttaaactgaaggcagcaaaccatcaggggcctaattaaggctgcatagtacattataattacagtgctcattttgtgtgttttatttcagctaatttactccagcaaactcctgactcatattcatcttttcttctaataaaagactcttggtccatcatttttgtttgtctgttttgcaaatgcatccacgatattccctcattctgtatatggataatgatgtgatccaccttttatcttcactaacttccatttttatttatttttctctccttttcttaattttgccaagccgtgttatattttagttttaacctctgttgcttttttctcctttttggagctttatgagtgctcaagatttaatgggcttattttcttctttagccacaaaaccagcataaaaatatgaagcatatgtaattatgtattttggtaatttggcttgagcccaaatctcttggaattgttatttttaagtgtatatatacatatatatatatatatatacacacacatatatatattcatatcaatttatttttctctatttctgtgacttacggaaactctatttagagtaatgtatttatttcatgagttaaccccctgttaacaggaagcaaaatgtgcactgcttcttttttcttttctttctgattatatgtaaagaataaaaagttaaaaaataatttaccagtttatcttatattgagactcaaatgatttcttgacttcaaatttatacccattttaaacaaacaaaaacatttttctccggctcagtggtgattcagtttgtgatacacaaaattcactgcaaacatttaaaaagatgtgttgtaattatgctatatattgactcatcattcaactcttgctatttgttttgggtagacccaattctccttggtaggaagagcaaactaagcttccagttagctcaagctagacgtttctatagttcctactttctcattttccctcatggttgtgcttactcttgaaaataagacaacttagatgcaatgcgtaagttatcactcattggcagtttaatttaaactcgtggaaaaaaacaacagatttgtgcctttacagaaccctctcagatgcacaggcccagatacaaattactgcttttacacataactcagattctttcccttacagcctcaccattgctgtgtagcaaaaaaaaaaaaaaaaaaaaaaaaaaccacctcccaaactccttggatcttgtgccaacatggaactagctagaccatgtcttctctacagcaaactgctgcttacttcatttgcatgtttttcttttttcatgatgttggtttcgtaagaagacactcctgttaaccaggggtgctttatgctttgttttagcatttattaaaccctaagtcttagttgaactttcactacttttttaattttatgagtacatagtaggtgtatatactcatgggacacatgagatgttttgatacaggcatgcaatgtgaaataagcacatcatggagaatgggttatccatcccctttcaagcatttcttctttgagttacaagcaatccagttacgttctttaagttaaagagttaattgtacatttaaaatgtgcaattaagttattattggatatagtcgcactgttgtgctatctagtagtaggtcttactcattctttctatttttttgtacccatcaaccatccctacattcctctagagccccccactacccttcccagcctctggtaactatccttctacttcctgtgtccatgaactcaaatgttttgatttttagatctcgcaaataagtgagaacatgtgatgattgtctttctgtacctggcttatttcacttacatactcatctccagttcatccatgttgttgcaaatgactggatcacattcttttttatggctgaatagtactccattgtgtgtatatactgattttctttatccattcatctgcagacggacatttaggttgcttccaaatcattgcaattatgaacagtactgcaaccaccatggagtgcagatatctcttcggtatactgatttctttcttttgggtatatactcagcagtgggattgctggatcacatagtagctcaatttttagttttttgaggaacctccaaaatgttctccatagtggttgtactaatttacattcctaccaacagtgcaggagggttcccttttctccatacccttgccagcatttgttattgcctgtcttttggatgtaagccattgtaactggagtgcaatgatatctcattatagttttgatttgcatttctctgatgatccttcactgcatttttgactcagctctcctgtaatctcaagaatgcaaaactttctgtggttctgcccacttgccctccttgtttctctgtgcctcgctgtgtctctcgccaaggtctaacaggctggtttaatttctcctgatttactaatttacctgattttatttgaatcaaactaactttgattccatgtcttcatgctgattcatagatatctcccctgaattctcctctgatcagtgttgtccattcagcatttctctacctcttacgactatcatcactgctccacaaaggagcatattggtaattcttccctgttgatctttgtttcatttgccttattttatttcaaccataaaataatagcaaatacttacatcacgttgctttgatccaagctctgttctaaatgtcttacatgtattgctattcataacaatttctcctctcccaggcaccattattacatccatttcatagaggtggacactggagcacagagatgttaaatagtttgctaaaaacctgcaaggacacaaaactaggcacatcggcttacatccatgcttatcaccagtatataatacaatagaataataatgatacctcttactatgatatttccccattaaattttgtaaataccaagactgccaatcagttactcttctgaaaggatgatggtctgtcacatccctaagttatttcatttaggaatgcaaatgtcgttcatgttctgtgtgtttccctgttctttctagtcatttcccagtttacttccccatctttttactcgttatgtcactttatttaattactcagagctaaaagacaaattttcctactttcagtgaaatgtcagtgaaatctggagatattaataaaaaggttctgaccaaaaaagctctaacaggtttcgactcccaggtaggagggaaaaaaatccccaaacaaatacctgtggtttgaataatttgtaattaattcactgggtctctgattgtgacttctttcgctgatctgctgtggacaccgccaaactgtttgactggcactgtatctccactgtttcctttacatggggcagttcaattcctactaattagcactcagccggagtcttcctgtttgcctacctctagcttagacgaaagggtttccatgtcatgattttcaggtggggccaggtgctccttctggagtaatcttttgtccagtattattactcctacttgaaatagaggtggaagagagactttccttctcccagagcagaatcacactcctgtatccttcatgaatagagaactaggttccatctaaatccacatacatcttggtgttctgggatgattttgactgtgttttatttttgcaaaacagttgtaaccatagatgagaaacagtaccatggggggtggggcatggtggtttctaagtctgtggttttcctgggctttctgcagtgatcatgggagcaccagcgtcatggcttgctttgtccccacgttggcctcctgtgcctgtgtggctaccagtctaattccattcacttcttctcccaaatgtaagcttatgcctacttgcgatggggcaaaatccccaggctagattcttcttggtaggtaaagtcagcctacgtagagcactcttgccctgtggcttgtttctagtttttctatacagattctcaacaaattttgttcaacctcagacagcctgagttgtgacctgtgaatatacaatagcaaagtcaactttgatctctaatgaagttcctacagatttgtaagtcaagtaacaaaagtctaagtctatcagtaaaaagcaaacaggaccacttttttttggttacaaaaaacatgataaggaatattctctacccatcacagcacttggccacagctcccaataccattaagttatttctagacatttagttacatccttggagattttcctttctcgggagaacataaataattcacagttacaaccataaaagttttaaggcaaatggctaaatatttgcacgtattaaacatgcagtgcctgcagcctcaattttgtgttctacaaacaaacagcacagaaatttgccgaattcaccaagtaaaatttttcctcaaattgaaacacagataaggaaatcctagcactaagaaatataaattccctatgttgtgtcctctgtcttttctacatttaaaataataacggttttaaatgaaattctccagatataaagtatttcagttattctatttacacttaacaattatgaatcttgttatgagtaaataaataaatggcagatttattttgtttaaacagaatgtgagaaccaacagtccatttatattcattcacttattcatttggcaaacacgagatgaccttccctgggtcagagtgagctgggtgacaaggaggcaaaattaaatcaatatctgctctcaagggctcgttctgtaatgggggattgaaatgagaattttaaaaatgtgaatgtgcttgttactacaaaaggaggaataattaattcatctcagggcattggtaaagactcaccaaatgaggtaactttcaacctttgcaagctgattgagattttgcagtcttagacggtgggagtgtatttagatctgagaataacatcagcaaaggattgaaggtgggcaagttcctataagtttcaagagggccttgcctgtctggttcactgctgatcccattccttggaacagtgcctggtaggtgcttaataaatatatatgattcatatgtaggtatacatattaattgttgtttgtgggaggaagcggcaggaattgaggctgcaaaggaaggttgcactatctggtttagggactgatattctatgctaaggggagtggactttgaccttggaaggtctgggaagccattaaagattttaagcaagggagtgacattgattaaatgtgtgtttcagcataaccacctacagtttggaggatgggttggggagggaggagaaactggaggagaggatatagtaagaggctattcagtgaaaggagaggatgagtttaggagataaatttggacacaggattaatgaattttaacaattagatttaggaaaatgagaaagtgaaagaggattcaaaaatgacttcaggtttttagcttgaatatatggatgcacgatggatgagagaagcaattttacatatatacgtacaaagaaaggtgttatgttcagcttttgaaaaagttagttgggggtacttagagacattctcattgaaatgtccagaagataattaggagatgatatttgaaatcaacttggaatagtcaacctaagttcttgtaactcctcactactaaggtaaatcatgcatgttaaatggccagtaccctgagaccaaccctagtttattgctgtacaatacttaattctagtataaactctcagtactgtaatttgtgtgttctctgtgtagcaactggtagcttttgtttatgcttattccaaacttatggaatgaaaataagtttatataacttggatgaagtataagacttaaaagactccatagattaaaagttaattatagttatatactgtagagaggaaaggcagctaatgttactggccttttgttgtcaggcctcattaagttgcatgaattgactaagtattgagatttagtggcagaaataaaatgtaagtagacattacttcctattgttttatgattcttttaaaatacgtttcttactataaaagttatgcatgctcatttcacagaatttatgaaatattgggagagaagtatacaaatccagcaataaccaagactaacctttttaggtaataacttctggtcttttttaaaatatgtattttatacaaatgaatatattttacatagttgcaattataatctatatgttattttggatctactcttaaaaagttacattgattattatatatttctatgatgttaaaaggttctctcaaatcatttctataaacttattaaaacataaaattcaattgttttgcattattagttgtagttagttgaaatttttttaagtaatttgtagtatatttataattctttcattccataatactgttatgatctgccaagcttttaaatttgagaatctaaccataagcttcacgactatagctatttcttggtcttattgaatgtatttagaatttagtggtcaaatgattgtaactattgatattataatcttcattaagcactgtttctctgcatcatttttcatccaagtgttcaaagcatatatcagcataatttaaatatacgcataatattgtatacctattcctttttttatttaaaaatggactctttggtgtttctcatttgttgtcctttaagaattttttattatacaaaagcacatttgctgtttatttcaataaaattaaaaatcaaatttatttcaggctgggtgctgtgtctcgcaactataatttcagcactttgggaggctggtgggaggattgcttgagcccaggagttcaagaccagtctgggcaacataatgagaccacccccgtctctacaaaaaaaaaaaaaaaaaaaagctcagcatggtggcatgcacctatagtcccagccactcaggaggctacgggaggctaaggtgggaggattgcttaagcccaagagcttgaggctgcagtgagctataatcgtgccaatgctctccagcctgggcaactaagcaagatcctatctcaaaaaaaaattattccaataaaccagggttattcttgaggtattggccatctaatatgcctgcatatttcagtttattccaataaaattgaaaataaaacgtgttttctctgactttattgttataattaatagaattagaagctgtcaatgtttttcaactatttatttattggatctgacctgatagaattgaaaaacaaagaaactgttttaatgttaaaccccaaattctgaaagctttctattagactaggctaaataggagaaaaatcggggatttgttttcatatagccatttttgcactttgtgacatacgctatttacttccaaaatctggtcatatcttttctaatatattcagtttattcactctatgggccttcatgagtgtttattttagcacgaaaatttattggtcttcgtcttaacttcttggtcttttttcttaatggttatattgtattccacgattggcaatctttttctgaaaaaggctagtgtcttagtcaagtaggactgttgtagcaaaatatcacaaactgggtgatttataaacaacagaaatgtatttctcacagttctagattctgggaagtccaagatcaaggctcctgcagatatggcatcctgagggcctcctttctcaaagaaagttcgtcctcacatggtggaagggacagcaagctcccttggggcctcctttataaaggcactaatcccattcttaagggctctaccttcatgacctaatcacctccccaaggggaacatctcctaataccattgtcaggcctttgagcccaaaggctggatgtacactgtgacctgcacgtgtacatccacatggcctgaagcaactgaagatccacaaaggaagtgaaaatagccttaaccgatgacattccaccattgtgatttgctcctgtcccaccctaactgatacatatattctcccccacccttaagaaggtactttgtaatattctcccccgcccttaagaatgtactttgtacacctaccccaaacctataagaactaatgataatcccaccatccttcgctgactcctttttcagactcagcccgcctgcactcaggtgaaataaacagccttgttgctcacacaaagcctgttggtggactcttctcacggacgcgcgtgacaaccattgccttgggggttaggatttcaacatatcaattttggagagacgaaaacattcagaccatagcagccagatagttactattacaggccgcgtggaccatgaggtctgttagaatcactcaaccctgcctttgtagtgtgaaagcagccatagacagtatgtaaatgcaggtgcatagaatacacaataaaattttatttataaaaataggcagtatgcgtctgacaagggtctcatatccagaatctataaggaacttaaataacccaacgagcaaaagccaaataaccccattaaaaaattgtcaaaagacttgaacagacacttctcaaaagaagacagacaagcagccaacaaacatatgaaaaatagtctacccacatctccaatcaccagagagaaatgcaaatcagaactacaatgagataccatctcataccagtcacacttggctattgttaaaaagtcaggctgggcacggtggctcacacctgtaatcccagcactttaggagaccaaggtgggcggatcgcctgagatcaggagttcgagaccagcctggccaacatggtgaaaccccatctctactaaaaatacaaaaattgcctgggcatggcggtgggtgcccataatcccagctactccagaggctgaggcaggagagttgcttgaacccgggtggtagaggttgcagtgaagtgaaattgtgccattgcattccagcctgggtaacaaaagcgaaactccatctcaaaaagaaaaaaggcttatattgttggtgggaatgtaaattagttcagccactgtggaaagcagtttggagatttatcaaaaaacttaacagagaactaccatttgacccaggaagcctattactgggtatatatctgaaagaaaattaattgttttaccgaaaagacacatgcacttaaatgttcgtggcatcactattcacaagagcaaagacatgtcatcaatctaggtacccatccacagtaaactgcataaagaaaatgtggtacctatgcgtcatgaaatactacggattggataaagaaaatgtggtacatatacaccatagaataccacgcagccataataagattgacatcatgtcctttacagcaacatggatgcaactggaggttgttatcctaagcaaattaatgcaggaacagaaaaccacatacagcgtattatcacttatagtgggagctaaacaaggggtactcatggacataaagatagcaacaatagactagccactactaagtgggaggaagggggatcgaacaagggttgaaaaattacctattggttgggctttgctcactacctggttgatgggatcaattgtactgcaaacctcagcattatgcaatatatccatgtaacaaacctgcccatgtatcccttgaatcgaaaataaaagttgaaattattttttataaaaaggcagccgtgtgctctatagcaatcaataatggggagaaaacaaacaaaaacatcgggatagcatgaccagtctattaaaaatgcttttccatttccatgattttattttagcacagaatgaatgagtttattttgtttctacgtttttagtaatagcaaaaaaaaaaggtattcagttttagtatacttatataaagatctgctttaactcgtcagcctcttgtagcattagtttctgttgtctttgatttttaactgttatgcattgttggaacacagcagctgattttgaacagctccaaaatgtaactcaaaatccttttggctgaatatatatttgtgttttaacaaactaagtcattagtgaagaaattagcattaacagtcctcgttttgtaatggattggggcttggatcaaatatagattgtgacagccatagagaattgcctctgtattctatgatacctttgtaaatgtaaaactttgtatttcttttctaagaatattaactccatttgagatgtatgaccctttccacagggttcctctggggcccttcccaatactatgtaactcttagaggtgatgttttctgtatgttgggtctaattggtgtgaatgggacccattctcattgttgacaaggcaagcttgttcagaaaacatgaacacagaggtacacatttagctttacaagttcatgctaaaatttctgataatgaaatttattttctcttctttcctttttaaacttcaagaaaaggcatatactattttatattttgtggtggctagtacctaaaaataccacgatttttaatcccgttttatacattgtgttatttctgtttatttatgtcttattttacatatttctcttatttaacaaactaagaaatcttgtgtactataaacctcaaggagaatgtcatgatctccatggattgggatgcactgttgcaggattacactttcagtgccaagaagcttcataaactggccctaacccacctgtcccctcccccactcactctgtacatgaggcacaccagatatgccccacgttcaagactttactcatgcacatactgcccttcctttcctggaaagcctgaaaatggtcatgaacgtattctttaaggccccacctctgtgttgcttcgtgtacgccctccttcgggtagcgttaccggcttcctctgctaaacaccacgtctcagttgtttgccttttcttccctcaactgtgatgtcttcatctttggatattagtcccctctcccaaacaccacctgtcacctatcacagtgccttgtaacagtcacattgagcacagataattacatgttgtactgaatgcacctatgtagaaaaaggaagacactggtcattgtacaccaattaatcatgtgttttttttcctctttctttgttttatctttaggcattctggaagttttacactgtgttttagtagaaagtccagaagctctaaatattattaaagaaggacatattaaatctattatctcacttttagacaaacatggaagaaatcacaaggtaaatgaactattttatttccctgaatgaattctcaaatccttttagatatatttttaaatacaataacttttaaaaagtgtgtcaaatttttcatgagtgtttttaatctcttaattattttttgagatgcagtcgagctctgtcgcccaggctggagtgcagtggcgcgatctcagcccactgcaacctccgcctctagggttcaagcattctcctgtctcagcctctcaagtagctgggactacaggtgcatgccaccatgcccggctaatttttgtatttttagtagagacagggttttaccatattggtcaggctggtcttgagctcctgacctcaggtgatccacctgccttggcctcccaaaattctgggattacaggcatgagccaccgcgcctgggcttcatctcttaatcatgatcaagtaatattttttagtgtttattcatagcatcagtgggaacatgaacagttctcaatttatatatgaagaaaagttggaaaattagtgggaaactactgtaatgtttaaataactgagtcaaatgtaactggaggaatgcatttgctttgtaaaaaagtgctgctgatgcttgattctgaagggggaattcgaatcagctgacagtgactgcacccagtggctcatgcctgtcattgcagtaattggggaagccaagatgggagggttgcttgaggccaggagtttgagaccagcctgggtaatatagcaataccctgtctttacaaaaaaagaaaattagccagatgtggtggcatgcacctacagaggctgaggtaggaggattctttgtgcccaggagttcaagtctgcagtgagctatgatcgcatcactgcacttcagcctgggtgacagagtgagatgctgtctgaaaggaaggaaggaaggaaggaaggaaggaaggaaggaaggaaggaagaagggaaggaaggaagggagggagggagggagggaaagcagggagggagggaggatcagctgaaagtaatttctcttttcaggttctggatgtcttgtgctcactctgtgtttgccacggggttgcagtccgttctaaccagcatctcatctgtgacaatctcctaccaggaagagacttgttattgcagacacgtcttgtgaaccatgtcagcaggtaaattcagacagacaatgtcacctgacaggtaccataataaaagaattaatgttcttgccctgtagctgatactatatggtctgttttttaaattagaccatatagtattattttctgtatttttgcagtgaataatatgtctttttctctaacaatcagatgggctaataataaatgaacctagcaaaatatggatttgccgcaaacacatgtataagagcttttattcacattcctatgtagatacataaccattggcatcttcaggaccaccctgacaactgtataggtatatggttgtatataattgtactttacatcttcttagaatgtaactaaaaacactatccttcaatatcattgtttttttctttttttttaagacagagtctcgctctgtcgcccaggctggagtgcagtggcacgatctcggctcactgcaagctccacctcccgggttcaggccattgtcctgcctcagcctcccgagtagctgggactacaggtgcccgccaccacgcctggctaattttttgtatttttagtagagacagggtttcaccgtgttagccaggatggtctcgaactcctgacctcgtgatctgcccgccttggcctcccaaaatgctgggattacaggcgtgagccactgcgcccagccccttcaatatcattttgaggtacctgctatgtgcaatcaaaaatagaatgtccaaaatgtaataaattatgcaaataaccaataaaactacatcttcagttagatctgccttccaaggcacctaacgttcattgaataccatgtgccagctgtggcgctaagggctttacgtgtattctctactgtttgtgtctgtgctttcctaggaaccatgatgattcacattttatagacgaaaaaactggaactggaagtggaacttagatctaaatccagagactgagcttataaccaccgcgccacactgcctttcttatcccctgtattagtcaggcttctctagaggcacagggcgaataggatagctgtatatatgaaagggagtttattaaggagcattgactcacatgatcaccaggtgaagtcccacaaaaagccgtctgcaagctgaggaacaaggacgcccgtctgagtcccaaaacctcaaaagtagggaggccagaagtgcagccttcagcctgtggctgaaggcccgagagcccctggcaaaccactgctaagtccaagagtccaaaagctgaagaacttgggagtccaatgttcaagggcagaaagcacccagcacgggagaaagatgaaggatggaaaactcaaccagtctagtctttctgcgtccctctgtctgcttttattctagctgtgctggcagctgattagatggtgcccacccagattgaggatgggtcggcctctcccagcccactgactcaaatgttaatctcgtttggcaaccccctcacagacacacccaggaacaatactttgcatccttcaatccaatcaagttgacactcagtatgaaccatcacatccctcaaatgaacacataaataaatgataagaaataacggcttacaatcaacaaaacgctgtgtgtgatagtagtaacattgacatactgtatctagcagctagcctggagaaactgataacttcctcctgttttaaacagaaatgtggggtttgttgtgtatttctatgatgtgttttgttttttgagacagagtcttgctctgtcacccaggctggagtgaagtggcatggtctcagctcactgcaatctctgcctcctgggttcaagccattctcctgcctcagcctcctgagtagctgggattacaggtgcacaccaccacacccagctaatttttgtatttttagtagagacggggtttcaccatgttggccagcctggtctcgaactcctgaccttgtgatccgcccgccttagcctcccaaagtgctgggattacaggtgtgagccactgcacccagctaatgtgttttttaaaaatatataatatacatatatacttattgcatattcactctagggcaaagactttacatttattctattattcaatcctcacaagatgcttaaatttatagatgtttaccagtccattttccaggaggataaatggaggatgagcaaggtttcataactagtgccgggtcacagagctagcaaatggatgctcaaattttctctcttgactcggaaacccatggtcttccaactgtacttccaaccacactgtgctggaaaaatggaaattgttaggaaatggatacagctggtttttttctttcgctccttttgaggagctcctttttaaaataaatcaattacatattaaattatgttacctctgctgagctaggaagcaaagtccaagcaccttctatgtttttgtttgtttgtttgttttacagtattgatttaagatttccttcatgattctttatataacagacctgccgtttatgagtgatatgttctgagaccttcattcatttctacctagtattaccatagggtatatgtccactcctaaaatggaattaaatacaacttactgttgtattttttctgttcacagtgaggcataatgaacaacaaagcttattaatcaccttggttccttcataaacaacatgacctacctcagccccatgccccatgtgacacaaagcttagcttaggaaaatttctccatgtccggaattcccaataactccattaattctaaaagtctgctctgagtgtctcagtttatgacataaatatgattaatgatacacaacatgctgaagaggaattaagacaaaataacattagttccttgggtgacactgccaagaaatctcagaagcaaaactgctgatggaatgttcacagtgaagctggctttctctgtgtactacctcagtggtagttttaataattttttagtaattaaggaaatatatatttaatatgtggcatcttagagaagcatgactaatgtttaaaatagtgagatgtggctgggcacggtggctcatgcctgttattccagcacttgggaggtcgaggcaggaggatcacttgagctcagaagtttgataccatcctgggcaacatagcaagatctcatctctactaaaaataaaaaagaaaattagttgggcgtggtggcactcgcctttagtgccagttattcaggaggctgaggtgggaggattccttgagcctgggagatggtggctgcaataaactatgattgcactactgcgcttcagcctaggcaacagagcaagactctgtctcaataaaattaaatgaaatacacaagtgaaattgtgagatgtaaatgaaaacaatgaaaggtttttttggactttccttacatgtgattcccgtctctttaaagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggtacgtactatccattttctttcaccgtgttccagaagatcttttgctgggcatttctgaaagctattggtgctgcttccattaggtacttctatagggtattaattattcagaaatttagcattgagatgatgagtaagagtgttgaggaacaagcagtatttcactaggggaaaaagaaaatacttaaaattatagtacatttccaagggactgccgagcttgtgaacaatgctgtgtatttaaagagtagatttaaataagagtgtattgcttaggaacaatactgtgtatttaaagagtgcattccgaagcatgaatgaactgcaagaaacttgtgagttttctgctttaattggtatgtttaaagctttagttgccaacataaaagaacaaaaaacaaatcttggaaaataatgggaagaaatagactaagttcagccttctgttagataatgtaatggtgggaaatcaataatttgtaaagtgtggtatgaggactcagatcataacaaatgacactttgtttcagaagtataaaatggtttaaaaataaaggaataggtcatttcaccagctaccaactcttagctttgatggttgagtatatattaaaaatgaatactttatattaaaaaataatattcttttctctgattcatgaagaagtagagtttggttagctccatttaaaagcttagctcttgattatgtagattttttagatgttaaaattcatctggattctgcagacataagcttatattaataaagctgcatttggaatatagtcctggtatgatcttggcatagtttataaattatttagcatatggaagatgcagaaagttaccttaagttataaagctgaactttgcctcatgtggagtacaaatgatagacatttatgaatgctttatgggcctaaaacttatgaaaaataagaaataagttgaactacacctaagattttatgctaatgagtttatatctaaaagcattccatgtagttgtatctaacaatgatacttactgaattctttcttcattgagtgccaatagctcagttgtctagacgagaggaagctgtattttgattttttgtgaatttttaatttttttttttcgagacagagtcttgctctgttgcccaggctggagtgcagtggtgcaatcttggctcattgcagcctctgcctcccgggttcaagcgattctcatgcctcagcctcctgagtagctgagactaacaggcttgcaccaccatgcccggctaatttttatatatattttagtagagtcggggtttcaccatgctggccaggctcatcttgaattcctggtctcaagtgatctgcctgcctccgcttcccaaagtgctgggattacaagtgtgagccaccgtacccagcctcaatttttaatttttgtgagtacataaaaggtatatatatatttatggggttgaagctgtgttttgcatatttcatctaacctctgaggaatgtggttggagtcctcacagtactgtagactgctttgtacaaaggcgacctgtgccagccagaccatagtcacagtgccttgttcccacaggaaaattgtcctgctgaccaagcagagagaaagagccctaacttcagaagacctattaaacacaaaatagggctaaagtccatgttataaaacatttgaactataatcctttagatactattaccccctctctccctagctcctagtattgctctgcaggaaataagtactcaaatgaataaatgaagcacgtggacttgttttcccattacacagagattagatgaaaaaaaaaaaacattgatcgacaatgccaagttgctttcatttagtctctccatacaataacatattttactatttttgttttgtattcaatttgaagctttttctttcgatacattaaaagtacctggttcttatggaattgaattgtatgcgttataccttttattacaaagtatctgttcagtagaacaataagaacaacaaaaaaaaatttagtgaatctgtggacatgtaccagaaaggacgataggcagtggaatttcaggagaaaagcatcttgaaattttattcattttttttaaatggcaagaaaatacgtatcatatcaggcctacagttgaaaagtattttctcttaagccactgggagtctattaaatgctttgctgattttagattcgtaattaatgaagacaaatctaaattagttggaatgtgagttatgaagctcgaattcatagtaacagataaccttcttgggggtcgttctcctgttttcttcttaatggttgatgtacaatttgaagtatcaaatatcagtgatttccaggatagagcaccttctctgccacttaacattttgtaattggagagtggcagtatttctcggaacaaggattgggctcataagcaaaagtttttagctatgtcttcatttcttctcttcaatttaaactttgcggtgttgctacacttcctctctgtcaatgcagaactggattttgggaatccaggtcccaggtgtttgagaggaccaaaagtataaaaaaatcttggtgctttgagagaatttaaatatagaagtagtgtggaggaatgtacaggaaagatgggtacaggtttctaatagagggtctataaagctatcgtatccctccaagtgaaaaatatatttgattataatagatatcgtgtaaataacatcgctattagctacagatcatggtacaaacaagaaactagacctttttctgcattgcttttatatgacttttttaaaaagctgcctttattatattcagggaattctagaagagacacttgatagtgaatttattgcctgtggatttgaatattggtaaaatagaaagtgtccacattaaaaaaaaaataggtattctctactactggcatttcagatatgtccttggtagagatattggcatgctagaaataaaaagaattattaaaaatacaaagcatgtatcacaaagtctatttttgtctttgctcaagttgaaggttttgtttatgtttatgagcatgtgtgtttgggagaaccttaccttcttttctttcattgtgcagtgagaagcagatgctctcgggacgaattagcaaaggagttcttcgaatcaggaatgggcttagaccataggttggtcttgccggggcaataaataacatttatccaatatcattttcacacctccagttatatcctgctttacttaagaagccaaccaagatcttgtgtgaaataaatgaaaaactataggccaattggcctatagttgtctcacaataagcaacgtgctgcaggaatgaatgatcatattttctgctttcgttatctttatgtatttttattttaaattgatagaatgaagggagtttagcatttgaaaaagggactgacatgaagtacctgctgtgcctgagactctgttacttgtaaaacattaatcgtcaaaataactaaacaaggtgatggtacttggtgttctgtttataagacatccaaattaagagaggttaagtaatttggttatggtcttacaagtagtagatggtaaggtagctatttgaagtccctggagatgttcctttgacatcattatataatctgctcatagataatttctggatcagttgccatccgtctacatgcagaagtttctgtgtatcagaaggtccattttacaacataagtagcagcctgactcctgaaataatctttttatttttttgacaaagagtttaacatgtaacatgcgtttacattcaagatttattccttctgatgttgtgcattggtttgtcactacttattcaaatcttttgactttggctctgaagctgattctctgagataaaaaaatacatgaccttccttaatgttttccccccaataggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaagttagtatgtctatgttttttggtctctttcctttctcatttctcatacctccacagaagactctgcactgccattgcccttcttctctaaccattgtttgtctctcctgggcacctgtcctctgcgcattttgcctgtgccttgaaggaggaggtaagcctcacctaagatgggcatcctgcaaggctgaatgctttgtttacggatcccacagtgtttagatgtgggcagtctccctcaaaccagggtcctgaactatttcaaggtgtttttttttttttttttagttcatttatttagatgaaatgagcaaggctgttttaaaaaatactgcttattttcttatattttcattcattttccttttttaagacatagttcctcaccccattgcacaccctcttatttcaatagaaattaaatatcctttttgttgatgaggcccagatggctttcttcagtgttcctctccacctttattctctttattcctttattctctgcccatggtcaatggtgccaagatggtttcctcacactctttccttttttgctattaccagagggaaacaaattaaagtgataatccattgtagttctgcaaatgaaactttaataaatgatggtctgttataataagtaactactctgtcacttatttttatacacacacacacctgtacacttagaaggactccatttgtttcagttattcttttagttataattctcccaggaataattcctagttacaaaagcatcatattgaagaagaaacagagtaatcatgaatattagctatccacgtaccagttactttttctgatgtatttatacaaattatgtttctataagcttctggaatgttttaacatttttatttttcctcacttttctttgcttttctttatttttttggactggacctgatacacaaattagaaaaagaattatggacaggtgcagtagtttgcacctgtaatcccagcactttgggaggccgaggtggaaggattgcttaaggtcaggagtttgtgaccagcctggtcaacacagtgagaccctatctctgcaaaagttttgttttgttttgttttgtttctttagttagcacctagttttgtatgcctgtagtcttagctacccgggaggctgagttgggaggatcacttgaacccaggagctggaggctgtagtaacctgtgactgtgtcactgcacccctgcctgaacaacagagtgagaccttgacacacacaaaaaaagaattacgaggaaaatgaaaaatttaaatttatttttgtaaacccgagggccccaggaaatatatatcatttaactgtttcaaaaagtgtttttcaatggaactcagattaaaatagttttgcttaaatgagcagaatgtataaaagattttagtaagttctttttcgttgttgagattgataaacaattagcgataaggttacctgctttcttcaagttgaagtgacatcagaatctcctttaaagcagcagtccccaacctttttggccttaggcaccgcttttgtggaagacaatttttctacgggccagggctggggttgaaggtggggatggtttcaggatgaaactgttccagctcagatcatcaggccttagttcgattctcatagggaatgagcaacccagatccctcacagacacagttcacaatagggttcgcactcctatgaaaatctaaggccactgctgatctcacagggggcagagctcaggcggtaatgctctcttgcccacacagctcacctcctcccttgtgcagcctggttcctaacaggccgcggactggtacctgtcgtggcctgggggttggggcccctgcttcagagaatttcattaggaaattggacattgaaaagtgaccaagaaagtgaaaaaagaatctaaaaaaaaaaaaagaaaagaaaagtgactggtttttcccctcattccttgttaaatcctgtaattttaagcatatagatatttagatcaggtcttttctttatctttcggtactttgggactttaagtgaccagttattacggacatgcacttcattcccgtaagaatgtggtgcatgtgcttttggttacttctccagcaggtgatgtcttcactgacccattaattaacttaagcaggttttctcttttgatgaatatgatgtcctcatgttttaccttttacaattagaggcccttgaattctaaggtgatcacattatgatggtacgtaggggaaaatgtggcttctgataaaatacttttgtactaacaatttttccctaagattttgtgaattagaaaactttaatgtacaccagagataaaattgactctaacgtgcatcctctttagagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccaggtaccaagatccactcgaatggcaatcactggtattgcagtcatgctgatacacagtggctttacacttggaccacaacccataggaacgaatttcacagtaatacagttgtacagttgacatgtaggactgaaatgagtctcataaaataacacttacctttaccatgtccactcactcattttctattctattctatgtttttgttgtcgttgttgttgtgatggagtcgtgctctgttgtccaggctggagtgcagtggtgcaatctcggctcgctgcaacctctgcctcctgggttcaagcgattctcctgtctcagcctcccaagtagctgggattacaggcgcccaccaccacacctggctaatttttgtatttttagtagagatggggtttcatcacgttggccaggctggtcttgaactcctgatctcaggtgatccacccgctttggcctcccaaagtgttgggattataggcattagccactgtgcctggcctctattctatgttttaagtagttttcccaacccaataaactgattccctaatgtacgaacagattacaacctgaggtgttaaaaacactgttcaaggttgtctttaaagttttattaaaataattaatattacttagtttataaagtgcatattatacttttcatgcacgtctgtgtgaagagactactaaacaggctttgtgtgagcaataaagcttttaatcacctgggtgcaggcgggctgagtccgaaaagagagtcagcaaagggtggtggattatcattagctcttataggttttgggataggcagtgaagttaagagcaatattttgcgggcaggggtggatctcacaaagtacattctcaagggtggggagaattacaaagaaccttcttaagggtgggggagattacaaagtacattgatcagttcgggtggggcagaaacaaatcacaatggtggaatgtcatcagttaaggctatttttacttcttttgtggatcttcagttacttcaggccatctggatgtatacatgcaagtcacaggggatgcgaaggcttggcttgggctcagaggcctgacaatacttttaaaaataggcaataatagcaacaggtggaacttagtgacaaaaatcgtgcaagaaattttaaggtataatagtgttaagatgatttaatatctggggtaatgtactgcacttgaagtaatatcatacagatgtgacacacaccgatcttagagtgtagttcttaagcccccaacctttttggcactaggtaccggtttcctggaagacaatttttccacgagccggtgggctggggttgaaggtggggatggctttgggatgaaactgttctctctcacatcatcaggcattagttagagtctcataaggagtgcgcagttcacaatagggttcacactcctatgagactctaaggagaatatagagaaagatgaggatgccgtataggaaacatggagttttcaatttcttctcatttccttcttcgatacgcttatttggaagatatttagctgacttttatcttgggtatagattaagatcatgaactctagagtcaaagtgcctggcatcaagtactcttcccttaggggagctgctcaccttctttactgggatgcttagagtatgtttgtcatagttaatagataccatattacttggcaaatagtcacccaacaaatgttagctgttgttcctctttttctgtttcatagatgtaatggtgttctgaggttggctatgaattcaatatcgacttatattgatggtgaagtagcttcagtgaggttgtttagatattcaaagtttgtttcttagtttttaaagatcaaagacattgcttccaaagtctgaacttgaattaataccatgcctccaaagcttcagttgcttagcaatcagatttttagctcctcaaatcgtatttcttgttccccctttttatatcatgttgttaaaataaacatgcaaacattgttcatggccaaaattcagtttgcattgcccattgctaaaaggtgggaggatatgtatagtgcaacctaagtttataggaaaaaagatttgggagactagaaatgaacaactagatgacatcatggtagaaacttaaggattacctgagacccagataacctctatcagggaaaggaaacagttatcacctgcttctcttgggaatgccacctcgtcgttgggcattgtggtcatttgcccactctatgtgttgcgagactagctgtggggtcacacagaagtgcttaatcaagacgtaaacaaccagtcccttaccttgggttttttatgaacattcaatttcttccttttaatgggaacatataaagattttgtttcttttctgtgaagcttatatttagaaaccactaacagtaacagagtagagtgtaggggaagatatcaatcactagtcagacatttatacgctcaaagatccgatggactataatgtgggcactgaattgcctttactctggctaatgaatgctggcccagttggtgtaagagcttggggatgatttctcattttaaattatacattccttggtagtagccccatatccattaaacatcttttggttgtccccaccaacactcctttttttttttttctggtggctcataaattgatttggaaacctaagttgtcaaaaaaaaaaggtaccaaaatttatttaaagaatatcatgaaggctgggcgcagtggctcacgcctgtaatcccagcactttgggaggccgaggcgggcggatcacgaggtcaggagatcgaaaccatcctggctaacacggtgaaaccccgtctctactaaaaatacaaaaaaattagccgggcgtagtggtgggcacctgcattcccagctactcgggaggctgaggcaggagaatggtgtgaacccgagaggcggagcttgcagtgagcagagatcgcgccactgcactccagcctgggcgacagagtgagactccgtctcaaggggaaaaaaaaaaaaaaagaatgtcgtgaaatagatggcttagaactttgttctatgattactggtttatgaggcagttttatttagttcaatttgcagtgaagactgttggcactgcatcttattgcatttgtttctgatgtgtcttttttctttttgtaaattttagatcgtgttgcctcctcatctagaaagaataagagaaaaactggcagagaatatccatgaactctgggttatgaataaaattgagcttggctggcagtatggtccggtatgtaattttgaaatttattttcagattctgtgaatacatctttctgaaaacataactttttctgccttttcccgctatggggtgacatcaatcagttagttggattgatttttttccccctacacattagtttttgtgcagttttgccttactacgttattgtagttaatggggctgacaggcattattggcaggttcactgaaggatggtctagctgcctagacaatggaaagttatcagtgtctgggctgaaagttatattttcaaatcaaggttaacatatacagataataggcattgatttttaagccacttaaaagatctcagtgaaattgaaagtgaaaactgaaaatgaaaagaaggcaatttacttttctctcgctcatgtttcttttctttcagttccaattgtgtgtaaaagcggaaacctgtgggcaagtgttcctagttggtttcacaggtagaatgaagactgagaaaccatgattgcacatgcttctaaatgatactttgctaaagagcttagtttacaacttaatacaatttagatttaaaacaaacaactacctgtgtaatcctagtgtatatcatatacttgtttgtgtcaaaaccatggtaatactttcatttgtatgatatattctaagtgtcccaaaggccataacactttcttatacctgactgaatatggaaattaatgtatttacccttcatagtttattgcattgagctctgaataaagaatacttaatataacgttagtagtagtatcatgtgatactccacactactcagtaatatttatatatttattcagtgttttgcattcttgcatacagattattaggtcaaattgtcattacagtgaactgggttgtgttgttatttcagttgtactggtgatgacctagcggagagttcttgcagttgctaaatgccttggcaggcatcacatagctagtgagtagcagctccaagactggaatcaaggttttctaagacagaatttagaaagtgactgcaagtcactgtaaggcttgctgaagcatgaccagaaaatgggatgcttttattaactaaatgatagttagacatttgttacaccaacaaacacttgggtacctagttttgtgctacgttcatcaattttttttatttttttgctatagagtttcgctcttgttacccagcctggagtgcagtggtgtgatcttggctcactgcaacctccacctacccggtttaagcgattctcctgcttcagcctcccaagtagctggttttacaggcatgcaccaccacacgtggctaattttgtatttttagtagagaccagtttcaccatgtggccaggctggtctcgaactcctgacctcaggtgatctgcccacctcagcctcccaaagtgctgggattacaggctggattacaggcatgcccggcctcatcaattcttaaaattgaaggacatgtataaatgctaaataaaagactggaccatctattagtcagtaggaagagagatgctacaaatgtgtaagtaatcaattgccagaggaattacaggcaacattctccagaagtttcaaaaataggaagagatgattagaggccaggaagattttttaaaaagttcccattaaaaaaaaaaaaacaaacaaaatgtaaaacaaacagcaaaaccccatattataatagcaaatatttcaacgggcttctaagatgatctccactgcaaactcctagtaagttcacctaagtggttatgttttgcagtggaaccttaggtgtgtttcttctttaagaactgactaaaatataaagtctcactattattgattcttccagttacatttagttctggttgataccatacatcacattcctgccatgttcaagacactcttcgggttttcttttttttttttttttttttttttttgagacggagtcttgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtttcgatctcctgacctcgtgatccgcccgcctcggcctcccaaagtgctgggattacaggcgtgagccaccgcgcccggccagggttttcaaatattaaaggataatacagtaccgtggggccttcttgcccgcaactgactcaagttatcctttgctgggtctgaggccagttgaggcaacactgggcttgatgtacctctgggggaaacactgagcccttggtctgctgctgttgtgttagcacccgcacctttcctggtgcaggaggtgttctctcatctaatgtatgatttgcagtctgcttcttttccaagaccttccctgaaactcctttttgtgtagtagttagaatccttgaccttgtgatgtcaattattctagattaagatatgtgcctgttactatgctaatttcataaattcattaacattttaaatgaggttttgaagtattcaagtatatttttctttggagcaatttatacttagctacccagcatgctggattttttgaagaagaggaagttatcgttactttgggatatatttcccaggagtatggtgcaagggccctattttgtggaataacaaggcagatctgtctatcatttattcgtccctttaacatttattgtatgtctactatttgcctggtgtgtttagtactggggacccaattttgaaaaggccttgacttttaaggtattatgtttgccttcttggcgcttcctctttagttgaatgattggtaggcaaacaattacagagtaaagaagtaatatttagctcttcccagggaaatcagggaaggcttccaggaggaggtaaatatttgatccaagactgagggatgtgtacaagatagctggcaatcagaaagcatgaccgtgtagtaggcagaggacctggcatgtgtaaaagcgaggaggcagaagagacaggacattagccatgacctttcagtagtgcagtgttgcaagaggacacctctgctgtggtgtggagaagaggtgagaagccaggccatgtatgcaggaagtgtgtcacaaaaggcttggaaagaagatgattttattctgtagggggctaaagagcattgaaaaatgcttagcaggaaggtgacagacttatgtctgctttcaaaagaagctctgctgtgaatgtggaaaagcagagagcctggaggcaggaagagagacagggagagggcacaggtacctcaggtgagaggcgactcagagccccgcagtggggatagagagacgtgattacaggagatgttttggtgttcacgtatgggatgtagcaggagaaggaagggaatctgcgcagatttctggtttcattgagacacttgagaagatgatggtgttggttattctggtatagagagtagagacaaagtggagatgacctaaatagggagattatttgtgggttcaacacattcatttttacaaatgctcattttatgtttcgtttgtagggttagagatttagagtttagaataaaattacataactcaatttcattttcaaagttctgcaatcaaataagtatatctaatatatgattctatataagtcttgttcattcataatgatgaccagaaagaaaggaataaatacatcatttctaacttggtgactgctgaagacttaaaaaaaaagctcactcatgtttctgtccttctcatgtggcatttttaggatctggtaatgatgctcatgaactaatttgttccctgacagcatatggctgccatctaggtgctgccacggcgttaatgccgatgcgatttaggtctctgagaagataacaaacctaattactaatgcaaggagagagaacatctttctcattaattcattcctaaaaccttgcatttagtttaatgtgattgctaatatgcagtttcaagaattaatataaaaaccacctgcatatgatgctaatggattttgcgaaggtagtagggtgatttgtgagatcaggaggtaacatgcagggggtaaaagaaacagctagaaccacctcaaagtgtttatgtcagtcagtcctgtcgttaattgatgtctgtaatcagtttggttctatacaggaaaatcactatgaattaaaactaagtcattgccacacccttcttacacaggatttatttcaatttataaaacgtgtcaagtgcctaggacataccaggcatgtttaaggtgtttgggacacatcaaagaacaaaagagaccaaaatctttgcatttttgatcttctaattcacggagacagacaatagcccaataactcaataaatccaatctgttagaaggtgtatggaccaaaaaaaaaaaaaaaaaaagagtaagctgggcaggcagactgtcctaattagacaagtgggcagggtaaacctcactgagaaaataagatataagcaaatgctgcaaggagctgactgagtgagcctgtgggaatctggggtagaagtctgcatggcgggggttcatggaagctctgtcaaacagaagggaaggaacgaagataatgccagcttttaccagtgacctcagatactcactgcgcctgagaggttgtgggggcagctttgcaggggtaatgatctgggtgtttcttcttgccttctgcctccactttctaccacacagttgaattccattgctagtgcctggcattggagactattttatgtcaatttcctgtcctgtttcaggttagagatgacaacaagagacaacacccatgcctggtggagttctccaagctgcctgaacaggagcgcaattacaacttacaaatgtcgcttgagaccctgaagtgagtttcttaactttttctattttccaacctgccttccctgaaaaaaaaaaaaaaaaaaaaaaaaacaggtattgatgctatatgttaattgagctgtgaagtgatttttaattccagctagaactttttataatgcataagtggattggatcagtatttgttgagaataagactttgaccctgttaatttatgtcctcttgttctacatcagtattttgcaaagggtgtcctacaggtgtatatgggtattatggatgatgaggattttgtgacctgataggatacaggtccacagaatgtgggctgtggaccgggactgtgtcagtcacaaattgttactggtttgtgactaaataagatattaagagcaagtgtttataaacttctataccaatttagggaagcaattttacatatattgaatctaatgatttaagaaatgtgaggtcatagcctgtatgtcttcattttgaaaattcagttttctctaacaattttattgtattatatcaggaaaaaccacaatagaccaaatattaaaagaaaattagttcttcaccataggtaatttgagaagcactgatttaatatatttaaaagatgctaaattcaaagagttgaataatttaaaattttttgctgatggacttttcagaactttggggtgaagtctgtttatggtatttcctaaactgatttcaccatagcagcctgttttcagagcatacctatgaggactatttatctgagcaccatatctttggttttgttttagttttttaaggagccaaagtcagctgggcatagtgactcgtgcttataatcccagcccttcggaaggccaaggccagtagatggcttgagcccaggagtttgagaccatcctgggctacatagtgagaccccatgtcaacaaaaaatatgaaacttatctgggcataatggcgcacacctgagtcccagctacttggaggctgaggtgggaggatggattgagcctgggagattgaggctccagtgagctgtgatcacgccactgcactccagcctggatgacagagcaggaccctgtctcaaaaatgatagtaataaaaataaatttaaaaggagccagagtcttactgtgttgcccaggctggcgagcaacggcaattcacaggctggatcatggcgcactgcagcctgcaactcctgggttcaggtgattctctggcccagtctgggtatctaggactacaggagcttgccactgcatccagcctgagcacatattttgagaaaagctactgtagagtattttatatcacccagtaaaggcaaatttgctttttagtgattgctgccagttgacctcttgactttgccccttacctttgcagacggaataatgggactgaaatggaataaaggaaggaatataatttcgaattttgatatagaaaagtaaagagaatatttttgcaaagccagtaactttactcttgtcctccttccatccttgatgtcctacagaactggatttgttccaataggtcacttatcctaatatgtttttatattacgtacaaaactctagtcctttttgtttgtttcagttttgttaagagtagtaaggagttatttccactgaaattattttaccagggacccggaacataaaatttaaaccgcatttcaaattctagaatttggactcgggtatatagtcatgagctgcctaacagtgtttgactcaatgatggactgcatatatgatggtggccatgagattataatggagctgaaaaattcctataacttatgacatcacagttgtcataacatcctagtgcaacgcactaccttttctatatttagatacccaaatacttaccattgtgttacagttgtctacagtatttggtgaagtaacatgtacaagtttgtagcctagcagcaataggctatatcgtatagcttaggtgtgtagtaggctctacgatctaggtttgtacgaatatactctataatgttcacataatgatgaaaacacctaaagacccatttctcagagtatatccccattgttaagtgatgtataactctatatcctcaaggatgcagattatcatgtaaataaacacattaggcataagattgagcttagggtctactaggaacttaaaagaaaaagcaatatatacacatcaagtaaattgagaacctaaaggttaaaaatgacaaggtttgcttgtaataaagaatgcataacgagccctgtgtcctgagtacgtggattcagcatctctgatcttcctttgcgctcttgacatgaggcttgtatatttagcttagtaattcatagcagctcattatttcttcatcttttacaacagaatgttttattgaaaggtcaaggtctaacataatttaaatttgcagtgcattccctattattttagcaattgacagctaagccagctatagcagagagtaaattctggactgtagaaatctctgtatttgcatttagcatgttgtgcctttgactattacatgtaatccagtgtcatacctaccagctgctggtggctgatttggttaatcttcagactgcacgtactgtggttttattctctctgatgaatgtaaatcaccctcttcacaagcaaatgcttaacatttctttgttgattttcttatagctagtttatatggttttatgatggactgatttttatttatttatttacaaattgaattaggggaaaacatctgtacttctctaagattcataccatgcccaattccaagggtttagagaaagtacagtactttcttcctatatttcctttattcacttatttaattggcaggccccagagcagcgtagctaagaacacagactctggagttgggtcatctggacttaagggcttggtccaccgaggaaatgttgctggagtcactcaactcctctgaaccctaggttttcttctccttagtagaatgaggatcataatgtatttgcttcatggaattattatagggactaactaataggatattgataaaggctttaacaccatatgtctgagagggagcatagtctaggttttttgtttgtttaataaatatatcatgggagggatgaacagcttcatttgtttacatctttagaagttccaagtaacaaataagcaagaaattattccagaatatcccttattttgggttgaggagcaatttaatgaaatatgaattttgggtgctgtttctgtgatttttttcttatgtaaattgttgacagtgacaacttactttagacttccatcgtcatctgtgtatcgtacggtactgcgaaattgtgacactctcagaacagcacagcttggcagatcatgcctgccagatgaccctcaaatgtgaccagtgttaccaaaggttcagtttctggtttagtttttactattttccgaattccagatcttaatttctgaataaacagctcacgttttagaaataattgatataaggatttttaatcgacatgtaatacacattcatagaatttatttctttggaagttaacaaaaatatagtgacactacaatgatatttttcctcctagccaagtatttttcctgaaaattatttttagatgatgtagtgtgcttgtgcacgtatgtggtgaaggatgggaggaatagtagggacccaggacacagggatggagaggaaagcagtatggaagggagacaaataactgataaggggagaggtggaatttttgtccaagagagcaagttagtttctcatacctcttttcctcctcctcctccccctccctcccctccctccatcacccaccccttccctccccttcccctccctttttttccttccttccttccttccttccctcccctccttctccttcttctcttcctccttctttctccttccccttcttcctcttcttctcctcctccttcctcttctccttcccctacttcctcttctcctccttctcctcctcctccctcttctcttcctccctcttctcctcctccctcttcttctcttctctcttcttttccttcctcttctcctcctccctcttctccttctccctcttctccctctccctcttctccttcttcctcttctccttgctcttctccttctcgctcttctccttcttctcctccctcttcttttttctcttcttcttcttctctttatctttctcctcctttttctgtctcttcctcctcctcctcctcttcttttttctctttggtttcttgctggcaacaatcttcccaacttacttacttatttatttgtttgtttgaaggagtctcgctctgttgcctaggctggagtgcagttacgcgatctcagctcactgcaacctctgcctcccagattcaagtgattctcctgcctcagcctcccgagtagctgggattacaggcacctgccaccacctctggttaatttttctttcgtatttttttttgtagagatggggtttcgccatcttggccaggctggtctcaaacccctggcctcaggtgatccacccgcctcagcctctcagaatgctgggattgcaggcgtgagccactgtgcctggccaatcttcccaagttctaaatgttgtgaatctttatgttcagtcctgggccatttcttctcagtgtgcaagctctctgaaggtattctcaccactccactccgtgacttaattaccacacaggtgctgatacctccccaaatatccatctctaccccagacatctgctctgagtgacggaattgtttgtcctatcattccattgacattttcccctggatgcatcagaagtgacctagacctatatagctttatgtcccctgtatttgcatttagggtgttgagtctttcaacatgccaggctattcatcctgctacacatgccaggaacctgggaatcacctttgactcttccctttgtttcattcctacttctagcccattatcaggtccccccaagtatacgtcactcttcctccatcctgcctttccacagcagtcagtctggtccaagccaccatcatctgtcacccagactaccatagccatctcctaactggtcctcccacttgccgtctttattctgcacacagcagcctgagttcatacacacacgtgcattcattcatattttgcttaaaactgttcaatggcttcccatggaacttggagtctgatatcttcacaagtgtgtgcatggcccagacaatctgacacccctcctgtttgtcatcatgccttgcaccactctttgccttgttccttatgttccagccctcatggtctcttcctgataatgagttaaactttttcctgcctcactattctgttccctttgcctggaaaattcttcatttcacccttaaaggatctcctccctactcatccctcaggccttcatttaaatatcacttccctgataagaatttcctcaccacttccttcacttcctttataacacctgatagtgtgtttataactcaccacaatttgtaatatcactttctgaggttatttaatatttgcctttccttctagaccaggggtgtccaatctttttgcttccctgggccacattggaagaattatcttgggccacacacaaaatacactaacactaatgatagctgatgaactaaaacacaaatcacaaaaagatctcataatgttttaggaaagtttatgaatttgtgttgggccacattcaaagccatcctgggctgtgggctggaaaagcttgttctagactgtaagctccatgaagccaggaactataattaaaaaaaaaaaaggttttattttttagagcagatttaggttctcagcaaagttaaaagaaagatacagagacttttcttatgccccctgtttccacaggcaactgccctcaacagagtggtacatttataacaattgataaacctacattgacacatcattatcacccaaagtccacagcatgattttttttttaaattcacaatcatgtacctagtcctcaaaaggtatccagcgcataacattctcagatgccaacttgcttagatattgcaaatgtacctcaaactttgtgacttttttataccttcaaatctcaggctcctttcagtgtccttctcttgttgtgttaagtgcccctcagaacacaactcagatatctgggagtcatcctggacacatcccttcccttcacccatggctttctattgatatgttaatctatcgacttctttattttcttccattattaatgttactatcaccacatcatcaactccaacatgattgccaccctatgctaacctagtctaagctaccattgtttcccacctgaaattataatatcctcccaacagatccaattgaaatacaccctagatactctcttttctattgtttttttttgcctttttaaaaattgtacaaatttacagggtacatgtgcaattttgttacatgcataaagtaacaaaagtcaagactttgagggtatccatcacccagttaatgtatattgcacccattacgtaatttctcatcatctactcccttccaatcccctcactcttccaagtctccatgaattgtcattctactctctatgtccatgtgtgcacatttttttaacacccacttgtgaatgagaacatgggtatttgcctttctgggtctagcttatttcagttaaaataatgaccccagttctaatcatgttgctacaaaatacatgatttcattcttctttactgctgaataatagtccattatgtatatatgccacattttctttatccattcatccattgatggacacttaggttccttccatttctttgctgatgtgaatagtgccgcaataaacatgcaagtgcagatgtctttttgatatatggatttcttttccttcgggtagatatccaatagtaggattactggatcgaatggtagttttatttttagttccttgacaagtttctatactattttttcatagaggctgtactaatttacattcccaccaacagtgcataagagttcccttttctctgcatcctcgccaacatctgtttttttgtttgtttgtttgcatttttaagaatagccattctgactggtgtaggatgacatcccacctgggttttagtttgcatttctctgatgattagtgatgttcagcattttctcatatacctgttagccatttgtatgtcttattttgaaaaatgtctattcatttcctttgcccagtttttaaggagactatttgatgcttttcttgttgttgaattgtttgtttcttgcatattctggatgaatgagtagtttgatgtcagatgaattctttgcaaatattttcttgcattctgcaggtagtctcttcactctgttgattctttctctcactgtgcagaagcttattagtttaaataggtcttgtttgtctatttttgtttttgttgcctgggtttttgacgtcttagtcataaattctttgcctagacaaatgttcagaagagttttccctagattttcttctagtatttttataattttgagtcttttgtttaagtcttaacccatcttgagttgatttttgtacatggtgagagataggggaccagttttactcttctgcatatggccatccagttttcccagcaacatgtattgaagagtgtatcctttctccaatgtatgctcttgttggctttgtgaaagccaacaaatatggctgtaagtatgtagctttatttctgggttctctattctgttccattgatctattcatctgtttttctaccagtaccatgctgtgttggttactatagccttataatagaatttgaagtcaggtaatatgatgcctccttttatttacccctcaggattgctttggctatttggactctttcttgttccatttgaattttaggattgtttttccctaattctgtgaaaaatgacattggcattttgatatgagttgcattgaatttatggattgctttgggcaatattgtcattttaacaatactgattcttcagatttttgatcatgggctgtttttgtgtttgtttgcatcatctataatttctttcatcattgttttatagtttctcttgtacagatcttgtacacctccttggttaaatatattttaattaggtattttaggtatttcaatgaggtattttaatttttatgtggatattgtaaataggattgcctccttgatttgtttcttagttagattgttactggtctatagatatgctaccaatttttgtacattgattttacatgctgcaactttactgaattccatttatcaaataagagttttttgtggcatctttaggttttccttgacataagatcaaattgtcagcaaacaaggataattagacttcattttttccagtttagatgccatttatttctttccattgcctaatttctctcactaggcctttcagtactgtaatgaataggagtggtaaaagtaaatatccttgttttgttccagttcttacagggaaagttttcaactttccccattcagcataatgttagctgtgagattgttgtatatggcctttattattttgaggtatgctccttctatcccttgtttatggagagttcttattatgaagcgatgctgaattttatcaaatgctttttctgcacctattgagatgctcatatggtatttgttgttggttcagtttttgcgacgtatcacatttattgatttgcagatgttgaaccatccttgtgtccctgataaaaacccacttaactcctgaaaacatgcagcctccctcccaagactgaaccaggaagaaattgaaaacctgaacagagcaataacaagtagcaagactgaatcagtggccaggtgcggtggctcatgcctgtaatcccagcactttgggaggccaaggtgggtggatcacttgaggtcaggagttccagaccagcctggccaacatggtgaaaccccaactttattaaaaatacaaaaattagctgggtgtgatggtgcacaccagtaatcccagctactcaaggaggctgaggcaggagaattgctttaacctgggagacagagtttgccataagccgggattgtgccactgcactctagcctaggtgacagagtgagactctgtctccaaaaaaaaggattgaatcagtaataaaaattgtcccaacaatgaaaagcccaggatcagatggatttacagatgaattatacctaacatacatagaactaatatcaatcctcctgaaactgtttcaaaaagtcaaggagcaggaaattctccctaaccgctctatgaagccagtatcaccctggtaccaaaaccagacaaaggcacaacaaaaaagaaaactacagaccaatatccctgattaacatagacacaacagtcctcaacaaaaataccagcaaacaaaatgcaatagcacctctagctattctgtactttgtagccagtgtgttcatttcaaacattaaggtgaccatgtcaatctttctatttaaaatcccttaatggggccaggcacggtgggtcacctgaggtcaggtgagcctgtaatctcagcactttgggaggccaaggcaggtggatcatctgaggtcaggagttcaagagcagcctggccaacatggtgaaaccctgtctctactaaaattataaaaattagccaagcgtcatggcaggtgcctgtaatcccagctgctcgggaggctgaggcaggagaattgcttgaacccaggaggcagaggttgcagcgagccgagatcatgctgctgcactccagcctgggtgacagagcgagactccatctcaaaaagaaaaaaaaaattaaatacataaaaaaaaataaaatccattaatggcttttcattgcttttaagttaaatatggtgctttaatttgccaaagtatcccaaaatctggggcctcccctctcaccagcctcattataagtgaggctgcccttgtactcttgcttgcagtcacactgacctttgtgttgcttgcctgtccacacattccattccaccacaagatcttccacacgtcctcttcttggaatgctcttttctttttttattatactttaagttttagggtacatgtgtacaacgtgcaggttaaatatgtatacatgtgccatgttggtgtgctgcacccattaactcgtcatttaacattagctatatctcctaatgctatccctccccgctccccctaccccacaacaggccccagggtgtgatgtggaatgctgttttctatgcctggctctcatcctttggatcagggctgtccaatcttctggcttccctgggccatagcagaaaaagaattgtcttgggccacacataaaatacactataatactaacaatagctgatgagctaaattttaaaaatcacacaaagaaatctcataatattttaagaaagtttatgaatttgtgttgggccacattcaaagagctgtcctaggccgcatgtagcccgcaggctgcgtgttggacaagcttgccagatctaaggtcaggttcacttctttcgaacatgttgtctgagttccttgactcaacaattttacttctataggtactcatcctttctgtactcccagtatagaagctttccctgtgtgtgggaattacatggttgcctctgtactccaccgaccatatgtttcatgacagcaggcatctcacttgatttttgttaccatttttcaaattttacttagagctcagtaaatattcatcaaatgaatgaattaataaataaatgataaatctcagtcagtaactgggtttttacataccaaatgcctacctacagggtgcctcacatttgcttcctaacagtctgtttacttttctgcagctatatagtttaagtactaaaatgctacattaccaatccctactgcttaatctagtagtaaatatttactgaatgcatgtaaggccaagaacctgctcccaactaatcctttcttgcttcccttattttgtgcttttctagcctttctatcagctttgcagttccaacttatagtgtgctgtttctctcaccacccttcagcagacttaaaaaaaaaatgagttaaacaatgttaaatcatcaaataaagtggttcaataaagatgatacagaaaccaaacacttcattcaaacaaagaacttgatatggttgtagtgttaataaatatattttaaatataatccattgctcccattttaaaacctcctaggattgggcaaagagtacttagatacaatatccaaaacatgacctattaaagaaaacagtccatccattggagttaattaaaagtaaaactttctgtacttcaaaagaagccattaagaaaatgaagagacaggccaccagctgggagagaatatttgtgaatcaagcacaattgtattaataggatttgtagtaaatcataccaatcctaacaaaggacttgtatccagaatatatatagaaatcttataactcaataataagaatacacaaaacctgatttaaaaattggcaaaacagctgggcatggtggctcacgcctataattccagcactttgggaggctgagttgggtggctcacttgaggtctgaagttagaaaccagcctggccaacatggtgaaactccatctctactaaaaatacaaaaaaagtagctgcacgtggtggcaggcgcctgtaatcccagctactagggagactgaggcaggagaattgcttgaacctgggaggaagtggttgccgtgagccgagattatgccactgtcctcctgcctgggtggcagagcaagattctgtctcaaaaaaaaaaaaggcaaaaattggcaaaatactttaccaaagaagatacacagatggctaataaagtgcaatcaaggatgttacacatcatcagtcagaaaaatacaaattaaaaccataagaagatactaccttacacacaataaaatggctataatttttgacagacataccaagtgttggtgaagctataggaaaactgaaacccacatgtattactgcaggcaatgtaaaatggtgccaccactttggaaaatagtttggaagtttcttaaaaagttaaacataaacttaccatagcctagcaattctactcctatgtatctactcaagagaaataaaagcttatgtccctgcaaagatttacacgtaaatgttcacagaagcattattcataagagccaaaaactggaaactgtgcaaatgttcatcaactaaggaatagataaaatgtgatccagtattacaatggcatattattcagcaataaaaggaaacaaactactgccacagactccaacatggatcaacctgaaaaactttatgccaggtggaaggagccaaacacagaagactccatattgtgtaattctattcctatgaaatgcccaaaacaggcatattgatagagacataaagtagcttaggggctgtctggaggtgagagtgagaaacgcctgcagcaggcatgggggacctcatgggctcgtggaaatggtgcaaagctagattgtgctgatagtcatgcaactctataaatttaataaaaatgaaaataatcagcctctaaaaagtacattttctacctgatgacttctaactttgctattctgcagaataacctttagcagctcctagtccattcacataagtgtaattccctcagcatagcatatgaggccctcacttaatgtcttaatcagggttcttgagataaacagaaccaacagggtgtatgtatgtgtgtgtgtgtatatatacatatatatatagacatatatgtatatacagatatatatagagagagattccttaaagaattggcagggtgctggcaaaattcccttttgctcagaaggtcagtctcttttttctgttgagacctttcactgattagttgaggcccagtcacattatggaaggtagtctgatttacttaaagtgcactatacttttttaaaaagtttagtatttaattttagaatcagagggtacatgtgcgtgtttgtaacataggtatattgctatgtacagagatacataggaatttacctatgtgcgttgttacataggtataatggtgggaatttagattctaatgaacccattacctaaatagtcaacattgtacttgacaggtaatttttcaacactagctcccctcctgctctccttgctttgaagtccctactatctattatttctgtctttatatctgtgtgtatccactttgcttggcccccacttacaagtgagagtatgaagtatttaattttcttttaaatgatgaggataatggcctccaactttatccatgttgctgcaagaaggacatgatttcattctttttcgtggctgtatagttttccatggtgtatatgtaccatattttctttttgcagtcaacagttgacagacacttaagttgattccgtgactttgctattgtaaatagtgccgcaatgaacatgtgagtgcaggtgttttttttgtttgtttgttttttgtttttttgacagagtcttgctctgttgcctaggttggagtgcagtggcatgatctcggctgactgaaacttctgcttcccaggttcaagcaattctcctgccacagcctcccaagtagctgggattacaggtgtccaccaccacgcctggctaatttttgtagttttagtagagacggggtttcaccatgttgttcaggctggtctcaaacgcgtgacctgataatgatttcttggacagatgcggtggctcactcctgtaatcccagcactgtgggaggccaaggccggtgaatcacctgaggtcagatgtttgagaccagcctggccaacatggtgcaaacccatctctactaaaaatacaaaaattagctgggtatggtggtgagcacctgtaacctcagctactttggagactggggcagtagaattgcttgaacccgggaggcggaggttgcagtgagccgagattgcaccattgcactccagcctgggtgacaagagcaaaactcctcaaaaaaaaaaaataataataataaatataatgatttcttttcctttgggtaggtatccagttgtgggattgcagggctgaatggtagttctatttttagtttttggagaaatattcatgctgtttcccaaaggggttgaactaatttatgttcctactaacagtgtataagctacatcctcacccacatcttttattttttgactttttaataataaccattctgactggtgtgagatggtatctcattgtggttttagtttacatttttctgatgattggtaattcagatcattttttaatgtgtttatttggctgcttgtatttcctcttttgagaaatgtctatttatgtccttttttctttcttttcttttcttttttttttcaggaccagagtctcactctgtagcccaggctggagtgcagtggtggatcataggtcactgcagccttgatttccgagactcaggcaaaatttctgcctcagcctttagagtagctggggccacagatgtgtgccaccatgcctgattaaactttgaattatgtgtagagacagagtctccctatgttacccagactggtcttgaactcctgggctcaagcagtcctcctgcctcggcctcccaaagtactggaattataggcatgaaccaccatgcctgaccctttggccggtttttaatacagttgtttgtttttttcctgttgagttgtttaagttctgtgtggattctggatattagtccttcattgggggcataatttgaagatactttctcccattctgtaggttgtctatttactctgtagattattttgctgtgcagatgctttttagtttgattaagtcccatttgtctatttttgtttttgatgcatttgcttctgggatctttatcataaactctacctaggccaatgtccagaagagttttttctaggttttcttctaggtcttacatttatatctttaatccatcttgagttaatttttgtacatggtgagagatagaggtgcaatttcattcttccgcatatggctagccattttttccagcaccatttattgaagaggttgtcatttctccagtgtttatttttgttaactttgtcaaagatcagttggttgtaggtatgtggctttatttttgggttctgtattccattccattgatctatgtgtctaattttgtaccattaccatgctgttatagttactatatccttatatataagtcaggcaatgtgatgcctctggatttgttcattttgcttaggattgccttggctattcggactcttttttgattccatgtgaactcaaagtgtagcaatttaaatgttaatctcacccaaaaacagcttcacagaaacatctggaataatgtttgactaaatgtgttggcactatgccccagccaagttgatacataaaattagccatcacacataatgagaaatatttatgaagcatatagtgcaccccaaacttaccccagtatttctttttacccttaacctatagtacacggtcagatcttaatactccagtcaacccttctctgcccctcccacacagacccacgatctcctgcttctgtaggttgtctgtcttattcacctacctgaaatatttgcctcttcatctctttatcctttattcccacatgtcttcatctttgaaatgtttaattatccttcttggaatatcttaaagatgcttctaaaacatgtaactttttaaaatgtggaaccctacttggttttattataattcttcagtcatcatcttttctcctatcagactgtaaacgctgtcaagagaaacatgtgcagtagtactcctgaaaatatcaaatggaaaactttagaaataaacaatgtataagttttagattgcatgccattttgagcagtgtgatgaaatctcacgccctgctactttgtcctgcccaggatgcgaatcatcgctttgtccccctggcccatgctgtataggctgcctacctgttagtcacttagcaaccatcttggttatcagcttgattgtcatgacactgtagtgcttttgttcaagtaacccttattttatttaataatggccccaatgcacaaaattaaagatgctggcaatttgaatatgtcaaagagaagccataaagtgcttcttttaagtgaaaaggtgaatattctcaacttaataagggaagaaaaatactgtatactgaagttgctaagatctataaaaacaacaattcttctgtctgtgaaattgtgagcagtatgttgttataatagttctattttctattagttactagttttaatcccttactgtgtctaattcatatgttaaattttagtatgtatcatagtatgtatggataggaaaaagtatagggtttggtactatctgtggggttcaggcatccactgggagtcctggaacatatcagccatggataagggaggactactgtactacagagtaccttagatatggtggtaactcaataaatatttatggacttatatatttatgcacatgtggtctattatgttcactgtccgtgtgagttgaattcatacttttctaggtagtttgcattgggaagaagattatgaggctgaattaattagttatgagaagattatagtattgatggcataaaacactggctctctctcagaagcccttaaggatgaattaactaattacattttctatggctcaggcttacttttgatgtcagtacaccatgtgactttgtctctcggtctggactcacattaactacattcctggcatgtcacactgaggtactgatttgcagtgataataactgtcttataatccaaaatattcatttttacagatcagcttgggaagacacattatcatcagaagatttcttggtgggcatgtgctcaaaggtttaattgcctgagtttatggtaaatcctaatattatgatcaatcttgagttctctcagagctgggttggacatccctctttgatacttttacagccttgtgattacctcattgccctgaagatactatcataattgcctgttgtctgtagcacagggccttgcacatgatagcactcagtagatatttactgaatgaataaataaaggaatggagggtgctggtaaaatcttcctgtcctctggatagtgtctgaataagtgtaatctatatttgttcctgtgagttcgttttttattttattgctgatcaatccctttcaacgtgcacattctttattcagcttattttgtaccttcaatcagctcttggtcttcccatagttttgcaatttaacgctagaaagataatttcatggggttattttaattttttcatatataacaaaatttaactgataattgtgtgtgtatagatggatagatacccatatgtataagcttatatgtatctgtctaaatggttaagcttatacatatagatacttgtctatatggaaatacatatatataatgtacgtatatgtatatacatataaccatcaacctatccacacattattaaaatattatagagataagtattatgggttttagataattcccacattcttactagaactgatcagaccttagaaattctgtaatcccaaaatattatgccgttatttcttactctatcaaggcaggagaaaccactcagtgccgtgggtactaaagacaaattgtctcaaaatgtctcctgtatatacgcatttctataaaaggtaaaacaataatatcatacacacacacacacacacacacacacacacacacacaccacgtatatctgctttagtaggtacatagactccccagcaggatatcgaagaattgttaacaattgatgcctttagaggaaggaaacagaattagaagaagttggagggagacttacttttcagtgtattcctttttgtgccatttcagttcgcagtgtcttatcccttactcagaaatgaataattagcaaatcagtaaatgttcctttcaccttaaaaacaagacttctgactgggcgcggtggctcacacctgtaatcccagcactttgggaggccgagatgggtggatcacgaggtcaggagatcgagaccatcctggctaacacggtgaaaccccgtctctactaaaaatacaaaaaattagccgggtgtggtggcgggcacctgtagtcctggctacttgggaggttgaggcaggagaatggcgtgaatccgggaggcggagcttgcagtgagccgagatcgcgccactgcactccagcctgggcgacagagcgagactccgtctcaaaaaaaaaaaaaaattgtgctttcaaggttgtatctcattgctactgctgctgtcttgggttattctggacatagagaagaaatgatcacacttatctctggttttgttttccaggactttgttggcattaggatgtcatgtgggtatatcagatgaacatgctgaagacaaggtgaaaaaaatgaagctacccaagaagtaagttgaatgactaagcaatattaaataatctgtgtagagatttagtgcaaccaaataactcttgatggacacacagatgccttgcttttactgaagctttaaaattcagattcaaggctgggtgcggtggctcacaccttaatcccagcactttgggaggccaaggcaggtggatcacctgaggtcaggagttcaagaccagcctggccaacatggtgaaaccctgtctccattaaaaatacaaaaattagctgggcgtggtggcaagtgcctgtaatcccagctactcgggaggctgagacaggagaatcgcttgaacttgggaggcagaggctgcagtgagtcaagatcgtgccactgcactccagcctgggcaacagagtgagactccatctcaaaaaaaaaaaaattcagattcaaaaatttaaactaactgaatgaccctaggggttacattaagtatctggtgaaacaatagtttctatcacattgctgagtgatgaaacaaagctcagaatatatttgggagtgtgttataaaaattgtgttattttcccagtgtgtgtttatatgttaacagaggtatccatatttctaaatgattacatatagctttctactttctgcccaaaaatctttataattttatttacttttacaataaaaatatattcgaggattaattatgaagtcagcattattatccacattttaagatgagaaaattgaggtagatagatgctgtagtactggtttggcctgctgttctatgacctatgtttgtgatcctggttcacttaagacctcacctttctcatctgcctgtgggcattagtaatacctacttaacagggaagttttaggtattaaagaaatattcaataaatgatagctgtttcatattactttcttatttatttaaacttaagtattcaagctgcttttctgatgtgcaggacttgtaagtagcaggcctgtagatgtattaaataatagcatcgagatataatcaaagtagccaccccataatctctatcagtcacctcaggcctcatgttaccccagaaaaacataaaatccaagtagaaattgtgcttttgctgtgcaaatgcagatttaagcaagtctctagttcaacagtctatgaacatttttactcaggtgctccataagtgagtttataaaaactgtattgttacctcgtgcagttttaggttctaaaatttttcttgaaaatttaaatagttccaaaagatgtgttttatgggtacattttgcatatttacatttcaaaatgacactttttcatcaactttgagtgtatcttatgagcacagaccacagtgttcagatatctgccatcatctgtgtaaaaatgatataaaaatgttgataatggagaattttacattatttcattttcctttttcaactgtattttcaaattatttctcctactgtatattatgctaataatcaatgttttatgcttggcagtctttgagtactctatcctacattataagtaagatatgtatctaaattgaatttttaattgtttttgttttctgcgatcatagtcattaagttaaaattttcctcctgagttatcattatattattttagtacacaggtgctcaaaacaacataaattgtttttaataaaaagtcatagaaaataggatgttattggaaatagctcatagtaagatggatttaggtattctttatccaattacattatgtattcacgtacaaataatatttattgatagagtcaagttggcagagtggttgcattcttcgttcacataaataatttttgttattaaaaagatcattgagttaagttaaccaaaaaccataattgtttattatgaaaaatcatatttaatgatttttttcagggtgacagctcaattatgcctttgttcagtttcttgaaagccaaaaattggaatctacctaacttccaaaagaattcattatcctctcattttcattatcctcatcctttccaaaccactctcaggttttttggaaagtatccaaaaaaggcattattaaggctaaaacagaacaaaaccaaaaaccaaaaaacaacaacctagtaattatacctgttactcttttactcagaagaataagaaagtagaaatgttaatttcacattatctttgacagcataatacatttaatcaattgtatcaaatgctatgcgtgagtgtgtgtgcatgtgtgtgtatgtatttgggatacaattcaacttatttcatgtatagattctatctgttataaaatctaattgataaaggcagttttcactgacaaaacaatcagctaaaacagaattatcttttgtcaaaaatatctggttgtatttttctgttgaaacaaatgggttaatacatgtccccatgacaatcatctcaattccaatttctaactttaagataggtagatgatagattgatagctagatgatagacagatagatggatggggcacagggtttaaaaataagtttgtctcattgaggaactaatgtcctctgccttgagtatttattaatgcatattccttgtgttgctctcacaacgcaacacagcaattatttgagagtgggtgaagatatggaaaagctgagacccttaaatgaaaactatacttggatctgctgacagtctatatactgtctctaaattttccatgagatatcattttattctttctctattgacaaaaatcttcataataactggtattgatatgtatgcagatcagcgcgagcctaaaatgttggggttttttaacaaccattttgcaagcaatttggcatcattgtgtaaaattgaacatttgcacgtcttggtacccaacagttccactcatagagatataccctagagacagttcgcaccgacgagcaggcaaactatcattcatagcaatgttatttggaatagctaaagaataagggggtagttataggaggtggaagaaatattcttcaataagaaaatgaatcaagttggctatagtctaataataaaatcacggaattataaatgacaccatagatgaacctaaaaaataataagggtgtaaaaaacattctacaagggtgatgcaatgtaaaaccatctttgaggctcaaaagcaagtaaaactaaaaaataaaaactaaatacatattttggagatacatacttcgataaggactgacttttaaaaatcaatgaaattataattctagatagtaattatctttggtataaatataggcagggatgtaagatggggagcaacacacagatagatgtaatgttagtaatgttctaattgttaacttcgtggtggattaatgaagttaattttattataatgctttgaagcatatacttttgtagttattttataatgattttttaaaataaaaatctgatgacagatgtaaatccagatacaccattagtcataacaaatgtacatggtttaaattctccatgtgcgtaacagaaattgtcagattggattcaaaaagataatttatgatatacagctataagaggtacatcaataactttagaacatagaaaagttgaaaatagtaagaatgacacactaggcaatactgctcaaaatgaaactgatgtactctccttttatcagtttctaaataaaattgaccttaaacaaaattaatattaagaaaagaaggccactatatggagaattgagaaaacaagcatcatgctataactactcatgtatacaccaagtaaaacagcttcaaaaatcaatgaagaaaaatactagtagattttcaaaaagaaatagacaaatatgcaatcacagtgatagacctaacacaaatctcagaaactgatatgtgtaacagataaatgttaacaaagattaataaaaatataaacacacaccaattaaaagcttgacatatatagagtgctgcatgcatgaaacatttataaaatttagtatcctttaggacattagacactgatatcgtaaagatcatatccactggatcacaaagaataacagcaaaaataacaaatcatgacacacttagacatttaaaaatatacttctaaataggttatggatcaagcatatcatctggaaaattatttacttatttaccactctgcctttgtttatttctagttaaaaagataacccatatttcttgatcttgctaaatgaacctatccttttttcatgcctttatactcttataaatggatgattcaaaaccagatttttaaaaagctttttaatattttggtttcatttattttattttttaggttgatgaatatgaattgcctatatttatggtataccacatgatactttgaaatatgtatatgctgtggaatggctaaaccaagccaattaatgtatttattacctcacataatccctttttattttgtgagaacacttaaaatcaaatctcttggcaagttcaatatataatacctcattattaactatattaaccatgctgtacaatagatctcttggatttatacatcatggaaattgtaaaacaataatggaaaaggaaaatatttcatattaaaacatgaattgcatatattaagtattacttggagaaagtaaaagaaaataaattataataagagcaatattaatgaatttggtgggggcgggatgaaatataaacaccaatgatgccaagagcctgttttaaaaacctactaagcaggggaaaaagactctgaaaagattgacaaaggaaaaagaaaaaacaattttgttagcaaacttaggaatattttgaaaaatgtaacaaatgtacattaaaactttctaaaggtaaaagtatggacaattgtatagaataatatcaaaactgatccaataagaaagaaaatacgaatagagctataactattaaaggaattgaatcaaacacacatacacacacacacacacacacacacacacacacacgtcccaaacaacttttctattgatttctaccaaatacaatctcacataaagaggaagaaacacttcacagtttattttctgatgatatgattttcatatcaaagcccagatcaagacagtatggaaaagggaagttatagtccattgctattatgagcatagatgcaaaaatgctaaggaacatactggcaaacaactcagtagtgtattaacaaagtataatatgaccaagctgagtttatcctagtagtgaaaagataggttaacattagaaaatgtatccattaaattgatgcttaataaagacgaaaattcatatgatcatcccaatgtatttagaaataaataattcataagatttttttatttataagcatataaactcttagaaggcaatactctgagagatttctttaacctaacaaggggcaacagaaaccaataatctataaggtaaaatctcaaatttttcctttaaggtttaggaatgagacaatataagtcactactacttgatgtattcaataaggccagtgcagtgagacaagaaaaaaatcatgaggcttggaaaggaaaaacaccaaattgtcatcaatagcaggtaatattgcatagaaaactcaggagaatttacagaattatttctaacaataataggacgcttgaccatttccttaaccttgctttatttctttttaagtgtgcttctgcacttgatgttatttatgtttcatgtcctctaatctgaaatatgcacttgctaaaggaaaaaaatctgtgcatcaaaagcatctgttaatcccagcactttgggaggccgaggcaggcggatcacaaggtcaggagattgagaccatcctggctaacacggtgtaaccccgtctctactaaaaaatacaaaaaattagccgggtggccgggcgtggtggctcacgcctgtaaccccagcactttgggaggccgaggcgggcggatcacgaggtcaggagatcgagaccatcctggctaacatggtgaaaccccgtctctaataaaaatacaaaaaaattagccgggcgtggtggcgggcgcctgtagtccctgctactggggagactgaggcaggagaatggcgtgaatccgggaggcggaggttgcagtgagccgcgatagtgccactgcactccagcccggacgacagagcgagattccgtctcaaaaaaaaaaaaaaaaaaaaaattagccgggcatggtggcaggcgcctgtagtcccagctactagggaggctgaggcaggagaatggcgtgaacccgggaggcggagcttgcagtgagccgagatcgcgccactgcactccagcctgggcgacagagcgagactccatctcaaaaaaaaaagacttgcagaacaatatcaagaactcctaaaaattaataaaaagatgcccaaatagaaaaatgagcaaaggatatgaacataattcataaaaaacccctgcagatccaataagcatatgaaagacactcaacttcagtactaatcaaggaaatgtaaattaaaatcacaatgaaaagctatttcacccccaccaagtgagaaaaaatggaagactatgtaaattagtacaaccactatggagatcaatttagcctaatcttataagacccatttcttttccagaaataaactttagagatacttttgtactcatgcaaaacaaacctgaaaagaatattcattgcagcatagattgcaatagcactgaattggaaacaatttaaatttccaccaaattcccatcaatccctatacagttgtttttttgtttgttttgttttgtttttagatggagtcttgctctgtcacccaggctggagtgcagtagcacaatcttggctcgctgcaacctccgcctcccgggttcaagcaattctcctgcctcagcctccctagtacaggcgcccgccaccacgcccagctaatttttgtattttttagtagagacgggatttcaccatgttggtcaggctggtcttgagctcctgacctcaggtgatccgcctgccttggcctcccaaattgctgggattacaggtgtgagccaccgtgcccggcctaaatatagtttttatagattcatctaatggcatactatagagcagttaaaatgaattaactatagctagatagattcaaaggacaaatctcaaaaatactccttagagccaaaaaacaaaaaaagcatgttaccaaaaagatgatacagtgtaatactgtttaaagtttaagaacataaaatataattctacagataattcatagagccagatatatggaagaacactataaaaatcatgtctaggaatagtcaacttcaaattcagagtaataattctctctggggataaggaggggattggaattgaggtgtaacagaaggagagcttcaagtgtattcactatttttgatacttttgcataggcctggaatttttcatagtaataacaaagaggtgattgataacagaaaccaggttttaatctacttaaaaaaaatgttggtggaaaagaggagataggaggaatataactagtctttaggaagttcaggccaggagcagtggcttacgcctgtaatcccagcactttgggaagtcgaggtgggcagatcatcagaggtcaggagttcgagaccagcctgggcaacatggtgaaaccccgtctctactaaaaataaaaaaaaaaaattagccaggcatggtggtgaacacctgtaatcccagccactcgggaggctgaggcaggagaattgcttgaacccaggaggcggaactttcagtgagccgagatcgtgccactgcactccagcctgggtgacagagcaagactctgtctcaaaaaaaaaaaaaaaaaaaaaaaaaaaaaaaaagggaagatggtattgatggtattcgtttcagaaggaaatggtgtttaaagaagtttttttttggccaggcctggtggctcacagctgtaatcccagcactttgggaggccaacgcaggcggatcacttgaggtcaggagttccagaccagcccggccaacatggtgaaaccctgtctctactaaaaatacaaaaattagctgggcgtggtggcacaacctgtaatcccggctacttggtaggctgagccaggaaaattgcttgaacctgagaggcggaggttgctgtgagccaagatcataccactgcactccagcctgggtgacagagtgagactccgtcacaataaaaaaaattaaaaaaaaataaaaatttgataaagcataggagacacatgagcatgtttatgtaaatagtgggaagaaaccagggggacgagttttaaaggagagaggtggtgattgagagcaaggtttcttatttccatccttgtcctggtgtcttgaattctacatttcaagggacttagtactgactggattagggagaacaagacataggcataacctagcggatgactttaaaggtccattcttctgaacattctgtatggatgcacaggccatataacctagatacaacctagatacactgataaaagtcatagattagaaattgtcttagctttccttaaaatgtattatttaagcaaaatataatgttcacaagaagattaattttgggttaaaatcttgataagaaccagtattgttttctaccaggtttacctctgtcatttctgagtttgactctcacttccccttgctgaaagcatgtatttcctgagtgccagggttttatatgacacacatatgcattttaagttgcttttgtgtaactattagaaatatggtcgattcctacacgcaacccttgggctatggtctatgaaagagcagtatcatagcagaataaccttttcatagcccacaatatttctactgctgtctcttttgcatatattttagagacattttgataatcggtcaagttcaatatatcaattggaattaaatgctatattccctattaaaaatagctaatttttgtactgtgcagccagtggagccggaaatcattatcctcaataaactaatgcaggaacagaaaaccaaacactgcatgttctcacttataagtgggagctcaacaatgagaacacatggacacagggagagggacaatacacactggagcctgtagggagtggggcatggggagggagagcattaggaaaaagagttaatgcatgctgggcttcacacgtagttgatgggttgataggtgcagcaaaccaccatggcacacgtttacctatgtaacctgcacatcctgcacatttaccccagaacttaataaaaataaaatgtttttttaaaatagccaatttttgtgtacatcttgcacatgtaccccagaacttagaaataattttttttaaatagccaatttctgatatataatagacataatttaatggaaaattcttaagaaattttgaagaatggatgattcgttgtagtttttttctttcctcctgtgcctctttttctccttcctctcaaaacaaacaagcaaacagtgaagagcacaacacattatcatctattcttaatttcacgcatcttccctcatttattgcagctaaactcttgacacactgcatagtttgatgagcctagagttaaattattatagcaataaagaaatacgcaactgaaaaacaatccactcactccaagagcttgtggtcctcactatctcatatgcctaattgagtgtttgagattgttcgaaaagctgtagatttaaatgaaaataaaatcctgtctgaatattaatggcattcatttaaactttcatttagcacttatctattatgaaatcaacacaaaacacagtaactcaaaggctgcttgagtgtttaaaagcctattagggctgagcacggtggctcatgcctgtaatcccaacagttgggaggccgaggcggtcagatcacctgaggtcaggggttcgagaccagcctggccaacatggtgaaactctgtctctactaaaaatacaaaaattagccacgcatggtggcaggtgcctgtaatcccagctacttgggaggctgaggcgggagaatcacttgagcctgggaggcagaagttgcagtgagctgagatcgcatcattgtaatccagcctggacaacaaaagtgaaactccgtttcaaaatattaaaaaaaaaaaaaaaagcatactaggatcatctgagaggtttctaaaactactgctaggttttctgctcttcccaacacagccttagccctaatgctgtgaagctactacatgtgacaggaaacaaggtgatatctctgaggcatagtagggcagataaaaggctgagaatgatatggttgatgcatgtgtgtgtgtatatatatatatatatatgtatgcacacacacacacacatttaaaatgactttctgaaatgaatgtattagatactgaatgtgtacccgtatgtatactgtttacatagacacaagcacatgtacaaaattcactttggtaaatatttacctcagtgaaaaatggtttagaaatacagttggatttttctgtaaagatgaggcactgtaattatgaagaaaagaaaaacccttagatactctttttgtgtgtagtgggtaaatttcacagaccagaaatttaaaaatgcaccaatgtgccgtgttcttcattttctctgattgggcctaatttaggatttaaatccaatgagccttgtagccagaatgcagcctgacagtgataaattaattctagtttgtttagggcactaattctagtttgcttagggcaaacataattatatcaatattttctgtgtctagtctcacctttaagtcttgattccaatgtcatcttctcaagtggtctccctcaacgtctttaaaattgtgctctatttaaaaacgtgcttcctcctatccccctttcctactttatttttcttcatagcatttaaatcttctaacatactatcatattatactttatttggtttcgtacttgattcctcattggaacattttcatgcgcgtccgtgtgaagagaccaccaaacaggctttgtgtgagcattaaagcttttaatcacctgggtgcaggtgggctgagtccgaaaagagagtcagcgaagggagataagggtggtgccattttataggatttgggtagataaaggaaaattacagtcaaaggggatttgttctctggtgggcaggagtgggggtcacaaggtgttcagtgggggagctttttgagccaggatgagccaggaaaaggactttcacaagataatgtcatcacttaagacaaggaccggccattttcacttcttttgtggtggaatgtcatcagttaaggcggggcagggcattttcacttcttttgtgattcttcagttacttcaggccacctgggcatataggtgcatgtcacaggggatgcgatggcttggcttaggctcagaggcctcacaaacataatttctataaaggtatacatttttgtctttatttatttatttatttatttatttatttatttatttatttatttattttgagacagagtttcactcttgttgcccaggctggagtgcgatggcgccatctcggctcaccgcaagctccgcctcccgggttcaagcgattctcctgcctcagcctcccaagcagctgggattggaggcatgcatcaccacacccagctaattttgtatttttagtagagatggggtttctccatgttggtcaggctggtctcaaactcccgaccttaggtgatccgcccgcctcagcctcccatgtattattagttcctagaatagcacctgaaagcattctactgctgaatgaatatttgacggtgaaattgaatacaagatttatgcccctcttattaccagggctgcttatgttctgggtactcacctgatagggaggtcttgttcagtcgttggccattctcatctgactttgctgtcttcgactgaattgtcttcattcatctctgctggcattttacaggatgtttgtgttctgcactgatttgatattgggttcacattgggtgccctcctcccctctgtgagtcactgttccttctcgtgcctcatccgggcctctttaggagtgctggaaagctaagaatgctctctctggccgcttggagattgcagcctattggtggagggagaaggaagggttgccacagccccatcagcctggaattagtttgtcaccatatctgtactgttcatgggtttggatctgtgaaattatgagaccctgccatttggctgagtacaatataggaagcaagatagaagctcactttggctctgcgatctatctggtcctcacttgggcagaaggctggggagaacttgcctcctctgactctcccctcctgtaggctctggaattttcagcctatcttagactggaggccctgggttctttatctgttcttttctgtcctaaggcataagggctttgttcctttggtattcaaaagcagagattttaatatcacaaggccctgctataaagatctttgtctctgcattgaatattcaaagacattttaaaatccaaaagccaagtatagcttttttttccctctctctctcttgaaatgcctccttcttgagagcagtggatacttcatggtcttgtttcaaaggggctgaggggtgtaggaagcccttcaagtaaaaaggagtttggggtcaggggagtagggcacatcttcatattacatgtttttatttaaaaacaaacaaaagtaaaaaagtagaagaaatataacccttgttttctcccttctggaaattaatccttctgtatttgttttctggagaatgattctgaatattctctatatgttttctgtgaaaatgtcagcctagtattcgtttctagtagatgtgctttcagcaaaacttgctcttaatgtctctggtgtgcagtcatctgagatttctcatttgttccaaggtacttgaagggctgatttggctttgaaatttacagctaacactccctgaacttggctgtagcctttacatatttactgtacatctttcacaatataatgatttccaagcttcatttaacttgatccatattaaacaagtaagcttgggaggtgggggtggcttaaaaaaaacaaaaggttggtgcttactgtttttggtattctgccttgtttttgttaaatcactttaattggccctttaattacattacactgagcccttgtttcaaagactcatctggaatacctgcttaggaaaaatgtgggtcagatgggaatgaagcacaaaactgagctgcaacttaacatgaaaattccccagtggagccaaacactgtcaattttttgtttatatctttggtgacttgatgcaaatagaatcgacagttggccaggatctttgttgttttgttttgttttcagaggtatttaaaaaaaattttgctatcgggaaagcaaagcctaaactgttaggtatttgattactctcaatgttgttgttttattcttttttattttattttattaaattatgtagttgccaaaataaaactaagagctaataactataaaagtattttgatactttgtaaagtgagcatattaaatcatttgtttaatttcatatatattcctcataagctaattttataggatgattgatggcacagagaatgtgcatgttaaagaaagggggtaaaagctacttatacctgttcagtaaataaattggaggagagaaaagtctgtcggctgattctggcagaagtttctcatgatgtttgagaaagtagaatgtaatacagagacatcttaatatgagctatatgttttttgtatgaatataataataataggagtttttcccattttggtggctataaaattttactttccaagagttattttagtattttttcttttatttactttaactttttggaaatcaatctgaaattttacttgaaagtgttcagtttctggttcatgtcaattacatttgattcaaaggctttgttcatttttaaccacaagaagataatcattcatattagcagttggttgtcctctgtgtacctaattaaattgtattaataaggtgaaatgaacattgtcaaactgtacttatttacttttaaatatatctcattttgatataacaatttgattcttagctcctttgtcagaatgtactacaaacagaaaattcgtttcataaattattgctgttaccattaattcatactggtgaaacattcatgatgtcaatagtgttatccattataattagttaaagtccatgaatttcatagatgttcatgtttatttttactgtacaaatgatttgttgttcaaaataggtggaaataaaaaggttcaggtgaagtgagagtttgtaactataatttggatgggattattagccatttaaaaaaacaattctaagcttcaaatcctttctcgtacaaggttatagaggaaagaaggttaaaaaagtgtagtttacatctgaagatgaatgtgaacaaattattgggctacttaaacagatgcaaatgcatctccataagttttcattgagatcacagattaaagcaattctagaagaaatctgtatgggaagaaaacaatgtagaaaataaagaggaatgattttgtcaatattatccagcttcgcacattagcataacttgtctataagtttttattgggaaagacctccttcccaccttccacctttcaaaagtacttcctcattccatgagatattgctagaaagtctaccattaaaaattggtttccagaaagtatcactcctctttgggaatgcatgtatccctcattagggtagcaatggctccgatcagtgattcacaggtggatatcgaaacttcatcatctgtgtggcctctgtggctgctagatgggatcaaggctgctgaaaagtgaaagaagattgtgtgctggcttgtgctgggtgaccatgggccagttgtggggagtgagaagtagttgtgaggaagcaaggaagtacagaagactgggctcttcatcatgtaccctgaggctgcctccagcaaactgttaaacttggaaattagactatgctagcttgattacctgttggtgcatttgaaatgcagtgggagctttttcttgaaaaataaaaaaaaaaaaaaatactttccaggccaggagtggtggctcatgcctgtaatcccagcaatttgggaggctgaggcaggaggactgcttgaggccaggggttgaagagcggcctgggcaacaaagtgagaccttgcctcaaaaaagaacaaaaataaaacccaaaaccataaatatataatatgtaaaatatatatattaatgttttgggttttttttaatttaaatacataaatatatctatatctatatattctaaaataaaagaaaatacttttcaaataagaacttatatcttcagctgtgattacagtttatagatttgcctatttaaatgtcagaagtctgtcgaatacaatgatttatagaagttgttaaaaaaaattcccacatggcttctttattaaaaaacaaaagctacagttaattgcccatacaaacagagtttttatttaaaatggaacaaaatttaatgtccataaatttaacttatgaatgtaaattgaatgacatagatcagtaatttgtcctaattgttataatctactcaaaacaaaacattggtaaagcttttgtctacagaaaaattacttttttgtgtctatagataaattacttttttgttgttgttgttgtttttttgagacagagtctcgccgtgtcacccaggccagagtgcagtggcacaatctcggctcactgcaacctctgcctcccagattcaagcgattctcatgcctcagcctccgaagtagctgtgattacagttgggtgccaccatgcccagctaattgttttgtattttttagtagagatggggttttgccatatcagccaggcttgtcttgaactcctgacctcaagcgatccacctgcctcggcctcccaaagtgctgggattatagaagtgagctaccaagcccagcctatacataaattacttacaatatatgggatgtattatagtaaaatagaagtaactaagctaaagccatctgtattcaaccttaaaaaagttatttattgctgtaatatattgattcattcaacaaatttttactgaatgcctaccatgtattggtcactattctaggtgctggggggtcactgtgaataaaatggacaaactccctgctttcaaggagcttgccttgtaatgatgccagtcatagcccagattagtagtctatttttaagagaatttgtagtttattttcaaaagcatatatatatatatatatatttatttatttatttatttatttatttagagatggagtcttgctctgtcacccaggctggagagcagtggcgtgatctctcctcactgcaatctctgcctcttgggtttaagcgattctcctgcctcagtctctcgaatagctgggattacaggcacccgccaccacaccttgctaatcattgtatttttaatagagactgggtttcaccatgttggccaggctggtctcgaactcctggcctcatgtgatccacccacgttggcctcccaaagtgctgggattacaggtgtgagccactgtgcccggccttttctcacatttatttttaaaagcattttctcatgttttaataattaattttgtaacttagcataattacctagtgaacgttcttgagttgaagatgcatttatgtttatattaatttggtaaatgaaattaattatttcaacaactgtatatgaaaaggctgttatctgctgggaactgttttaaggataatggcagttagaaaaatgaatcagaaacagatcctgacctcaaggtatagtcaataatggagaatacaacagtgacagaagaatggaagaaaagcagttataaaataggctttgtgccaatctcagtagttaaatagaatgaagcgctgtgtgtctgtgtggagcagggcagtactattgcccttatatgtgtgcattgaaaagttaatattttcaactttgtatttcttccaacgattacaacttatacctgttttattacgataataccttctctctccagcctagaatgtagaagcagtctctgctaagagatccttgaactctagggaaataaaatgcaatcagattttagatggttatatagctgtgattttctttactttctagtctctatcttatttagtcttcctaaataacgtaactaggaatgacagtaaggaaataagttacaaatgcatttaaatttccctgtggaataagaaataggtagtatctgaaggatacactgatttatgaaataaatattacattaatctaacatttaacaattgaagaaaaatgacttcacaggaagagaaatctctaaaatatttcaataaataaccaatattttgatttagactatacaaaagcctcagctattaggaacacaaacaatgacaggtccttttcatctctgagagacaggtaagttgtctcatttctgtcttattggtgtaaaaacaaaaacacaaagattatgtggcttttcattctgatcagttattagctaaagtgaaaggaacctaggcttgctgtctggtacttcaccactggttaccactgtggtttatggaagaacagtaatgaggtagggccagaaaatgatatttacagagatttttatgaaaaggccaattatacacaaatttctttgtctctgatttgtagttaccagctgacaagtggatacaagcctgcccctatggacctgagctttatcaaactcaccccatcacaagaagcaatggtggacaagttggcagaaaatgcacataatgtgtgggcgcgggatcgaatccggcagggctggacttatggcatccaacaggtacatgggaattagcatttggtctgagacttacttaagtgggaattagcataatttgtaacaggaaggattacataatgactattttaaaacttgtatcatatagatcacatatagtgcacatttggactaaaacagctgtttaatgctagactcaagaatttacatgaccttagttctggctgtgatcgtgaacacatgtgaggcacacaatgaataatactacactggtgacttataatatggttttgtggtatttctctctctgagactgtattttaggagaaacttttgaaatgtaagaagactgggataaagtgataataaaatgggttcaccatcccttattcacaacccctggggccacataaatttcagaattcagtctttttatttggttttcagaatggtgatttgaggatatattacatgtatatacataacaaccttggtagggcaagtgacttcaaattgcaattcattccgcacaagggaggcatggtcataccaaagaggggtaaaggccataaacagcctcgcatcagttcaggtttcaccactgagttactgttgcagatcattttgctctaggcatcagtagatattcaggtatttgggtattaaggtattcaggattaggtattcagtacaaatttgcctgaaagagggaaggaagaaaagacaagacaaaacagtatttctggctgggcggggtggctcacacttgtaatcccagcactttgggaggctaaggtgggaggactgcttgagcctgggagtttgagaccagcctgggcaacatagtgagagaccgtctctacaaaaaattaaaaaattagctgggcatggggcacatgcctgtagtcccagctactcagggggctgaggtgggaggatcacttgagcccaggaggttgaggctgcagtgagactctgtttcaaaacaacaacaaaaacaacaaaacaacaacaacacagtatttacagtatttattctctggtttaccagaacaacccctgtgtgattccatagctttcttttttttttttttttttttttttttttaactcttgggagatgtggtgggaacatccacagcctcccaattcctgcttatcttaaagtattgagaattgattatgcttcttgaaatgtggagacttgagcaaatactgcagcaggtctcaggaagtgaatggaaagaagtaatttccaaagtggcattgccctacacacttgtaggagtagatgcatctccccgatcccatggaattcagttctgtactctaatattaagcatccttttgccaagatagtaagatagcctgttcactctctctgtgtcaacacattttaaccacagtttaacattggagcctctcgtacaatagacaagttatgggtttcatagtcattttagtgcccctggcattgccgggtttcactggttggtggattcaacccaatgcatatttttcagttagggacatagaagggtggtccataacacgctggaattttttgaagaagggaaagcagccttaagttcttcattgcctgaaaaccactgagggagaaccagcactaatttggctgttcttggaataaaaccctgtccatgaactgtactcagaagttatatgttctctaagtttgtcctttgccatgtgaacgtggcagatggaagtggttagagatcactgaagttgttttttgttattgttgtttttccttctcatggagagggtctgctttccatagatgcgcttattcatttgattgaatcctgtatattgatagtgttttggtaactttgcagcctgggaagacgcatggattgtggaagggtcacgtttttctcatggaatttaaagtttgatgtatttggtagctacttatttctaaaagcccttggtattgctttgacggctgcaccctgtgttttcctgcaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatggtattttggttttactttcctcttcttcggttgcaagatgatgtagtagttctttaaagccaaataaatgaataaaagggggagtactggatagagtcctctagtctaggtgtggaatttcagccaagtggattttcttccctgaaaaacacctgagggattagacccatctctcagtgggatggctcaggatgctgatgattctttgggcggagaaaatgggcctgtcttcctcaagcctctgagatcagtaggtacctccctgattatgatattgggctcctcccctagcccaccagccctcctccagaacagctgatttttgctgatttggggaataagcttgtagtggaggctagtgttttacaaaatcccaccttcatcatttacacacacgtacaggcaacattgaattaattaatgtgatattctgctttaagggaaacacattacaatagatactcaataactaactatgtgttgaacacaatggatttttaaaggttctgcaaagaatacattttccttaaataatacctttgaagaatgtagtttaggccgggcatggtggctcacgcctgtaatcccagcagtttgggaggctgaggcaggcggatcacaaggtcaggagattgagaccatcctggctaacacagtgaaaccccatttctactaaaaaatacaaaaaaattagctgggcatggtggcggacacctgtagtcccagctactcgggaggctgaggcaggagaatggtgtgaacccgggaggcagagcttgcagtgagccgagatggcgccactgcactccagcctgggtgacagagcaagactccgtctcaaaaaaaaaaaaaaaaaaagaatgtagtttagaatgatccactctttaatccgttgctcctgcagtctgagttagtttaatacccattttcaaaaaattggcaaaaaacaaattacggttgtgtgcttcgtcacagggcctataatttttgatggaaagttttaaaaatgtattccaaatgtattctagtggctcatattttcagtgcattacctgtacataaaagtggatcttaaataataatgatagtttatatattcactgtgtaagtgtttctaagacttttacaattattatttaatcctcacagtaactcttatgaggatgatgcttgtattacgctcattttacagataaggaaactgagattcagggacttctgtgtcttcccatttaaagtggcaggtgtaggatcctaatcataggcatcctgacatattttagtcctttgaattgagtaaagacatacttggcatcttgacagatcttatcagttactggattcttatatttgctgcaaattaaatgacgtatctacttgttaacagtaatatccataatgctaacataatatctatcttgaggttagctttctaacaacagagatgtggtacacgcattatgaatcagttgctgttaggtgtgcagataccaagaagattcctgtctcaaagagtgtacagtccctgtaaccactgggaagaaagtaaacaataaaaggcttgtaagccaaaaaatggcaatcaaagagacttctgtaattctctgatatagaataaaccctcaaagctaattagttctatataattatgtttttaaattgaaatagaaattgttttaaaaacaatttaaaaaatagtttttaaattgaatagaaatttgtatacaataaaatgtacacatctgaagtgttcagtctggtaaattttgacagttgtagaaacaaaaggaaccactaccgaaaacacctccaatattttcttcattccagaaagtttgtgttcccaacaaagtaaccactttgtaagttctatcattacagattaatttatagcaaatagacatataaatgtaacctataaatgtagattttataatcattatcacgtgtattttttatatgtagtttcttttgttcatcatgatgcttttatgatcttgcatgttttatgtatatcacaaaatctattgctcagtggcattccttaaataataatagtaataatttactgtttgtttatccattctcctatagatggatgatgtgggttgtttccaattttaggtgattatgaataaggctgctatgaatattcatatacaaatcttggtatataattaatataattaatctttcatttctcttagactaaatatttaggagtataattaccgaggcatattttctaatttttgttggcctttttactgaattgtgtttctaaaagtatattttggatagaagaaccatgtcaggtatggaaggattttcttccgtttgtaagttgctttttcactttcttaatgaggtctttcaaagagcagacattcttaatttgaagtccatttatgatttttttcctttatagttgtgggttcctaggacatctttgcctatgcaaaaacaaaaatattgtctcttatgtttccttccagagttttattattctagcttttacttgtaggtgtgtgatctaaagtgagttagcttttgtgtatgatgtaagcttaagatcaaggttcatttgttgcacagatgaatatccaactgtcccagcaccatttgttggaacaattatccttaccaaattaaattaccttggcgtcttagtcaaaacctattgaacacataagtcagtctatttctggactgtatattctgttccattgatctttatgtctgtccttaagttaatattccattgtcttcatttttatcacatagtaaatttaaaatcaggtagggcaagtcttccaacttctttcatattttataaaggttttttgttcttcttttgcatttccatatacatttagattcaacttgttaatttgatttggatgggattacagttgaattcataggtcagtttgggaagaattgatattttagccatatttagtcgaccaattcatgaacatggtacatttgtccatttattttcatcctctttagtttctcttagcattgctttgcagttttcagactagaggtcttatacattatttgatttatctatatttttgatactattaaatgaaattagtttaaagttcatttcattttccaactgtacacgaatatgagatatataattgatatttacatattgatcttatatcctgtgatttggctaaatttatatgtcagttctatttttttgtaaattcagtgggattgtctatatacataatcatgaggtctgcaaaaactaaacctcactttttcttttacaattggtatagcttttttgcttcttgatttattgaactggtaaagaattcagaacactattgaatagaaatggtaagagagtttattctgccttatagggggaaagttgtgatgtttcaccattaagtatgatgttaagtatagctttttatagctgtcctttatcacattgaagagattcccttctgttcttagtttgtgggtgattttatcataaatagggtcatgaattttgtccagtgcttttttccccatttattgaacagattatgtatttttctcctgtattctgtggatatcatgactatcaagtgattttcaaatgttaaaccaactttctagttctaggataactctcttcagtcatgatgcattgtccttttttacacagagctgtattctatttgttaatattttgcttaggacttttgtagctaagtttatgggcaatacactggtatatatttttttcttataatgtctttgttagattttgatatcaatgtaaatctagcttcctaagtaggaaattttctcttctgttttctgaaagaatttgtgttaattctacattgtttctttttcaaatatttgatagaatttatcattgaaaccacgagcctagagttttatactataggaaaggtattttgttatgaattcaatgtatttgatagcttgagagctatttagattttctatttatttgtgtgtcaactttgataaattatgtttttctgtaaattagttcatttaatttaggttgccatatataggcataaaattgcactaatgtgctcttattattcttttaatgtctgtaggatctttaatgatatctctcttttcattcctggtaatgatagttgatgttttctctctttttatcttgatcacttctctaagggattaattgattttataaatcttttcaaaggttaattgaacttaaatgtacttttgttttggttaaactttcagacatttatttatttctccatatcaccaatcgtggattattatgagtgatctgctgtggttatgtgtgactatgtcttacattaccttaggaaagcatggcattattgagtaggactatggcatcctatggagaacgttaatgttcaatcacagtatcaagagatcctggtttcacagctttgaaatgacctattaaatgtactttctaatcaacaaatgtatatatcaggcatacaaatattcactaacattgccttatgataatatagtatttccaatagtgtttttgcatattttcaaatatttgattcaactactctctttaggcaaaagaagggtgtaataatcaaagagttcttgagcttccctctaactttataattctttaacatttgtgcatccctagaggatgtaggtagcagtgatgacagtcaatatatttttaggttggaaagatacttatataatgataaagataaaattttggggaaaaaactcacacctggttttatagtctgacacatcaaccatttgatttccccaggttttcattactttacacatgaatatttatattttggtatctatagtcttaatagagatataattacctgttttccttccgctcccccactctgcttaatatcaaacattttgaaagttacttactctacatttagaaggaactctgacaacattgctttcctgatactcactgaaaattgcaaagagagaatgcctaagtctggttgactcaattttaaacttatagataataacttaataataaatgtctaaagttatagataataactaaaaataagggaaaacactacagctcagagaatttataaccttgagtcttcaaggaaagagttaattatggtcagtatccaggaaaaggagtacagtttcccctgcacatagaaatatgcattgcaatgccagacagaaaaaaatcaatgatggttatattttaaagatattgtcacttaagggcataaactatattcagtgacacatgatacatttgcttttagagataactttactccagaatggtgccagataagtaaaatgttaagaagttattctgatgacatacagtgttttatactatttgtagctaatacgtattaataatttcatcttcgtaacaccgttgtggacaacatattgctaccttatgggtacctactttcttctgaattatgtgaattttaagaagaaagaaaaggagcttatatttataaaacatatgctccacttcattttacttccatatttgcaattctcatttccattttttaaaatattattattattattattattattattattattagttgagatagaatctcgctctgtcccccaggctggagtgcagtggtgcaatctcagttcactgcaacctctgcctccctggttcaggtgattttccctgcctcagcctcccgagtagctgggactacatgcgcctgccacgaggcccggctaatttttttttttttttgtatttttagtagaggcggggtttcaccatattggccaggctggtcttgaactcctgatgttgtgatccacccaccttggcctcccaaagtgctgggattacaggcatgagccactgcacctggccactctattttattttaacacatagatatggaacacctactgtgcctagttctgggaattcaaagatgaataagagtttttgtcttatgtagctctcagtgtagacagggaaaatagactaaattgctaccactaccatacaatgaaagtgttaagctgaagagtcataacacagggggtttaaatcagcttggtgatatgagggaaatctttaaagaggaggtatattagttatctattcctgtacagcaaactacccctttccctcccaccaaaaaaaaaaaaaaaaaaaaaaaaaaaaaccctctcagtggctaaaaataacaaaatttgttatctcaaagtttctgtgggttatgaatgtgagtgataggtggttctggatcatagtctctctgagattgctattaagttggccagggcttaagtcatctgaagacttcactggagctggagcactggatactaagacagctcacttgcataactgttggctaaagaactcgcttcctctctggctgttggcagaagacacagccagatgggtacagccttgccacacagagctcttcatagagatgctcgagtgccttcacatggaagctgacttcccccagaatgaaaaatcgaagagtgagtacaaggatgctgtaatgcttgttacaattacttctattatattctgtttgttagaagtgaaccactaaatgaagcccacactttttgaatggaggtgtactcaagtatttgtggacatattttaaaaccaccaaagtaggtacagctaagtcaatcgggttcatgcatttcaggcagagagaatagtatatgtaaaggcttagagacacaaggaggattgcaaatgggaatttcagagagctttgtacgaccagatgtagagtggagtttgaaaagtggcagtagatcaaatagaggaggcaggagttgaaacagtttttttttttttttaaattaaagaatgattctagtggctctttaggaaaaaggctgaatgtaaacaaaactggagatgaggacagcagtttggtgacaaaaaagaagtatagatgaggagtgttggagaccttgtctttggcaatactgtgaacagaaaaaattatttggcatttagaagtagaatcagcagaaggacaaaggaggcatctgagatagtttctggattgatagatgtcaagtacatacacactggttgggaacacaggaattggagcagatggacatggggtagtgggaagattctgagttttattgtaaacatcttcagtttgaggtgcatgtgagacaactcaacacatataccaggattcaattacatatataagtacaaacgtgagactattgctagagagaaacagagggttaaaaatttaattttttaaatgaaagaaatgtggacatttttacactaagggagagagagaggttgaaagtacagtaagaggagcttgatgagctgtggtctctgagaaggttgaagggaatgaaattcagagcatgggtaaagggattggcctcctgtaaaaggaacaacaacacttattcccctaaggttagtaggaaagaagtaaagattgaagacgctgcaaaaacctgtgtacagggaaaatcaggaggaagctgagggcagtctactgtataattattgtcttcaggttgaaatagaaaatgagtttattttcctaaggagtagaagttagggcaggctggactggattagaagccttgaagagagcagtaaagatgtgttgggtatagaattctcagctgacaattattttttcttttagtactcagatatatcatcccgctgccttctggcctttatgttttctgataaggcattgacattaatcttttggagggtcccttgtatgtgatgagttgcttctctcttgctgttttcaggattctctctctgtttttggatttgaacagtttgattatgatgtgtctagttttaatttctttgagtttatccccaaagtttactgtacttcttagatgtgtaaatgaatgtttttcatcaaatttgggaagcttctggccattatttattcattctttcttctcttttctgtctctccttacagtctgtgatttccattatgtgtatgttggtatggttgagtgtatcccccaggcctctgaagctctgcttgtctttcttcatttcttcttcagtttttcatacttgactaacggacttatcttcaagttcattgattcttgtcagtgcaaatctgttgttgagccctctgatgtatgtttaatttcaggtactgtgcttatcaactccagaaatttttattcttttttataatttacctctttattgatattcactatttggtgaagcatcatttttgtacttttttttttttttgagatggagttttgctcttgttgcccaggctggagtgcaatggcgtgatctcggctcactgcaaccttcacctcccaggttcaagtgactgtcctgcctcagcctcccaagtagctgggataataagaatactggcaaaaaattatgcaaatcaaatttttcatagttctggaaattaactaaaggctggccaaaatccagggagtgtttatttgattaaaatgtccaaatgttgctaagaacagcaactagtgatgttttaacttgctcctgccccatcaccctctctctaattctatggcatattgaaaaccaacggcccctcaatcatagtgaaaatcagccacccacaagccgctggagtgggcagaacagagttggaccaccaccatgcctggctaattttgtatttttagtagatatggggtttcactgtgttgatcaggctggtctcgaactcctgacctcaggtgatccacctgcctcggcctcccaaagtgctaggattacaggcatgagacgctgtgcccagcctcatacttttatttagttcattacacatggttttatttagttctttgaacagatttaaaatacctaacttaaagtctttgtctaataagcccaacatctcggcctcctgaggaataatttctattgactgctttttacccctttatgtatgggacatactgtcttgtctttttgcatgtctcacaatttttgtgaaaaattgaacatttaaagtaatgtaatttggtaactctgtattcgcccctatttcagattttgttgttgtgcttattgtcattgttgtttgctttcttggtaatttttctaaactagtttagtagagactgtgttgcctgtcatgtgtggccactgaagtctcagtttcattagcttcatggtcagctgatggtaggacagagacttctttaaatgcctaggactgataagtctcccagtctttaccaaaggagaggcaatgtaatgtgagcatattggcacatgccttcaacactcaaccaggcaatttataatttcacattagccttctcttactgcatgtgcagagcctcaaggtctttcagaggtgtaagctttctcaggtttttcctgaatacatgcacagccctgggcatgagcatggccttctagagtcccaggaatatgttggagcttctcacatcccactatggatatttcactccccagcttttcctttcaaactttttggtcagttgctgtttgcctcagctgttattgctgcctcacaaagctgcaaggctaacaaattgcctcagatgattttcaacaaatgtccttggagaaacaactatttgcactgggcaagctctaagtcaagtggaataaagacaagtcttaccgatggaattttccagaaaagggaacataatgacagttatctgggaactgggctttggaggaactccagctctgttctgcccactacaagggcttatgggtggctgattttcactatgattgagggtcctttggttttcaatatgctgtggaattagagagagggtgatgcagcaggagcaaattaaaacatcactagtttgctgttcttaccaacatttggacatttttatcaaataaacactccctggcttttgccagcctttagttaatttccagagctatgaaaaatttcatttgcatagttttttgccagtgttctcattaattctgtggagaagaggatttttggagattctttctctaccatttctactgatgtcactcagcaataaagattaaaaattgctgttttgtgggatggaacagagagcagactgcaaacagataaaaacattgtggagaaacattgatggtcccgttgaggttagagactctgagttagtggtgccaatctgttcggtgcatgtgttttctggcgaactcagcagagcaggtatagatgttgagagtgaaggtagtgaaattggacagtaattggggttaagagagcaagtaggggaaaagctaataagggcaagaaagtatggaaagttatatagggaagggaagaatgaaggaatctaatgagtttgaagagtgagtgtataagaaaatgagaaaacagggagaaaaaatggtgatcacacaatctctgtattttaagaatttagagatagagccactgacagttgtttgacaaggtttgattttaccgaagttatgtgaacagtgagcaatgagaatagagtggcatattctacagtagaagctgagattatgtttagtgtttactatgtgccaggatataacagcatgcttcatagtagggatgcaagtgatctgtatggaaaagacataagaagaaagattaattttccaatgggaggaatcagtaaagggagaaatatcttcagagttagatgttgaaaggatcaggaatcagtaaagggagaaaatgtcttcagaattagatgttgaaaggatcaaaatttcaacaagtagagattagtgtcagaaaggccatcgctactagaaagaaagtacatctgatgtgattaagtgtagaaagagttgaggaagggtagatggtccacttaggataaaatatagggtacagatgggcagagagaacagacatagatgaaggtagaaagattagggcaaaatatggaatatcttgcaaactcagctaagaaatgtggataaatttgtataaggagtaccagccccaggaagttttaaagcaagagcttgatgtgtgatcacagtttacaatagcaatataactacggcaacagtgggaagggacagattggagggggcagtgcttggaggtagaccagttgggaggctttagaaaaattgtttttttgaacaaggatggtgggaataaaaattaaaagatagatgttgagagattttatagcataaagcaaaatcagtctgattatcactaagaggagattcaaaacattcatttataatagtctatactgctgttgctgacatttaaaaaaaagtcaagggcataaaaagtttaataaaattgaatcaagccttatgtaattaatcagaattataatttattttctcttaggagaatgcttacatattccagataaaacatgaactctgtatttgagttgtagtatctttggagtactgttgtcaataatattttaaagcatttgaaaatggaatttattcttatttactacaaggtttaatcaagatttgaattgttttatccaaaataataccagaaggttgaaaggatggctgattaataccaataattttaaaaagtattatcattagacctaaaagattctagatatgtataaaattttagcttttccttatagcttcttgtaacttaagattttaatgtatagttagatcttgactgccctctagtggcatatattttcttagctatattgtttggagagcagagtgtatggttactttaggcctttttaggccctagttaggtgattggtggtgtgtcatgcctgggaggtacggggagcacagtctttgctcagtccttggccttaatcttgaggtagttcattaataatataattcctgaattgtttctgctttgaataccaacagacttgataatgtatgacaggaatatgtctcccaactattcatttttaaatgtccattattattatattcattataacagtataaaaatcacttatataacatacttacatgagttataattgcctatcaaacacataaatatatcgtgtttaaaatcgagcaaagcataaggatgttcgggggagagttctgtgcctttgacaggatgctacccattagctatttgtctgggctgctatatccggagcccggaagagtcttcgtttctagatacagtttggcaggtatatatggagcacttactttgtggctcaggtgcttgatactacaaggtatgcaaaataagtttgttacggattgcttggatctttttaaaaaactcctacaaacccagatttcactttgtattagtattttagcaagaggtataatgttgaactgttgcttctttaaaacgtagttgcaaactaccctaaactaacttaataaatatatactatggggcagggcacagtggctcacacctgtaatcccagcactttgggaggctgaggctggtggatcacctgaggctcgaagttcgagaccagcgtgacaatggtgaaaccccgtctctactgaaaatacaaaaaaattagctgggcttggatggtggcacatgcctgtaaccccagctactcaggaagccgaggcaggggaattgcttgaacccaggaggcggaagttgcaatgagctgagatggtgccatcgcactccagcctgggcaacaagagcaaaactccatctcaaaaaaaaaaaaacacaaacaaataggaaaatccacagagattaaaaaagaaaaagaagagtccttttttttttgtgaagtcccttgcatgatagtatctgtgaaccacatgtttgtttcaaattcaggttaagtatcatcaatgagcataagaatagcatagcattagggccaggaagaagaatattaggactcagaaactctgcattgtttctactgcaatatattctccatgtagtaccccctattttcattccctatagtaataaaggggattagtggtatgttttaattccaagagaattgtgtagggggcttttggggaaattattacatttttataccgaatttgccttctaaaatatttgatttgtgctaatattaaaattagtttgcattacttgagtgcactatacatatttgtgaagtcttgatatattagaaaccaaacacagaaaagagaacctggtatttttcagtagtttagttttccaaaaaaactgtagtatagttttcatggtatataatgactatagtatatactaattctatatttagaaaattaggagttacatctattaatgcatactagaatgtaatgtaatattttatttgcaaatatcaacataattaaaaataaggataactacctgatcattttttcttccctgaaaataatctccaaatttttgtgtaatttatagctcatatttatctcttagattcatttagggaagattacaggcatgttttaaggaaacaatttatcggtaatctgttttttgaggaaatactaactctgagtaaaaatttgactttcctgtttgtttagtattgcagcactgagaacgagtttctttctttctttctttttttaaacacagagtcttgctctgttgcccaggctagagtgtagtggcatggtatcggctcactgcatcctctgcttcccgggctcaagcagttctcctgctcagcctcccaagtagctgggattacaggcatatgccaccaggccctgatgatttttgtattttttgtagagatgggatttcaccatgttggccagactggtctcgaattcctgacctcaagtgatttgcctgcctcagcctcccacagtgttgggataacaggtgtgagccaccgcgacccgccaagaactagtttcttaatagcacaaactacctttaaatatcataaaatctgatagaatttttttctctcaaaacaacgtttacgatcctatttttcaaaatatatttacttaccaagtaataggcatgagaatttacccttaaccatagaaatgtttctctgattcagagacttaagctagtttctgaagggttagccagcagattcagttagttctacattcagtaagcactaccaccattatcaaaaaagcagttattgatcgtttcattaattaagcccatgtgatagggagccatctcatgctacagccatggtgtctccactgctttacttcatctcattttaaattgttacatatgacctagctgtatgtttattggcaacctttagtgcttatatagattatttttatagttctaatttgatcataccaagtcattgattgaactgttattaaatttttattatgcataaagtctttcccaaatcttaaggagaaacaaataggaacttccttcttctcttttcttttctttctttctttttctttctttctttctttctttctttttctttctttctttctctttctttctttctttctttctttctttctttctttctttctttctttctttctttctttctttcttttgtctttctttctttctctctctctctttctttctctttgtttgtttgttttgttttgagacaggatctcactctatcacccaggctggaatgcagtagaacgaccatagctcactgcaacctcgaccttctaggctcaagtgatccttctgtatcagcctcttgagaagcttggacttacaggcatgcactaccatgtctggctgaatttttaaactctttgtagagacagggtaccactatgttgcccgggcgcgatcctcccgccttggccttccaaagtgttgagactacagctgtgagccaccacacctggctgaaaactagcatttaaccagtaactagtaactctgtgcgagctattggaggcaaagtaggaagaagaggggctataacatgaagcagctcccaagttccaccatttttagttgtgcgatgttggtcaagtctgaaatttcctcctctgcatctaactcagatgttagctgggtgaccaccttctttgagatatcaattcaatgaacactcattcctctcctctgtggtttcagaaggacttaccttctcatcgtcgttctggctctgggttcctcattctgagacttccccctctcgtctctctcaatctcacctgcatctcatttcctagggatacttttcccccttttgcatcacactggtcctaatgttggatgctgacctttttatttttcccccagatcttttaaatacagcatttgtatgtatagcagatcacagtgaagatgtatgcgagaatggaaaaattttgcatcacatttgagttccttagccatcaccatcctgtagggaaatttttactattgatgctattgttacttttctccactgtttacaactttcccttatttctgtttctcttctcttccttgcttcgtcttccctcttctctctcacccgtacatgtctactcatttcttatgcagagcagttcggatcttttttcttattgacttctttccatctcatcctccacaaccaaagcaccaaggcacttgggttttgttctacagaaaggtcgttccctcctgaaaatgaggctgacggagactcattccccagtctctccagcgcaagccctggtgctttccacttcacccagctggtctgacagtggctgatcctagatcagaaagcacttggtaaaatgggaaagaagataagaaggtatcattatcatcatcgctctaggttgaattactaaagtcgtgatttatctttccttcttttatttatgatatctttccttctctttcacctccccatccaatgaccaccagaaatctctgtccatttcccagcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggtgagtggactttgtcctgtgccagtcatctgtacgtgctggaggctcatctcctctgctgttcctcttggtagcttcacagtaccagtgtttcccacagcacaaacgtggaaaaatatttcacaggaaagcttttgtcctcgtagtctcaaaacccttccctacaacccatgaatgcagtgaaattcaccaagtaagacattgcttttccatggttatcaaaaagataaatcatctttgtctatcaaaatgttaaagatacatatgtagaggaaaaatgcatatacattgacgcagcgattccgtatcaggagtttatctttaagctataattagtggtttgtatgaacatttaatagctacaatgcttaatgtagtgttgtttataatcacaaacggttttcattttcaacattattggtaatttctattaagttggatggaagctggtcaggtgtttattttgttatttatatactaataaatgtttaaagattcttttacatgtgtaaaatattttgatcagtaatatgggcgaggtgcctgtaatcccagcactttgagaggctgagatggagggatcacttggggctaggagtgcaagaccagcctgggcaacaaagtaagatcctgtctctacaaaaaaaaaaaaaaaaaaattaaaattagccaagcatggtggtgtgcacttgtggtcccagctacatacgaggctgaggtgagaggattgcttgagctcgggaggtcgaggctgcaatgagccatgatcacaccactgcactccagcctgggcaacagagtgagaccttgtctcaaaacaaacaaaaaaataataataacaacaaggtatatatgcttatagccacaataggataataatagtcacttttgattggtaaaatcatagatttttttaaagtcttcttttttttttattttttaagtgaatttattttccttttcacatgagggggaaaaagctactttttaaccaagaaaaataaaattagaataaataagcaatcatgaagagatttgacgtttggatatttcttggagtgaaatgtcctgtgtaggaaagcatttctaggcttgaaattagggcagttgacccacttagttttgaaacatcacatttcctgaatccagttttttaaaaatttcaaatagaaaaatttaacacttttttggggggttggggggcggtcaaaattagcaaactttaaacttcaaaaaataaaataacagataaaaggcagctttaggtttatacctcctgaagatcagatgtaatgaaccagagtgggaagtaacctgaggaagttaaaataacctttactcccagtcaaatgataggcaagaaaggatactcccgatttgggaacaggcatggggtgggtggggtaggaaggagaacaccacagccaggtaagtcggttgggcattttatgccttttgatacctgatgtaaacttttttaaaaagacagtgtgttatattaagaagaattatgtcattgctttgcattggcgactctgtctggtaacgtaccgattcacaatgaaggtgaggtttaagaaaaagtcaaaagatttatctgaaaaaaaaattcacataactcaggtgtgcttatgaatcaacggaatatacttgtagatgcaaaagtcacgtttatcaaaactatgtttcaaatgtacttacaatatgagatttcactttatgtatatatataaaaaggttggcatctatattcaatttttggcttgttacttcagcagatatcctaaggatatttttaggtttgatttgaagcttttttacttttagtatgtaactgaaatgcttctagatttccattttgttaaagtatctgtgccatcggttctaaggaatgaaatttcattttgaaatagatgaaaattacactatcattttcaatgacagatgcccagcttgattccctagctcataattatttgtatttgtgggagtagagaaaaacaaaccgtattctgggaaacattcattgtcgcagaaaaatgatatattctaaaggcatataagttttctttcagtagaaagtatgtgaggttcgatttttaaaataataagctctcaaaatcatgacatagattttggatttttttcccaagattcgataatataccatgttaatattaggtagggatttagaattcccagacagctccattttgcttaggacattgcagtagaccgatatgccagctggagtttctcctactgttgtgttgatagaagggactgctgttaggtcgtgacagagtggtgggtgggtgcgattttcctggcttagtctgtgacaagggacttttctgtcctctgtataggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggtaagtctactatgttttgtgttttttttaagtttgcagcacaaggaagctttcatcctgaggcttcctaaccgggcgtttctgtttcagggtgagtgagcagatgagttgcagctgtaaatcgtgagggtgccttgtgactgacttgatcagatgcccttgaaataacattattagaaatgctatctatacgacttagctaggatttctagaaggctgaaatggcttttatgagtatgaataagaaaataaatagcagataaaagaataggtttccatcattgttaaattttcatttagaacttccctgcttcatcagctgcctagagcctctttctgtttattcatctcataaaagtgaaatgaggacccacaatggatcaggtactttgctggatgctgaggtgacaaagatgaatgaaacactgtcctatctttgtatagattacagattacctgccaggggaggttgacacttgtacagtttctgtttagtggctaagttctaagacagaaaaatgcagaaagctctgtggaagcaccatgcagggagcacgtgctgctgcctgtggggccccgagatggcctttgagcagagttgtaaagatggagggtgggccgggttcagtggctcaagcctgtaatcccagcactttgggaggccgaggtggatggatcacaaggtcaggagttcgagaccagcctgaccaacatagtgaaaccccatgtctactaaaaaatacaaaaaattagctgggcatggtggcatgcacctgtaatcccagctatttgagaggctgaggcaggagaattgctcgaacccaggaggcagaggttgcagtgagcagagatcacgccatggcactccagcctgggcaacagtgcaagactgcatctcaaaaaaaaaaaaaaagatggaaggtgttggtgaagcaaggaagacatttactcttcagacatgcactcccaatttggtggccttggccacacagggctgtttatatttaagttagtttgaatttttttttttttttttgagtcagagttttgctcttgtcgcccgggctggagttcagtggcgcaatctcagctcactacaacctctgcctcctggattcaagtgattctcctgcctcagcttcccaagtagctgggattacaggtgcttaccaccatgcccagctaatttttgtatttttagtagagacggggtttcaccttgttggccaggctggtctcgaattgctgacctcaggtgatccacccacctcagtcctccaaagtgctgagattacaggcctgagccaccatgcccggcctaaattttaaaaagttaagaattgagtttcttagtcacattggccaccatttaaagggctcaattccctcaggtggttagggatgcccctgctggacagtgcaggtagcgaatatttctctcatcacagaaagttctattggatagtgttactctagagcatataaacaagacagtatctgatacaaattatataattatcttatttcagccaggcatggtgattcatgcctgtaatcccagcactttgggaagctaaggcggaggatagctgagcccaggagtttgcgaccagcctgggcaacatagcaagactctgtttctacaaaaattaaaaaaattagccagttgtggtggcatgttcctgtagctccagctgctcaggtggctgaggtgggaggatcactcgagtccagggaggtcgagactgcagtgagctgtgattgtgccactgtactccagcctgggtgacagagtgagaccttgtctcaaaataataataataaccttatttcaaagataagccaacacttcttttcaaaatggcttttgaatatatcctgttatatgtttgcatatggatttgcatataaaaatgtatatatatttgcatatatatagtcttggattttaagatacatacctacctcaaccagtatttctttttcttttcttttcttttttttttttttttaagacagagtttcactcttgttgcccaggctggagtgcaatggcgcgatcttgactcactgcaacctccgcctcccaggttcaagcaattctcctgcctcagcctcccaagtagctgggattacaggggtgtgccaacacgcctcgctaatttttgtatttttagtagagacggggttttatcatgttggtgaggctggtctcgaactcctgacctcaggtgatccacccgcctcggcctcccaaagtgctgggaatataggcgtgagccactgcaccaggcctatttctaatagtctatataaatttgtcactgatcttcaaaatgttagccagtttgttgcttgtatgaagttttatattcattcatttagctagcttttgagcaggtatgaacatcatttccctaacacagatttgcaaagataataggaattttacatttgtgtaactcaatatctatgtttaaaatttttaatttttactttttggagatacatggtaagtctaatatgtatgaggtacatgagaagttttgatacaggcatgcaatgggtagtaattgcatcatggaaaatggggtatccatcccctcaagcattaatcctttgtgttacaaacaatccaattatacttctagttattttaaaatgtatgattgaattactactgaccatagtcaccctgttgtgctatcaaatattaggtcttattcattttttctaactatttttatacccttaatatctattttgaacacttatctccgggtggtgaaattagtgctctaaccctcccctacctgtctccctttctctgatattggttttagggatgtcaaagtattagtgggaaggtaggaggaaggctttttattggtgttatctatctgtctacactggctgctactatggatgtgacttaggtttcatttttttaattggctttttaaaaaatacttgactgctgtgcttcctttctttggatgttaaaaaaaatttaaatgcatgtgtgagttctgtttgtatggtacgtggttcacatgatacacacagatttgcagaatgctcatccgtactatttaagcacgtaacaaatgttcatggtaccacacagtcacatagaccaatcaccattgcaataatgagatagactctgaagtgtgtcaccgtggcacatggttttgaacaattttggcttttgactttgtatttcatagaatttttaaaatttaaaaactgacttgaactttgtattggtatctctatcatagagttaacacaggattttgatgaattgtctgaaattttgtggttgaggttgctgggcttttattagaggttttgggaggacctgcgttttggtcttcaaggcaggttataagctttatgtagcaataatcattaagtagtaactttgtaggggtcagtcatgaatctaaattttctactatagaaaggctttcagagtttatccatgcctatgatttttgaatgctttttggtactggaatatctcttccccatccctcctctcccaaattgactttatatagcttcccaaaaaagctccttaatttacctgtcactactgggagctagcattgaggtagctagagctcaaaggatccagtttgaaaaactatttatttagggttttctagcacagaaacatactatggttgctaaagtactaaaatggatttataagtggtctattttaaatttttcttacacctagcctgtctttatgtctgtatcatgttcgatttgccatttttaactatcttcataatctcttcttattgctacagagaaagctcagtcatttatacactgactattaaagtatgtggtaagatggataaatgtagaaattattatctatggagatatacacatacacacacacacacacacacacacacgcatacatatgtatatgtgtgtatgcgcacacatacacacagacacatgctgtagatccctgtctggtcagcttagtagacaacatggccaagtatattttgacctttctatctattgcatagtttatacaactgaaatgatttgctgaccagtataagttgtttctatataccgtcaaaaagaaaatcacaaacatctttgaaagactgatatggccatccagttaaatccaggggggagctatggctatcccagttctggaagaggatagggttgttctataaaggtactgctaggaacaaccctatcctcttccagaactagatggcggatcacaagatcaggagatcaagaccatcctggctaacacggtgaaaccctgtctctactaaaaatacaaaaaattagcccagcgtggtggcgggcacttgtagttccagctactcgggaggctgaggcaggagaattgcttgaacctgggaggtggaggttgcagtgagctgagatcacgccacctcactccagcctggtgacagaggagtgagactccgtctgaaaaaaaatgaaaataaaaagatgctgttaggtctcttctaaggggctgcagacctcttcctcaaatagggactgcagcagccctcaggaaactcatctgttaactggataaaaaccaaatgacagaaacactggtctctggtagaaggagcaaggctctcattccctcaactcctcctcaaaaccacgcttacatggtcaagatcaagagcattgttgaactagagtgaaattccactagaatttcagggtttaaaggccgcattgtctatgtggcagatcctctgttaggattctcccttctctttggctttttaaaaatctcttcagagtatctttggggaaggcaaaaggattccttcaatcatcacttttaaaagaccccttggactgtaatgtcacaaaggaatagtgaggggcatgtgtggaagcagtttttagatgagcttaagtttttccatgaattcttgtctcttctcaccattggactgataaccattcaaaatcaggattggggaagcccagggaaagaggttgcagtgttcactcttatggacagaatcccaagattgcttctaggaatctttctctgtggtgttcacaccattttatataaccctctcctcttgagtgtcagcagaacttgtgaatatgatgggatatcactcatgattaggtcactaaatcagtttactttgagttagtcaaatagagattatacaggtgggcctgacccaaccagatgagcccttagggattgggtccttcctgaagtcagagagatacaaaatatgagataaattttcctgctggacttgaagaagcagactgctgtggtatggagagagcaacatgatggtaacctgcaggctgcttctgagaactgagaacagccccaagttcatagctggcaaaaaaacaaacaaaaaccgagaaatctcagttctacagcccaaggaaccaaattccatcaataaccagggagcttggaagatgactccaaccctcagatgagaatgtagcccacgttaccatcttgattatatccttgtgaaaccctgagcagagaacccagccctaccatgctggacctctgacctacagaactatgagataagaaatgagtattgctttaaatggctaagtttgtggtagtgtgttccatagcaatagaaaaccggtatgttgatcaaggggctttcttaggttcaaccgaaccttcagactcacaagactatcaaagaccacccatgacaccagtctgtttagagagagaacaggaatcatggcttgccagcagggcagtcccaaggattcctcttccaacaggagtgtttttagatgtacgtataattctctgagttcatacgcggttacctcatcagaagccatttttattataagccatgctgcctaataacttagttgacacttcagcttttacccacagaggtatagtagctaatcaagctgtgatactcctccataccaagaacctaggaggagctctcctgacacatctatggtctactgcattttaccaaaaccagagattattccacatcatgttttgggaccaaggctttttatattaaagccatgatttttatatggagcatccctttatgtacacattcctcaagagcctagtggaggtgatcctcatcacattagttgggggacaagaacaagggtaatagaggcctgagatctctcttctttccccccacccccggcgtacctatataaatttccatccatcttaccacataattattttcattactagccaatgtaacaataagaaggaattatgaagatggcaaaacatgccatatcaagcatgacacagacacagagacagggtagttatatgagaaatgtaattacagagcacttataaaacctttcagtactttagcaaccacaacttattgctgtgctaaaagattttttctaaattgtttttcaaacttgtaatatgacaagaaaaagaaattggagatgataagaattggagtaaaagggacgaatttatcatcattcgaagacaatataagtatttacagagaaaaccctaaagaatctatacacattactaggaacaattggagtgtttcacaaggtagaatttctattctagcagcagttaagaaaagtaaattaaagataccatttacagtagcatcagagactagcagtagctaggtatctctctaacagaaggtatataatacctttactgagaaaattattaaaacttattgagagatggttgactttattaaaagacttattaccaaataaatgagaggtgtgttatgttcatggagaagacaaaagcctgaagatattaattcttccaaaagtgatctatagcttcaatccgtcgatcagacttttcaaataaaaatcccaacaagtgtttttatggaagtcgatgtgatgactctaaaatgtatatggaattgtaaagggctaaaatatcttctgtctaaaagcagtgaggggatgcatgtcctaccagatagcaggatttattgtgaagctatagtcattaaaatagagtggtattgttgtagggatagacaaattgacaaatggcataaagtagagatgccagaaacatagaactgatatagaaacagatgccatagaacatgatgaggtagtgtgtcagtatgttggagaaaagaggcctgtgacaaatggggatctgtagtgaaaatatgagatggtcacttcttcacaccctatatgataacgaactccaaatggtcttaaatgtcaacagcaaaactttgaaaccactggtggagtatatagacaaatttaagaacattcatttaaaaaaatgaatgttctgcttccttaaaggaagcagaaaaacagtcaggtattaatggggagaagctattcacaatgtgtacaactgaaaaaaatgttagtgctaagaaaatataatttctgaaatcaagcaaaatgatgaaaaggtatgaacaggtatttcatagaagcaacaactcagagggacaataaacgtgtgaagagatgttcagtattattgatcagggaaatgcaaattcataattaaatgctattttacatccattctgttggcaaacatttgtaaagacctgacaatactcagcattggagagcagtacacccatagaacctcttttacgttgctcttaggagctcaaattggtctctccactttggaaaactgtgtgacaggatctctgaaaatggaatattcacatacccatgacccagaaattctactccagttttttagctacactagtgtgtctcaacagcaggagatatgtacaagaatggttgtaggagcactattcacaattgccaaagccaggatacaactgaaagcacacaggatggatgaattaactggaaactacggtaataaatgacaacatggatatttaagggaaagaagtcccaaaagataactatggtaggccgaataatgtcctccaaagatgttgattgatggcctactcttggaaatctgtgaatatgttactttacatagcaaaagagattttgttgatgtgattaagatagtgatcttgaaatgaggagattaattaacctggattatctgggaagccaatgtcatcacaaggatccttataagaaggaagtaggagtgtgtgtttctgtgtgtgtgtgtgtgtgtgtgtgtgtgtgtgtgtgcgtgtgtgtgtgtttgagagagagagagagaaagagagagatcgatctgggagtcagggaaagccagagacctctagaaatgacaggaaagtcaggaagtgggttcactgcagggcctccagaaggaactcagccctgttgagcaataggttggtagatacttaagagtatttttaaaagaaccaactaaataaataaaaacaggtgatgatgagagtgtgtcacaaacaaaagtttatcagtaatccacggtccacttctgtgtattttgaaattcttcttttgagacagagtcttactctgtcacccaggctggagtgcagtggcacgatctcagctcactgcaacctctacctcccgggttcaagcaattctcctccctcaacctcccaagtaacttggattccaggcacatgccaccatgcctggctaatttttgtatttttaatagagacggggtttcaccatgttagccaggctggtggctggtcttgagctcctgacctaaggtgatctgcctgctgtggcctcccaaagtgctgggattacaggcgtgagccaccacacctgttctgaaattcctaaagaagaaacaggattgtgtctgtagagcttttgggactgatctagtaagaagaggagaaattgatgataaaggtataagtatgagaggagataattactcatgttcctgataaggtgaaggggggtgtgatctcaagcacaagtggatgaaatgagacaattttttcattttagcacagaaaaaaaaatggctcaggtacaggtcatagtagtatcctctcttttatgagcagggtgctttgtatgtgtaggggaactccccaagcaaaatgaacggctttgaatgaatggcttctctgtatttctttatcttctccaactccctagtgtttgattgcctcatatcctacatagtcctttggtgcttcccattgccgccttctctggaagcctatttccaaagggaagtctcccttccatcttctaacataagcctacacaagagaatttctttcaaaagatttctgaactagagttgatgcaatgccccttttggaggtattatttttttggagacttattttgcaatgcctcttttgggggtaattttggagatttgttaaggtctctcacccattctgcagttttgataaggtggtgggagtgggggcatgtacgctccctcagtgtctctcgcccattctgcagttttgataaggtggtgggagtgggggcatgtacgctccctcagtgtctcttcctgcctgcatctttgggataagtctgtgacctctgggaacagaagagtcctgcagtgaatggcttaagatggtcctggccacatggagaaatggtctcttccttgatgacctcttgggttgggtttatctctccctgttcttttgtaccattagaatagtaacatcttaaggactgagaatcagatatcagcttagagggaaaaaaaaagaaacaaaacacaactaagaaggccaaccagtgcctttcattctaagtctctggagaaacagaagcaaatcttctagttcatttatgatctaagcccagctcaccaatttaaaaaatcagaacttgagtcccaaataccagctaataataaattgtactttttctttgccttgtgctctcttccttgccacgtgaggataatttacttcttcttcttctttttttttttttttttttttttttgagacagagtttcactcttgttgcccaggctggactgcagtggcgtgatcttggctcactgcaacccccgcctcctgagttcaagcgattctcctgtctcagcctccagagtagctgggattacaggcatgcgccaccatgcccggctaattttgtatttttagtacagacagggtttcaccatttggtgaggctggtctcgaactcctgacctcaggtgatccacctgcctcggcctcccaaagtgctgggattacaggcgtgagctgctgcactgggggaaaatttacttcttaaagcacactcatagggcaaatttccatgggtcaaaaaactattattaatttaataggaaaaaagtgcattcttgagctcctatattaaacctaatttgtattaaaattatactaaatctccctaaaatgaagtcagtaattaattaacatgtcatatgctcacctaaatgtattcccttcttcacttgttcttcagtttggttgttaacctgttctaccaaagcttgttcttaactatcacatagtataaactccagattcccttacagaatatatcataccgaatatgtacataattcaaacttcagtgtaaggaaagcaaaacaaaaccagcaacaataaagttggaaaaaaacaataaagacaaaggaatgtcagtgaagaaacgcagatgatatctgatttacccagcatattgacggcatagggaaaaccatgcacagagtcttctctgatgtgaagcgtgtgcttgtctgctgaaagaacttaggcgctatgggctaattcttacgactgtgaggaagactgcacatctcactctgcttctgcttggctcctccagagccacgtgaaatcacaacaattctttttttttttttttttgagacggagttttgctctcgttgcccaggcttgagtgcaatggtgtgatcgcagctcactggaacctccacctcccaggttcaagggattctcctgcttcaacctcctgagtagctgggattacaggcacacaccacgacgcctggctaattttttgtattttttgtagagatggggttttaccatgttggccaggctggtctcaaactcctgacctcagatgatccgcctgcctcagcctccaaaggtgttgggattacaggcgtgagccactgcgccaggccccaacaatgctttaaaaaaaaaaaaaatgaagaaatgccttaaggggtaatgaaatgaatttcccataaagtagaattcaaattcttctaatgagggatgatttccgggttccttggggctccacacacatggctttggtggacatgtgtctgctggcagatacagcgttctgaatacaaaccgtgtctccattctacctgttatggactgagttgcatagctctaaccctcaatgtggctgtatttagagatggggcctttaaaggggtaattcaggttaaatgaggtaatagtgtggggccttaatccagtatggctggtgtcctcataagaagaggagaagacaccagggttgactgtgctcagagaaaagaccatgtgaggatacagccagaaggctgccatctacacaccatggagagagacctcaggagaaacgaagcctgctgacaccttaatcttggccttccagcctccagactgtgagatcacacatttctgtggtttaagtcactcagtctgtgatcatttcttatggcagtctgagctgaccaatacaccaccccttctactcttgcatcccctactaagctagtactattctcaatttattcttacgggaacagccttatattatcagtagtttgaagagctaaccatatccttaattaaaaataagtgagagagtcacttaaaatcttgatgtatagtttatggtaaaagaacggttatttatgtttggagattaccacattctacagtgtctgctgtggatacgtatcttgtgttgtccatttcaagcttctcagctattctgcaagtaaagatcatctcagaggcccatgatggttataatcaaatccagaaacaatacttttgagtctgtatttgccacctgaaaggagtgtgagtaaaattgaattcctggtcctctcagaactcatggaattcctttcctcgggagaaaaccagattatttttgtaattaaaatagctgtatagctgtagacagaaaagaaaataaaaaagagaggcagggaaaactttccattattgattttatcatgctgctgttttagaaaaaaaaaagaagccaggatatagaactactagtttgttcctacagtatgctttgtaccctcagttgaaatattgcagcagttagattatttgatggaaatgggtggcttattcagaagtctggttttcaacatggtgtgaattaaggttagtaggtctgtaccatccccaaacccacctgcctggctttaccataacagctgaagttcctgtcaccagcatcctctgtgcaacctgctatcatgatacagacctgggagagtaacttattattgggaatctccttaattaaaaatcaacacttgtcagaggaaggaagaaatcaggactgtgaggccaacttctatagcagaggaatccaagtacaacccaattctgaaatgattcttgtgtggccttgggcaaatagcctgttttcatttccttaaaataaaaacacaaattagagatgatctcttcttgtctagttcagttctaagattccagaaatcaaaggcaagtgtttttctgtttgtttgtgttttaccttccctctcagagttctttattttttatttttattttatttttattttattttttgagacagagtgttgctcttgttgcccaggctggagtgcagtggcatgagctcagctcactgcaaccttcacctcctgggttcaagcgattctcctgcttcagcttcctgagtagctgggattacaggcactggccaccacacccagataattttttttttttgtatttttagtagagatggagtttcaccacaatggccaggctggtctcaaactcctaacctcagatgatctgcccaccttggcctcccaaaatgttgggattgcaggagtgagccattgtgcctggctagcattctttaaaaaaaaaaaaaaaaatcaactttgattttagattcagaagctatatgttcaggtttgttgcctgggtatatagtgttatgctgaggtttgtagtacaattgatactttcacccaaatactgaatatggcacccaataattttgcaacccttgtccccccaccacagttgtccccagtttctgtttttgccatccatctttatgtccatgagtacccagtgttcagctctcacttgtaagtgagaatacacagtgtttggctttctgttcctgggtgctaagatatggcctctggctgcatctatgtagctgcagaggacatgatttcatttttttatagctgcatagtatttcatgatgtatgtgtaccacattttctttatccagttcactgttgatgggcactgaggttgattccatgtttttactattctgaatcgtgctgggatgaaacctatgagtgcgtgtttctgtttttggtaggatgatctattttcttttggatatatatatatatatacccagtaatgggattgctaggttgaatggtagttctgttttaagttctttgagaaatctccaaactgctttccacagtggctcaacttatttacattcccaccaacagcgtataagcattctcttttctccacagcctcgtcagcatctgttcttttttgactttttaataatagccattctgactgtgtgagatggtagctctttgtggttttgatttgcatttctctgatgattagcaatgggaacattttttcatgtttgttggctgcttgtatgtcttcttttgaaaagtatctgttcatgtttttttgcccattttttaaatgggggtgatttgttttttacttgttgggttatttaagtcccttatagattctggatattaggacctttgtcagaaacatagtttgcaaatactttctcccattttgtagattgtccttctcagcattcttgattcaaattctagcatccatttaactacctatagaaacttagacaaatgacttaacatcttagttgtttcctcatctgaaaaaatgggattaatattaaataatataggcaaaagtacttatgtattatatggcacatagtaggccacaagcagctagctgttaccttttcttctgatcaaaaaatgtgaatttacatcttcatataatattggtcatttttatctgctttttggccatttggtttgggttatatatttaatacatggattcttaactgtatttcagaaatgttaaaatttgaaataatttattcttaggaaaagctggtacgcttgtgatctgctttatcttccttttattgtagccccaaacagagatttcaagcctgtattttgcccctacatctttgggactgctagctccttggctggatttgcatgctcatcaccctcccctctgctctggagcagggaggctcatcagcacagaaagttaaaatttgctgaagccatctgtcttttgttggaggaagcagcttagccataagttgtagctactgttttaacagatttgcaaatagttagggtgggtctggctcaggcccaagtaactgattgggctcatatgcactaatttaagatccactgccagaatgaaaacttcccttatatatcatcaggctctgttatttgcagggtgtcaattaaggtaactggatagaagatcaagaacacaaaggacaggaaggtgggacccatattttacatgtgctgggggagaggcatgattttgtggaaatctgttttattgtgttgaaatacttgtgtgtgttctgcctacttcatgctaataaagaattgaaccccagttatgtttagctatggagtgatgattaagagtgatgtcatttaccaacctgttttgttcaatttatgccaaacattccatcttaatatcatttatcattttctgacactatatgatgtagacagtggtatacaatggtaactagttttttatttacctgttacctgtcttttgtattcaaagttgtgctccagaaagtcaggggttatttttgattttgttcacagctatattcccagtgtgtagaacagttcctggcacatggtaggtgttcattaaatatttgctgaatggagacacctgatactctatgaagacaatgtagaacagtaacttagaaaagggattgccaaactaaggcccaaatccagctcaccacctgttttttttttttttttttttttttgagacagggtctcgccttgctctgtcacctagtctagagtagtgtggagtgatcatagttcattgcagtcttcaactcctgggctcaggtgatcctcccatctcggcttcccaagtagttgggaccacaggcacatgccaccatgcccagctaatttttaattttttaaaatagctctttgaaaaacaaagctaactcctaagcagtgtgcccagagtcaacctaatttgttattttttttttttcttgtagaatcagggtctcgccatgttgcccaggctggtctcaaattcctgggctcaagcgagcctcctgcctcagcctctcagatacagatacaggcatgaactactgccttggccctgctgttttaagtaaacttttattggaacaccaccacgcttgtttgtttacctactgtctatggctgcttttgcactatagctcagagttgagtcgttgcaacagaggccatatgatccatgaaacctaaaatgtcttctctgtagtcatttatagagtttgctgagccccaggataaagcatgggcattgggatccaccagacttggatttattttctggtcacttagtagctgtgagggcaagtgatttaaactaagattttggtttcctcatgtggaaaatggtaataacgattcctatctcattggatggttgtaagggttcaccaagatgaaacatcaggaaacattaactactaatatggagccatgtgtgctgggaatttcatttattggcgacctcttcattacgcaggatactttgtcatgtactgaacaaagggaggtgacggaggcctggccctttctctgtgtggcagctgaacagtacctgtagtttttctccactctgtcttctttgatcccattgccacatagttgtccttgctgtgtataggctaatttttaaaagtaaatgtagtttctagaaatattggttgttttgttataatagattattaaaaccataatttcagaagtaagaatatgatttgatttttcctgttaagttctgcttcacttaaaatgagaaaaaaatatgctagtttctacctgtggaggtacttgcataaatacattcctttaaaggggaccaaaacagtaaagcaataaatagaaataccatctactggtataattgctataaactaatgcaaaaatggggtgtatttaattatttattttaaaagttttatattgcttttgaatatttggaaaatacacaggaatataatgaaagtgattaaaaattacaaacattcccactacacagagaaaaaattgacttttaatacatctctcctacttaaagaactgagatgatagtgtaaaaataattttccatcacctcctttttaacttaatattacatatttgtccaaaggcttagaaacattttaaacatacttttttggtttttttaaaatcaactttttgttttgaggaatatctgccctgcagaaaagtgcaaaaaaatgctttggtaacacctgtatattcttcaatcgtcaattatttttatttgccatattaattttatctctctctacagtttattttgttgagccctaaagatgacttttaatggctgcacgtatttactcctgtgtatgtatcacagttaattattctcaggaatagattatttctctttttacctttttgtaccatttaaaattcagttcactgagcattcgtgctaagcattatacatacaagatctaactttaaaactataaccctaaggggcaggagttacagaagataggattaaagcttagagaatttaagtaacttgccaaagatcaaatagctaacaagtggaggggctaagacatgaatcctggtttactggacttagaactctgtgtttttaatcacttcatagtaatatctgtctgccatcttcttagatgttaactcttctacaaaaccttcctgactcccatctctccatacttcctttgctcctagaaccctggctgcttagatggatggtacgctatttcagtataacaacttcttttttttttcttttttttgagacggagtcttgctctgtcgcccaggctggtgtgtggtggtgcaatctaggctcactgcaatgtccacttcccaggttcaagagattctcctgcctcagcctcccaagtaactgggactacaggtgcccaccaccatgcccggctaatttttatatttttagtaaagaagggtttcaccatattggccaggctggtcttgaacttgtggcctcaagtgatccacctgcctcagcctcccaaagtgctgggattacaaatgtcactgggcccagccagtataacttctttacttttctttgtatgttattagaccacgagcacgttttgccctggatctgtgttagtcatcttttactcctactttctgacacatggtagttgcttagtgagtaattatcgaataagtaaatgaatggttgaaagcttcttaacacatattaccaaattgctctacataaatcttatactagtttaagttgatttggaggatttctgttactgaattcaccacctgccaacattgagtgttaggactcaaacagtatgttgtttgggccattttatgtccacaccactcttacaaatttctttatgggaaagaaatttttgtcccattttgttaaataaaattttaaaaatgaaagcttgttttttaataaaatatatatacattgaagaaaatttgttaaattgggagccatagagaacaaaattaccaggaattccactattctgaagcttttaaataaaaaccctgctgctgttttcctatttaaaaataaaccatatgttatctttctttctttcaataataattacttggagtattttcctatgcattagtgggcctttgaaaaccaaaatgtcaaaggctgaataatgttcgtctcacgaaaaaaagtatatttattatcaaaacagtattctagaattgtaaacatagctatggggaacagtttaggacataaatatttgtgcatattactagacactgaatattttaaatgaaagtatttcaaatatgcagaaaagtttaggtattagtgaaacaaatagccaaaggtcaactatacagatatttacagctatccaataactttccatgtaggctaggaactccttctacaaataaagtgatcagaaagaaatagatgtttaccatttgaggaaatgtttctatcttggtagctcctagtttatgttaaatgggtgctagatttactaatttctgttaatgcagttcaagctgtctgagatctattgtatttacacaatacaatagattttttatttgatttgatttctttttatttgatttctttggggacactcatttaaaacaacttttcttgactatagctttaagagctgtcacagctgcagatacagctgcaattttttttagttttaactagaaactcatcatttactcttccttgaacacagctggatatgttcttttttcctggttggtggcactgttatacagctattcatatgactatatgttgctgcatacaaactgggtaaaatcattatgaattattggatgtaatttttatcatcttatgctattttgggggttatatattgctttcactgccactaatttcagtaagagaaaagtgtgtaaatcataatgacagagctaactacaattcttgtcaaaattgttggcttattcttaggatccattggttttatgctctacaaattagaggatctaatttgtagtctgcattccaatactgacgtttttagtgtgctgcctacttgaacattcatgtaaaacattacaggaagaaatgaaggctgggcacagtggcccacacctgtaatcccagcacttcgggaggccaaggcaggcagatcacctgaggtcaggagtttgagaccagcctggccaacatggtgaaaccctatctctactaaaaatacaaaaattagccggacgcagtggcgtgcacctgtagtctcagctactcgggaggctgtggctggagaatcacttgaacttgggaggcggaggttgcagtgagccaagatcacagcattgtactccagcctgggtgacagaacgagactccgtctcaaaaaaaaaaaagagtacataaacacccatccctgaagaatatcatctcatccccttgtgaaaaaaaaaatctcatctcctttccaaaaaataccatctcattgtcttgccaatcaattccaaagagctcaaaaaaacaattaacaaagttagtatagttcccctttttgttcaaaagaggaaagatttgctaactctgacacacatgggaagagcttatgaaatattttattggtttttgctctattgttcattgctattgcatataaacataagattatatatataatttgtgcattataaatgtacctcattcatgcataaatacatgcttcatacattaaacatgtatttttcccccatgcttagatccagtttattccagaaaaaaagcaaaattttcttcaaagatcaaaagcaactattagtagatggaaaacttttaaatttttgcctccaattcttttttttcttgagctatgtatgaggaaatctatagctcagactgtgtctggtgttagtatgtatcaagctctttagccagaaggaggagcaaggcaagtgaaccacatcccttggcacttagttccttcttactttccctatatgagagagtacatgcactcctgagcaaggagactgcagggcggggatctctagaatccccggaggaccaggggctgcatagcatttacttcatcttacagagttaagtctgagatgacagaagggacttatctagggcccacagctagtaaattataatgtcaagatcaaatcctggttttctcacccttatgggtaatatttaatgtcattgttccctttattacactacttttttcaccctagggtgacagctctcacaaagttcggtcctggaacaatatgtttgataattctatactaacaggatcatatactaatggtactaaaacttgattttttttttcttcccaggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtttgctttttctttaaaaatcaggccatttctaaaaagcaggaaaagaatatctttatacaaaggaacttctgcttagacaattattatgacttacttaaaatgatgaccttgatgtgttatatagtagtggaatctaagcaaagatggtactttctaccagctatcagtggatgggaaacttttaaatttttgctttcaattctttttttttttttcttgagctatgtgtgaagaagtctatagctcagactatgtctggggtttgtgcgcatcaagctctttagctagaagaaagatcaaggcaaagggaaccacatccattctcatattagttacgttacaagtagcttgttagaatgatgaaaaatactttcctttttatgtgtgggcaatgtcaggctgaatctgaatatatagaattataagataaatttccgaaaccgtctttagaaacagaagcagaactctatgactatatccatagcacagtaatctgtttaatcatctcttacaaaatgatgccatgtgtggaccgcatttgggattctgaaaacgtgatgtgccttagtcatctttagaatcaggaaattgacaatggtgattggaatgtgaactatcgcttcttcgtttgctaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaaggttactaatttatacgctgtgattttaaatttgtagttatgtgaggaaggttacagtccagagtaaagggtctcctagtgtaaattttttcctccttctcctcctcctcctcctcctcctcttcccccttctcctcctccccctcctcctcctccccctcctcctcttcccccttctcctcctcccccttctcctcctcccccttctcctcctcccccttctcctcctcccccttctcctcctcctctttgtgcaaaggatgctgtagggaaaaattaagcaacctgttagtcatctaatttgttagcgtaggtgcaatctatctcaagagttactttttaagatgtctgtgtttacattcttgcctgaaacttgcagagcattttctccaaatagtattttttatgataaaggcggcaagttattttaacatcctttcttatactaaatcagagtttctcagtctcagcactattgacactttaggccagacaattctttgttgaggacacaccttggacattgaaggatgctgagcagcatcctgacctccacccactagatgccagtagcactccatcccccaaactgtgagaaccaaaaacatgtattttcagatattcccagatgtcccccagggagcaaaatcgcccaggtttaaggcaactcaattgattatatgctcatatttgaagtagacagaacattttaatgttgcttattgttagtcctctgaaatatttcagatttttgcttagaagaacaaagccagattacagcacaagccattctgcaagactcaccgaagatgtccttgctgatgatcgggatgactatgatttcttgatgcaaacgtccacggtatgaggttgcagcttttgtcgtttatttctatctgtcactcattatgttttacatctccagtaatacataccgattcatcatacttagtaacattatttttaaaatgtctgtttctgtttttggatatattttggggactgaaagtttgaaaaaagtttacgtattatgatggatattatgcaatacaagagttattttagaaaaaatatttgtaatggcatgcataatcttaattttgctctgtttcttgacaaaattttaaattgcccttgaatttttcaactacatttgattttcttcatcttactgaattgtctgaagatcaatcatcataatttgtgagaggtcaagctttgctcccttccattttaaattctcaaagctacttctcctaaaatgctacattgaaaaagtatttagttgtgttcattgtagagtgatcccatatttgagtttgatgttcacatgttctgaactatttcaaaatgagtttaggccaggtgcagtggcttaaacctgtaatcccagtactttgggagttagaggtggatggatcatctgaggtcaagagttcaagaccagcctggccaacatggtgaaacgctgtctctattaaaaatataaacattagtggagtgtggaggtgggcacctgtaatcccagctactagggaggctgaggcaggagaattgcttgaacccaggagacagaggttgcagtgagccgacacggtgtcactgcactccagcctgggtgacagagtaagactctgtctcaaaaaaaaaaaaagtgagcttaaagttcaaaatgttatgtgtcagagaaaggaaaggccaagaacatgcaaaaaaggtgggtgacgagtataaaaacccaaacattggccaggtgcggtgactcgcgcctgtaatcccagaactttgggaggctgaggcaggtggatcacctgaggtcaggagttcgagaacagcctggctaacatggtgaaaccccgtctttactaaaaatataaaaattaactgggtgtcgttgtgcacacctgtagtcccagctactcgggaggctgaggcaggagaatctcttgaacctgggaggcagaggcttcagtgagctgagatcacaccactacaccccagcctgggtgacagagtgagagtctatctcaaaaaaaaaaaaaaaaagtgaacatagatttgcatacatgtataagcttgaagaatttgaagcttccctatgcttaatggattcgtggttttattacatacatacactgtatatgtgcacatatatatgtatgtgtgtatattacacacatctagcacacacatatatgctgaccagcataaaaagacttaaatcatttagcatgtttgctcagatcacatcttttctctctttcctgttatttcttatttaattcaggatctctggtaaaagacgtttcttagtttgtagtgttagtcctttgtgcctacaatattttcattcacccaaacggttttaaaccaagaagtgaattcttaagtcattcacagacttagacacagttaggattgcaaatccaagttttgttttgtttagttttactttgccaatatttggttctgctatcttcacagtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaaggttagttttcctcaattttttgcaagaatgacatgtgaaaaaaatattggtgaacctagctattccttttccttgtattttgtgaccaaggtatttctatttataggaagaatataatcaagccattaatgtcaatgtcgtttttgttattcatacaaaccagttaaggaatctaaatgtgttaaatgtgcaaacattgtacagtaagagcagtgcagccttttggggtaatgatcatatattccttcaggtaacatgactaacagcttgggttaccaatacttagcctttgttttagggttgagagatgggtgaatgtgcggcttttaaccaatgacttgatatagatttcgggaactggctatgtggtggggagaaaactgtgaagacaatgtgggctggtagtttagaccaggtggacgcatttgaactcggactgaggagaagtgggttctttcctcagctttgccattgactcgctgtgtggctttgggtaagtcagttacactttctgtgccatctttttttcatttgtaaaacaaaccaaactcaaaccaaaccttcaaaaaagtgaagaaggctatcttccttgcagaataagacaagagaagatctgaccattggcttctaccttttgtgcccatgcatcctctctgatctgctgtgacaggtctccgaaagagtcctttataacgttgcttttcttctatacttgcaccatcattttttgggaaactcactttcctgccctcgggttgtaacatatgaagcataatggacttagcattttcaatgggagcccagcaaaaatctctaatgaagagctctttacataagtttggaacaaaaaaaccacatgtctccaggaatattttttgggggccatgcttaattttcagggatggcaacagtataagtaaagaactcaatatagggatgggataactgaaagatgattttgttggaggaaatggaagatagggaagggtcattggattttatgtagatagtgtgaagaaatgcagcctacatttgattactcaaaaactgatttatcccagcctttttgttctttcccttctgcttgcctggctttagccttttttgctggttttgttaatatgtttactgtacagtggcaaagaaagagaatgctgataaggctcaaattacttaactttgttaccatctctagtaaaagctttagggaaggtgaaaatcaggtggcatttgtggttaatatcactgggtttttttttttttttttttttttttttttttttttttttttttttgcatattctagttaaatctgtctctcagatcactgggaattgtccagaaaggggcaaaattttagccaaattttaagtatatcaaatcactgaaggcttatgtagaatttgcctaaggactttgatagtgtctggaaataaatgcttctcatttcagaacaagtggtaaaacaaaacaaaacaaaaaaaagctaaaaaaaatccatgagatgaaaattacaaatttggatgatttttaaatagttaaacttttttgaacccagaaaaaggtctagtttggtttgagtttttggagagaaggtgcaggtcagttcttacttggttccaacttgttgacctgtcttcattaggtgtgaaatgtagagacttataagacctgattcagaacgtccactgcagtcaatggagttttgctcagaatcacagaatcgggcctattgtgcacctctcccattacagcatgagcttgttgcttgcgcagcataatttagttagtttgcaagatatacctgctttctcttttatctgtggttgtacaaagataaaaatgttcttttgaaattcagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtacgcggtcagtgatgatatcagtcttctagggaggaagacttctttcccccattaaaggaaaacacagtttgtaagatcaaaaagtaaaatagacacatgtacatgtgcccctggtctgaaaatcagccgagcagacctgcccctagcaagccctcctcatagctgtcccagccactgcactcctgtgacctgagaaacaggtctcaccccaacaaagctgcacaatcaccaccacaaatgcctgtagcgagaccactgaggcacttgcagatgctgctgacataaattacagctgaagaatctgcacagatactacactaccgcatccacccagaaccaaaaccagtgtatcctacccaaccggtaccctagaacccatctacaggaaaagctatttcctacaaaagctacttcataaagttggaagaagctactgttttaccagatgaacagatatcaaaggaacacaagaaacacgcgaatggaaggaaacatgactcctccaaaggaacacaataattctctagtaacagatccccctccccaaaataaatttataggatgcctgaaaagaaattcaaaataatgatcttaagggaactcagtgagatacaataaaatgcagatacttcaacaagattaggaaaccaattcatgatctgaatgagatattcaatgaagaaatacatatagtagaaaagaactaaacagaaatcttgtaactcaagaattcaataaatgaaataaaatatacaactgagggtttcaacaacagactagatcaagcataagaaagactttatgaacttgaagacaggtcttttgaaataacccatccagagggagaaaaagaaataaaaataagaaagaaggaaaaaagcctatagaacttatgggatgccactgagcaatggagaaaggcacagaaaacgtttaacaaaataatgactaataactttccacatctttggaaagatatggacatccagatccaggaagctcaaaggatctcaagagaatcaacccagaaaagtcctttccaaggcacattataatcaaactgtcaaatatcaaagaaaaagaatcctaagagtaatgagagaatagcaccaagtcatatatacttggatttccatttgactatcagcaagtttctcagcagaaaccttgaaggctagggaaatgagatatattcaatgtgctgaaagaacaactgtcagccaagaatactatgtctagcaaagctatccttcagaaatgaaggaaaaatagagtactccacagataagcaaaagcagaatgaattcaccacctctggacctgccttagaagaaatgcgtaaggcagtgctaaagctggaagcaaaaggatggtaattactatcatgaaaacatgtaaaagtataaaacccattcgtagaagtaaattttaaatcaaactcagaatactgcagtactgaaatggtgctatgccaaatctttcagacctctagtactctagtatgaaggttaaaagtcaaaattgtcaaaagtaactacagctacaagtagttgttaaggaacatacaatatagagagatgtaaattaaggcatcagaaatataaattgtgaggggagggtaaaagtccagagtattttttttttttttgagacagagtcttgctctgttgccaggtaatggtgggatcttggctcactgcaacctctgccttctgggttcaagcaattctcatgcctcagcctcctgagtagctgggattataggcatgcaccaccacacccaggtaatttttgtatttttaatagagatggggtttcacgatgttggccaggatggtctcgatctcctgaccttgtgatccgctcacctcggcctcccaaagtgctgggattacagacatgagccaccatgcctggccagtccagagtatttttatgcaaccaaatgtatcagcttaagatggtctattataactacaatattgtttgtcttagtttcatagtaaccacaaagaaaaaattgcagcagtcacactaatgagaaagggaaaggtatcaaagcttagcaccacaaaaaggtatcaaaccacaaaggtaagcaagagagcaagaaagaaatgaaggatctagaaaacaaccaacaaaatattaggaataattccttacctatcaataataaccttgaatgtaaatgaattaaattgcttagttaaaatatatagagtggctgcatggataaaaagcaagactcaactatatgctgcccactagagattcacttcacctttaaggacagacatagcctgaaagtgaagggatggaaaaagattttcaatgcaaatggaaactgagagtgagcagaagtagccacacttagataaaatagacttaattcaaaaaatgtaaaaaagagtcaaagaaggtcattaatagaaaaggatcagttaagaagatataacaattgtgaatttatatgcattcaacactggagcatccaaatatatgaagtatgttttatctaaagggagagataggcttcaatgcaacaatagtagggaagttcaacaccccactttcaacaacagcagataatccagacagaaattcagcaaggaaacagcagatttaaactgcactctagaccaaagggacatactagacatttacagaacattctgtgcaacagatgtatagctgaagaatacacattattctcaactgctcatgtggcattctccaggacagatcatatgttaggccacaaaataaatctttaaaaatttaagatgatatcgtatatattttctgatcacactagtataaaactagaaatcaatactgagaggaactgaggaaactttacgaatacatagacattaaacaacatacccctgaataaccagtgggtaaatgaagatgttaaaaaagaaattaaaaattttcttgagacaaacaaaaatggcgacacaacataccaaaagctatgggatacagcagaggcagttctaagagggaagtttacagtattaaatgcctacatttaagaagtaaaaaataaaccacctaatattgcacctccaaaaaccacaaatacaagaacaaactaaaccccaaattaatagaagtaaataaataataaaaattggaacaataacgaaacagagactaaacaatacaaaagatcaatgatacgaagagttggttttttgaaaagacaaaatcagtaaacctttagctagacaaagaaagagatgactcaaataaataaaatccacattgaaaagaagacattacaacctataccacagaaatacaaaggataatgagaaaatattatgaaaaattgtatgccaacaaattggataacctagaagaaatggataaattcctagatgtatacaacctaccaagactgacttatgaagaaatagaaaatctgagcagattaatagtgagtgaggaaattgtatcaataatgaaaagtctctatcaaagaaaagcccaggactaaatgggggaaaagttgaaagcttttttttctaaggtctggaacaagacaaagatgcccactttcaccacttctgttcaacataatactagaagtgctagccagagaatttggcaagaaaaagaaataaaaggcatccaaattggaaaagaagtcatcaaattgtctcagtttgtagatgacatgatcctatatataaaaatacctttaaaagtttactaaaaaactgttaaaactaatacattcagtaaatttgcaggatacaaaatcagcatacaaaaatcagtatttctttgcactagtagtgaatgctctgagaaaaaaaatcaagatacaatctcagttacaatagctttaaaaatcagttatcggctgggcgcagtgactcatgcctgtaatcccagcactttgggaggccgaggcgggtggatcatctgaggtcaggagttctagaccagcctggccaaaatggtgaaacctcgtctctactaaaaatacaaaaaaattagccgggcatggtggcaggcacctgtaatcccacctactggggaggctgaggcaggagaatcacttgaacccaggaggcagaggttgcagtgagctgagctccagcctgggtgacagagtgagactccatctcaaaaaaaaaaaaaaaaaaaaaatcagttatctaggaatacatttaacaaaggaggtgtaagatctctacactgcaatctataaaacattggtgaaataaatttaagaggacagaaataaatggaaagatatctcatgctgttggattggatggattggaagaattaatattattaaaatgtccatagtacaaaaagtaattacagattcagtgaagtccctatcaaaataccaatgacattattattctattatagaaatagaaaaaataattctaaatttcttatgaaatcacaaaagaccccaagcagccaaagcaatcttgagcaaaaagaataaagctggaaacatcacactaactgagtttaaaatacacaaagccatagtaaccaaaacactacctgacttgaaactatactacaaagctatggtaaccaaaacagacatatagaccaataaaacagaacagagaacccagaaaaaaaaacacctatccatatccaactaattttcaacaaaggtgccaagaacacacattggggaaaggacagtttcttcaataaatggtacagggaaaattgaatatccacatgcagaagaatgaaattggacccctatttttcaccatatacaaaaatcaactcaaagtggattaaagacttaatgtaggaccttaaactatgaaagtactggaagaaaacatgggggaaacacttcatgacattggactgggtaaggattttttggacgagacctcaaaagcacaggcaacaaaagcaaaaatagacaagtgggattatatcaaactaaaaatcctctgcacagccaaggaaacaattaacagagtgaaaagacaatctacagaatgggacaaaatatttgtaaactatacatctgataagggatcaatatccagaatatataaggaacacaaacaacaatagtaaaaacaatctgatttaaaagggggcaaaagaccttaataaacatttctcaaaagaaggcatacaaatggccaacagacatatgaaaacatgctcaacatcactaatcatcagcaaagtgcaaatcaaaaccacaatattaccttattccagttaaaatggctattatcaaaaagacaaaagataataagcattggcaaggatgttgaggaagagggaaacccatacactgttggtgggaatgtaaatgaatatacccattatgaaaaacagtatggaggttcctcaacaaattaagaatagtactaccatatgatccagaattcctgggtatatatcccaaggaaaggaaatcagtgtgtggaaggaatatctgcacttctataattatcacagcactactcacaatagccaagatagggaatcagcctaagtgcccatcaatggattagtaagtgaagaaaatgtggtatatatacacagtggaatactatttggtcataaaaaaaatgagaacctgtcattcgcaccaatatgggtgagcctggaggatattgtgtttagtgaaataagccagacatagaaagaaaaatactgcattgcccactcatatgtagaatcgaaaaaagttaatgtcatggaagtagtgaatagaatagtggttatcagagactgggaagggtaggtgaaagtgggggagagggagcagatacccaatgggtatagagttaacattagaaaggaagaataagcgctggtgtcctattggacagtagggtgactatagtcaaccatcaggtattgtatatctcaaaatagctagaagagaggattttgtatgttctcaccacaaagaaatgaaaaatgttcaaagtgatagacatgctaattaccctgatttgatcattacacaatgtatgcaagtatcaaaacatcatgttacaccccattaaatatctacaatgtgtcaattaaaaaacagtaaattagaaattaaaagaaaatggaaaaagttagattaattatgtatgtttacttctgttaaataatgacaatgccttaagcccttcagagtaaacagagtatgttccccaagcagtgttcacatagtaatgaaatactctaattcttgaaggagcacatcaatcgatatgcaagaaaggaaaatctctgggctccttctgtaaagtattcctttgttgttataaagaaaaactttttcccttgtcttgtttcattactaacattattaaattcattaaatgtatttcaggtggaaccgagtacaaaattatttcctgcggtttttgcacaagctacaagtcccaatgttttccagtttgagttgggaagaataaaggtaataaaacttattcctggtattgtatttgtattttttctattaggatatagcattgatttattctgaaatgaattcagtatattagtactgatatgaatcaaataaatcattctttcaagaaaagatagccatgcttgaaaatctctttcaggtcacaagggtaacaaaataattaaaaagtgtttctctttagttatcatatgtatattattcaataaaaggcctatagaaaaaaaaatgccgagattacacacattgcagcagtcattgaactgataggtgagctaatgaatggacttaaagatctgaaaccatgccacctacaatagtggtatgtatggaatactccagtaacataaatgaaagaacaactcagttggatgggttggatcagctaaagctcaaagaagaggtaacatttagtttgattactaactgtaaaatagaagctcttggggtacgtttattaggagaggtcattctgggcagaggatgagaagaagcaaaaatatgtaagagtgaacatgctgaaggttaaggaattcagtgtaaccgtaacaaaggatgccttccagaatgtggctggagattaagatggataaaaggtagaacaagtccaagttgaaaaggtcttgtgtgccatgtgaaaaggttagcatctattacatagacaagggaaatccattggaaatttgaagaaggggattgagcataatgaaacttgttttggaaaaatatgttgttattaatgtggaggtgggcaagaatgagaataatcagtagcaatgaggtgtcaataatttgatactgtctacatggaagacagtgattagagccatggaagtcagaatgaaaaatgataaatgtgaaaacattctagagaagaaatgaatacgcgaaggcccgtggtgggtgatgacatgatgtgatttctgcccagtgctctgaatgtcaaagtgaagaaattcaatgaaggacgggtaaacggcgggagtaactatgactctcttaaggtagccaaatgcctagtcatctaattagtgacgttcatgaatggatgaacgagattcccactgtccctacctactatccagcgaaaccacagccaagggaacgggcttggtggaatccgcggggaaagaagaccctgttgagcttgactctagtctggcacggtgaagagccatgagaagtgtagaataagtgggaggcccctggtgcccccctgtcccagcaaggggacagagtggggcaaggccagaggtgaaataccactactctgattgtttattcactgaccccgtgaggtggccccaaggggctcttgcttctggcgccaagtgcccggccacatgcacatgccaaattgtaaagaccatcgatgctaggaagaaactgcgtcaactaatgagcaaaataaccagctgacatcataatgacaggatcaaattcacacataacaatattaaccttaaatgtaaatgggctaaatgctccaattaaaaaacacagactggcaaattggataaagagtcaagacccatcagtgctgtattcaggagacccatctcatgtgcagagacacacatatgctcaaaataaagggatggaggaagatctaccaagcaaatggaaaacaaaggcagggattgcaatcctagtctctgataaaacagactttaaaccaacaaagatcaaaagagacaaacaaggccattacataatggtaaagggatcaattcaacaagaaaagctaactatcctaaatatatatgcacccaatacaggagcacccagattcataaagcaagtccttagagacgtacaaagagacttagactcccacacaataataatgggagactttaacaccccactgtcaacattagacatatcaacgagacagaaagttaacaaggatatctaggaattgaactcagctctgcaccaagcggacctaatagacatctacagaactctccaccccaaatcaacagaatatacattcttctcatcaccacatcgcacttactccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggacactgaacaacctgctcctgaatgactatggggtacataacaaaatgaaggcagaaataaagatgttctttgaaaccaacgagaacaaagacacaacataccagaatctctgggacacatttaaagcagtgtgtagagggaaacttatagcactaatgcccacaagagagagcaggaaagatctaaaattgacaccctaacatcgcaattcaaagaactagagaagcaagagcaaacacattcaaaggctagcggaaggcaagaaataactaagatccgagcagaactgaaggagatagagacacaaaaaacccttcaaaaaatcaatgaatccaggagctggttttttgaaaagatcaacaaaattggtagaccactaccaagactaataaagaagaaaagagagaagaatcaaatagatgcaataaaaaatgacaaaggggatatcaccatcaatcccacagaaatacaaactaccatcagagaatactataaacacctctatgcaaataaactagaaaatctagaagaaatggataaattcctcgacacatacaccctcccaagactaaaccaggaagaagttgaatccctgaatagaccaataacaggctctgacattgaggcaataattaatagcctaccaaccaaaaaaagtccaggaccagacagattcacagccgaattctaccagaggtacaaggaggagctggtaccattccttctgaaactattccaatcaatagaaaaagagggaatcctccctaactcattttatgaggccagcatcatcctgataccaaagcctggcagagacacaaccaaaaaaaagaactttagaccaatatctctgatgaacatcgatgcaaaaatcctcaataaaatactggcaaacggaatccagcaacacatcaaaaagcttatccaccatgataaagtgggcttcatccctgggatgcaaggctggttcaacatacacaaattaataaacgtaatccagcatataaacagaaccaacgacaaaaaccacatgattatctcaacagatgcagaaaaggcctttgacaaaattcaacagcccttcatgctaaaaactctcaataaattaggtattgatgggacgtatctcaaattaataagagctatttatgacaaacccacagccaatatcatactgaatgggcaaaaactggaagcattccctttgaaaactggcacaagtggccttctctccccactcctattcaacatagtgttgaaagttctggccagagcaatcaggcaaggaaaagaaataaagggtattcaattaggaaaagaggaagtcaaattgtccctgtttgcagatgacataattgtatatttagaaaaccccatcatctcagcccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttccaagagaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactatactacaaggctacagtaaccaaaacagcatggtactggtaccaaaacagagatacagaccaatggaacagaacagagccctcagaaacaacaccacacatctacaaccatctgatctttgacaaacctgacaaaaacaagaaatggggaaacgattccctatttaataaatggtgctgggaaaactggctagccatatgtagaaagctgaaactggatcccttccttacaccttatacaaaaattcatccaaggtggattaaagacttaaatgttcgacctaaaaccataaaaaccctagaagaaaacctaggcaataccattcaggacataggcgtgggcaaggacttcatgtctaaaacaccaaaagcaatggcaacaaaaactaaaattgacaaatgggatctaattaaactaaagagcttctgcacagcaaaagaaactaccatcagagtcaacaggaaacctacagaatgggagaaaatttttgcatttttgcaatcttctcatctgacaaagggctaatatccagaatctacaaagaactcaaacaaatttacaagaaaaaaacaaacaaccccatcaaaaagtggacaaaggatatgaacagacacttctcaaaagaagtcatttatgcagccaacagacacgaaaaaatgctcatcatcaatggccatcagagaaatgcaatcaaaaccacaatgagataccatctcacaccagttagaatggtgatcattaaaaagacaggaaacaacaggtgctggagaagatgtggagaaataggaacactttcacactgttggtgggactgtaaactagttcaaccattgtggaagacagtgtggcgattcctcaaggatctagaactagaaataccatttgacctagccatcccattactgggtatatacccaaaggattataaatcatgctgttataaagacacatgcacacgtatgtttattgtggcattatttacaatatcaaagacttggaaccaacccaaatgtccatcagtgttagactggattaagaaaatgtggcacatatacaccacggaatactatccagccacgaaaaatgatgagttcatgtcctttgtagggacatggatgaagctggaaaccacaattctcagcaaactatcacaaggacaaaaaaccacacaccgcatgttcttactcacaggtgggaattgaacaatgaaaacacttggacacaggaagaggaacatcacacaccggggcctgttgtggggttgggggagggagggagggatagcattaggagatatacctaatgtaaatgacgcgttaatgggtgcagcacaccaacatggcacatgtatacatatgtaacaaacctgcacattgtgcacatgtaccctagaagttaaagtataataaaaaaaagaataggatttaacaatgaattggactaatagaatttgtagatgaatggaattcaggatctcaaggagactgagaatgaatgattgatttaaaattttagtttggacaatttgaccatgctaatcaaaaagtagaagagcttttcgaaattcaggaaaaaaggttgaacttaattttgcaattgtaaagttgaggttccaggcacacattggagtgaatagagtagatagttttattaggctggcttggtgaccttggacatctttcttaaattatttgagctcagtttctgcatctataaaatggggttcacagtatccgttttatggagttaatataactaaacatcttgagcagtgctttatacatggtatacagcaaatttatatactcaataaatttacatacaatatacatacgtatgcatacctatatacacatatgtatacaccattgtgctaaaaagagctatgctggagattaaaattttcatcatcaagaaatcagttgtaattcatctttgagtgtgaatggaatatttgagggcagatgtagagagtgggaagagatggctgaggagagagcctggttgtatcaactaaaaaagaggaacctatgagataggctgagggcagaactctcaagaatgttggagaagaactgaaagagacattttagtagacgccaagcgaggatggagttttctaaacaggagtggctaacagcggatgccgtagatggactcatacaactcggagtaaaggaattcctggcttttgttaatgaggagggctttggtggccttgccagaagaatttaagcaaaacaatgggagaggggctggtctcagtggctcatgcttgtaatcccagcactttgggaggaaggaggaatcacttgagcccagaagtttgaaaccagcttgggcaacatagtgagaccccatctctacaaaaaataaaaaattattttaggcagatgtggtggtgcacgcctttagtcccagatcctccagaggctgaggtgggaggatcacttgagagtgcagacatggaggctgctgtgagccgtgattgcgctgctgcactccagcctgggtgacagagggagaccttgtctcaattattatattaaaaaatgatgagaggagccatgtgacagtgaattcaagattggaaatgagagaaaggaggcagcaagttcagactgacctgttttttttttttttttttttttttacaaaattggacaaggagttgtagtttctcagaagcctgactgatatattcagtcatctattgactattgacttctactgacattttcattggccgactaatagctatcacaaattgaatgcatccatactggactgcttgctctcttctcttcttttcctttcttctttctctcttcttctcttctccctctccctccctccttccctccctcccttccttccttccttgtccctgtcccttttctttcttgctgacagtctcactctgtcacccaggctagagtgcactgatgtgatctcagctcactacaacctctctctctctctttttctctttctctctccttccctccctcccttccttcctgccctcctatcttccttgtccccatcccttttctttcttactgacagtctcactctgtcacccaggctagagtgcagtgatgtgatctcagctcactacaacctctctctctctctttttttctttctctctccttgcttccctccctccatccctccctccccccttctccccttccccccttcccttttctttctttctgacagagtctcacttgtcacccaggctggagtgcagtgacacgatctcagctcactgcaacctccgcctcccaggttcaagcaattctcccacctcagcctcctgagtatttgggactacaggaacatgccaccatttttgtttttttttacaggcgaatttttgtatttttagcagtgggccaggctggtcttgtactcctgacctcaagtgatccacctgcctcggcctcccaaagtgctgggattacaggcgtgagccatggtgcctagcccagtctttctttaaatgttgctttctcaatgatgcccattctgacaaccccatttaaaattgctgcccttgattctggttcccccattctagctttctgtcccccaaacccccaggcccatgacatctcttttaaaataccatttaattcatttaatttacttattgattttatttcatactttcagtgagaaaaatggaagctatatgagggcaggggttttgttagttttattcattagcatatcatcagtatttaaaccagtacttggtttttccccgcctattgttagagggcaataggaaagcagtttgaggatgaagtagtctacagcatgcagttgagggggctctagaggagaagaagagatagaagataatgcagaaatatgagataatggttttcttatggtcccataagaggcaggcatcggtgttgtcaagatcatagataaatgaagaaacttttggcaaagcagagacctctctttctttgacaccagacagaaagaattaaggatggctgaagatgatactggaggtggaggagaaataagtaggtttgttaatgcctaacatattctgttttcttattcggtagtcaggtttatctgttgagctttatctggaatacttctggctagaggaagtgtcttaaggacgagttgggtgacagagaacagatattgagagagagagccagggggatgtgacatatctgtcattcaggaagtttggcactgaaagtccctaaagacttgccagctttcccggaggtcccagcctggtaaagaaatataaaggatatatgggtatgcttggccttctctctgtgccattcagtatatgggaaagacacatcccgaaacctgtttgactgcccggaaggtgtaggtattctctctcataatgtatttcctggtttgtcctttcagaaacttttcaacccaatttctatgatttcttgtgttgactttgcttgactcatagggttatcttactttccctgtctctgtcctgtgcagaattctagtcattactttgtgaaccccaagggatgttctacatttattctttttctgcctccccatccgctagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacaggtcagccccagtgaatccctgacattctgattgggacgcttgggattagcctgctgcccggggcttccggtagtggtgcggggcaggggtggttctaaagaaacaagatgaaatttacaaagatctaaattctttaggcaatggagtcattattctgcgtattctaagtttaagtttatttctcaaccattctgttactgaaaaaaattattctgtagttgaagatgccacatgatggtttcttcattcactcttgcgttacttacaatgacaatggcgaataaaaattcagacaagtgcaactgcaatccgacttatgacttagcagagtactgtaatagagaatagtgagatattagagatggaatcataagaatcacttatgattcctatgttcaacccttcattttatagatgtaaaaaactgatccaagagatattaatgaaagaaaattgggaaaatactgggagtgtcttcgaaacaagtttatatgcattctaggcagtaataatagtaacataaagtataataagtactcaaaggtatttgagtagctttgtttatgattttctgtttttccatatgatagccaattaaattgcagagatttcatttaagcagccttcttatcaataaggagctaagtttctaagttttgggccaagatttccctcccaaaatgccactgaaatgttgaatcacaaactgagtaaaaacaagtcatgaaagtaatgcacaaacatatttgtatgttttaagtctttaatctgaaaataattattgaagccaggtccatttttatatctttagatgttcttggcattttttattttaatatctttaaaatttaacctatgctttggaaaacagtttgtcagttcctcaaaaaataaaattatagcgttaacatgtgatctagcaattctactcctcgtatatacccaagagaaattaaaatatgtccacacaaaaacttgtacatgaatattcatagaagcattatgaacaatagtaaaagaaagggaaccccaaatgttcaccagcttatgagtcaataaacaaaatgtgatatatccatataatattatttggcaataaaaatgattgaagtactgatatatgctacaaaatgcaagaactttgaagacattatattaagtgaaagaaaccagtcacggaagtatattaagtgaaagaatcctactagtgtgggattttatttaattgaaaagtccataatagacaaatctttagaaacgaaaagtagattagtagttacctagggctaggagcggaacaggactgctaatgggtactaaattccttttgggatgataaaagtgttctaaactcaacttatagttatagttacacaactccattaatatacataaactattaaattatgtattttaagtaggtaaattgtatagcatgtaaattacagttcaacaaagatattttaaaacaaaagaaaatcaaagaaaaattaatctggctagttaattctttttatgtattacatatgtatttacattttttacatgaggtaattagatatctttcataatgtactcttgagatggttcagtttgattttaattttgtattctttttttttgtgagaagagttttatcataatttttcatctgatgatgttttttaagaaaataccgaacaaccaaaacaaacacaacatttgggaaggaattcttgtttatgaaggaaaacgttgtgtctctactgagcatggaattttaacattataatttaacattttggcatgctatcatcgaaaaccaacataacaccttgtctcagtagtttatattaattgcctgtgatagatgtgtatgtatgtgaatggataatgtaaactctcactaaagatcataaaggatttgaggcagttttccaaatgatatggaacatgaatgtataaaaatgtgtcactggcatcaggccatagaaaatatatggataggaaaataaaactgaggctaagagtgacacacagtcatttataccacaccgattggtagagttggggcccacattaatttcattcttcctagcagccaaagaaaaatatgatgagtttcaaaatccaaattccaaaaaaggaagtcttaactagcatggttgagaagaatctgatgccccaataacatgacaaatcattaatattttaaagtgtgcaatggtggtagatttatgtcagtgtgtactttgtttctccttaacacatgtcacagtttataatttaatttactccattttggtcagcgggggtggtttactccctcaattgaatataagctccctgggggcaggaatcatgtctatattattcaccattgtatcatcagtgcgcagtgctaatacataataggcactcagtgatatttgatgaacaattgaatgacaatgacatatgaaagaaatttctccactagagacttttttgttgttgtttctttatttatctattgttttgaggtggagtctcaccattgcccagtctggagtacagtggcgcgatctcggctcattgccacagatccttgatacaatggaggaggaaggaggtgctagatgaatgtcaaattctatgtagaagaaaatttgtagaacatctagaaatgattaaaagtactatgcagccattaaacatgtcatagaaaattaaaagaagacacaggttgggtgtcccaaatccaaaaatctgaaattcgaaatgctccaaaatcggaaacattttgagcaccaacataatgctcaaaggaaatggggtatttcacatttcagactttcagattcaggatgctcaaccggtaagtataatgcaaacatttcaaagtctgaataaagtcccaaatccaaacaattctggtcccaagcatttcagattagggatgttcaacctgcagtgtctattcccataacttttttccttcaaatttacagtgcatactgatttctcctctgattcagattttaaaaaatcattcatttctaatcttactaccactctcctcccttctacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcaggtaatcagaacaagagacttgagtgaatttcagaattgctaagcattaaggtattagaacatgcctttgtttctttctctgtgtgtgtgtttatttctttgcattcctgtgtaatggtagttcttcataaaattaactaacttcctattcttttccctcttattcattagccatctcctcttgtttcccagatgctttttaccttcattacattggaatacctgaaatacaagccatcaaatacccctttccacccatatttccactcttaccaaccttagaatacttgtttaccagtagatgcacccattgtcacatagcaaggttttactttcccctagtatgcttttgttttgttcttttgagacagggtctcactcagtcacccaggctggagtgcagtggtggtgcaatcatagctcactgcagcctagaactcctgggctcaagccatcctcccacctcagcttctacagcagctgggactgtaggtatgccaccatgcccagttaatttttttttatttttagtcgaaatgaggtctcgctctattgcccatgctggtgtcaaactcctggactcaagtgttcctcactcctcatgctcccaaaatgctaggattacaagtgtaagccactgcacccagccaccttagtatgtttttaaggaatcagacacactggctgtctttatgctcctcaagatgtctaaagggtcctttattaatgtctcctctgtttattaaagtcaattggatgtttgcatcgctgacctgcttttttgctcctcgttcctttagtcagcgttgactgaagccttactctgggtatgcacttaggggaaacacaagtgaaccctgcctttcagaatctcacagcctctaaggaaatatacactcatttatgcattaaaaaatcttattgctaattgcattaaatactctgaaggcaaagaatggattactaaaagaaagaacatttagactggattactgttagaaagatgagggagaagacccctcagagattttgacttttaagctgagttcagatttaagagttgtgctcagcagttacaagaaaaaggaacaaggcagggtgttctaggagctttccatgcaaaacaaatagcccagcaaaggtcctgaggcaggaaaaggccagtgtggctgctggtaggaaaatcgataagggaggaaagagagtgtgatctagtgtctggttagtcaggaggctttcttgctggtccaaactctaggagaccatgctcagaggagggtggggcaaaggagatggagaaaaggggttggacactgtgactacttcagagacagcactgatagaaatggttatattgtagatggtgacacagagggttttaaggtcctctttgacactgtcatgtatttatatcacaattggtattgagtgtatagatttttttaaaaatttggcagagcattctctcttagaaatgtttctaccaacatactcactcagttataaatccttttggttttcagtaggagaaagacccagctaatcactgaatgaatgagcattcaccacttaattgtcttaagtttagatttctagaattggtacagcagttcaatgatctcatccataacccagatcttaatatttttctgctctgtgatcctcagcctgtggttttcttcctaaaatgctcaccttattctttctgcagtaatcatgtcatcacccagttacactcattttgaaagaagggaactctagtctcttatcactgatggaataactttcccagaagacccttagcaaactttcccttatatatttcattggccattgcacctgtggctgaaagggaggctgggagggtaagtgtattagttcgttctcacactgctaataaagacatacctgagactgagtaatttataaagggaaaaggtttaatggactcacagttccacatggctggggaggcctcacaatcctggcgaaaggcaaatgaggagcaaagtcacatcttacatggtggcaggcaagagggcatgtgcaggggaacttccatttataaaaccatcagatcttgtgagacttattcactaccacgagaacagcatgggggaagacaccctcatgattcagttatctccacccagccccgcccttgacatgtgggggttattacaattcaaggtgagatttcatggggaaagaaccagaccatatcagttaacatccactaaagggacatttgtttgccatttttgcttatacaaattatgtttcatctcctgggaccgagcacattgctgcctatacaaaatcaggattctgtttctaagagagaagagtaggcaactaaggatgtttaccacagattatgatttcatacacattattaaaggatttagaaattaaatttggtgtctttttaatggtctcttagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacaggtacagaaatgaaatgaaaattcttcgtatttatgttggcttttagtcattcaggatctctgccttgcaaaattatataactcacacgtcttgttttccttgttctgtttaaagtcttcaagttgatttagttagtattcttagtttcaccaaaagaatttctttggttagtttacacaaaagagggacttattagaagatatcaggtatatcaccgactctttgagaaggccaagatatgccagagtctgaagttcttcaaataggagcaaatttcaaccacaaatgggtcttcatcatcttccactcataggaatttttgattcctaggactcgatgctagaggctttccatttgtgcctaccatagaagaaacacatgtctcttccaccttgcttgccggaagactgattacctgcttgtggtttcttcctttcattgcttacccccaaagtcaggtctcctgagggtacaacagaacaaagggaacctgcctatatcagagaatgggctagttgggggatgtaaattttctggaatctacctcagagtgggcctcagagtgtgggaagttactggcgtagggatggtgttaaacaatgtaattcacagatgtcttttttgatttcttacccttaccattttcttctctatccagggtagctcagaatgaaagtgtttatagggactaattacagaatttttttttttctcaccagaatgtaatttctttgaggaaagggatgtggaattttcttaattgttataaacagcatttattgagcagagaacaggtccagcctcttccagattaactctgttaaactactgttgggaaacttctgcttctggaaagatggagtacatgtgcttttcccgattcttccttttaagtacaactaaaaccctggacattacaaagaagacaacataagaaggctctgaaagatagagagaagaagagaggttggctacagaactcaggacccaaggaacaacatggtggtgagttccctggattttctttttgcctcatctatcccagatttgaagctaaagaagacgacaaccaggaaacaccaatgggcatagacaagaaaagctgcaacaaaagcctcctctttctagataaaggatcagggaaggggcagcttagcaagacagaaatgtgttagataataactgcactactgaagccaaaaaccacagaaaaaactgttccccacccacactgggcacaggctgagtggggaaccttgacttccactctcaccaggctgtaacaaggtgtcccagtagaggacagagctgggactttatccccgctgagtagtaacaaggcccatttcttccaaagtatcagtagaggttatggaaggagaagtagcaagacactcttacctttctagcaaggttcacatcagtacaggtctaatgaggaaccagaactttttaccactgcccaacagtaacagggtcccttccctcctccagatgtccaagaaggctgagtgggaaaatggacttcgcctcccacctggcagcaataagataccctaagcccttctcctgctggatggggtcagaggaaaccaggtgaaacagagttaaaaataagacccagagctcctagcataatcctcaaaatgttgagatttcaattaaaaatcatgtgtgtgaagaaccaaggaaaacttgaatgaaaaaaccaatcaataagcaccaacactgagataacaaagatgttaaaattatctgatgaagttttgaaagcaatcgccctgtaattccttcaaaatggaaaagaaatagaaagcctcaacggcagagaaacaaaatatatggcaaagaaccaaatggaaattttaaatctgaaaaatataatcactgaaattttaaaactcaatgaataggcttaaaagcagaatgaagggagaagaaggaacaatcagtgaactgaagagagggtgatatcaactaccccatctgaagaaaagatgaagatgaatataacaaaagatctaacatttgtgatgttggagtctcagaggataggagaaagagggtgaactgaagaaaataatgctgaaaacttttcaagttcagtaaaagatatgaagtgagagattcaagaagatgagtacattccgtataggataaacataaatctttaccgagacacatcatagtcaaatttctgaaaaaattaaagacggagtctttaaagaaatgacactacctacagggggagaaacaatttgagtgacagcagatttctcattagaaagtatggagggcagaaggaagtggcacagcaattttcaaatgctgaaagaagagacgatcacctcagagttctatgtactttgaaaatactcttaaggaacgaaggggaaatcaagacattctcaaatgacaggaagttgtaagaatttgactacagcagacctaccctaaaagaatgctaaaggaagttctttaaatataaggaaaatgaaaaatgaaggaaatttggaaaattcagaaaggaagaaattaacactgggtaatgttgtaatatggtgaatgcagtgcatttttattctctggagttttctaatttatgattgatggttgaagcaaaaatcataaaactgatgtgtttctaaatatatgtatagggaatatttaaaaattataaacagaggagaataaaggaacagaaagggagataaggtttctatccttcactcaaactgaagtctactggtgttgacattgtaccatctggtgcaccgtcaataccagtagactgtatgttaggtatgtatataaaataatactcagagcaagcactagaaaagctgtacaaagagatacactgagaagtaccacagataaaataggattctaaatattgttcaagtaatgcatagcatagcaagtcagtaaaaataaatcagaacaaacggaaccacaggtgaaatgacagactgaagtcatagcatatcaataatctaaatataccaattacaagaaattggcagagtgaatttataaaactcaatctaactatatgcttgctatgagaaactcacttcaaatataataatgtatacagattaaaagggaaaagttaaaggaatatgtattattaaaatattaatcaaaataaagcaggagtagctatgttacataaagttgacttcagagcacagaaaattaccaaggagataaggatcatacataatggtcagtccaccaagaagataaatatatatgaattaaacaacaaagcaaaatatgtgaagccaaaactgatagaactgaaaggagaaatagacaaatccaaaattatcttgcagaattcaagactcctctctcagttgatagaacagctgaacagaaaaatcagctatgacacggaaaaactccacactatcatcaaataatagatctaccaaggtttgtagactactccacccaacgacaaggtacacactcttttcaagtgttcatgaaacatttgctaagatggaacatatcctgggccataaaataacctcaagacatttttaaaagttgaaatcatacacatttttttatcacattgttatcaaattagaaagcagtaacagaaaggtaactggaaaatctccaaactcttagagatactaaacaacacacttctaaataatctatggtttgaggaagtatggggagaaatttaaagattcattaaactaaaagaaattggacacatcacatttgaaaatttttgccacagctaaagcaaggccaagagggaaatttctaacactcaatgcttacatttaaaaagcggaaaccactcagatcaataacctgacctgccacttcaagaattttgaaaacaaagagtaaaataaacctaaagcaagcagaaagaagtcactaatgtagataataacagaaagtaatgaaactgaaaacaggacaatagaaaaaatggatccaaaagctggtttttaaaaaatagcaataaagttgacaaacctctaaaacaactgaaaaagaaaaagagaagatacaaattacccataccaggaatgaaactacttatcatggcacaccctgctgacgtcaggtgataacatgggatttttttcttctcacctttgaaataacgataagtagatgagctgatgaatatgttaattatcttgatttaatctttctacaatgtatacatatatcgaaacatcacatggtacctcataaatacatacaattaatatttaccaattaaatatgttttaaaggatcgtatgggaatacatgcatacatactatatgattccatttatgtaacattcttgcaatgacaaaaccatagagatggaaaacaaatttgtggttgccacgacttaaggatgaggggcagacagagggatgtgggtgtgctcatgaaaaggtaacaggagggatctttgagataaaggaattatcctctattttgactgcactaatgttgctatcctggttatgagattgtactacagttttgcaaagtgttaccaatcgggaaactgcataaagcgtacttgaagtctctctgtattatttcttacaatagcatataagtctataattatatcaaaataaacgtttagggaaaaaaaatcacataaatgccaaaaagaaaatctaaaatagtttcttaaaggaaaattatgggaaagcatctttctcttccgaatttataaatttaatagtattgttcaaacataaatggtaaagtttcccgcagtttaactgaaccattaatgttagcagcgcgtagttatcccttataaagattaaccatgccgaatatgaaaattcaaaacccagaatactccaaaatccaaaacattttgagcactgaaatgataccacaagtggaaaattctacacgtaaatacttagtacaaagtttatttcatgcacaaaattatttaaaatattttataaaatttccttcaggctatgtgtgtaaggtgtgtatgaaacatagatgaatttcatttttagacttgggttctattctcaaaatagctcatgtgtatgcagatggagctggtcctctctatctgtgggttctgcatctatggattcaaccaactgtatattgaaaatattcagaaaaattccacaaagttccaaagcacaaaacttgaatttgctgtgcaccaagtactatgtctaatccacttaaatgaagtgatatgtcagcactgccttgggtattataagtaatttagagatgatttaaaatatatgagaggatatacataggttatatgcaatttctgtgccatttcatatagaagacttgattgtctgtggcttttcatctctatggagggtcctggaaccaatactccatggatactaaaggatgattgtattccaaactctgaaaaagaaatcctagatctgaaacacttccggccccaagcatttcagataagggatactcaaacctgtgttacttttcaattatatttttccttcttatttgtgtctgtgttcttctcaaaaagagttcttgtaaatattcaatgaatgttcaatagagatgttagctagaaaataatggaaatttaggataagcatgatacaatactttttaaaaatagcatttagatctcttagttatgaattcttaaagtatacaagagtctgacatattgtggacttgagaaagaggaagaaacgttatatgactattttgcagcttgttaagctatggatgatttgatttattctgcggtactggttggattgtgtgatggacacctgtggaggaataatttatgaacaatcagagattttgagcatttttgcttttgtggtagttgtgcctttctttgtttctttctttctttctttctttctttttttttttttttttttttttttgagacaaagtctcactgtgtcgccgcccaggctggagtgtagtggcacaatctcggctcactgcaacctccacctcccaggttcaaacaattctactgcctcagcctcctgagtagctgggactacaggcatgcaccaccacacccaactaatttttgtatctttagtagagatgggttttcaccatgttggccaggctggtctcaaaatcctgacctcgtgatctgcccacctcagcctcccagagtgctgggattacaggcatgagccactccgcccggccctgctgtgccattcttgaattcacctttcttttcttcctccttcttcctctttcttgtttttcaaactttcagatcaatatgcttctcaattttaaggatgacaaaagtgaatgtccatgtccagaagaaattcgtgaccaactattggatttccatgaagatttgatgacacattgtggtaaggtctttttgattaaaagcttttattaattgtatgtttttaatccatatatcctgagacgaaattaagtgtatatgcgaatattttcacgaatacacacgatacctgttagaaagttatataaaaacatttattattatggcaaaatggcaaaataactgtccctatgtggggagtcctgagggatagagaaatcagagaggcagttaaactgagcagaagatgaccaaaattctttctctctttttcctctttccattagtggcaggaaatgggaagggggacatgtggccaggtgcctctggcagggaggttaaggttggtttagtcaatgggtacaaagtttcggttatacaagatgaatgaattctggagatccatggcacaacagggtgcttctagttcacaatactgtattgtgcacttaaaattctgttaagagggtagatgtcatgttaagtattcttaaaacaacaacaaacaaacaaaaccccccaaaacaaagaagtgctaagaaacttagaggtgatggatttatgtctgttcctggtggtggtgatggtttcacagatggatgcatgtgtccaagctcatattgcatagataaaatatgtacagttttgtttatagtaacctcaatgaagctgttttttcctcatgtaagaaagaaatttgatcacaaacagttgtatttaaagcagttgagggtgtactttctagaaaatgtagactatatcttttgaaattagtgaatgcctatggaaaccctacattaagttgttatgtcagtaatccaaatctgttaagggaagtctcccctccttttattctaagaactttaaaaatggaattgattaggtattctggacgtgtgtgtgtttttattcctttatgcagtggtgtggataaggtctgatgattcaatgaaagaaaatgaaccagctgtttttaaagttatagataaaaataatgccactggtttaaccggtggttatcttattttaatgaagataataaaaacaccactttgcatattaatttggtttatgaatgaagtaccactaaatgactcccagaaaattatactacatgtgtgtgtacatgtatgtgtgtgtatatatatatatttctacaaatatcccttgtagaaatgtgtatgtatgtgtgtgtatatatatatttttttttttctacaagtatccctgtatttctagtatccctacaaatacagggatactagaattctagtatccctacaaatacagggatactttaaaactttagaattactgcttcagatataaagcattccctggtttagggtacctaattatgcctgttctctctgtttctcaactaaccaaaatactgctaaaatttttggaggcaagagaggagaattaaagtctgtggggcatggtgtaggcagggctggactgtaagtctaggcagacagtatctgaagtccgagatgcccaagggttagcccaaatagcagaattgatctttgcccctaagagagtctttttggtctctactcagtgttatattttgttctgggtgacagccctgagcccacaggaatagaacaaaaagagagaggaagaaaagaggctgaccagtgaatgttatttatgagggctggtaagcaacattgcttaacttaatgttagatgtttttgacattgttctaagttgtgcatgaaagaaattacaaggcctcagaattatttgcccaagtgtattctttaaatatttttttctgcctctctgtttttttatactaggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctgtaagcagtatgagagtgcactggcagaatgacccaactgctgacacttaactcatcctttgaacgaatgttttactggatgagccagtgagataattgagtttgcaacttccaagaatcagactcttaagtagatgcctgtagctcccagaaataaacagcagcatcagtctatgtgtatagcaacagactgagaggtagcagcatgataaagatggatggtctccatagagaactagaaatttaggtattttatcagagaccataaagagaaagttaaaaggaagtatagtaatttagccttcatatctaaatatgaggtcgattttcaaatattattgcatcaaattaaacttttttcttaaaatttaaacagatattgtctttatattttggttctgaaatatttcctcaactgttgtatacttctggttgatccatatcctatttcagaataataagcacccttgggctgtgagtgccttgggcacagcactctgagtaggtctgagggatccagcctactttttacttcacttctaagactgtattgattttaagatgcagcaatggtttgttaatagctttccctgaaataaaaaaaaataaacttacgaaaacttttacagcacttttttttgacttacaacagaaaacctttattcatacagttacttctaaatttatttttcagtgtcacaatcacaaatttgagtcaagttttctttaaaatcagagttcagtgtttctttcttttctttttctttttctttttctttttttttttttttttttttttttttttttgagacagtctcgctccatcacccaggctggagtgcagtggtgcattttcggcttactgcaacctctgcttccctgtctcagcctcctgagtagctggaattacaggcatgcaccaagacgcctgattagtttttatatttttagtagagactgagttttaccatgatggccaggctggtgttgaactcctggtctcaagcaatccatccacctcagattcccaagtgctgggattataggagtgagccactgtgcatggccagagttcaacgtttcttatgaatcactttctattattatcaagtttatgatcttgagtggttaaaatgacagtgtggttttcagatataggggaatatattggcattttatttgcattttgtatttggttaaaaatggtagtttttgtttttgcttaaataatttctagatgaaagtaaaacagcctaatttgaaagtcagccagcatattaatactaggattaagtgcctcatcgtgcataaattggtcaccccacttaattttggtaatttcactgtttatttgaaaagatttggacttttctattgcttttacatttactatgtttcatgttacattgcaaagtaattttctgtgtatgtagtaacttttcgctttaatataaattcacaatcaaatccttttgaagacattttaaatgacaaatatggatacaactttaagtgaaaacataattatacgtagtcactagtgcaaatgactcaactgaggagacagttggataagcatacctttttgaatgtccgtgaccgaactttataaggataaatgatgtcaggccttctgggaagaaaataatagaacaaaacaaataaaagtagtaggacaccttatattaattgccataccttcaattacatatgaattgccaatggtaattttgaaaaagtgatataactgtagcttatttaattataagaatgatttttaaagaaaggtttgtgttttttatctttgcatgattgtaactgatctgtattgaaatatgtatcatccaatgaaggttattttcttcaaagaatatctagagccttttcaagcctggtacaaatagaaataccaatttgggggtacaggatatggacttgaaatgtccaactgatttgtcttctcttatttttcttttaaaaaatatccataatgactttgcagccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattagggtaaattatttaactactacaaccctttgtctcgtaaatgttttctaattgttatacctatagagcagtacattaactacattgataaaaatatattgtctggattatacgattattatactaaatagcttttcttttttttatttattattatcatactttaagttttatggtacatgtgcacaatgtgcaggttagttacatatgtatacatgtgccatgctggtgcgctgcacccactaactcgtcatttagcattaggtatatctcctaatgctatccctcccccctccccccaccccacaacagtccccagagtctgatgttccccttcctgtgtccatgtgttcacattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttagagatagaaacaaaagctaagttagaaagttgctcagtaatgaaacaagactaattttacagtgtggcacacagccaatatctttcagtgtttttttttaagtctcatagtaatgtacaataatatataaaaacataggacagtaaaaacacattgatccataggtctgtgtggtgtttaatacattaaaaaaataaaaaaacacattgaaatccaaggtgggtagttggaaatatgaacaggaaatgataaggaagcttgtctttatctattgggccttggaaaaagaaggggtagggggaacaaattttctgagaattcagcatcatgagcttgcatttcatgtggatttgggggttaaagttaacaccccatattcaagagtgaggataaaacaaagatatttcagaatatttacttacagtccctcattggaagaccttctaaaatttttatgctaaatgttaatatatacattagggagaagaaaacggaattcagagaaaaagaatgggatgcaacacgtttttttgagtatactactgatttatacatgtataaatctaagcaatcattaataataagcttatatagttcggggatttgaaaataagatggaaaaattgcctattgagtagtgttcgctactcaggtgatggtacaaccaaagcccaggctgtttttttgtggtacagcaaaagcccaggctccaccacgacacaatatatgcacgcaggaaatctgtatttgcaccccctaaatatttaaaatatttttaaaaataattaaagaaaaaataagatggaatcaaaatcataacaaagataaaaattatattaagctctatgatgttcattaagaacaatacctaaacataaaaatgtagaattctggaagataggatgttaaacagtgattagaagacaaatatttagcagaaaaaaaagctgatgtagttacatagatatcaggcaaaagaggagataataaaggtaactgctacatgaataaaatagaccaaaagaaacaataaaattgatcaaagaaacttagagttaattctttgaaaaaaacgaataaaatggaataccaagtttttctttgacagaactcaaatacaatcctgagggaagaaaacaagtgtataatgatacagactgtttcatatcatttctatacattttaactcagaaaacaatattgcatattgctcatggacctattaagtatttaaaattataaaaatggatgaaaggttctattaaaaattcataattgttgcacactaaaaataaatatactaatgggacagagagggaaagcaaaaaagccaattgagaaaagcaaatattagagtctttataattgtatgagcataggtcttatttgagtactaatatttaaatctaacccgaggaagcctctcataagaggttatcttaattaaccaaatgaaaaagaaagccttccagaaaatggagatcatattctttcttaacacacaacagtaatatgtgccattaaaaagtaaatcattcattagtgataaaactcaaaatgatgttaaaaagcaaaatgcttctttttgtggtattcaaaatatttaacacagagagattcttagtaaatgacagcctgactgctatttaatttacctaaaactaaaagcaaatgagattttaaaatcaagttacttcattcaaagatttgaattaatgagacaataaaaagaaaaagctgcccttgtttaccttagtttgttctggcatgaaataagtcagacccatattagccttgggcatcaagttttttttctgacctatgctatctaaaagccctgttcattaaaaataataaatgcaaaaatcatactatcccactttcttgatatagccagagtaactaaagttttgcatatgactaaatgaataggtgagtaattcagttaaaggaaactaatttgaagagaagtttcaattttctcataggctgtatgttctattcttgctctagatctaacaagaaaatgttttatagaaaagactcttggcatcgatttgatttatgttaaaatagaaatcaacagagctctttatttgcagtgaatgatactttctcctgaacattatgacccttaggaataccttgacacacatattacaagaatatgtaatgcagtaatgataatacgagacattttaggtatcacctaacaccgtttcttgaaactggatgtccgttttaatgagttagattacttgtacctggacttcatgtatactcagtttctcttggagaatatgaatccttttaagtatttgtcagaatgataatatgaatgcaataagaaataacactattgtaataatatacacaaatactgaatgtaatactaacaacagcatatataaatactagcaacagcatatatatgaaaagcagagatacttatatatgaagaatttttatataaacatggtataacactaattcatatttttatccagaagaaggttggacacatggttggatatccataaaattaggaatgatgtgtccaaagtatatttcattttaactgtttacatttttactatgtttattacaatggaaaagaatagacattcgtcaaccaattttggtaaattatcaatatttttgaggaaaacaattacattcattaatttttgtggcttattaaatactgtgattgcttttacttttcaactcacataaattatttctaaaagatttatgaggaacttggttaactatttagatgttgctctgagctttaccccatacgtccattgtcctttctagggatattatgaataacaaagtgttttaccagcaccctaatctcatgagggcactggggatgcacgagactgtgatggaggtcatggtgaacgtccttggaggtggagagtccaaggtaacgtctttgattcctgagatgctatttagtatcatctcctggagtatatagattgatatagaatgcagattttttttttttttttttttttttttttttttggagacagaggctcactctgtcgcccaggctggagtgcagtgcacgatctcggctcactgcaagctccgcctcccgggttcacgccattctcctgcctcagcctcccgaggagctgggattagaggcgcccgccacctcgcccggctaatttttttgtgtttttagtagagacggggtttcactgtgttagccaggatggtctcgatctcctgacctcgtgatccgcccgccttggcctcccctcccgaagtgctgggattacaggcgtgagccaccgcgcccagcccagattgtagattcttaatgagaatttcttaaatcctcttaggatgactgtttttaaagaagactttttgaaaaaaacacacaaaccttagggagttgaacgtactactagtttttttttccttgattttgataaaaatttcctgtcttatactgtgtaatttttggcctcctaaattattctcttttaggggatatttagaaactgaagtatctcatttaggggatatttagaaacttagaaacataaaaattactctatgtgttaatttattttaaaattttgaattataattcagttctcatcacgttaccagtccatggcacaagcatgttcttcagactccaccatcctccatgacacagacattggttggtttcacttaatttccaatccagattgagatttgatgataatactcttggatgtatttgttgtagaattctaaagtgaattctttttttttttttttttttttttgagacggagtctcagtctcttgcccaggctggagtgcagtggcgtgatctcagctcactgcaacctccgcctcccaggttcactacattctccttcctcagcctgccgagtggctgggactacaggcgcccaccaccattccctgctaatttttttggtatttttagtagaaatggggtttcgccatgttagccaggatggtcttgatctcctgacctcatgatcttcctgccttggcctcccaaagtgctgggattacaggcgtgagccaccacactgggcctaaagtgaacttttaagtgaccacaacttaatggtatcaaaaaccaaattagtagaatagtataataaaaaaaaactttatataatcagtataattttataacctctgatatgaaaatatgttttgatattttaaatcttaggatgtatttttcacaatactgaaataagcccatatttcatatgatcagtctgtttaccagttagacaggcttagaaggatatcataatatactgtactttattacagaagaactccagagagtatctggggtaaactatgataatatttggtctcaaggaagatgtgtttggtggggtcaaacatgcaggccttccagtccaggaaatcatctcatgaggtgcaaatcagggaggttgtaaatccctggaatcagtaattctactaatattaatactgataagaacatcctattatatgtgccacgtactgaactatatatttttcagaaatcagctcaatgaattcactcccctgccccttacctaaagcaagtattattatccatattattctaacagaatcaaagagattgcatcatttcccatggaagcacagctgatagcggtagtgaggcatcacaaatgaatctgcctttcacctttgagaatgcagtaataagtcaatttctgttctaacccatccatggtaatgaagtttctgaattagtgccaggcttgattttcattgactcagggacgaggcaaatcgtagtctgcacatttgaagatctttggtatctgaagtttggcacacacatggacacacggggattgacgatgtgattgagacctcaacgtatgaactcaattttataaaggtcgtttgctttcagcagctaatgacatgctttatctgtaggaaatcacctttcccaagatggtggccaactgttgccgttttctctgttacttctgtcgtataagtaggcagaatcaaaaagctatgtttgatcatctcagttatttactggaaaacagcagtgttggtcttggtaagtaaatgacttttatttcatctttaaggttgaaataatataatattacatttaaaaagcaaacgttttgttaaaaaatgtgcaatggacctgaatagacatttcacaaaagaagacagatagttggccaataggtatatgaaaaaatactcgacatcactcatcatcagcaaagtgcaaattgaaaccacagtgagctatcacctcacacctgttagaatgcctattattgaaaagacaaaacataataagtgttggcgagggtgtggggaaaagggaacccttatacatgttggtgggaatgtaaacacagccattttagaaaacattaaggagattcctcaaaaaattaaaaatagaactaccatatgatctaacagttttacttctgggtatatatatccaagggaaatgaataatcagtatgtcgaagagatacgtgtacttccatggtcattgcagcattattcacaatagctgagatatggaatcaacctaagtgttcatcagtggatgaatggataggaaaaatgtggtacatattcacaatggaatgctgtttggccttaaaaaaagagggaatcctgtcattttcaacaacatggatgaacctggaggatattacattacatgaaataagctacgtgtagaaagacaaaaaccacatgatctcactttcatgtggactctaaaatcaaagtcgaactcatagaaacagagagtagaatgaggttaccaggtgtaggggggagtggttggggagatgttcaaggatacaaaatttcagttagatagaaggaataagttcaaaagctctattatacagcatggtgactatagttaataacaatgtataatattcttgaaaatcgctgccagagtagattttgagtgttttcaccacacaaaagtgtatgtgaggtaatatgtatgttaactagctcaattgagtcattccacaaagtatacatatatttcaaaacatgtacacaatatatacaatttttatttgtcaattcaaaatacgtaaaattaaactttaatgtaaatcaatgtagattaatacactatggatggtgtttagaaattaaattttaagaggtagtatatttttgtatggagtttatagttacagcacgatccaggttatatttcatcttcatttgaattaatagcctccccagctatgagaggttcaacaccactggatgtggctgcagcttcggtgatggataataatgaactagcattagctctgcgtgagccggatctagaaaaggtgagcaatgttcctgccctgtgtgtttgtctgaattatgctttttcacggttttctcaatattttaaatataagtaaggttggtgcagaagtcattgtggttttgcaatgtgacattatggccaaaaccgcaattaattttgcaccaacacaatatgttctagtgctattagaattaaagtacattataatttacattgcacactatataatgttatatattacattgtatataattctactatacattatattgtagttagaagttatgaagaacaatacatttgaaaaaatgaattttctctgatgagaaacatttttctatggaaggagaaccaacgttctgtatctgtattcttatgtgtttttttcttttcgtgatatctgctgccacttttgacttaatcatacacttcagtttttaaaaaggttattttgacatctcatatgtacattttatatcacatatactttattccagcacaaagcatcagcgatatagtaaagccgtgcactctaaggatactaagccacacatgtgtattaccagcatttagagaaactttccctgtattgtagttgcaatagcattccaagtagtcacctgattttttttccttgctcacctggcatctgttcttcccttatcagccaaagtgaccctcttaaaaagatcatgccaatcctccatccagtactccccaaaggctttctatctcactcccagtaaaaatcaaagatgttgcaatagctcctacatcatctgttcctacataccagcctgatttcatctcctacagctttcccgcactctctcttctttgcttcagccacccttgtccccttgctgtagctggaacacgccaactgtgctcagcctcagggcctctgcacctgctagtccaaccatctgcagtatccttacccaagataccatcgtggctctttgtaggcattctttcagtcaatgctccaaagtcaccctcttgatcagctcttccacatccatgctgtgtaaaactgaaaccttttctccacttccttaaactcttcctgtttcctttactgctttattttcaactattggaaatgtaaatatttgtatattctgtacacaaatatatactttcattttatttatatttatagaaacttatattttaaatatatattaagataattgtatgtaaaataaatatatttaatcaaactctatgtagttatgtatttttaaaaattcatcccctactataatgtcaagccagggaggtcagagtggtttttcctctgttgttaactgctttgtcctgcctttagagaacagtgtcagcactgggtagacacttagtgcatggctgttgaagacatgaaagagtgaaactcttccccaaatcctcctgacataccagtccaggatcatgaagtcttgcatctctgagacacctcaggacatgtttcccccgtatagtacttaaaatcttttaatctacacactcattaaaatggccaatactaatgcagttgataataccaaatgctgagaaggacaaggagcagctagaactctcttctacttctgttgtgatgagtaatggtacagccagtgtggaaagcagtttggcagttccttaacaaattaaacatacacctaccataaactatatgcctagcctttccactgctaacaatttacccagtagaaaggaaaatatatgtccacacaaagacttgggcatgaatgtttctaacagctttattcgtcatagccaaaaagtgcaaacaacttgaataccgaccatcaatgtattagttgataaataacactgtgatatacccatatacggtgaaatgtcatcccacaataaaaaagaatgaattgctgacatatgctacagtgtgaatgaatcccaaaatcatatgctgagcgaaagaagccaggcacagaaagatatatgctgcatggttatgtgtacaagtgtcctagaaaatgcaagctaaattgtagtgagagaaaaccgattgtctgggactaggtgtgtggggagaaagggactgcaaagggcccagggagctctgaggagtgacggccatgttctgcgtcttgattatggtgtgttctcacagatgtctacatctctcaaagctcattgaatttatacttcaaagagatgagtttattgcacattggttctcttgcttcactatagttgatataaaacatttttagctatattattatttatatttgaaactgatttaacttaagctggatataactcaatttgcttgataagttgctcctctgtcagtcttacttccattgataatgacttttctaaggatttcttttaaaattgaatttcttgtgaaatattgtagaggactaacattcgtataaaacaaaaatattttaagaggaaaggccaggcaaaaatatgttatgtgctaatttcatcaatactgaaaagtgggtcatcttatcaaaaatttcctgaacactgaaaccttggctaaaaaagtaaaagtaactgctcaaaataaggtgtttgctaaatgctgtgtgtctgatttgaaccaaggatgtttgactgtgatcttaggtttttctctacgtattttctcacacctgcttccccattaaattgatatatcattttggaaacaatttctctttaaaatatctttgcatctcatatagatcttttaatatcttgagtggattcagtttttacattgcaccagaggtcattagacatgtttgcaatttatgactttgatagataagggtctcaagttaaatgctattaaattcagaaacattcttctttcgtagttttacacataatcctgcagctcttggcccacccagacagacttggttgccctgtctgacaaggaattgcgggtggatttatacagcaggcactgtgggtgattgtgggtagatgaaaacagaaggcaccgcgggctgaggctgctgctttattgtctccaaagtgtttaaggagatggtgcaaataaaacagcaactggttctagtccgtgagtcttgagccctgggcagatatgtttgtggcatttattaaaaagaatgtctgcttagagagagctgaaaaaaaaaaagcttatagtaggatcataaatatttttattatgatgccattttatgacgatatttaaatatttctaaagtctaaggttttactaaagggagttcaagtagattatcatgagagcaaaaagaatttgcaaaaatgcatttgtttaaaagcatcctttaaggatgtcatttattgtatccaatgtaagcatctaatgagttttcagccaagggataactctttgttaatcatgttgtttgcaggtagttcgttatttggctggttgtggactgcaaagttgccagatgctggtgtctaagggctatccagacattgggtggaacccagttgaaggagagagatatcttgactttcttagatttgctgtcttctgtaatggtaggacttgatttcttgaggtcttttgagttatcattaaaactgcatagagatataataaggattcatctcagcactttcatgaaggaagtattagtaaagaaatcacatattttataatcgataggggtttttcacagtaaccacttataatacaatatttgtttacatacttctttccttatttaaattaaaatttttaggcatctaagttctcctaaattttttattttgaattctaataatagtttggattatgacatcattctataataataacaagttagtgagaatcaatagtttatgcctccataatgctttactctgaaaatttttaatgcaagcaaaatttactgtgtctcatatacttaatgctagcaattaggattacattttggctttattagtatattgttgggttttagttattcttatacataggaaatgattagtataacatttatttgttcagaacttccatataatcatatttgtttacttatcttccccattctactttaggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacactgtaggtctaatatacacaccctcacgagtgatccatactacttgatgtgaaattttataaaatatattctgcatcctatgaattgtaatataacttgtggtacagaagatttctccctttgaaaatataatgtcttagatttggaagaatgaatggaatttggtgctggaataggtcgaatgaacaaagagagctgaagaagatggtgtagatttagcagagggaaatttaggttgtagaagatgcatcttatgaattttcctaggggagctagggcaaggtgggttgttgtaaatgatacgaagtgaacctttggggttagactggagtttagtgggaaggtagttagaatgagattttatgattagaaagagacctttcgcaaatgaaagggggacttgactaaactgttatggtggtaaaacctagaaaaggtttcattctgaggagtgtgatgctttgttgaggtacagaagacagatacgagaagcagtcactatcttacatttatctgtaggtatacgttgttaatactagagtccagtcatcgacataagtaaatccaggtgtgatgcttatctgtgtaggtgaatgtcctccagcggggtcatgcatccacactgctagtgcctctggtaaagatgtaacatagggctttattgaggcacatttctaaagaaaaaaaagagttagagggcacgcaatcctgcaaaccctttgtcttttacatataaactgggcatagatgttccatgtacaccatagccggatttgcagactgggagcactcctagagcaagaatgagcactccccaccacacacacacacaccatgctacatgcttatcagtttcccatgaaggaaccagggagctcttaggttctctcagtagtagaaaatgtatccagagacctctggcccaggaccacactagcaagggtacacctgagggcctcacggacacccttgcatgcccaggaatgaggctgtcattcaaagcctcactgtcactctgcagactgctgtattcagtggagacagctgtctgctgagttaccaaggagggaggatgtgagcctctagggccatccagatttggctctcatcagcaagagaacatgtaattatattttccctgcagagatggggagggagatatgttgagatatgttggattctttggcaggggttgcaggaggttgagtagttggtacagaggtaggtgagcaagtgcaataacatttataaagtacttgctctgggcaagcactgtactggatgccttacatgtgaccttgtatgccatctttgtcaccctttctctacatgtgtgccacttacagaaatagtctaagctcacacgtcctttgatcagttattttctttgttaatgcactcactaccactaggaaggaaaagaagccatcaaataagcagttcctccttttcccctcaaaggaatcttaatactaaaatttccacagatgtgttcttggtgttagaatctcaagtctgatctttaaccagttgttattctcccttaaaaacgtcaagctctacattataacatatatgaaacatatcagaaaaataatgtgttacctagtagtccctttcctcggagagatatgtaataaacatgaaatgtcagttatcccatttgctttctctttcttttgaaacattcatgaaagtgacacagaggaggaggaagatgacactatccacatggggaacgcgatcatgaccttctattcagctttgattgacctcttgggacgctgtgctcctgagatgcatgtgagtttctgggagttcaggagcagcaatcctgatttctctgtgttaagacatctatagctgtcaaagagcataacagcatccaaaaccaataatcttcatgctccattaaaaataatagctgcagtctaatcactgaacaagtgtttgtttagttggaaatgtctcgttggttgtaaaaattagtaatgggatttcagtgcaagtcattaatagagtacttaagttactcatatatctctgaaactcatacagcctcccacattttaagaagaaaagaacatattttctctatgcaatttcctcttatgttacagtgcatccagaaaacaactgctcctaccaaaagtcattttcttttgtgtatttagctctatgtgtttgccatcgttttaggggaaagtgagagggaaggtatagggggtggatattaagagctatttagaccatataaattagtgtctgtctgtctttctttctttctttctttctttctttctttctttctttctttctttctttctttttctttcttttctctctttttttttttaattgaggcaaggtcttgctctgtctcccaggctagagtgcagtggcatgatctcagctcactgcaatctatgcctcccaggttcaagtgattctcctgcctcagcctcctgagtagctgggactacaggcacatgccaccacgcccaactaatttttgtatttttagtagagacggggttttgccatgttggccaggctggcctggaactcctaacctcaagtgatccaactgcctcggcctcccaaagtgctgggcttacaggcgtgagccagcgtacccagcctagattagtattttctgaaactttttgacccaaatgaaattaaagtttcgtggaataatacttttactctgtaatacattctgatattttgttctttattttattgtagttgattctgtgttattctattatattcatttaaaaaaaaatcctggcccagggcccaaaacattcatttccagatcttttaatgggaaacaaacccagagtttgagagtttgaaacacattgattggtgctggggtagttaagaactgtaagtatatttctaaagtgggatgagcatgaagccagggctttcttacaaagcacctttttctctacccttattatctatatttcttttggttttggttgggttttttgtgtggtttaggtttttcatacccagaggttaaaacttccttgatgtactcttttgttgtgaacaaagaggagtcacaggatagagaaatgttagaatgttagaaaactggagtctgatttttataaaaacttaaactttgctgctagtaagattctttcatcttagtaaatggaaacagagactattaaaaatttctgtgctggaggtgattactgacaacaacaacaaaaatacttgctcacaatatttgttatttttcccatctcagaaaaaaacatcagcgaaacaaagagaaagtatactaataaatagaagttttcattctattatattaatgggggaaaactaagtgaaggaataggggaccaaccttggcatttctgaaatttatgcatcttcacaactattatttgaggcctcctgtgtgccagaaattgtgcttgagtttcacgccctgtaatgaggtaaacagatgcccatcccggctcttcagacctagtctgtcctgaagacttgctgagattcttgaccgtatgttcatccacagtcatcctggatacttcatgtcagtctaaaagaactgttaggatttatgttcgtcatttcctccacattatatatccagccttgggagaaatcagggtcgaagacagatggatatgcaattcatttcttagcacaaagcaagaaagaagctaatttggtcataaatattagtatatgttcagagtctaatgataattttctttgtattattgctcatgttattgataggtatttacatgtaattttggaaagtaaactttcataaacacgtcagattctcagtatatcttaacagtccccaaaaggataaaaactattattctaatggatgaaccaactggcctagaccatagtataaataacttggtgtatgctgaaatcactgaaaactgtttgagcaagtaaatattcgcaggtaagccagaaaactatttctgagagaggcataactttatgtatacactgatcagaaaattattttggacttggattccaatacttcagatttcctagacagaattgtaacattgatgtcacaaagttgttctaatgtttttttttcccctgtatagttgattcatgccgggaagggagaagccatcagaattaggtccattttgagatccctcattcccctgggagatttggtgggcgttatcagcatcgcttttcagatgccaacaatagccaaaggtaaggccaacttcaatttgtcctaattcagtaggatgttggatgacatcatgttctaaagaatgttttccgtactcaacatcccaacctctccacttcctaaattatgtgtatactacttaaattagtttttttaaaaaagctgtaaagtatatattttataattttttcctttttttttttgaattagagccttgctctgtagcccaggctggagtgcagtggcacaatcttggctcactgcaagctccgcctcccgggttcaagcaattctcctgcctcagcctcccaagtagctgggactacaggcgcccgtcaccatgcccggctaattttttttgtattttaagtagagatggggtttcaccgtgttagccaggatggtctcgatctcctgacctcgtgatccgcctgccttggcctcccaaagtgctgggattacaggtgtgagccaccgcatccagacttttttccattgtttttaaagctcattgtttttaaagctgtgtttgctttgggattttaattttcttttatatgacatttcagacagcttccagagaagcagaaacatgcactgctaccctccattgtcttatgtcctgccttgtgtcattggtcgcaagctcttctgtctttcttgaccttagttccttagttatgcattttgatagttttcattgtcactttcttgtaatgcttttctattaaaagcactgatgatagcttttgacttagagattttaaaatcccctctctgttaaaaagagtgtttgttgtttttttggttttttgttttttttgagatggagtctcactccgtcacccaggctggagtgcagtggcgcgatcttggctcactgcaatctctgcctcacaggttcaagcaatcctcctgcctcagcctcccaagtagcagggactacaggcatgtgtcaccacgttgggctaattttttgcattttttgtagagacagggtttcaccatgttagccaggatggtctcgacctcctgacctcacgatccgcctgcctcagcctcccaaagtgctgggtttacaggcatgaggcactgctcctagccaaaaagaagtgttcttttcatgagtaaggagaaaatgtttttcaagattaaagaagttattgaagacaactaaaataagtgttaaatcccaaattatactttgtttttactttatcaaatgtaaggtgttttttttcagttttcaatactttattggatatttatacataaatcatttacatgaaagacttctaattgtagaacaaaacataattaggggccaggcgtagtggctcatgcctgtaatcctagcactttgggaggccaaggcaggtggatcacctgaggtcaggagttcgagaccagcctggacaacatggcaaaaccccatctctactaaaaatacaaaagttaaacaagcatggtggtgggcatttgtaatcccagctactcaggaggccgaggcaggagaatcgcttgaacccggggcagtggggaggttgcagtgagccgagattgcaccacttcattccagcctgagtgaaagagcgaaactctgtctcaaacaaacaaacaaaaaacataattaggcaggaagtgcatgctatatatattccttttctttcattaattatgcccctagagaaggcaggctataatagctcaagtctagaatgaaaggggtcaccatatacctgaaggtagctcatcctgtttgccagtcatgattatgagaaagtaaagcttcatgtatgctaaccttacaaacccaaatctacaaggtggcaaaactaccataataattgaacgcccattatagctttaggcaaagctagaaattaaaaatcttccccgcctttggcttccccatttgagacagtttcttctccttgtgcatctgtagctcatcttcctttgctgtctctgtacctctcttctaactcattttcatttgcttaaggaaaatatcttttctttactctatactttgagccacaaaatagacactatcaggacaaagataataatagtaccagtgacatacagattaggaaatagggaagcattaaattttgtaataacataataacaaagaaccaagaacatagattgtaagagagcccaggggtcctttacagaatgggccccaaagtttccaggtacctcctcgtttcctccagtcatctgcctttagcagccttcaagagttttcaagttgctttctttccttttgtagttagttgtgctctaatatgttatttttcttcaaatatatgcagtatattgtctacatcgggagtcacagtggtttgtgtgtgtgtttgtgaattttgtatcagtcacaatgaaagttaacttttaacaacacaatccattggtatttgttagatctctgcttttttttttttgcttttttttttttgagacggagtctcactctgtcgcccaggctggaatgcagtggcgcagtcttggctcactgcaagctccgcctcccgggttcacgccattctcctgcttcagcctcccgagtagctgggactacaggcgcccgccactatgcccggctaattcttttgtatttttcgtagacacggggtttcaccatgttagccaggatggtctcgatctcctgacctcgtgatcggcacatctcggcctcccaaagtgctgggattacaggtgtgagccaccgtgcccggccaaatctctgcttttttcagccaggtgtggtggtgcacgcctgtagtcccagctactcaggagtctgaggcaggagaatcacttgaacctgggagacggaggttgcagtgagccacggccgtgccactgcactccagcttgggcagcagagcaagactctgtctcaaaaaaaaatttttttttttactgctttccttttgtggagaatgtagacagaaacctgtaggtttttatgtcaccatagctgtgcatttaactttatgtggctgtgcattcactgcagagcttcaaccaccaatatttctttctccttttcaatgacaactcaattggtctataagcatcaccaagtagcagtaataatggttattatacattccatatttagtatgtgaagtttgtctctaaagaatgatattttcccttctcaggattagctagggtcttcctcagacatttttatcatatttatttccaagctagagtatgcctcagaataataatgaaagaaggaggggttcagaaaacttgaggaacaagcacataatcttgcagctcttggcccagactgatttggccgccctgtctgaggcagtaattgtgggtggatgaatacagcaggcactgctggtaattgcgggtggatgtatacagcaggcactgcggggtgacactgctgctctgttgtctccagtgtgtttgaggagatggtgcaaataaaacagcaacttgagccaatccgtgagtcttgagttacaggcagatgcatttgtggcattcattagaaacaatgtctgcttggataagagcttaaaaagcaaagcatatagagcaggatcggtgagcttctccctttttccctaggcacagctacggtttaagataatagaacactgtacatttaaattcctttttaatgcgatttttaggagaattgaaattgaattttatatagatttttaattgaaaatcataatatactgatttgacactaaggttaagtcagctttggctggattttaaatccagttttagttggtttaaatacaactctgtcagttactaggtatgtgaccttggactagttacttctctaaaggctagttttcgtcattcattgaataagagtcatgatagcagcctcacagttgggttgtgggaattgtgtaagatcgtgtcagtaacattcctagtgcagtacccgacaacagcacaacacatcagaactattattcttataatgtaaggaaaggaatgtattagttatattgggtgttataattataaggaacgaatactaccaggcattatcctttcatctagtttcctttagaacattatttgtttgttttcatgattcacatataaaattttttcattgactatacgtggaaacagaaaagttgtcattttattcatcagtttattcaggatgattgtggtcatgtgtcttctttctctgagttcttatttctttgatgttgtatccatatgaaaatttctgtgatagtatttgtagaagagtacagtgtgtggtcagcaccagtttggcgtaattatcatgtggtcaaacaggaagtaaataaattcttcagtatttgaaattggcacataatcccatgatttctcatatcagcggtccccaattagggaacctacggagtgactataaggaattcactaatctctataggcataaagctttaagtgttgatagagaaagcaatatgacccttaaatgcacgttaaatgctattatgattaatgaaacatatttcatatgaaagccatactggttttatagtgtcatttcatcatttcgttattgttctaagacgtgaaaatgtaaatataccaagattatcacataaaggtagatgagctttattcatgtttaaaacaggctcacttagaaaagagtgaacatccccacttcacattttcacttttcatggatttcacttggagttttagaaagtagattttggatgcctgtttgtttctcctaagtatctaacaatgccatgtcttgtatcctgtatgcagttaacaagtggatgcctatataacagttaaatgaccttggctttacattcactgccttatttcctcagcaaactcccataatagcttgagggtagtcgaagaacagaaagccatttcattgaaaactgtgtttaaaatgtaagaagtctagaaagcagccatttgtaatctatcctgtatatgacacagccattgacaccaaaattcacttctctcttttagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggtgagattggagcgatggacttcctcctctcttgactcttcactctgtgccttatgatgttcttttttatatatccattcattaatttattgacaatgaatgtttattgagtacctgttatattttcaggtaagccatgggtaaacagaaaataaactaggctatgttctcaaggaattcactgaataaactgacaacctcaagaaacttcccactgaccaaaaagaatatgataagaattctgataaggtgctatatgggattcaataagaggttcacataactctaatttgggaggtcacagtgactcctgttaacctctgttcagtatcaacttccaaattggcctaaacaattatgcttctcaataaaagcaatgaaagaattaagatgatttaatggatattgttgagtcagtatcatcttggtatcttcgtttgttaaggtacaaatggattgaaggctgttctgtatattgggtggcccacatggagaatctgccattatcagcttaaatgttcttttctttgaaacactgtggaataagctgaagttctaaatgttattgtagtagttatgctactatacatatttaatacctactttcatgtactcattaattttatcaattaaatgtgcttttttgatttcaaagcacattaggacttgagccgacagtagccccttcatgaaatatatgagagcagaatcacaaaaatgaaatgaaaatttcttttttctttgttttgtgtattcacctgacgttgtggacctggatagtatgggcgataacatagtagtaatacagttatcctttggttattggtgctgatagacatgagaagaataaatatgaataataaagagaattcagaaagaatttacgcatatgagatctattgtgagaataagctcctctctttgcctagcaaaggaaaatactcacatctgtgatattattgtcttcttacattgatcctaccattgatatttaatgatagagtctgaacctgttaagctttttgaggagataggtgtcatttcattcatttttatctatttatgaacaatggatagttgattgtttttagtggtaaaaatcatatgaacccgacacttaaagatgtaactaaagaatacatttccatgtgtcatagtgctatcatcttccggatagtgaaattgtatgtccccatgttaatccctttgaagattatctactgccaaacacaaatggccttctactctctgattctttttcaggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtgggtgagtggataacaaattctattccggcttcttctttaaaaaacagaatttacaatgtggcctttgacaaattatttagaattttggaaacattttccataccacaaatttaattcattttaggtagtcccatatactgaggtatgagtcttctctgatcgcccttgctcccagtcaagttccagagtgttcctccaagcctccctagggtatccagctgttggatatagcttttgaccagttacagaatactattctggatgttgggagtggggagtaattgtgttgggagtccttggccactttaggtgagatgaatagatctccccttttgactgtgtttgatgatttaactcatcttctagaagagaaaagaaaaaagggacttcttaaatataaaatgtgatacagcataatattaaaccatatttatgtgtggcaacgatgaaggctgaatatttcctccaacctggaaaaccatttcctataagtagaagtgctagaatgtcttacaatgaaaaccagaaacgtatctccccctgatgaagttttgcctgtgaaagtgataatttctcaagcccctagaaagatcgtggctcatttgtaactgctcagggactcttgcaggtgcagccagcagcctggcagtccctgggggaagggcaagttttcacccatgggggagtgtctgggttgagaaccagatggcactgagggaagtggaaaatcagaagagtaattctttaacttccctaatctaagattctgtaaaattgaaccaaaatgcctatctcacagatattttctaagtattacatgaggtaaaacacttgctgttgcctgacacagtagatgttcactgtgtacattttctctcccttccttctctggcaaatttgctgtctcagcctttttttcctcctttctgttccaatattccctcttctttttcttcttaccatccattggaatgagggaagagacatttactaaagttaatggaggaaagtcttaggaaacagtggagtctgcatttgtgagtggttaggaaagaaaggaggagaacagaaacatcttctgtatcaaagaaggggtggtcttcagatctaggggatagagataagttgggaaatctaaccttatataaaataaagtaactaagtggttaatctttggacaaagaacatctaatgaataccatctgaagtgaggtatagattcaggtccttggctgatataatttattctaatgaatgatctacttagtttagaaacatttcttggcattatgaacattagctttgttccaacagacaactgagaccttctatgatgcagcacttactcagaagattagtatttgatgttccattattaaatgaacacgcaaagatgcctcttaaagtaagtataggaaatgtttgtagatatttgattactggcttctctgactttattttctatgacaacatatacatttcttagatacatcatgcttgacgctgggaaatttctcccaattattgaaatgggcatagaagttataggaatgtatacatcaacttgaaataaacaacttctataagattatagaaatcttaacattgatttccatggaaacaatggaaatagaaatcaattgaaaaaaaaggaccacaggccgggcgcggtggctcacgcctgtaatcccagcactttgggaggccaaggtgggcggatcacgaggttaggagatcgagaccatcctagctaacacggtgaaaccccgtctctataaaaaatacaaaaaattagccggacgtggtggtgggtgcctgtaggcccagttacgtggaaggctgaggcaggagaatggcgtgaacccgggaggtggagcttgcagtgagccgagatcgcaccactgactccagcctgggtgacagagcgagactccgtcaaaaaaagaaaaaaaggaccacagggaaaagataagccaagatactcttaagttggaaaacatggtaataggcctggcctaaaatattattagaaacctcgagagataaagacgaggctttaaagacaacattttctaagttaataatcacatgacaggttccaattgtcacttcatagggttcaaagataacctctctgtatatgcaattatagtttgtcacacagcatagaaaaatcactggtattttctctaactttattattctgttcaggatcaagtctcactctatcttactgagttgggaatgttttcttgtcctttaatatcataatctagactcagaatatagaatatagtgtttgcatcaaagttatatagtaatgtgatggatttttatagatgaccactctgcaatgccatctagtagcattattttttccccaatggctacccagtactagtgctgaagaagtatgagatataaagagtctatatggagctgttacagtaagcatccctggatatttagcaaaagtaatctttctctatgaaaattgactttggtttaataaatctggatacattagtgaattaggtaaaataaattatatccttgataaaaattctatttttatgtttttttgtcatcttcaatagtccttgtcttgcaaaattttttgatacaaatgagctggaaaattcgtgaaaaaagatacagtctcatgctgttacccttatgcaataaaactcttttacattagagatatgtcagtgttaagccaagcaaattagaactcaatatttcatcatttgtgactcctaaattgtgtggatgtatgtatgtgtccattttttttaactgaaagggaaagtaaatgagttgtaatattttaacagtaagacatgcagtccactttaataacagtaattcttataatttattttcttcgttagatataggaaagggtcaaaatatgtatagtcataagatcattttattaatttgacaaatatagatcaagaataaattatccaaagaactaccaaataattgaaagattctgtgcttgtccttgaccttccagtttagttctaaacaagcaatatgcataggtgaaaatgtaaggagcaacgtagacaatcagtaaagtaataaattgcatccataaccaccaaagaaatgtagacaaataagtgatcagagtagagcaattttggaacttcacttggagaagtaagttttgtggcaagccatagagaggcagagagggagcaaaaagaatcacagatgtatagttcctttattgtgcttctgggtcatcctgacatcagtcccttcattttacacacagattccaagatattaataacaattcattaaattattagtaaatgattaacgtagaactcagggatacatagacatccaaacaacctcataaagaatcctgttcaagatatagttacttgtaaaattgggcgtctggtcttcatattgcaatcagtgttaaatttgaaagagacatagtgtcttagccggggttctctagagggacagaactaataggatagatgtatatatgaaggggagtttattaaggagtattgactcacacgatcaccgggtgaagtcccacaataggccgtctgcaagctgaggggcaaggaagccagttcaagtcccaaaacctcaaaagtagggaagccaacagtgcagccttcagtctgtggccgaaggcccgtgagcccctggcaaagcactagtgtaaatccaagagtccagaagctgaaggacttggagtctgatgtttgagggcaggaagcacccagcacgggacaaagataaaggccagaagataaaggcaagtcaggttcttctgcctgcctttatcctagccgtgctggcagctgattagatggtgcccacccagattgagaatgggtcagcctctcccagtccactgactcaaatgttaatctcctttggcaaccccctcacagacacacccaggaacaatactttgcatccttaaattcaatcaagttgaccctcaatattaaccatcacgtgtagtatacacggtgatagtattctccaagataatttatatgggattgggcaatttcacttcagatgaccttataatgtagcattagagtgtgatatgaggagaaatgaaaaaaaaatataaaaggttttgatagctcattgcttttataattgttttcccacatagctgctgacaaatcattatgaaagatgctggaaatattactgcctgcctggagggtggggaaactttggtgctgcctcagaagaagaacttcatttatcaagaaagttgttctggggcatttttgatgccctgtctcaaaaggtaatttaatggtttgtgggtttgtttgtatcaataaaatggtatagagccacacattcttagtaagatagtattcctagttgaatactatctttgctaaccaagacacgtatggcttgattttttctcttttctcaacttcataacaaatgttgaaaatgcaacttatatttacttaatcattgtggtagcattttccttgtgatcataacactgtttctgaatataaaatggctaagcagttcaggaaattatgcacaaggttgataagtttccggtgcatttggactcaaactctccctagtcccatctccaatcttataaaggccaaagaaattatatccaatataaaaatacaaaacatgaaatcttatgtaattgtaatatcccagtgccctgctaaagtctccagctttgctgctatggagatttagataccgtcgctcaatgttgcattgcatatgtggcattgccttatagttgcaaaatttataatgaatagttcatatgttttcagatgactgacaggtgttgatcttagagaaaaggcagaacaacaagttttgtgtgttcatccttaaattaatcaaaattagtttcaattcccagattgacattattagatgattggagtagtataaccactaatttgctacataatagaagaaaatttgtctgcaattacatttggtagcaacactttaatgctttttcttaccgaatttcctttggtaaactgagtccttttaaaataatgtgtaagtattttttagaatcatttacaacatttatttaacattgaacatttaaagtgaaataaattattactattatttttcagaaaatctataaatataaatttaactgtcattaatatataaatagctcttcctataaatttttagcatgcatactttctatagaatttcttttccagctcagaattttatttttcaaagctttataatgcaacatggatcagttaaaatttctcactctctagaatgttatgctttatgtttttttatatgtagtcattataatgtacaggaattatctataactaactataaggaatgtagtccctattgactgaaattatgtttatctcttaacaatattttacacattgacaatattaaagtttacttcatttccagtgtgttggagagtcaaagattttattctccttaagctgaaacttcagtaaatctagctgcagcttcttttctgtttgatggggttttaggccctgtgtttcattttctggaaaaagaatgatcagagagttcagttagtccagggtaattcagattttcttctgcaaccttctgtcagccctgatgatcatgctgacaacttttgccatatagtaatttttttttttggtcctccatttttcccagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaagtatggactctttctattgcagcagatttttattgtaaatgatgtgtgaagtctgaaattgaataaggtactaaagtgaactttctctaatacatgccccctttgaattggtatccttttaataggggtccctttaatttataaaacgatagtaataataataatgattatactaatatcagaaatagataagatgtaccttctaggatactcttaacacaatcaagactctgtacatggaatatctataatagaattaagaaagtatgtcagttatatttttagttgaaaaattaccctaaatgtttattaataacgacaatcaacctctatataacatcttttacttaggatgtacccagcatgcactgcaaagctgtttctgcgagtagcaagggaatcccttcacccatcactacatctcagcaaggcccagggttaacagctgatgttcagcatgataaaacgcagcacaagatggaagggaatatcaaatgagaatttttatggaaaattccaattgttctacaaataggatgtttgggaacttcaggtgttcgacgtctgagcattttgttgttgtcgttactgtttttaagtaggaccatggttctccatgtgcaaggaaagctgcctcttcatgccaccttatcttactgattctatggtgactcagcaagatcagttttagcaaggtagacacttggtagttattatccacggcttctgaatttgcttgggagttcaactttgaggcttctgagtggcccccagctgatttagcttccataaccagatcagaatttcaacctgagtggtatgccattagtttgataatgccttaaatttgcatgtttggtctttgatgacagtcctgtgagaaaagaccctttcccccatcccccagtatttggcttatatgattgatcttttgtatctcttccgaagtaagtaaaccaaactatcacatattcacattcctacatgggtaagtttgtggtttgctaacatatgatctcatctgagatttttaaatatcagaacaatatcatggttttggtgttggttgattaaatccaattaattaataagtgtgggcatggatattaatttacctaggcttgcccctttggggacttcttaacagatacaggtttatgtggtgatatcagtgatttctagacgattacgattttttatatattgcttcttaagtatgtgtatgtcttatagttcaattactgttaactgctggaaaacaacagcaaaccatcttatactagattttatgtagaattgtattctcaaagttaatactttaataagatatatttattaatgaatagaattatgtatgtatgtatatatatttaattttccattcatagatacgttttaagccttagatttatcatcagacttggtcatcatttgcatgtcctcaacatcaaggaattaaatattcatttaaacacaaaaggagtcaagattaaatattatcaaaaagcaggagttaattattttccctatagttaataccagtaacatttacagtgttatttgtggaccatgtatatttaaaaattttaacacatcactactaaatttagtgcttgttttttcttttttgtgtaatctattgtcctaatctttgaatgtattttaattatttcaatttatatatttaataataattgttattatagttttataatatgtaatttgttatgttagcacataaaatatgaatcaatataagatgagcagatagaacattatctgcttgacttttcttatattgttgtgaaaatagaaaaatgtaattctaaaaaaagaagtcgtgtttaacagttaaaattgaatgagatataagcattcataagctgtgagtaaattattaatatgatttcctgtaaattctgtgaaaatcaagctcttttgtctttacttttctcatagtattacaattcctgagaaattggaatacttcattaacaaatatgcagaacactcccatgacaaatggtcaatggacaaggtaaaaagagtattacattctaattcagtagtcattattaatgactggtcactgttcaaatatttctgaccatgacagttttctgttttaaaatgagaacttgatctaaattaggaaaaaatacttaattacaattagcttatataataatataatatttagctagctctatcattaacacaaatatgatacccttatgaataagcactattttaagctttcaaaagatctattcattaaattataaatatagtttctataacatatattgtttatcagagtaaaaaagcaacaatcaccaagagcttcaggaggaaatgatgactccgggttcagaattcaccttttaaggaaactttggttttatatgtaggtttttttggtttattttttgagtcctgctctgctgcccaggctggagtgcagtggtgtgatcatacctcactgcagcctggaactaccgggctcgagcaatcctcctgcctcaaccgcctgagtagttgggactacaggtgcacaccaccataccttgctaattgttaatattttttatagagatgagatcttgctatgttgcccaggctggtctccaactgttgttggcctcaagcagttgttcagccagcctcagcctcccaaactgctgagattacaggcatgagccaccatgcctggccaggttttatatgtagttctatatcagataaaatcttgaaaattcttaatcaggatttaacaattatttaccttttctattcttctgttgtatttcttactaccaactagatctgcagtttactaaaaatagattacatcggccaggtgatttttttgtgtgttttcaagaaaaacaacagaaatgagaaaactaaagtagctgcatctatgagataatttctacatattataagttttctaaaggaaatcttatgcctacaggttcatgtttaagttgagcttagtctaaacttgacagaggataaagtaggttcatcagaggagttgagttgagatagttcaagaactaaaatacttctatattggtttggcgaaatgaaaatcagacaccaaaggttgcttccagaggatgtgtatgctacgtaacaaataaagatcatcatgctggagatgtcatgttgagtttcaaactctgccctggccagccagtctttcggtccctctaagaaacccttttttgttggttttgataagtatctggttcttcattcagtaattgatttactaggtaagtcagtaaggatctatcttatataaaaactctgctaaatactgagtgggtggagttggtgatggagaggaatattacaggaaggttttccagtctaattactcagattctgtaggcagacaagaaattatatagggaaatggtgatatgtacagatgggcaaaataatatggaatgaatgtgttgagagaaaatttgatgaaagaatgggtaaaacaggtggcattattcagagaagacgctgagatgcatactctagttttcctatttaaaatgcatgttttgtatttacacttcataggtggggtcccaagatgggtcagaataaatatccttgggaccatgcatccctctagcctcctcctgtgggaatgcttattggcacaattataagaccttggtctgtttaaggaagatcaagtgcttctaatctctagataaaagacttgttccagatgattactgaaaatacatcatgcaatatgtccatgtaacaaaactgcacatttactccctgaatctgaaatttaaaataaaagaaaatagcattgaatatctttatagtgacttatgctggataaaatttcaatcttaacccttaccttagttcattttaggtttattttatcaaacacgcacttaaacacctgcatatctacaatctctaaaattaacacgtgtaaaacaatttttaatgtttgcctttttttaagttggcaaatggatggatttatggagaaatatattcagactcttctaaggttcagccattaatgaagccatataagctattgtctgaaaaggtaaggattttttgtttgttttagtttgtaaagtttttattcttttgaaaaatgtgttttttggttatattttttatattaaaatgtcttctttattttaaatttcacattttttcttccaaaggtcccgtttaaaaaaaaaaccttcttatattttgtcttttcctctcaattcttaatttctgtcagcctttctgtgtttattctcttctctccttaacatttttcttttcctttttggtttttattcctctcccatatttttaagtactttaaaaaatcttcttatcatgcttaagagtttcttgatgagtgatgacaaagtaataatgtgcttattatgtatagattttcatatattttacttctttgggaaagaaatgagtatcttgacaaatgaagtgaaaaggatttcacttcattgtgagtcacatgtatattacataagctgtcccttttttctgtgtaaggtcctaggaaccgggttgctaaaggaaattgaccttggtgctatataatgaacaaagcgaggatccctcttactaacattagtaaaactagatctctgctcacactctgcttttcagaattttactttcctttttatatttttaaataagctatgctcatcaaatttttaaaaagtgaaggcagtctattttagagcaaagcgttacttaacatttttatttacattcataatatatctgttgtttcttgttttttcttctctaggaaaaagaaatttatcgctggccaatcaaagaatctttaaaaactatgctggcttggggctggagaattgaaagaactcgggagggagacagcatggccctttacaaccggactcgtcgtatttctcagacaagccaggtaagaattcatcacggtgatgaatcaactgtttatgttatggattaaataattttttaaatttaattattgagtttttctaaagaataatctgaaaattctgaagagtcacaaaatttagaagggagagaaaaaagctatatatatattttttttagtttcaaaggaggttaaatgatgattaagttactggactttatgtacaagccttccttttcctggctagtatagaagaagtaaccagttgtaggacatggatgaagctggaaaccatcattctcagcaaactaacacaggaacagaaaaccaaacaccgcatgttctcactcataagtggaagctgaacaatgaaaacacatggacagaggaaggggaacatcacacaccggggcctgtcagggagtggggggctaggggagggatagcattaagagaaatacctaatgtagatgacgggttgatgggtgcagcaaaccattgtggcacgtgtatacctatgtaacaaacctgcacgttctgcacatgtaccccagaacttaaagtataataaaaaatttaaaagaagaagaagaagtaaccagttgtaaggtcctgaagttttcctaatgaaaacagtacatcatgttcgtttgctacagctagtttgtctatagggctttcttctcatttccagtgggatctgagggttgattcttaggaaagagtagggtgttcagacagtcatgatccagatttagaaggcacaagggcgctcctgtctgcagagggaaggtatacagccacacaggcagagcaagaattcacagaagatgttgctgctggaccatgtcaagggagttcgacaaacaagcaaggctctacccataggtcttcggtgctcaaggtggcaagagtaaggcacagccttgatgtggaaaagctagagttcagggaggacaccaaataccacccgttaacatttagtcacgaggtcatgtgagctgcttacctttgaccccctcatttctcctgggagctaaatctgtcattattcttttcctgacccctcagctcactatgtatgtggtttacaccaaatattgtttattattgctatttacacaaatatcatttttgaaaaaaaaatgagggtctaacagcatgtgcttcacatgctccatatttgaaatatacttttaaataaatttgaccttggtcaaattttaattttaaataaattgagttctgatttgggcatactttacattcaattgtctttgggatgtatcatatatggatggaagctataaaagtgtattttatctatttttttgtctgtgtacttttctaagtagattagcttttattttaatctgtttcaacaaatgctgagcacaaactgcgtactagataataagaatacaaagatagcaagacaattctaatcctaaaagtcataaaatagtgttagataaggtcaagttaaatctactacaacatggtatggtaagggtgggactagtggtatgaataaggcactacacagtatagagaaagggatgtttttttttttaattattctgtcaggtagataagaaataagaaattactacaaatggaggtgactttaggcttcatgaaaaataaggtagattctcccactgcccttaataacaaaaattatgtactctaatttaaaatcatgtatattttatatcactcctctttctctttctcctttttgttctaatagtaagcccttaatagaccctattaacccgtgaaaccatctctcatgtcttagtgattttcacggtgacatgtgatttttgaaattcattcttaaatttcatatgcgatttcaaaatattaggcgatgcttgtgccagaggcacagtttatgagataagaggaagggctatggaatttcaccacttgggcttaaatcctggtagtgctactttctaaagatgtacctttgtgtacttgatctctgtttgcctcattaagtgtgaattcttattgttactattgttatgtcaatatttctgtggagggcatttgttgagagcatctcattagtggtaaatgaaagagtatatttgtgtttgtagcactttggcctgtaggtgggaaagaaagaatatttctataagcctcagaaatggggagcaatatacaccaaaggccacaagtctatttataacttgccattattttcacccaaaggttctttaagcataaaccaatattatttgaaatattaacatagattgtcgtttctccgttacttgccttatagcattttcttttttgactgtcatcttgttaaacctcttcgtctttttttatgttactgatttcctatgtgattataaagcaattttctatcatgtataaactcttctgactaaaggaacactttttatagcatcattttataaaaggaatacaaatggatgagtgaagatcatgtgtagatgtgattctgagcctgaattcctcagctttttttcactggggcttagcactccctcagggacacacaagtggcccatggttaacggcagtatctggcacagccaagcctggggtgacattctggtctcacccatgagtacctagctggtatcgtgagcttgggtaaactggttaacctctgtatgctgcagttttctcatttttaaaatgaagctggtatgagcatcggctttgaaagaatgttgtgagtgttctggttatgatgcttgtcaatcacttaaaagaataactggcatatatttcaatataggtgagccataatttttgtcgttatcatcgttatgtggatcaataacctgatgaatgtcctttgtttaccatgaataccacaggaagacatgaatcctgatttcaggaaatttactgtccacttagggttttataatttgcatatgtaagacaaacttaaggacatgaataataccagtatcaacttgacagaatatacaatagagtatataagggctgatcaaagttacaagaagctgattggagaggggttaactgggtgggttttgaccccctccttggtagggatactaaagaaaacagcaaaaaacatttctgacaatttcaggcatatcccacaggttttcaacaattatttactcccaaattccaatttcttaccttgtatctgtttttcagtactacacatgtaggacaaaaactatttaaaacaaatgaaaaataagcttataacccggaaggggaatggagattagaatgaaacttttggaatgtgtttcttatctagaactaaaatacaagataggatagaggaatggtgcattcattccttcaacagatacttattgagcacctattatgtatgctgcattgttctaagcttttcaaatagatcagtgatgaaatggaaaaaaatctctgctgtcaaggagcttacattctaatgggggaaataaacaacatacttgaaactgggcaaatttcaaaagaaagaggttcaatggactcacagttccacgtggctgcggaggcctcacactcatggtggaaggtaacaggcacatctcacatggtggtagacgagaagaatgaggaaccaagtgagaggggtttccccttatgaaaccaccagatcttgtgagacttattcactaccacaagaacagtatggaggaaaatgcccctatgattcagttatctcccactgggtacccccgacaatatgagggaattatgggagctacaattcaagaggagatttgggtggggacatagacataataatggatgaaggggagtaacccgagatggttgccatggattctagcttgtgtccccaaatcaatagctgtgttaggtgaggtaaagaccataggagtgctggggacagcaaggagagaataatgactttgattttatatgttgtggtgggcaaaattatgactcccaaatatgttcacccactcctcactacaactgtatgggaactatggtgttgatagcagttatggtggtagtagtgataatgatagtatactaacaatgagaatagccatttactaaaattcctgatccatttctttgtgtcaggcactttgctaaggattttacatccattacctagtttcataccaacctttgaggctggtggcctatttagcatattaaaagaaaaactccaggccgggcatggtggctcacacctgtaatcccagcactttgggaggccgaggcgggtggatcacaaggtcaggagtttgagaccatcctgcccaatatggtgaaaccccgtctctactaaaaatatgaaaattagctggtgacagagatgcgtgcctgtaatcccagctactcgggaggctgaggcaggagaatcgcttgaacctgggaggcagaggttgcagcgagtcaagatcgtgccactgcactccagcctggtgacagagcgagactctgtctcaaaaaaaaaaaaaaaaaaaaaaggaaaacttcagacaaattaaatttaacagagtttaattgaacaaagaaccagtggcagtccctgaaaccaggacaggttcagtgagagtttggggctgccctgcggctggataatgtttatagataaaacgggatgctcaaaaaacagcagtgaggtacagagaaagctggattcattccaccatggtgtttgccttctttgaacaaggtttgaacagtgtcctcatggtgaaaggcacagaagccagggtgctgtcaaaactgacccgtaagttaagtatcgctcatgagcctgttattagttatagcatatgtaacactcacttttatttcacaagcatgataatgagctatattttcattttgtttttagtttgctttttgggcatttttaatgagagaatatacataattatggaaaatatcaagatatagttttagatttataagcaggaaccagagctcatttctgtggtacactttcacataacatgccattgggtggaaggaggtaagtgcccaggatggttagtgaaacttccttaaaattgataaagaggtatatttcattttttaaaagctttaattcagaaattaaagaagtctcttcctcgaggatttccaagtgcattgctgaatactatatgatatactatgataatttaaaagttggttatactttatcctaacatttgacccatcaagacatttgtaaatattgacgtctttgattaactcttgcttgcgtgaggaagagtaaatttcattgcagccaatttggatttgtaagaaactcaaaaatgtaatgatcctctgcataagataatgtttcagaattttggattcattgcacaatacatcaaattccgataggcaattttcagaattatcaatcataaatcattttcagacacccaaatataattttaatgtgcgagatgtgtttacaacatcattttgtatagaaacttgccagttttatctaaggaaacactatgtttggaaatttgtgccatatttttaaagtataagttaagtctctcttcacaaggtttttaatgaggcactgttttttcacacaaatgatctaggtttctgtggacgctgcccatggttacagtccccgggccattgacatgagcaatgttacactatctagagacctgcatgtaagtactattaacttttaaaaatagtctccaaatttaatttttaagaagcataatgtaatgctttcctgcatatatttggcagcatggtttatttgaatgtggcgatctataatggatccatggaatttatagattatatactctaattttttaatgctatcaaaattgatagctgggtgtggtggcacgtgcctatagtcccagctacttgggaagctgaggcaggagaatcgcttggacctgggaggcagaggttgcagtgagctgagatcacaccactgcactccagcctgagtgacagagtgagactccctctcaaagaaaaaaaaaaaagttgatacaactttttctagggtgtttcagccgtataacatattttcctttaatagccatttaaaaatctctatgttaaatagttgtgtgtgagaagaaagtaaatagttaataatgctctgtgcaagggccaccttcttttaagtttttccagagacattgattgcatttgcttgctccattcatagtctcatctgttcttttttgtcaccaaggaacctactttgaaatagcagatttgaaagtaagataaaatttattgccttgagacataaagttaataggtcaatatggtgttcaaataacatattagcattgttggtaactgtattgttccaagagaaataaggaccgtaaatataaaatttacatattgttaaattgtttggtttgccatttgttattgctcccatatgaacgtattaaaatgacacagtaaacttgaaaatcaaatgtagaaagaatccgggaggtaatcttatcaaaacccaaaaggtcacagaaagattaacttggctagtctaaggtctctcacctagtttggacagagattgatttagaaatcaaatctttgactgtccatctaacattctccatattcaagttgcataaggtttaggtcatttttaaggctttggaaattaaaacaagaacttgtaaatacaaatagtttttctgaagtccatagctattttggtttcattattgaattaatgtcttcaaacattatgaataacaatgaccattttcatttgctgtttagttactgtataatattgcaaatccttacaattctctgggattcacattctaaagaagagtgtttgatatcttttaaatgtatcatagcactaatactgtatgagttattcctttacggtatctaatattatatattagaaagcaatattatccttttttacttattgaaacgataaatatttttgttcatttaaggctatggcagaaatgatggctgaaaactaccataatatatgggcaaagaaaaagaaaatggagttggagtccaaaggtaatattttctaaaaacgtttattaaaaaataatctgagctcaattccatgagtgtatggatgaagtcgtcttcagcacaacagcttattataactttttaaaatcagaacggtttaattgtgcctgtaacagattgaagttggaaatgctgtaatttcctagtggctagtatatattttcttgtgtctcagaattttgacagctttcttttacccattttagcttacagacttctgtacttctcatcctgatatctgagttgttctatgaatgacttagacttccctccctgactctcttccccaacttaaatatctcctatctcacccctttttatttcctatctcagcctcttttgtctggtccagctatgttactgtctcttacatgcttttgcttgcacttttcccgtttttttattcaaatactaaatgaactaatgttctcttagttatttctcaagtcttttaaaatttatttgcatattttcttcagtttaacgtatgctatgctgatgatatctttcaacattatttatttgccgttagtctatacacatattgtttataatgtggtgtctgtgtgtgtgcgcgcatatgcgctgtcgttaatgacttcctatatggttttctttcccctgataggaatatactattttcgagctcagggccacaacatttatttcttttgtaatccttattgtatagttacaggtgccaataaagcttctactttttatttatttgactaggtgaaaatgtagaaggggagaagattttgaaagtggggatatttcatggtgaaaggtaaagctgtgatatggaaggatggtacctggcaccaagcactaggaaacagagtaacacaaattaggattggtcacagagaggaaaagagaagattccacattttattttttattttttttattttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgtccttaatccatttaaccctgagtggacacaatacatgtttcagagagcacagggttgggggtaaggtcacagatcaacaggatcccaaggcagaagaatttttcttagtacagaacaaaatgaaaagtctcccatgtatacttctttctacacagacacggcaaccatctgatttctcaatcttttccccacctttcccccctctctattccacaaaaccgccattgtcatcatggcccgttctcaatgagctgttgggtacacctcccagacggggtggtggcctggcagaggggctcctcacttcccagtaggggcggccgggcagaggcgcccctcacctcccggacggggcggctggccgggcggggggctgaccccccccacctccctcccgcacggggcggctgccgggcggaggggctcctcacttctcagacggggcagttgccaggcagagggtctcctcacttctcagacggggcggccgggcagagacgctcctcacatcccagacggggcggcagggcagaggcggtccccacatctcagaggatgggcggccgggcagagacgctcctcacttcctagatgtgatggcggctgggaagaggcgctcctcacttcctagatgggatggcggccgggcagagacgctcctcactttccagactgggcagccaggcagaggggctcctcacatcccagatgatgggcggccaggcagagacgctcctcacttcccagacggggtggcggccgggcagaggctgcaatctcggcattttgggaggccaaggcaggcggctgggaggtggaggttgtagcgagccgagatcacgccactgcactccagcctgggcaccattgagcactgagtgaacgagactccgtctgcaatcctggcacctccagaggccgaggctggcggatcacttgcggttaggggctggagaccggcctggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagctgtacagtccagcttcggctcggcatcagagggagaccgtggggagagggagactgtggggagagggagactggagagggagagggagagggagagggagacgggagagggagagggagagggagaagattccacatttttaattgcctatttcaaaatgctgctcagggataatatgcctgtattctaaaaccaccccataaatgtttgttaaatgaatgattaattcattgtttggctcatggatgcatggatgaatggatggatggcaaatgagtcatagagttttgttttgtgaaattcttgacagggtattgcccacataactggtaaacaaaatcactgcttattacatgagcagattacatgaaaaaatgtctgttcctttttttaaactatgtttaagtcactgtggtacagttaaattaaaaataataagcagctatcttattacaggttgattatcccttatccaaaatgtttggaaccaaaactgtttgaaagttgagatttttttctgattttttaaatatttgcatatacttactggttcagcatcccaaatcccaaatccaaaagcttaaatgctccaataagtgtttcctttgagcatcatgtagatactcaaaaagtttctgattttggaacatttggatttcagatttttagattagacctattcaacctatatgcttttctaaataagcatgatagaaaatcatcattatttaaatttctgagccagatcgatattttctttaagtcataccactcgtaaatggcacatccatacttctgcatacaacttgtactggctcaaatttgtattctgtagttgggaaactaacctagtggcagcagactaagtggtgaggtaggggaaattagtcctcgcagtctttaattctcttactgcatgtatggatctcatttttaaagaggaactagtttagaaccaaaatggcagaccagtaggaaacgtgttgaactatacagtcaggatcctggcttttaggttattgagattagcaaaccagagaaatgagtcttgggcatagaagataggttacagactgtggccagtttcagagcagaaacgacatgtgtctttttttcaaagttgttttctcactcagagacattaatagtggggaggatccttatagccaacagttgtaggcagttgcatcctgccagctctactcccactgccgataagaggtaggtgggaggaatctgtcaccacctgatgtcttggtgcctgggtgtgtgtgtgtgtgtgcgtgtgtgtgtgtgtgtgtgcgtgtgagagagagagaaatagaaataagaagtcagaaacactaaaagaatcagggccaaagctgcacagttttgttttcacccattctcttctcttttatcatccctgcatctgtgcagagaagatgaatctgctttagggaaatcaggagaaaaatgcctcctttgcttgccttagtcatctgatcctcagtgctcttttggaatctagaaaagtctgagggaaaatcagatgccataaggagttaatagaaataaaggagtgtaagtccaaaaagtatgattagtgcccccaaattagtaaaaaatgttattttcccactgccacttcaagtattttgtaccatggtcatctgttgttaagccacagacagcccactgctgtcaagcatttttttactgtttagtatgaatgggttcatgagtccgtgctggtatgtttggtaatatcctcagagttactgctcactcatttacctctccatgtagctgatttccttcagcacaagatgtctacacccatatcataaatgggaaagttgagggtggaggagcaacgtaaatgtccacggtcacactgctagttagaggcacagtgctagttcagtcacctggcaggctttcagatcccttcgccatctagttcaatgaaggtcgaagagggtgagaagagtttcagagttagtgggtactttgcattcttaggatttttaaattatagacctctttaaagcatctttctctttctctccccacttcccccacagtaacttattggtatgcggccccaaaatcactgattacaaattaagttgccaaattaatagcattctctgggactaaatgcagtgatggagttcaaactaggtgatggttgattaaattagggtgatggaattcaatccttgattttaaaaagatttttgcttttatttttaactgatacataattgtctatatgaggtacagtgtgatatttgcatacatgtatacaatgtgtaatgatcaaatcagggtaattagccaacccatcacctcaaacatttatatttctttgtgttgggagcattcaaaaactgctcttgtagctatttgaaaatatataataaattgttgttaattatagtatccttataaagtgtcctgtttaattatatctttgattaggacaaaagtcaaatttggtttctactaaacttagtaacatattctataccctctgctgttcacaagtgtttgttattattgtcttctgacaactgtttgtgcttgatattattaatatactgtgaagtacctgaattccttattatggttagtatttgttagcttggtagttcttgaccagcaccttccatgtatgatagcacagtgtcacctaatggtattaaagttcagtgggcgattgcatgtctgtagatggcgctttcagtcaaagccagcactagggaagcagacatttcctcctttgcttgcttatttattgtgtagggctaattcaacatttgtgattgttgcagtagctcctggctaaactatattggaaactgatttcatagggttatgttgttacaattcaaacaatatttattctcaattattcttcctggaattcccttagcagttgtatttcagggtagttgagcctctcacacaatatatattaccacacatgttttacgaatgttagatgtgaggcataccatgctattcggtttgctgctgttttaatagcattctttgtatcagatctttacatctgaaattaacagtttaatttttttataatttttgcaaaattttaaccaaaatttttacataatttataattttagaaaggtttttctccctattagtttttttaaatttacatattttctagaatttttaaatctgaaagaaagactacttttagtaagtattatcaggataagtatactaggaatctagactcttgctaaaatgtacttgcccacgtggtttaaagtcaagtattagacacttaagagtgatccacttttaatgtagcacatctacatatggttttgtgtatttataaataatgtgactatgaagtactctctgatctgagagatataatacaaattccatatttaagactttttctcttctctctgtgcgacagcagatgaagcataacccctgaaacatgccttataacttttctaaatccagctaagtatgatttagcatttgtttctactctccacattcagaattgctttgaacgcagaagagaatacagctgcttccctctcattggcgagtgcagatattattgtcacttagtattacaaatgcatgcatgttcatgttttaactgcctcttagaaggcatatgcacagtctttctgtgagtagtttttctgaattaattgaaacattaaaggcagtagaggcagaagagtcttatatgctctatgtattattaaaggatatggaaagttttatagtgtggtccaattatatatctgtgtctcatctcagattcttttcaaattactatgctgtgttcttgtcctgacatactcttaggaggaggaaaccatcctctgctggtgccctatgatacactgacagccaaagagaaagccaaggatagagaaaaagcacaggacatcctcaagttcttgcagatcaatggatatgctgtatccaggtaaaagtacacataccctaagtacacactcttttcacaagagtgaatatttaaatatctccatcatatttaaagctgaaaatgaattcaatgatctgtttacacttttgaggtactgtttaatatgtttaaaatacacacatcagaaacattaacacccctagctgtgtaccatataactgagttccttttgctacatatattaaatcagcatccatcatttaggcaaaatccccaggcaaaaaatcacactctgtttttgtaaatgcaacacttcgttgcatagtaagagagtcactcactgaagctttatatcatatgcaaaatattctttataggttaaatcttactttttctttgagctacaataacattagaaaaacttcaaaatttatatatatagataaacatatatgtatgtatatacacatatatatatacacacacacaattttaccttctaagaggctttgtacaaattgctttcccattttcatttttgctcttccagaggatttaaggacctggaactggacacgccttctattgagaaacgatttgcctatagtttcctccaacaactcattcgctatgtggatgaagcccatcagtatatcctggagtttggtaggtaccatagtcccattgctaatagcccagtgtttgttgtttttaatgtttacaacatcaggatatagaacaacacaggctgctgagctatttgtgatggtataaacccatctattcatcctactactaagtagagttcaacggtcaatggatgaacaagttcttggggagtgggtaaaatctgtgaacttttaaaaatctaacatataagttattccccttataatgtttattggcatttatttgttttcattttgaaagatacattggaaggacatcagaatttgaaggtagagttaaatctcgcctatgaaatcagttgctctactcataagaaaaacttccaaaactatggattttcaaaatttctaaacactatagaggtcttgagtttagcctttgcagggaaacacgttaatactagagtaactgctgtgcagaatactttattattgctcttagggtacaatgaaagacctcttccccgtctggcccagtgctgtctcaaaatttttaaaacctcattctttaagtcttagattcagcacagatgatgaaagcagcctccggtcacttctgttattttgtggtcctcccacattgttgaattaaaattcgacttgttaatttcttaccttaatgtcagagcaccttccagccactgcgtagtaatacgatgtaaggaattccagtttgttcccttttgaaaatagtgtgcttttctggtggttattcatttattttcattttcgttctcgacgttttctctttgtttttaacactcactccttttgtcattcaacacctttcctctgggaccattcatcttggatcccttagctgctgtttgtcttaggatgtaaatctagtttctgccatagcatcagattaaagtttgtagaaattagagctctggtattttcttctttctggcctcttgtatcctaaatgtgattaaagattttccaattgagcatctttctcataaacaattgacttctctttcagcctgcctctacagttcaaatactatattattgctctctttgagcccttctttttcttaaaagcttacactacaagctaatttataatctgtaatctctctatgactcatataactaacaatttttaaaaatatgattcctgacttatcctgatacgtagccaaattaatctgaattaatgaaatttaaccgaagaacaaaaatgaggtaggggtgaattattgaagcttttacacacaaagctaaatattgcaatttctgatctacatttgaaaggatccgatatgcgtagcaactccaatatccagtcttgtttttggagaaacaagggacaggagagaaagaaagagtcatcatttggagaaaggaacaagaaagtcatttgttttttactttcacattggagaacacaaacaccaatatgaagggaagaaatgtatttaggtattattcacagtttattcaaatttctgaataaactacctactacagttttcttgtatgggggtggggagaatcttgctccagggtacatctacccacttgacacatttcattctatccacagggtagagggccttataaacagagcacaggagagaaagtaggctacaatgacagagcccagccaaataacctttttcacaactcctgatgttgtgtgtaccgttttcagatggcttggccagggcaaattaggtacaagaactctgttagaggagcagatagagctgtgattgtcaatatcgtgtttattttaatttccatctttcattgttatcgcaagtgaaactgctatattgccttctccctttatccttcactttggagattttgcagcatatctctaatgtagccattcctagacctaagttaattgtggtagtaaaaatatgcatatgcctttttctaattgttgtataataccgtagattgtaatctctccacatctttttcacattttgcacagaagcattttttttaaatgtagtaaaagacatttcctatttaattcattgaaatatgagcagatttggctgtgttcaaaattttctcttgacataacttcatatgagaaagtctcttatatgaatccagccattttgcataatgtgcttaagagagattcaaatgccaaagtgccatgcaaatgaaatttgcaagtgttaaaaaaccataattttcttttacttgttcatggggagagcattctgatattgcaaaataattgcataagtttcctataaattatattgtatttttgtctaaaatttgataaactattatctcaagttattattattatattattttgcaaaataacttcttcaagcaaaagtcagcttggctcttgaatatctggaagctctgcttacaaattttactaaaacctgatagctctccaatatgttctgcatgccatcgttgttattatagttgattattacctcgtctattaatatatgcatgaaccttttccatatgcatgaaggaggtgagaaaggccaccttctaagctaaatgaattaggttaatcaattcttgaccttggtaaaccatggggaaaacttgggtgtttttgcttcacttatgaaaattatcttttgacataggtcaaaatttctttatgctttagtggaatgctaatttgccaacctaatattaaaattgctgtcctcctcctcatcccagatcctgacttcctgcagttttttagtttgtgtcttaaattgagaagctttaactttcggtcacacgaagaggcaatctttattattagaggccagggttaatatctagccaattatgtttattcaatttacactcactgtcctcttccccagtgagcttcttttcttaaaggctactgaaaatgtgggacttttactctattctattccattttcccctctctatgtcaataagatctcaaagctacacaaatgtgtttgtgtctctaaccacaactatgggctgtcctcaatagctttttaaatttagatttgggtattaaacatccttttatttttaatgacactgccaaagtttgcctttatatttttggttggctttttacattcagtttagcgggataatacatttagcaatgctttctaacctttgcattatggatgaatatcttgcaatgtttccagtgcagcatttacctaaaaactcttcaaatctacagatggtggcagcagaggcaaaggagaacatttcccttatgaacaagaaatcaagttctttgcaaaagtacagtatacaatctatcttgtttttgcttcaatatgtttgtttacataccctactcattagatcgttgcccttttcagaacatacttgtctacaaatgtgtattttactgcacgtaaatattctgtggcatgaaaataactgcatgaatcatcttcccagcattcttggtcagactttaactctgcattccctaccgcattccttcttcaaatgacttcattctatctgaggtttaattaggtctgcattttttttgttttatcatatgatatggaataaaaaatatctatttcttaacatttggatattgttatgatttaaaatttctagttgagaatttcttttataaataggaaagtctgagttaattcataaataggcacattataagaacatttagtacagaatattgtgggaccttagtcctgctcattttatggaagatcagagaggataaattgtttatatacaaaatatatcccattggtattatttattttgtttcataagcatttatcaggaatttgctatattactggaaaattcatcacttttttcagccaaaaagggatggacatgaagagttgtaaagtctccgaatgatttaatgcatttacttagtatttactgtgtgtctagtgtgggtcaggcattagggtatggcccagggatggccatgaatatacaaatgcccctgggtaagctttcttgtttaggacaccttgcagtgagcctgaagacctaattactgctgtctgcttccttttaaagtacttgcattcagcgattacagataatttgctataaatacaacttttgtggactttaaaatagcatgctttttgattgatgaatatttgacttgtagtatgttttcaaaattgtgttctttactgtaaaacacatttctgttgtcttttcttcccattcaatatagcactcagagtctgttccaatcatttgaagatccaaagtttgtcctggggtgcacatagttagcgattcatgaattgatagatccatatatatatctccggtctctgtgagattgtaatctttcttgatagccaattatcagaatgctgtattcgcagcctctaattttccctttaaaatacattcttgtgttgcccgtatactcagcacccccggtgcatctgtttacagatgcttaatgtggcttaatttctactaagtctataattcattcgtttaccatattgagtacctactatgttccagtcactaaattcaagcaatgtcccaattgtcaaggaagagcaataaaaactggtgtagtccccattatatatagctgtgctctaccacatggtaggaaaaagaagtatgtttagatagacatgagtttgaatactggtagtgccgatcttgttcttgctatgggcccgtcacagtccttagcactagggattcagtgacaaacagaagagaccagttaatagttctggaggccaggaaagggctataatgggaaacaaacccagaaatgtttcttgtttttgtgtaactcataggctcctggaaagagagactttaatccaaagtcccacgcatacaatgtaaaattgcaaatgatgttatcagagctcagaatgtgggactttatctagttgagatcagcaaagacttagccggcaaattgccactgagttgagatctacaggaggaccagagtgaataggatatggagtatgggaagagcacgccagacagagggaatggcgtgtacgaggccaggtgatgtgagtggacagagtgaggaggaggaattggcccaaggccagcaggatgaaacatgcgtagaaatggaaagtgcactttaagaaaggccaggttaaaagaatattgtgtaggcaactaagtagcaatgtgaccttcggtaagtcacacatttctatgtctccatttaatacccataatgcagggatgatggcatctaccctacagagcagttgctattatcagttgcaatgttcacacatagtagagactcaacatatggtagttatggattattttggggtctgctgggcactgaactatgttatatgaaaacattgagaatatttcattttgagaaaatagtgagaataattccaaactgttgcaagtttgctctgttcaccataatcacatcctgccactgtggctggagacggtagagtgagatttaagagaggcatactatgacgtgcctggcatggacataaggagacctgttgcatgtgaacagaactctgactgctccaaagcctcagctcccattcatcccctgaaagattccactacgtagatctgtcttcttttcctttctttcaggtcgttcttcctttaattgatcagtatttcaaaaaccatcgtttatacttcttatctgcagcaagcagacctctctgctctggaggacatgcttccaacaaagagaaagaaatggtgactaggtaaacagctataaaaataagcactgttgtatgacttaggtgtatatgcagttgcaaagaaaacctgaggaccttgaagtggggctgtacggagagtatctgcccatttccctggtccgtgtcttcatggaaacaaatactagacaaaaacagtttctacaagtttggatatgtgttctagatgttgagtttctttatattttgctgctaagtgtaatggtggatagaaggataaaatatcactcatttcacaatctacacatagaggccggatatgcatcaccctattagtatttgtgataaatggtacttttgacattagtttctttaatgtttccacaaatctgatatttttgccagcatttattgttcagaagaaaaccccacatatacaaatttaatttaaaaataatgaccaatgttggaagaaaatgaagtaaagatacctataaaatttctgaagctttcccctcttaacaatgctttctcatttctgtttaaaccaaagggttctttatggactcagttgtgattctgctggggatatcaggtccttttactcaaacttctgctagaatttaatatacatgagaatcaattacagagcaagtttacttctctaatattacattgcccaaaagtccataccaagcttttagattgtatcggaacaaaatttctataaaagtgaatacacagtataaagcagaacactggagaaaatacagactttccttggacttgacgtcgatgctgtgctgaaaggcagtacggtctccacctattagacagagtgagatgagattgcatacagcctccgtgagagggtggagaagtggaaagattcctgcactacgtaacactggggaatgcagctggagtggaattgtcagttcatctctttcacttattgtctattttaccaagtagcaagtggccagtcatgtgatatgggattgcaacagtataaaacatgtcctcaaacttcttcaaatgataattttcctataaaattgattatagttaaaataacagcaggaatccatcccagcggcgtgctttgtttccacaaattgctgccacatggagagaggcaatgcagttactttccaagatgtgaatttccaccccttcccacttgaacatggccttccttcccaccttcactgggagggagagcagctcctccctcatcatttcataagcaccacatccagtactctgggccagtatccccctgtggattgtgagtgcacgcaagtagctagaatatctcaaggcaccaagttacccttaaacgtcgtgaaattgaggacacgttgaagtctcctactcctccctgggtctgttagcctttttaaataggaactttgttctcagagggtgttgttaatctagctatcacttagttacataaagataaaatcagaaaatagagaaaaattcaaataaatcaatgcaaattctgctattttcctcctctcctgtcttgtgttttattatctccattcagtttcagccttacccttagaactattcactgagcccatactatgcatatatcgaagcatccaattgtgtgttttgggtatatatgatctgtatttgttaattatacctctataaagctggaaaaatttcatggaactatacaccaaaaaagaaaattggcccatttaccttggccaattctgtatccctcatagaataaatcagaggtacatcgctattttgtgctagcctcagttgatgtccctttggggctctagactaaccctagaccacccctctctctaatgacactgcaccagaatatctttaattatagtcatgcaccacataacaacatttcaattaattttggaccacatgtatgatagtggccccatactatatttttactaatttttttagatatgtttagatatacaaataccattttgttacagttgcctacagtattcggtacagtaacatgctgcacaagtatgtagcctggagcaataggctataccatttaggtttgtgtaagtacattctatgatgtacttatatcatggtcttatgggaataacagtgaaattgcctaatgaggtatttctcagactgaatccccatcattaaatgatgcatgactgtatttcatcttcagtttttcttctactaatagaaaaagcgttggtaaattttacttctcccattggtatttcccaaaaaaaggagcatgtgccatttaaaattccaacacatagaaaatgaggtgcataataaaagtaacttatgttattacagtactttagtgccaaacatagctagaatttaacctcagagagaaagaaaatcatagaggaaaatatgaataaggaaatgataaatgatggtgcatgtctgtacaaaatgctgtgcagtcattaacattatgatggagatgagtataatactttcggaaaatgatcatgataaaatataaaatatatgctcaaatagtattaacttttaaagggaacttaatttgtatgtatagaaaaatattggtagggtataaactcaatagatagaaaactggccctgccactatgaataaataagcatgtcttcattcgcatgataaacactatgataatggttttaagtgtttaacagacgtgagtagcaatagttgtgtgggtttgagttaacttttccacaattaaaaccaatgtttccatgagatgtttagatacttcctggcacaagaaattattatatactgagcatttgctgtatcgaaggtcagtactgtcgtgtctggagtatactttgcagtagctaaatacgtgaatatgagtatagccctagtgaaagccaggcagtaagatgggattcaaagtaaagtaagaccaccttgggtggatatagaggggcgagagatttatggaaatcaagccagtcaaagttgatcttgaacaacttgtaggtcagagattaacaaaggaacatattttctaaatgtagataactacataaataaaatgtagaagctggtaatttaggggaaaggtaggttatatagatggtaatggatattaactgtcagaatcaggaattttcttcttaaaattctatcacaatttttttaacctaattcattaatactaagaagctattaaagctttttatgtgaaagaatgatcagagcttccctctgagaaatacagtctggcagcaaaggtatgattgatgagagtgggagagttgggaggccatggcaggcacctggaggccaagacagcaacccaggctatagtgttggaagtgctgcctcaaataggtggtgctgcccactgatccatttagcaggtgggtctttttcttcttcttcttcttttgaggtagagtctcactctgtcgcccaggctggagtccagtggcatgatctcggctcactgcaacctccgcctcccaggttcaagcaattctcctgcctcagcctcctgagtagctgggattacaggcacccaccaccatgcccggctaattttttttttttattatttttagtagagatagggtttcaccatgttggccaggctggtcttgaactcctgacctcaggtgatccgcccacttctgcctcccaaagtgctgggattacaagcatgaaccaccgtgcccggcctcgttcagatatttctgaatgccacctatgtacggcaagctgtctgaggcctgaagataaacacacacacacacaataacacagttcctaactttaataaatttagaactacagccaagtagacacgtacatatagagctaactctacaggaagttgtgatgagtgtcagtggagacatctacagagtgctgggaatatagaagagatgtaaacagcagctggggtgagaaacagggaagagagaaagtcaacatgacttggcgatgagtaatatggcaagtagaaaaaggtccaacttggtgctgaaatttcaactctgggtagttggaacattgttggtatcatgaatagaaacaacatatttcagaaaaagaatcgtttcgaagaagaggttacatttggtcaggtatttatcggagtataaggtacccgcaggtcattcagttggagaaatccagcagattggaaatattagcatgtggggttaattgagagattagagcaagaaatgacatatttggggattatctgaacacatatatatatatatataatgcttgaagctccgaggaagtagataaaactgaaggagagtagagaaagaggcaaaaggttttgaataccctggagaattattacatttacagggtttttggaaataggtctttgaagaacatcaagaatggttaattagagagaaaaaaaaaaatactgtaaacaaaatccaaggaaggtaagagtttcacgatttaagtaataaacaatgccaagtactgttgacagaactccaaaaaagaaaaggttattatctttgctcattaggggcattggtgagctgcaaaggagtgttttagtacaagacaatgagtaaatgctgaagaagtagatgccttataaattctggagaatgttggaaatgaggggaagcagagaaaggggacaacagtattatagaaaatattttttagagaaaatataggctaaagcttataataattaatccttatagtttctatgaataccatgccctaaaagtggattgcacaggaggggaaagagttacaatttgccctctttgaggaccttgccttctgtatctgtatttctctctggtggcacatgtggtgaggaatcagcagagattgtcaagtcctttttctctgacagattttcaggcattacatataatttgataaatgagacatagagcagtctgccattatagcaaaacatcctaggtttggattaattgagtaagacctaatcctagcattataaattctggatcatcaagaatatctcagaatgtttcactctggatactagagaggaataggtaaaatacatgacttaaaatagattggagtacagggatccaaagtatgtacaattctaaactgaattattctctttagaaaaaggcagaccctgtctgagttagcacacacagctgtcagccataaagctcagtagataagggcacgtggacaaagtttctcctgttttattgtcttaaaattatagcacaaagataaataaggcaggtcaagggcctcatgactaatcttatgtctagtagccacttgaatagatcattgttttaaaaatattttgttctgataagaaattccccaaaacctcagattcactcagacatttgtagatgaacattttcttggaaaactacaaaataccctacataattttcatcaatacatgaatccacattgttacagaagtgaggggtgatggccaaaacttactgtaaaagaggtcaacctcacaaacgttaccttctctgcttccctctcttcccatcctgccactgatcagccaagccactttcatggtattccatggctggtctgtatccctagtcctggggagctgcacgtttgatcacagctgttaatgcagagttttgcaagagaacatagtcagtgaggacttagctgttctcgttattgggaaaaatcaagctgagtgtgggtggtactatacacatggatcttcaaggttagattttctggggtgagtgctggctgggtagagcctgtgctctctgagagctgagaagagcgtgagtagatttgaaaataatgtcacttgtattggtagagatttgcaaatggcccctgagagcatctgggtatggacctcttgcagcctgggttgggagctgtacaggagggctggatgtcagaacgctgacctacttattttattgagtttatttagtttaatgagtttattcttggaagaaactcattctgagctgagttttgagggacgagtagatgggaggatagcatggaaatgagtgaagggtatttctcaaaatagggacctgtgaggatcccacccagctgaggcttggtgaaaagaaaggacaaacagcagggatctcccaggttcaagtgtctgatctgagagttagtggataccagcgttgtcaggctgaatgctgaatgtgggcagccattatttggaatggctcattgctaattgccatgaaggactcaaagacacaggaacctgctctggagcagataagaaatatactgaacttataggtatccagagactttaagttatcacatctgtaatgctttcctctgagtgattatcagttgctcaaattctgttcctactttactgtattcaaattcactggatgcttacgttacgtaaggagtgtgatcaaggttggggacgaaggagatttcaaataataaaacatattaaaacttaaagtaacattgtatgcccgaagcaccatacgtctgttgtaaaataaaataatgtccatatatatattttttaaatccagagtttcagtggtacatttgggcagataaaaccaaattttttcctggtggtttttcagtagttatatccttatggggttcatatagattgcttttatattaattagctttgctttcaattttttttggtttcttataatatgtgcttttttaaccatgtttgttaaagagatgcactcaaagactctttctttaatacctttactccacattctgctcagagaattgattctttctgcgtgacatcatgttgcttttttccggctcatatatcagctgtttttttttcttttttcttcttcttttttttttttttttttaatttccccctgtcttttctaccttcccttcccccttcccttttctcttttgtttttcttttgtcttcagcctattctgcaaacttggagttcttgtcaggcataggatttcactatttggtaaggagacccttgaaaaaatacaagcatggccatcacttggttttctttgccatttttgcactgtgttgtgtgctgctatgttgcatggatgcatgtttgcatggctgcatgcatggtcgttgcaggccaagataaggtcctcgaggttgttcataaatagcattatgtatggtgaaattgaggactctatcttttttacactagtccaaagcataactgaaagtaaaaagactattattaaagagcaaatgaatgaaaatggcaggctgtgccgtattttatctcaggggtaaaaacaaaacaaagccaggcccttggatttgtgtttggttacctctgacagattaaataatgagctgttataaatcaaaattttaaactgcacttattttttttaatgctcttgactacagatttgcatgtcttctgcattccaaacattggaacgtcatagtcaagacactgaagccaaggagcttcggagcttcacttggcaagagtggcttttctagcaccactcactccagggtcagtttctgtttgtttctgagaattcacctagctggagtccatgttccagagcacctgcttccggacagccatgcagggtgggcactcactttccgcagattttccctgccgtggggctttagaatctttagtggctggtggaatttgtgtttcacactttcctgcatccgattttataaactgccgaagaaaatgtgaaccctttgctctctaggttttgagacagtgttggagtaattttagtaataaaacattgaatgtattgctagaggtattataagttcaattctatttacaggacaagctaaggattaaaaaaattaagtcatttctacaaagtcacagttaaactgaggaacgggtatatatatatacatatatatatatacacacacacacatatgcacaaataagttcttcacattacactttttgagaaataatagtttctggatatagtaggttattgctatatttggtttctagtattatatccaagatttggtgctcttaaatttagtaatgaaaatttatatttcattaaaattgcctgagtttttacattaatatttcagttatttaaaatcaatggggcagttatctttagaataatttctagttcactgacttttgtttaacttctcttcaacagagaaatattttcatgggcttattcaggcaggattttcatacactctttaaccttctcagaataacagtggattcaaatattctccatttgtcttcagcaagtgctatctaattatacatatcagctgcccttttgcggtcttattaatgagcataataatactttctatggtgctatttctaacttcctgcttattgtatatccttcttttcctgttatacctcatataatttcctttaaaatttttttgaggtattccatacctgaactacaaaatcctaagaacaacttggctaggtgtggtggctcatgcctgtatcccagcactttgggatgtcgtggtgagagaatcacttgaggacaggagttcaagaccagctggggcaacatagcaagaccttggctctacaaaaaataaaaataaaaaattagccaggtgcagtggtgcacacctatagtcttagctacacaggacgctgagatggatggatcacttgagcccaggaatctgaggtagcagtgagctatgatcacaccactgtactctcatctaggaaacagagcaaaaccctgtctctaatacaagcaaataaaaagaacaacttgatgaaaatgtatatgcatatacaaccatttaatcatagctcaagccaagacatagaacgtttccaacatgccaggagcctcccctgtgtcatttttcaaattataaccatctccagaggaactatatgtagactccattctatggattcttttcagctgttcttgaaattccatttttgttgaatatatcatttaagtttggttattgaagataaatgtataatacagtttgtcatgcttgttaggggtgaaaaactagaccttaacattagttccttccctgtgtggtcctagtatttcaattagacattgtggtttcatcccttagccttttaatactattatttttatttttaaggggaatttattggagacctggtatgttttctttatatctcaaagcgcatttttgcacatttttatattattaaagtgtatgttattgtttcaaatttgctttgatatttgcctataaaatataaacttcaacatggctttattaatcaaacatctagtacagatttgccaaattattagaatctttaagtctttttttttttttttgaaagagtttcactcttgttgcccaccaagctggagtgcaatggtgagatctcatctcactgcaacctccgcctcccaggttcaagcaattttcctgcctcagcctcccaagtagctgggattacaggcacacgccaccacacacggctaatttttagtagaaacggggtttcaccatgttggccaggctggtctcgaactcctgacttcaggtgatctgcccacctcggtctgccaaagtgctgggattacaagtgtgagccaccgtgcctggccaaatcttttaagtcttaagcatttaagcttcacatattatgggtattggtatagtatttaaatgtcacatattatgggctgtagatgctaatatgacatcctagagagaatagtgggtttggaatcagaaaacctagttgtaagtcctatttttctaacttaacagctgaatgatttggacaagggacttaaattctctgaacctgcattttttcattgttaaagtgggctaaaatacctaataaacctagagatcaattttttgtgaaataattcatgttaaagtgctatgtaaagtgtaaccttatagttttcacatataagatgtttctagtcttattaaaattattagattttattaacttatctaaagcttattatactttatttacataaattacatactaaactagtagacttagccctttaaaatacacacacagggccaggcacagtggctcacgcctggaatcccagcactttgggaggccaaggcggacagatcacttgagctcgggagttcaagaccagcctgggaaacatggcgagaccccatctcgactaagaatacaaaaaattagccatgtctggtggcatacacctttggtcccagctactcaggaggctggggtgggaggattgcttgagcctggagggcagaggttgcagtgagccaacattgcacaccacacacacaaaaatacacacagtaaagcctttataatacacccatttccagaatgaatcagaagtgttataacccaactatttactttttgatttatcagctatgccagtgtggatttttccaaacagagagacccagtagcatatatgcagtgcttgtttgtatatggtcatattaatctattctttttcagtctacttttatcattttcttgcattttggcaggaaatacattgattatcaatgggattacaagcgtgagccaccacgcccggccaaatctctaagtcttaagcatttaagcttcacatattccctgtactgtcttgtatttcctgtactatcttggtttaaagattttttcatgacctaaacctaagagtaaattaagacagaattgaaagttgaggttgacaagaaaatacttgagttttgtgatgatcagagaaggtaaggatgtagaaagatacatgttaaccttaaatatgtcagaaagtggagacaggacaggagcattaaaaaaaaatgaagagacaaaatacatgttctggtggtagtaattgtggtgagcagagtttgatgggtaatggaatatttattctaggttggctgccacattgtaattatatctccaaacctcgcctgtggttgaaatatttttctgacatatgaaatgaggattctcaaaactttggcttttatattttttgttatctactttaaaatatttcttctgcattgatggacactatacaggaattaagataatagtgtttttatgcctaatctattatttttgagacatttaaaccattttatgttatgtttaaaaagctaaggtttttaaaaaggaagacaagcggtattacccatagaattctgatgaatcaattagaataatttatggaatgaaaaagaaagaaaatagcttcttgtctaaatataggcttccctgtttgaattctgaaatgcttgctagtgattataagttggtgcacataacgaattttggaaatccaggtaggacataaataggacgtaggcaggttgacaagtgatatccttatcatttgccattttcaaggaccagtgttgactaaagaaacagtgctttgattcccagagttacccctgacttttgctgcctagaaattctgattactattttcaaggcagttagaggatacattagcccttctattacagtctgttagaatctttcaatcatttttagaggaagcagcatctgataactaagagtccaacagtaataatgatggtggcacaggtggtgcttatcagagtgccttaaaggctttctttttacatgtgaaaataaatcaaatgccttgatgatactcattttatgcattcattcaataaacatgtattgtatgtctgccacgtgaaaggcattcactcaagatgtgaggataggaaaatgaagattgatttctctttccactccggaacccagaccaatatgcaaacatctttcgcttgtactattgcaggagcatactgaccattctctctgaatcccctcctgcttctctcaactgtgttccacgatgatcttatcaaatcttctcaaaacacacttctctgattacactcctgcatattcagtggcttcccatgcctttagggtagaaagcacgtttcttaacctagccacattagtgtttcaccgtccattccccatgggccactccgtcctcgtgtcccagcccagtctctcctcctccctatgcttcttcagcttccttggccttctctctgcctcttgaatgtgttagattcctttctgcccagggtttttgcacatgctgtaattatcgcctgagtaaaggaccctcacacataattactcatctcctcaatccttcacactcataacaaactatccatccttcagacttcaatccaaatattactgtctcaagaaaggcttccctgacctccttgataatactccgtcctgctactattataatagtctctggtgccgtgtacttttcctccatgtcactgatggtatgcctaccagattaatatctctcttctctcgcataaactctcagctctgtgaggtcttcctgttgcactctcagtgcctggcaggaagtctggcacacagtaaatattttatgaatatatgatgaatgaatgaatgaatgagccacccaggtccggccttcaagaagcctatagtctaatagagaaggtagataagtacgcagacacttactatgagacaagtgctaagaacgtggaaattttcttacattcacgaatgacacagctttcctttgtttattttgcttaagagattattaagaaaaatgtagtacctaattatcctacaattggtgagaatcatgttttttttttttttctcttattccttaagaggtccatgaaaacacttaggccacttacagtgaatagaaaataacacataattaatgacccttaaaataataagatcatgaaactcaaccaacaatgatcctttcagttccaggaactatttgaaaaggcaggcatgaaatatttgtcacttataggccttttctactttccagttttctggtgcctttttaacatcctagtgagacattgaatgacctggacactcctcagagttagtggagaatttgtgaattaatcacataggtacatctaggaatacctgatgttattacaaaaagccagcattttgtaatacaatgagcataatactgacctagaacccaatgtataacatcattaatacaactccaatattagctacaggagtattaaacaagataaatattattatgtgtttaacatgaaacagtagctgttgttaaaatattcagtttttttctaggtgagtatgcctgacttataccagtagataaatcttaatgttacgtttggaagagttttaaaagtagatactaaataaagtaatacaatggagcctatcaactcttatttctacctaatcaataaattagtggattaagtttatgttgatacttctaatatctctcccaaaaaacactgacgtctttaaatgatgatttctgtcttatctcagaagttattatattagaaaattaatatgtttgtgttatctctaacaaggctcagattgtgcttgtgtttggtaggacacatataataaaagaaaaattggccgggtgcggtggctcacgcctgtaatcccagcactctgggaggctgaggcgggcggatcacaaggtcaggggatcgagaccatcctggctaacaaggtgaaaccccgtctctgctaaaaatacaaaaaattagccgggcgtggtggcaggcgcctgtagtcccagctactcgggaggctgaggcaggagaatggcgtgaacccaggaggtggagtttgcagtgagccgagatcatgccagtgcactccagcctgggcgacacggcgagactccctctcaaaaaaaaaaaaaaaaagaaaaattacttaaagtactcagaatcactgcagatagaagcatatttgaggattcagtgtgccattaagttgagaatgtaatggttcaatcatgcgcaatctgtaactattttcttatccttgttattcgtagctggaggatcattgagatctttctctaatttaaaaattctgtagtactatgacaatatgcatggcaaaaacaactatttcctggatttaacttattatatatactgtaaaaaatcctatttttttagagaagttcagaaatattggaattagatgcctataatgaaagtaataaagtatacatagcattagatcaacatagtattagagcgatacagataattctttcagttgaacatagcattataggagaatttcctggctttgaaaaatgaatagaatatgtagttattcaaaatgtgtcctcggtttgactgaaactcctcaccaaattagggaaccaataattttactctgttcaatatcacagactttagaaataacaaagtcattgacactctgcaatttctctctattccctcataattgtgagagaaatttgtaagttctggcacagtggtatttcacattgttaatagaattctgccaagattaatcatttcttcagagaaaagaatacaatattagaaaagtagagaaaaataaaaagtacaatgactgctatcactgtttccagaagagagagaagtcaacattctgtgaattctcagcatatcagattataaaacagaactggcatatgatatgtcaaatttaacattgagaattcctgagttatagaaactttatttaaaaaaacaatttgggattaatatgcaaaaattatttatagttatattatgtaatttgttgtttttattatttagagagtcatatatgagagttgttataatttgtttaaaacccaatgttgtccctattgttattagacccaggtgtaagttattattttaattatgtactttttatgtttacgtacaccttgatgcactgatataaatacacaatcttaaggacaaataggcaatctatcattgtttccctgagtgctcagaggtgatgagaggtgtgtatctgaggacaagggaaatagctgggtccttgaaatactgtgagttgaaaagtatcaatcttttggttttttcaccacccagagcaatgaatcaattatgtaaacttaagtacataaaaatccagttgccacctgaaagttttatcatcttacaaaactctgctggcccttcctgttcttcctgataacgtgattgacatttctgattatggtaatctggatagctttaagaaggacaatatttaagtcattattttattgaaaagccttaccacatgctttacctcttcaagactcacattattttaggcttcttacacatgctaatgggattgacacttttgcctggtctacaaattaaaatattgaagactctactttttctgccttcttagagtccctttcccattttttacatagaggtgtttctatttaaagttgtgctgtgtctaaaaggggtctaccaagatgtaaaaatgtgtggagttcagtttattcctttagcaatcacagaaatttcatattcccaatacacagtttcagtcaacccacagaatttgtctggctcctggtgctgtttcctactcttcttacatcccagagacagtccacaaatattttaagggcctgctgtatgtcagacactattctaggtgcagggaacaaagcaaacaaaaatcccagcctgccaggcttatattaatagaagtttaaagtatccctggccacccctcatggaaaagggcacaggaaaactcagtaccaagtacaaacactgataatctataataagagcagattggaagggaaagggacagacaactgagtgtttaggaaaaatgaaggacctgcctctctgatttggggctgattaatagtggcataggactcatatacgttgcactggatctcttcctcctcatgggccttctctttcccattgtctatactgcatctttcttatcttctctgcctccaaacactggaggccctaggccttttttcttcttacttatattcatgctggctagtttcattgagacccacgatgtttagaattaaatgtatgtttacaatgcccaagtgtatagctctggcttagatctcttccctgcactgcagacttttttttttttttcaatcaattgcctattctacatctttacccgaattactaataggcccatcacacttaatatgtgcaaagcaagggtcaggaccccatcccccacccccgccgcatccccttcctcccacagtctgcttcttctcgttctctttctacaccattcagtggtgccgcctttcacctaattactcaggcagaaaaccttagagttatccttgactgctttcccgctcacctcacattcaatccataagtaaatccttcaaatatatattctcaagttcttcaccactgatatcctaatctgaattcaccatcatcagtgaactgattccgttcctgcagtaggtccctaattatcttccacttttgctcttccagaatttcccacatagggaattaattctttgaaaatataaatcgtatcatatcccatcctgctcaaaacctaagaatgtcttcctaccgcactgaaaatccaagggcttgctctaaccaagctctagaacctgacctctcccaacctctccaactcatactctgcttctttcctcttgctctgactcccttagccacttgaccctctttgcttggaacaccaggttcattttttgcctcagagcctttgcatgggctcttccctgtacctggatctccttctcagatacatggatggtttatttcttcatgtcattccaacctctgctcaaatgccgcctccaggaaggactcatgagcactatccctgttattctacccagtttctgtaggtgtgtgtgtgtgtgtatatatatatagtatatatatataatatatatttatataatatataattgcatattatatattatgttatatattatataattatatcatatataattatataatatatatttatgtaaatatatattatatgatatataatatatttatagaaatatatattatataatataattatatataatctttttgtatataacaaatattttttatatatatttaactgtggcctgctattatgttatatgctgatattttgctaaatgattttttttttttttgcttactgattcgttatctatatccccctttaaaatgcaagtaccataaggactattttgttcattactggaaatttgagagtgcctggttttaatctttctttgttaagtgaattaatcatcaaatgaatacttctaagagttccaggagaagccccagagctggcatctgccaatggacaggaaaataaaaaatcctaccattctgctcattttgtcttcattattaccaggaattctgagacttgaagcacaagatgagggaatattttcatgaataactcagaatctcagtaataaataccttattttttcttatttgtatcatatcactaaactggcttgcccatgttctaatacaattattaatttcagtgtgtacttaggtcattcattttaggttactttttgtataaagaatataacatataccagtattacaaaaacttacattcagataatagttgtcaatctcaggacccaggagatgatagtgtgtgtgtgtgtgtgtgtgtgtgtgtgtgtgtgtgtgtgtgtgtaatgaggaactgatcatgtcaaactatattgtaagtggtcaaattattttgttaccttgaattcatcattttatttgctttctgtatccccattacgaagaaaaatatatgtaatgcttttatcactcatatttctgtacttccttgtaaaatatgccaatcaaaatgagtgaattttatattactttcaagaggagttactaccatctgaaaatctcagaggagtattatttaacttctttagtgtctgattttttttttacatgacgttttggtgctttttggtttttgccaaagaccaataacattcaaggaaattaatttaccttcatgcaatggaattcaggcaaattaattcatcttaatgcagtgggatgaaataagaaagcagaatttttggtgcaattagaatggaatgaaaatttttaaactttaagcccaccttatttcataaaggatatgagctgactttaaaagtttgtaaacaataagatttaaaaatacagtgagatgggagggagaggggattattgaaaacctcggttaaaactcttttagtctggtgcagtgcttttgaatgcttcttgggcatgtcagctatttgatgagacatgctttattgcttttctacttacatttgcataaccacttttaagcagaaaaactgcatgatttcaaacttgattattaaaaaaccttttaaaatattactgttgtgtcattgactaatttttctagcacaaatattggtagaaaagaagaacattgagaaattctcagggcaatttatacagcattttgtttcctctttaggcaatgatgcaacatcaattgtcaactgtcttcatattttgggtcagactttggatgcaaggtaaatggatacatttttacctaaataaattactataataatgatacatgtatatatataagaatattaagaaggacccagtgtctggattttattctttggatttgtaataaagtctttagtgtaggtgaaaagaaaaactttttaaaattaatacagtggcagcttatgtctatgatcatatatagattattatttaatgtcaggtaatttctgtagcagctaggaccataaaggagggttgaactggtaatgtatcacgcaggaaaaatggtaatctgacaactctagagatcttgttagcttccaggcgtgatatttgtgcttaacattcataataacatttggctttttaggaaacagagttttattctcattttacagatgaataaagtgatgtttaagattgcatactaagtgtgtaggtagacgaattcccatctgtgtgctttctactctgccctgtcaacttgaccagaaatctagcatgttgaccaaatacaaaatcagttcatttagcatgattgattcagccatacatttagtttatatctaggataaatctaaataaaagtttataaatgtctcctaaagagaatattccacaatactctttgattatccattcttgcgtttaagatttcatttaaggtcttttgtatgataaatgcagaaaggagacaccattacagaccttcacttcctactacaaatagtggcattaaggtatgaagttcagccttcggcggcttcattagaaaagacttgattgctacaccttaaaacacaaacattctgtatcatttgttgagttggtttagctggcatgaaattttttttgctactcattgcctcaggaaacattctagttttgttggatttcggattaactatactcactcagaagctgtgttttgttagttaaattggagaccgttagtgataagcatacagcattagcacagacttttgcagcaaggttttaataagttgactatgaaggcatttggaaaagataatttacagagcagtattgctgtaacttcaagtatattgaaaaaatttgttttagagttgattttaaaagttggttaccaggtgagtagagtaatggagaaataaacatcataagagaaccacaattcatttatatttcatttgttcctgttggaagatacgagtcctcccttatttactttctaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatatgtatgtaaatttatatcttggagtttttttttttttaatcgaaataccctgtagtacaatcaaaaacagtaatagccacatctgggttactaaaacactgtttacatgttaaaatgccttttttattgcaaaacgttataggttgacatttgtgtgatagacaccattcttacagaaatagatctctgaattacatggacccacagagaggaccagtaaggtactggttatagaaaatgacttccacattgttgaagtttccaaatgatcactatttctacattgcctcttttcacataaacgttttaatgcagttgaaccatataacatgcaacagtaaatgttttcaaattatttctgagtcaatgtagattgtttctccaagcttgacaatgtaataatgtgaagacgactgagacaaagtctgtgtctaaataattggccttttagagtggctcaaatatcctctgtttagaggtttctgacagtttttagggaagctttaatcttctgttttgggctggcattcagtagttaataaaactatacacagaatgcccaagattacgtggaaaaaatacgcatgagctgtttgaactccccactgccctgctcaggacatgagcctttgttgagcagaatcaccaactcagactcgtgcattgtccattcctcaggtgatgggcacctctgtgcaaaaactgctgagttactcagtgggtgccacaactaccagtggcagaacgtttattttaaattttgttttaagaaagcatgcttagtccgggtgcagtggcgcatgcctgtaatcccagtactttgggaggctgaggtgggtggttcagctgaagtcaggagttcgagaccagcctggccagtatggtgaaaccccgtctctactaaaaatacaaaaattagctgggcatgatggtgcacacctgtaatcccagctactcgggaggctgagacaagataatcacttgaacctatgtggtggaggttgcagtgagccagtattgccactgcactccagcctgggtgacagagcaagactctatctcaaaaaaaaaaagcagatgtgccttttgtttagttatttttatttgtataaatttacgggtttcaagtacagttgtctgggcttttagggcatccatcacccaaataatgaacattgtgcccattaagtaatttctcgtcatccaccccctcctgccccctcacccttctgagtcttgtctattattctcctctctatgtccatgtgtacacatggtttagtacccacttataagtgaggacatgtgatatttgactttatgtgcctggcttgtttcactgaagataacaacccccagttccatccatgttgctgcaaaagacatgatttcattctttttatggatgaatagtatatagcctaaactgaatagtacatagcttaagctttctcaggacaatgtataaataagtgggtttttctttcaagtgagattctctttttccttagtggaagatgtccaggtgtcttgttatagaattctgactagcttatatgctttgggaaccagcaagagtatttacgtggagaggtaagaatgtttaaagtttaactttgtattaattgctgcttcaagttttataactatttatttcaagaatcttcatttcataacctgtttcctagttataaactaaaccggattgacctttgaaattccttggaagtaattagacaatctttaaacaaaataagaattgatataataaaggacaatggagttatgcaaagaaagtaaagcactaatggtaaagactacacttaatatgaagtttcagctgagtgtttgagtcttatgaaagcacctgctagtatcgtttctcattatatatcagaaattcaaagtaaacatgaatatgagcagttattaaacctagttttattttctcatgttctcaagtttcaggatggagtggtttgcagtgttaaatgatgtgaataggtaacataagaaaaggtatccccagtaaatttaaaataaagagatcactggcaactttagtaagaaatttctgtgaaccagagaagaaaaacagggaagtttttttaaaaggtcagaataaataaaaacatattctgatagaagatttaattatgaatagatataagttctcccaaaattaacctgtaattacagtacaatttcagtacagcaaattacagaaatttgctttttccaacttcacaaaatcattcaaaagtttatttcaaagaataaacccatgagactagccaacggaatttgcaggggaataaaagagtaatgaacaggtactcatttggcctaccaaatattaaaacctataaagctacagtagttaaaataggatgacagttgtacataaaaatagcaaattagatcaatggaaaaacataattgggtttactctgaacattttacatttcttaccttcattttaagtaaactcaattttcatattatttttatggttatgacctatattaaggaagtataataatttattgatatgtgactttatttttgacatgttggctgttttctgtttttcactaatatatataatgccagatctatgttcatagattccattgtatttttatgcttatttcccttagctgtattcttagaatttggaattataggtcaaagggtatgcctgtattacaggattacggtactcatttcactgttttcagaaaatcctttccatttacattctcaaattttagaagtgaatgctaatttcctcatttgttccttactcagattatcttttttttctttttagtgcttgtgtatgtgatagtgaaaatataggatccctatttatattttcaaatgcactttcctgattaccatctacttgctatttttttcatgtttaccttgtcatttgtgtttctttactttatgaattgccttttctcatcttgcatctatttttctattcatgtattgtcatgctgatttgtaataatgcttttgttcattaaaatgattaacctcttgcctatttctcctgtttttgtgagttttaccattttttacctttatatatatatagtgcttatatataaaatatatacataaaacatatatatatatataaaatatataaaaattatatacagatagcattttatgacatggtaatgttgaatttttatataatcaaattttatataattttgacataatcaatcaattatttcatgtatgtttcttccccttagttttattattctgataagtttagactacacatttagcagttagaatttcaaacatttatcctcctagacttttcatgcttccagttctttatatttaactttataatcctattgtttgtatcctaaatatttgttaaatgccagatactaggatacagaaataaacaagatacttctctactctcataggttttatatctggtagaggaaaccaaaccaaaacaaacaagcaaactgataaatattatagtggcaaggtatagtttgtcctatgaataatcacacaatttggagaacaaggtagtcgagaatgtgtcttttagaaggcgacttttgaagcttataacttttctctatgcaacagaaaacaggtagaagctatatgaggtaggtctgtgtctagtagcttctgttttctcaatgaagaatgccttgagtcctaagccagatgaaggctgagaaaagaagtgtggaaagctcaaggaaagtagagaatgtctagaatgatcatctctgagataagaagggaatttactagaaatatatctgaactttatttctcttgggtattatgtaggattcaaattaaatttttaaaatcatcaaccatttgtaaagtaatcatttattaactatttattttattccctgatttaaaataaaaccatcatgtaaagtaatgtatttactagattacatttagaatttctattctgttctattatttgattttttatgactaaatcaatatcatatagcctgaattgttagtatttttaaaaatattttaatatctggtttttcaaaccctctaattccttcttattgctgtagcttttgtttttgtcattgttgtttttgcctatatatttatctggacaaaattcgaggtcacttttttaggttctaaataatgttttggtttttggtggcttgttttttaagtcttttttgtgcaattaattttgcggttataaagtgattggggaaacaaaaaaaaattcaaaggtaaggaaaagacattttgaaaaaaatagatatttacaaaaagttacagtggaactttttctaaaatatctacaaatatagatattttaacataagtcatccaaaagaaaaattgatatttccagaatgccaacacaaattatcagaatcagtctgagaatcactaattgaaacagaattttaaagtgaattaatgaaataaaaggactagtccaatcagatatgaggaaataagttgacagataattttttgctaacagataatttagctttttttcaaatggtgaggatattgctattgaaagcatatgatgtttagcaatacagaaattggatttgggagttaattttattaggaccaatattatcattccttttaggttaaatttgctaattgtaatatgacttttttagttactcacttggaagaccttaaaacataagcattttccacttataggcaacgttctgcattaggagaatgtctagctgcctttgctggtgcttttcctgtagcatttttggaaactcatctggacaaacataatatttactccatctacaataccaagtcttcacgagaaagagcaggtaacacagaaacatgtgcagtgctttgagatatgaagctaaaacttgatatttatcatattgtccaatagtgatttttaatgagctctttcagtttactatatccaatcttgtttgttcttaaatgttattgtttggtattctatgtgatgtaccctgtgatagatgagggagatatgatacatatagggcagcaatcagaatatgtggtaattcaagagcaaggtgactgagcaggccccttggacagcgtgtatgtgtgttgattgtgagagctcctagaggtagagtcatcttgtgtggcagatgagggagtatcgcagcctagacgtaatcccaggtttctcttctgggtgactgactggataatgtccccaccaagttagggcatgctcaagataggctggagagaaaaagagaagtttaaatttagatccatcgtgttttagttgtgcttgagacatccaggatgagtcagaacagtttttaagaaacatggctttacagatattagcttatagcagaaagaatggccaaaattgtctagatgaacatgcaaaccaaaaaagagaagagaatcaaagatagattcctaaagataatcagcatttgaaagttcagcaagggctgggcgcagtggctcatgcctgtaatcccagcactttgggaggccgaagtgggtagatcacgaggtcaggagttcaagaccagcctgaccaacatagtgaaaccccgtctgtgctaaaaatacaaaaattagccgggcgtggtggtgtgtgcctgtaatcctggctactcaggaggctgaggcatgagaatcgcttgaactggggaggcagagtttgcagtgagccaagactgcgccactgcactccagcctggcaacagagcaagactctgtctcagcagcaacaacaaaaaaagttcagcaaggagaagagagtcagtaaggacactgacaacattcagagggagccaaaaaggctgggcacattgatgttaagaaagaagggagttttaggaaaagggaatttggtcctgggtatgaaatgccactgaacggttggaaagatgagttgtaaaagtgcaattttgctgcacagtgaaaagcagctttgttcctgaggacggagagtgcctggatagctaagtaatccaggaaagatttgagtatcttgctgggtaggaggtattacagggctgaaaatacaggtctgagcaaggcatcaggtatttggtggagccgtgagtgggggacttcaaaacttcctcgaaaacggggaatggaggccaaggtggagccagtcataaatggcttgtaggtcatgagagcagcaaagttagaggaggaaatatttgatactattgtttgctgtaaagtaggaggaatggctgttttctgggagtgatggtacagtaggaacttaggggaaagagagaagctttgaaatagctaccttgaaacacaggagaaggagccagttgcaggcatgccacgtcttgctaaattttgaagtccaaaatgaaatagttgcctgtggaaatccgccatatcatctcagtactttctttgaatatcatccatttttatatgtacttctccagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcaggtaagaactggaagaagacattgtacccctgaaatctgttttatttccaaaagaattttaaatacataaactagaattttcccatcacaatttttattaatattttctttactcaaaaatattagtatttgtcatgctattttttaatgtagataaaaacaggcattgggtatatgttaaatagttactacttttaagtaaacatttttctgacttgtcaatctctgtaagattaatcaataaacacagcagtaaaaactaatgattttatagccagagacaaaaataaaacattcaacttttagcaatccacttgtagccatctgttatatagagaatgtgaagagaagggagggtaaaccaaaaaaatgtagtctaatgtctacaattattgcattatttgtattgaaaagttagaagcaatctaagtacccaataaccagaatatggctaaataagttgtatacatctacatgccagaatattatgtcatattttgttttttgtttgtttgtttatgagatggagtttcactcttgttgcccaggcaagagtgcaatggtgagatcttggctcactgcaacctccgcctcccgggttcaagtgattctcctgcctcagcctcccgggtagctaggattacaggcatctgccaccatgcccagctaatttttttttttttttttttttttagtagagatggggtttcaccatgttcgccaggctggtctcgaactcctgacctcaggtgatccacccacctcggcctcccaaagtgctgggattacaggtgtgagccaccacgtctatgtcatctttaaatgttgaagtttcaacaatattttatgccctggaaatactcatattatgaagggaaaaatggagaatttttaaaacaatgaattcagaatgttatatgtataatatatatgtaaatgaatttatctactgatgaaaactccagaaaaatgcagcaatgacttattaatttgggtagatgattatggttgactttaacttttctcttgtatacttttccccagtgcatatatgttactttcagggggaaaaaagtcattttaaaaatggcccaatcaagtttagaactattattaacaactatggttattattaaataagagagcagtgttccatataatctaactcttccattgtgccaaggatggggatagttaaaatgagataactgtatatagtctcatatagtaattatgtagcagagcttgtccctattctaagggttaggggaaccttttccatttgggaattttatttcttgtgtgaaaatgatttccaaaatgagtgaaagtcttttttttcattctaaattagctatctattctaaaaacaaggaagatcgttgaattcaactcagtaaacatttttttaatggcagctatgcaattagaacttggactagaaaaatggctgaggcatgagctgtacccttaaggaagtcatgtgctggagaaggaggctttaattatgttacaattgtaattacaatctatcatcatgttaatgaatggttttacagagcagaatactaatgtctgtctttaaacagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacaggtatgatcaaaagtaatttagtaatttctccaattcggtcataacgtttcttggctcacatgtccttgttcaatcgcttcattcactattttgccatgagcttgttggtaattataattaactgtttataggcaagttaatttttggcttaaaattaaaacaccttaaaatcaaagttggccgtttcattctgattttgcatgtaaaagttaacagtttgacagttatgatgtttaaatttttttttaaatattacaacactgtgctgaaaccatcatgagctctgtggtcagtacatttaactttggggggatggttttttttttttaaattaactttaaggagtagctgagaaaccactttatttattatgtgatccagggcaaagtggctaaaggagcctaacccagaagcagaggagctcttccgcatggtggctgaagtgtttatctactggtcgaagtcccatgtgagtgtgaaaatattgatagatcacgcctactgtttgtaggcacctgcttacttgcctcctaggtttcatgtaacagttgaggagagagaataggttcccctgaggagtttgagggaatataaaccttcttctgagttttgcaatttatcctttaaaaaaatcacagggatttttaattgcactccataaacatattttaaatttgcccctaaattttggactaatattgacattgcataaagatgtactatttttactatctagctttccctatctcttggcattttgttctcttaatttgcagttctcagtttgagacgtgcttaaatagactagcaatttccaacaataacccacactcattttacttgtaaaggtactgcttccataaatttgttttatcttcacacactttacacctaaggaatttagtttggctcacattttagaatctgttgggttttaaaataaagcttctttctactgacaatcctgttgatagaatttctaaagtacgtatttggtgaattttcactattttgtgtattgcaagtggaactatgtatttttaaacctggaaaagattttaatcataacaatcgtatagtagtctatcattatttcagtaactagcagaatatagataaaagagcattgatgattatcctgaattattttaaaaatttagaatttttatatcaattataattctatgccactctgtaaatgagagacaaagaaaataaaaatttcaacctcagttttatcatctgagatatcttaccagtttacttaatcagactgttgtacaaatcaagttactttgaatacataatattttttaaatatgcatatttaatatttgggatgacaaatattatttattgcctacatctgaggagtctgtcaaacttaatagcaaactttatataaaaacatacattaaaaacataatcactcagaaaggatatatgaaataatggctgcttaacatgcaactttgtatcttcacaaagatacaaatttatttatcctgtgtaactcatgtttgggggatgcaatagatcatccaaggtattctgaaggaaaattcaaaatccactgtaaaaagataaatagattaggtatgtagatagatagatagataatgcatgcccggtgacaggtgggagcattgcttgagctcaggagttagaggctgcagtgccctatcattgcacagctgcatcccagcctgggtgacagagccagaccctgtccctaaatacatacatgaatgaatgtataaataaatgaattccagaagaaatcagtccattttgagctgccaaaaaacaaagatgaatttttgctttttgcctgttgttttccctgttgggttacttcacttagaatgcctcatgggaaaatagggggagcccaggaaaaaattactaaaaactgcatatttttatttgaagaactgaaactcttcagtttcctcgatcattaaaatgccgaagaagcgtctttagatttaggtacaagactaaagtttggaacaagagtatttatcataatcagtatgttttcagatgaatgtctaatcatactttcaagaataagcaaaaatatctgaatatgtacttttgaatctcatgggcatatattaatataaacataaattggctaatgtgttatgtttttccccaaatatttaaagataaattgattttgccagtctttttatgttcccaaattaaaagggaataaataatgatatggtattttaaaaacaggtaaaaaatctgacagaatagaaagttacgtcatagttctatgtgtcctcggaaagtctatgttaatctcaggaatcagtatatgcctttcaccagctaaccaggcgtttgaatattcattctactccttggtaaacatgtgatcttgcaatgaaattttctgaatcttagttttcccatctttgcaatgtgcatattcatatctagttcacagaattcttgcttctagccaagtaccctcattagatactcaagaaatacttgtatccttttttgataattcttatatatcaaattaatacttatctctgtaaaaacttgcaggttctgtgtaacctctaattacaaagacttctttaagtggttttaactgaaatttcctttgcaacttctcagaatttcaaaagagaagagcagaacttcgttgtacagaatgaaatcaacaatatgtctttccttattactgataccaagtcaaagatgtcaaaggtattactataaactgtttcactgttctggaaaatatctgaatgtgactttcatgaattgactttttttttttagattttcgaagatttgtaactggaatctgacagatttggtaatgttataaattggttcaaatatgcaagctgttttaaggttactggaatttgtttgaatcaggcatggtaagacatgcagacgggaaatgactgtcatgaaggaagacatttctactgacagatccctggaaacaggaggcatggcatgccaggcagggccccccggggagaggtcagggtcagtcaggaggtagagagagcaaggagaagacgtgggcgagagcttgcctcgtggtctccactggaaggaatggacaaggcagggcaaacaggtttctgattggctaatttgaatacttttcaggggctccacatcatagggcctgtccttggctgcctggtacctagtcccagagtgattagagcaggtggatagtagcccagagtataagagcccgataggtgaggcaggggtcagtgtgggctctgggttggttgacttgtatatgaaaagcaagctccccaaaccaaggaagccatttccttctctaggacttgcctaacgatgggagggactgctgtctccccaggatcagcaaatctccaagatgtcagagcaacagaataaagacatgcttcacacacacacactcacacacacacacacgcaccccccactcaccaaaagtcagtataatgtatgtttaacatgtcaacactatgtgtccatcaagtgtgaatatttgtgtgcttatgtgtaccaaagaaacagacctcaaaataaattcgctgcattatttaaaagccacatggacgaattccaggttctcacacatgaagtgggaagtatctttccagatttttgttttctctgtcactcgtattggggaggggagtagcttccatttaaagcattttaaaggggctttatatgtttaattcctgctaaatgagaaataaatatattacatgtggtaacatttggctgccaaatggccaaagatccaaaaatgactgctactcaggcagagcaaattagcctctactgactcaataaattctggcaacagagtagcttaggtacacccactccactgacctccaaaagtcaccggatcctcaggcctgctctgtgatctgtcacaagggaagtagaatggtattgcttggtaggcctagtcttgtttaagagttttgaatgccctgtgtttgacccgacagcacatgaactagaagctaatgccagaagtctgtgtattcctgtacagatacccttttccctcttttccatcagttgagtccagtgattctcaaagatactctcaaagcactacatgtcatagaacctagagtgagacatgcataaagatgactgattataacacagtttgctcttatttgcaagaagaaaaaaggggagtaatagataagaacctctcaattttaacatttctgacccacaaattttctcaaactaaaaaattatttttttgtttttgtttttgtttgttttgtttttttgagacggagccttgctttgttgcccaggctggagtgcagtggtgcgatctcggctcactgcaacctctgcctcctgggttcaagcgattctcctgcctcagcctcccaagtagctgggactatacaggcgcatgccaccatgcccagttaattttcgtatttttagtagagacagggtttcaccatattggccaggctggtctcaaactcctgacctcgtgatctgacggcctcggcctcccaaagtacctggattgcactccagcctaggcaacaagaatgaaaatccatctcaaaaaaatatatatagatagatagataggtagatagcatttattacaagttctctgtgtttatttgtgggtgtgagaaaggtgggttttgcctgttgcattatacaattgtactctgtttttttcttaagatttcatttcctgttgaaatgtaatcacaggccttggacatttaaagctaggctaatttttataattactatatctaaaatacaaaaaagtatctttttataggtttttttttttggtaggctatttcattgtgggaatattagaaaattttttgtaagttcccacagaaaggtcatgtgataaatacaaccaattaaaactgtgctttctgttcataatgtggcaaaggaaagagcttggctttcagaggcagatcagcctggagtgctgactctgccacttcataatcccttcactcatcttaaacctcactgttcgtagcagcaaaatgtttgtcatgctgcttaccttgatggaggcttgtaaaatcagaataatgtgtgtgttgtgcctcacagattataggcatgcaacaaattttaatagatatgaattgtagtaacaaaatgataaagttaaaatacagctgaatatctaacaatcatatagttaataagtacttagaaaacgtacgagagaaagaaactgataggatagtcaaagatgtcagaggtaagtgaggatttgaataggtcttggaaaatgagtcttttctagatgggtcataaggagagagggtggaggagcctgctgataacccattttatgcagccatagcactgtttttgctcaaatctaacagtatatttgaagaagagtctgtttgatgtctttcttgccattttcctggtccactattaaatttaaagctattttctgtgaaattgttacaatcatatttgtatgtttgtgggtgtgtgagagacagagatagagaggaggcagaagcagaggttgattgattgattgattaaagaaagggctcaagtggctgggtgcggtggctcacgcctgtaatcccagcactttgggaggccaaggcagatggatcacgaggtcaggagttcaagaccagtctggccaagatggtgaaaccccatctctactaaaaatacaaaaaaaaaattagccaggcgtggtggtgggtgcctctaatcccagctacttgggaggctgaggcagagcattacttgaacccaggagatggagactgcagtgagccgagatcacaccactgcactccagcctggtgacagagcgagactccatctcaaaaaaaaaaaaaaaaaaaaaaaaaaaaaaaagggctcaggtgattgatttaagaaagggctcaggttagtccacttcccttcttaaatatgcccacatatgggccatgttattacatcttcatatctgatccaaatgcacagattgaaaatgaaaaagtgtgcaaattcattagctttagcggctctgtttaaattattgagctgcgcctatgagcaaggcacagtgcgtggctttgaatacagagaaacgacaaaacaggtttggcagctgccccaaaggagctgcatagtttggggaggaaataggcactaaacaaatgaacaaaaaatacccaatatgtgcgtacaggaggatattttattgcttatagatttaatttcctcatatgaacagtgacatcacccataaatgttcaaatatttactactctttccagttatagatttcttctggggtggaaagcaaaattattgtttgtgtataagtaggaattcatttgcctagtgttactcaaaattgagcaatttgtagatgtgtttagtgttgattatttttattataagctcacaaatatttataaatattaaaccagatataagctccttctgcctatacaaccataaaaccaaaagaactttacaggttaaaatcaatgaaaactctaacaccaataaatttagactaagaaaactccaaaccaatacaatttagactaagaaaactccaaaccaatacaatttagactatattggggatgtcgctttgctgaaactaaattaccggtattggatagaagtatgtttgtataatttatatcaatttgcttaatttttaggatagtggttcttcctttgggcaattatttttatcattttagttatgttgtcctttgaacaaagagcccattttaaatgatccattttttaatgaatgagtcaatttaacagtacaaattattcatcatattttttctaataaacttactgagaataatctcttacaagttggtatgtataaaaatgggattcatgcaataagcatatctttttggaacagaagtataattcttactgctatggttcagaagattataggtttaatataacacttcaatatgtagtttaattattacataattgtatattttataacgtaatatataagctatcattgctatatggtgactcacttgtttcactactttcactatggtaaaaatgtctttcaacctcatgctatgatacactttaccttctgttaagtaaaacaaatcatttgtatattaaattctattatgttttttctcaatagcccaagactattacaatgtatttatatttataaatattaaaatatttttcattatcatttcattatcacgaaactatgttgtaactttgaattactgctacaaaatattcaacatgcacaaataagtggatgtgggacaattattttaattttgacattagaacatgccatcttgatagaatactcattacccagtgaaaattagattctgtcgtttaaggtgaccctgtgttactagcataagcctcaaaaacatcacaagagagcccttgagtaacatggcagtattcagttgtaaactggttatccagatcgtcctgaatatttatgaaactccaatgagtatattacttctatttctactagacggggactgaggctctaggaagacaagtttgcagactgtataaaagaaaaatgcattttataattgttctgatatattagaccacacacacacacacacacacacacacaccatatacatgtatatatatttcaaagcaagcatttgtcaaaacaaaaataagccctttattcttatatttcttaagcattgaaaattagaaagcacacaatatctgaaattactatagaattttttatatatttatctgcttccctaaaattacaattttcatttgtcttctaaaaattacgtgggaatgcataccagtgaattataatgacctaggaatctgagggtaggacttgaaatcagcaaaagatactaagaagggaagagaaaaattattctcaaaacaggaggattttcaaaactagggagcagcagaaaatgaggaagatgaagtgacaagttagggaagagtcatagtggttctacatgtgagaaaagcaggttcagatcccagcacttctctttgttccataggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctggtaagtctccttttcatcccagcggtaatgatcatctgacctccagactctcagtgtttgattcctttgtctcactgccctatgtcaatatttcatttgcattacatgttttattaagcaggttttctagacaggcccaagactcaaacataaagactgctctttttttgaggctgtttttatttgtaagttatgttaatcacctccgggacacattcaagaaccaaacaggaaagacacaaaccaatctctggtagtgaaaaaaatggatttcatataaacttctatataaagtttgtgatgagaagcatactcaaatttatgaagggtgatttttcaatgttaaaagcataatatattgtgccaactgtgggtagataaggtgttgacttttaaatcagctgctgttctcctctgcaagatttaagttcctctgcaagatttaagttctcaagattttacaatgtcctctgagtttctgttcttcatagctatgcaaatgaggatgcaatattttgtacattggaatttctattttatatttatgtaaattggaggacatattctccattccacattgaatcactgaagctcgtcactgaacatgcatcgtttgacattctaaaatgagtgaattgaggggaagctgtgggagtgggctgcatcacgcagctctactggcagttctctagagtttgattctcagttgcattttccttgctattactgggtcatggaggatgttattaagggctaaaatgacttcgtggagatttggaagaatactggagatatacttctatttcagcccaagaaaacatgctatgcccccttcttcttatgaattggaaacttgattccattgaatttcaatgtccttactgtggaggtaaagcaggtcattaccttgcttcaggctacagcagtaccaagaaattatttgaatgagaatgccccaaatttgtagcatgtaattttataaagatgtttctcagacgtatactatttcaaaaaaggtttggattgtttctattgacttgtgacagttgatgcaatagaagactccttttaggtaacatatatttcttgacagaaagataccgaggatgaagtacgagatataatccgcagcaatattcatttacaaggcaaggtaagccaaattttattcttaagccacatttactacctatacattagttaatctctctttaaaataatactataaataatgttactttaaacattaaggtaatagacatattttaattagtcattatcctacttgcaaagccttttgtattaaaaattctaaagataataaatgatatatttttaaagaaaattaccagagattgtcaaattttggaaaaaatatatgtcatcagttgaaatacagattggatgtattcttttttaattattatactttaagttttagggtacatatgcacaacatgcaggtttgttacatatgtatacatgtgccatgttggtgtgctgcacccattagctcatcatttagcattaggtatatctcctaatgctgtccttcttgatagaggagttttagggtcttttggacgtagagaaggtgtctataagaaaatgttggctaggcacagtggctcacacctttaatcccaacagtttgggaggctgaggcaggcaaatcacttgagcccaagagtttgagcctgggcaacatggcaaaaccccgcctctacaaaaagtacaaaaattagctggatggtggtgcacacctgtagtcccagctacttgggtggctgaggtgggaggatggcttgagcctgggaggtggaggttgcagtgaaccaagaccgtgccactgcactccagcctagacaacaaagggaaaccctgtctcaaaaaacacaaaatttacatggagcgatcagtaattaaatatatatttttaagagtcgttagtctataggtgaattaggccatttttgctttactatatagaaatatctgagactgggtaatttaggaagaaaagaggtttaattgattcacggttctgcaggctgtacagaaagtataacacgggcatctgcttttggggaggttccaggaagcttaaaatcatggcagatggtgaaggagaggcaggcatctcgcctggcaggagcaggaacaagagcagtgaggagggaggtgccacacacttaaacagccagatctcacgagaatcttgagggcagcaccaaggggatgctgcgaagccacttatgaaagttttgccccgtgatcaactcagctcccaccaggccccgcctccaacactgaggattacatttccacataaggctgctaaaccacttatgaaagttttgccccatgatcaactcagctcccaccaggtcccgtctccaacactgaggattacatttccacataaggctgctaaaccacttatgaaagttttgccccatgatcaactcagctcccaccaggtcccgtctccaacactgaggattacatttccacatgagatttgggcagggacacagatccacactatatcaataggctatatcgagatttgcagcaataggaataagtgagtttacctaaggagaagagaagcgtgtacagttggaataaaaacatggatggaaatcgatagaacacctactttttaatggtgggtgaaagaattgttagaagtagttttggcaatccagtgaccatttactattatttggaaattttttataccattgaataaattattcatttgtttataaaacctgtgatgcagttttaaaagtcaagctagtattttgactcagcctgttgtcttctattctgggtgtcccttctgaggaattttttttaattatgaaaatacgcaaatgtcaaaaagtagcaacaacaatataatatatgcctttctgggtattaaaatgtctctttccaaagatccaaatcatatgatttttaaattagcattttaaagaataagataaaggtgagacatgcctttaccatattcacaatgcacaagtattcattcagagcaaatttcatgtgaagtttgatgtgtactcagttgtttactaacaattcttttagagtgagattaattactattagagtatgatctcttttcagatagccagaagaatttgaacatttttttaaaagtttataaagcctctattggaacttcagaagaaaagtttacactacaaacatttttcccctatagggagagacactaaatgtttttatgtacatgggtatttgagaagatcaggtaccccatgaaagggtgcaggggatccccaggggaccctagaccatacctggagcaccattatctagttcaacaattactgagttagagacagagagtgctcagtacctcttaagaggagtctgggccaatctcaagaaatggtcaaataaaggtggttatgattataagcagaaagaagtttgtccattatattctaaaggtcacttgtaagaatattttggacagtttagatgacgtattcaggagacaggaagaaggaagagagcaaaaaaggaaacattgattgtccatatttcacctccaaatgaataagacctgaaaataaagaggtaatgaataaatattcatcttgtcattttattctacactttcttaaactaggagttaggcaggcatattaatgagatacacagattttcaaaaaatgaatttttttattcctaacttcttgaatacattgtcttgaaattgtagggctgttcatcctgaggccagaggagtaattttatgttagaataaagattctactttattaattatgtattaaatagaactaagagtacagattaaaacctgtaagtatcaaacatagtcctcagacttaaaaagtaaacggatgaaaacattttattttatcaaaggataagtagtctttacaaatcatttatccctatacaaagctctatctgtctgtgtttgcctgtagatgaaaattatttctgacattttaactaggcactctcagtctgggagttgtgaagttttagatgtcatctatttatttctgcttcataacattcagtctcccatttctaatggagattctaaagtagaagacaaggggattgctttgtccgttttttgtttgtttgttttttgagatggagtctcactctgtcactcagactggagggcattggtgcaatctcggttcactgcaacctccacctccttgggttcaagcgattctcctgcctcagcctcccgagtagctgtgattacaggcgtgcaccaccacacccagctaattttttgtatttttaatcgagaagaggtttcaccatgttggccaggctggtctcaaactcctgacctcaagtaatccacccaccttggcctcccaaagtgctgggattacaggagtgagccaccgtgcccggctgctttgtccatttttaataacatacttattctatattatttctttgaactgatatgttctacccccattaaattgcttgcttttgtcaatttctatgacttataataatgtttctaaacacatgaagatttcatatacgtttttcaccaaggaaatttgatgctattgaaaagtaaaatgtgtagactcctttatgatgagtgtgattttaaaaacatctattgatttatataatttaatatctttgcctcagtgaaattaagcgctgttgtagagtccaaatatttataggtaaatgctatcctatatccttgcccataaaagtaaacatagaaatctttctacaattagactgtgaatggggaggagaagagcatgggtagccttacccattttgttttccagtttcccactcatccttaagccctagttacaacgtcttgtgttaagggaaatctacccaaccaccaaagagtatgataaatctcacggtattttatattttgttttagtagcccttatcacaattttaaatatttgtttaatgtctgtcttctctactagatgataaatttcatgatgaccaggactttatctgtctttcttagtatttttaatttttttttttttttgagatggagtctcgctctgtcgcccaggctggagtgcagtggcgcgatctcggctcactgcaagctccgcctcccgggttcacgctgttctcctgcctcagcctcccgagtagctgggactacaggcgcccgccaccacgcctggctaattttttgtatttttagtagaaacggggtttcaccgtgttaaccaggacggtctcgatctgctgacctcatgatccgcccacctcggcctcccaaagtgctgggattacaggcgtgagccaccgtgcctggccaatatttttaatttttaataattgtatatagttaaggtgtccaacaggatgtttcaatatacataagcatagtcacatgattagtgtagtcagacaaattagcatatctatctcctcgcatagttaccttttgcctgtatgtgctaagagctcctggaatctactctcagcaaatttccagtatgaattgcagcattattaactgtaatcaccatgctgtacattagatctccagacctgttcatcctacataactgcagctgcgcgtcatgtcttaactggtaaacactgtaaagcccaataaataatgatgggtggactcttcctatctttagattgtaaccttgtttttagattcccatcttcccattgtaaccttttccttttttctgcagttggaggatcctgctattagatggcaaatggctctttacaaagacttaccaaacaggactgatgatacctcagatccagagaagacggtagaaagagtattggatatagcaaatgtgctttttcatcttgaacaggtcaggctttgtgtcaattcaatcatatttgccttagccacatacaaatattttaaaaagagaatgtgtgttaatttgttaactatgacccaagaaacatatatgttcagcatattcattctaaagaataagagtccggtgtgcttagtatttcataaagacaatttctaagcttacaaatcttgtagcaatatatagattatatattttgggagatcctggcctttgttttgttgtcttttttcaaatatttctgaaagtattaggattatatttttaaattattctaaccaaaaaattcaggagttacatctgatttcaaatactttatgcatacttcattttttaatattgctcataaaaacatgtttgagatattatcttttaccggtttaatatttgaaacattttcttttttgccacttgtttaaccttgccttttattaggtatatttttgagctaattttctctgaaatcaggaacaaattacacttagagaagaacaatgcattgatagatattaaaatcatgtaagaaaagtgtttttatatattttttcagttgtgtcctactttacactacaaagctcagtttgatattcattacctttgcacaagaatgtgtaaaacaagaatacttgaaacattatcaatgggagggtcatatttttacagaagagatcatctggcttaggtaaaatatctgcaacacagagatatattatctatttctcatcaagtccattcagcaaaataatcacagtgaagaagctcattgtaacttgaccatctgatctgtcacagggctcttatgacagatcatactgttgatgacttggttattttatactaaatataaaataataataagatgccctatgccatctcaggaactttgccacctaaatgtatgtgtgtgtgcatatatatatatatatatatatatatatatatatgtatgtgtgataaatttcatagatgataaattaaattatatatatataattttgtattgcctttagccatatttgaacatattatcatagcaataataaacattttgcttgtattcctgttttatattatctgaaccctcacccctgccctggacagtttaataatgcaaagatatcatctaatgtagtatccttttaacttccttcttgcttactcaaataccctcccccaaacgttaataatttctctattgtcatgcaatttatcactacacttgatgagattaaagtcactaggatacccttaagctgtatggctattaacatatatttacgttatctaataccttggaacttaatactttcccctgaataacttacgtaatattttcatgaaatattaaataaatacaaattatcatcaatcagcagatgacaagacttgtcatgaaattttaagtgatttatataaagtcatagagttttatctccagaattatatatatatatgtttaagattattaaaggttaattaaatggctacatttctgacagcattgctctaccatcagtttttaattcttcctagtgtttatacatatatatagatttgcttgaataaattctagatacattaaatgaagcttatagaaactgattctattttattatattcccatatattcataaatatatccaatcatgatgaatgatggcatttctcaaatgaggttcacttttctaagtatccatttatgccttggatgtttatggagttccctgtcctagggcagccttatccccagcagacctggaggactgagtgctgtaagagaggaaacagacacttaaacagataaatatgggatgatacggagctgttaggatataaaatgtgctgaagaaagtatagaagcaacccatacttaatgtagatatgaagtaggtaatccctgtataagtcttaaggtaggaattatctagaaaaagtgggaggatcagagtttttcaaactgttaagaatatggcgagattggtttatcatgagaggagggttttgagttaaaagaaattgtcgattatcaaaaataaaaagtgggagatatcctcgtgtttaatttatgcctttaatatccctctgctaatgataacatgtgactgagtcacagaggagcgtgcaaagaatattttaacttgcaaacgtcagtgtaaaaaacagtaggtggacaggaaacacttgttgatttaatttatctcaagtatcagcagcctgttttagatgtatattttgtgttgtatatctggtaagttttcttatgagagtaggttatctccattgaattttctaataatcaaattctagccaagctaacacatcagcacatcaagacattcagacagggttacaaggtacatctttgtgttcgcctttggatcacatatctcacagataactatttacttatcattgatttagaggaaagcacactcaggtatttcctgaaatactttaataggcaggtaataaaatgcctgccaaatgataagcttcctggtggcaggaaccctttttgttggatttttactgtatcttaaatgccttaggaacttaaaatatgtttgtcaactgtcacccatgctgatcataatgctgtaattcctgtaaaaagctatcatctacagactggggtctcaaaatggaaatttaaattgaagtatgttgggtctcattgaaaactattgcccttgattgcttttacttctatgttaaaggcctaacagtggtttatttcacttgacacaagcatcaagaagatgattgaagtggataattgtcaccacgtgtttattgatcatagagggggaagagcatcacagaaataagtgcttttccgttaaacaagttgcctcgtgaaaatttctaaaccaccgcagtccaaacattttaaatgtttacttcagacattattacaatcatttttgactctttactgcaaaggataataaatgtagttttacttttttagctaacataacatttttatttctttcagaagtctaaacgtgtgggtcggagacattactgtctgggaagtacagtgctcaatggcctagagattactaattaatttaggtttatatgttgggattttttctttctaatacaattaatctctttcttctcttagagttccaaacactattagttatataaataacttgcttgcatcatttattgcaacttttgaatttatatttgtccctatctaacaaaatatttacatattttaacatttttaccaaatttactcactcctaatactgtgttcacaaagcgttgtcttcttctctttatcctgctgtattaaagaatagtagaatttttattaactgtctctttttgtgtttattactttagctcttacaataaaattagttacaatggacatatgaataagaatgaggtaatattttatgtaggcagaaaatatgtattaaaatcataaagaaccaaagaaaattttgagaaggagataaaatgattttatatggaatgattttctatttctttgattttagaggtgacatagctttgaagtacacagtattgggaaaatgtgatattcttactaagggaattatatagcatttgcaactatctaaattttatctttgggtaacttttaggatatggacttcttcatgataatcttaaggtacttttggaattggaattccaaatatagattacttaagaggggcaactgtttaatactatatttttgaagatagtttggggtgtaaatatttatttgtttttgaaggtagtttggggtgtaaatatttatttgtgtcattctacctcaggtggaacatcctcagagatctaaaaaggctgtatggcataaactactgtccaagcagaggaaaagggctgttgtagcctgcttccggatggcccccttatataatctgccaaggtcggaattactttattttttgtaatagatcaatgttattttttcctagtaagtgacaggtgtttagaatctaccttaataggggtacaatagtccaagagaaggatggaaaagctttattgattcttctacataaaacttgactaattttgttggatattttcggagaactgtggtctttaatgtaattattaaatgactcttactgaggaatatctgctcacatatgtgaggcaagagagagtcattaggagttctttctttgtcctggatttgaatcagaacatgatctgaatcattctttggcatcagacttgtcttgatttgaattctgacctcccaacttctctgccccatgacattggtcaagttatttactggcgaattttctcatctgtatcataatgggatcagccttatagagttgttcagattatttaatgggttgatgtatacagagtgcttagaagtgagctagtaggtttatgtcatgataaatgttagtcattattattatttttgtaattattagcattaggggaaaagaactgacttatgggaataatgtaaaaagatttgacaggcccgtcaaccttctcttagacatagagcagacatacttaatagagaagtagcctggtacattcaagtctggcttaggtggtccagggtaccatttcagtcaccttggagttctctgagaaactatgctctttcccactctgaagtttatacaaattgcatcacctctatgtctcagaaacaggactcagctcagctacatctcttttgtggaacatctctgaccaagccatgcccctctactccttgcacatcataccactttcctacagtattaaggctatttgtctctttgattcagactttgagatcctgtactagttttgttccattttctttcttcagcacctagaacagtgacttgtacattgacattcagtaagagtttgagtgaatgtataaggcaaagaaaaaaaagaaacataagcaaaacaaatagaggaaacatcatacttttcccttttgctaagacagctgtatttcttgccatcgtgtcacactcactgggtctaaaatgtattagcatcctcctcaaatgtgctacttctcaattctctgactcaattatgctgtcaccttttggtcagatagaatattaaccttaatatctagaaccagaaataccatttaacccagcaatcccatgactgggtatatacccaaaggattataaatcattctactataaagacacatgcacatgtatgtttattgcagcactgttcacaatagtaaagacttggaaccaacccaaatgcccatcaatgatagactggataaagaaaaagtggcacatatacaccatggaatactatgcagccataaaaaaagaatgagttcatgtcccttgcagggacatggataaagctggaaaccatcattctcagcaaactaacacaggaacagaaaataaaataccacatgttctcactcataagtgggagtcgaacaatgagaacacatggatacagggaggggaacatcacacactggggcctgtcggggggtgggggcaatgggagggagagtattaagacaaatacctaatgcatatggggcttaaaacctagaagatgggttgataggtgcagcaaaccaccatggcacatgtatacctatgtaacaaacctgcacattctgcacatgtatcccagaacttaaagtaatgaaagcaaaaaaaaagaatattaactttgaattcacattatcatttctttttggttactcctatactgtcattgcccagatttcatcagtttccctttgaactacttcacattcccatccttccctccatcaccacctcttcaagtcgcttgttccttgcctcatatcaagttgatggcagtggtttctgagttagtttctgtgatgtcatagagttcttccatcctctccaaaatgtcattttcaaaatggtatcctttattccagtggttcgccaacctggtgcttttaagaaacacacttaaactcatttaaaaagtattcaggcctcaacttattaaattagaatttcagtgagagcccagcatgtgtgctacttaaaagctacacaggtgactctgatgaacccagaaggctgagtctgtgctttggcatgccactctcacatacaagaatgtatgatgatttctagcagttccggctgcgttggcagttgccccctctgatttccaaggcccttcataaacctgtctaactgttacgtctcatgagtccttaacccaatttgttatcataaagctcagctttccatcctgcaatggcaccgtctctcattctatcacatctgttgttgttttatgatgttcccttcatgacattcttttattctttcttaccttgacatcttatccacatctcttactaacttcatcatgaattccactgattcttctcatctgcactggtcttttttcacaggcggccatttatgataagtagtgcagggtttaatctttgagtatgtactcccataaagttcacttaataccttttgttttggaatcctcagggccatccatttgttttttaatgtttgcttggacagagactaagtcctctattgacactgattacattgcttatcgagagacatgttatatgataatagtcatttaatgaacatctaatcaatgcgatttacatcctttatctcattttaaggcttacaaaactgaaatgtggttggagttatcctggttttataaaggaataaactgaaatttgggaaagtcgagtcacttgaccaatgttacaaagcttggaaatgactgagccaggattgaaatgcaagtcactgtgcgctatgtttgctgcaagaagcattgtctttcaggaggagagtcaagaatagagaatttatttctattttacactttcagtgcacagataatctagtaataaagcactactcaatacaatttcaacttattttctaaacaccctttttctgaaattgtgcttacctttcaggcatcgggctgtcaatctctttcttcagggatatgaaaagtcttggattgaaacagaagaacattactttgaagataaactgatagaagatttagcagtatgtttttagtggggctctaagatgaaagagggtctaggcttggtgcagcaatgttggcgtgagcagtcattatataacattgaaggaaaaaatatcattacagtatatgggtattaggaaacttttaaatcttaattgttactgcattcaatgcttatgggaaaatgtgctcttgtcatttccaagagatctcatcaacatcaaggggttgagaatttaaaatgaataatatagaagtattattaattaaacatgatttagtctttcttttaaattccttctcaaagcacctataaacacctgagaaccaggatagactataaaagaatgaactgtcaagaagttatccacctaaattaagtagaaggtgaacaaaaaattgctggtttttagaaatcaacagggcagagaatgatagactgaacacaggagactgaacacatggtaaatgtggagcatgagaagtagaattttcaccagactgtgctgataaagagcttgtgagttcagcacagaacagcagtcagtatcatcttttctaagtcatggacccatctaaatatctggcaaaagccatcttctcaacaaaatttacaagccatctcaaaacttggcagactagtcagaggcttcatgattcccaagataaagacatcttgtgtaaagttattttttaactcacagattattagggaatataatggataaattaatctaattcttaaaagcctaatcttgattgtccccatattttaaaatgatttttatctgtctttagaataaaaaatgtgtagactattggatatcttgtggaaatctgcccattatccacattaaggcttaattacaggaaagaacaccattcatgtacagagaaaattagtttccatggctaagtcagtggagatataaaactcaacaaaaagttggatgtaattgaattctgccaataaaaatgcttaataattttcctcgctattaaagttctatccgatagtaaaaaaaaaatattttttaagttttaaaagtaactgaaaataagaaaaaaagtataagtggttcaagcattaactcatttagtattatttacgtatcatgctgtgtgtaagcgaagaaaatatttcactttataagcaatttgcactgctatgggaactaaattttcacacttggggtgactcaggattttattgcaaatatttgtaaatcgagtcctccctaaagctaaaatccatgcagcaaatatactttgagttatgaaaatgcttataagaatggcatttggtatttttaaatgatataagttatccctgctcatattaatttttggtcaaattattaaatatctctgttttgagctgcataattttacaatggtaatgtaacagatatctagcatattatattacatttatatatgttatagcatgtatattacatatttacacttacatgcaacacatatacatacaagcttttatatacacatacacacatatatacatatatagcatgtataatgcatataaaatacacacacacacacacacacacacacaccccacaacagggaaggaggaacgttcgcattccttttattcttcattgctgtccttcacagtgcttttggatttgagtgaacatttttttttaatgtgacattttataaatttgacttttttgcagaaacctggggctgaacctccagaagaagatgaaggcactaagagagttgatcctctacatcagctgatccttctgtttagtcggacagctttaacagagaaatggtatggttgggagggttcctatgagacataggaggagcaaataaagacacccgtgtctgagtattctgtgccatgtgttcatgttttaagttcatcttgttgttgttaggagagagaattgttcaaagataacaaccagcctggcatgtacctagggaccgacactcattcaattttaggcttcagcaactacctactagttctagtttttcttaacaactttgtaattaatgatgtagttgattctgattcttcttatgaaatggtttttctgtttatcacaaacaaactttataaataaaacaaaagaaccaaagcaaattccagtgccgcaagtgtatggagaccgatggtggccccaaattttctgggtagatagtgtctccattgtgcagtgggtcttaggaaacctctagaggctaagtgagccatcacctcaacttggaggtatctctgagatctatttcaagggcattgcccatttttcttgtcttctgcagccttagtcatatgaattcaccaaagccacaaagggcaaacctctctgaagttacataagaaatgcactggtaggcctgatcgtcaaaatgtgctcagcatctgtcattacggagggcaatgcataaattggctgtgcagatgggacatagcagaggctagaggacctttatctgctgccctgcaatgggaaagaaagcctgttttgcccccaggcctttcccattctctgcagaatttgggatgtaatttaattaaaaactcatatccacatgaatctcctcagaagagttcatttgacctctttgcctgccataataatgtacatttctccctcttagctaatgtgatctatcctttctctcactatttctctctctcttattatttcctaactaacaaaatcatctcattcctaagcatagagcaactctctctctggcattgtcaggtaatgaggtatttctcataagtgaatttttctcatggctgaagtttaaaactgctgaaataactttgcaaattttaggtatatttttggtggaaacttttcttcacgtagtcatggtttccatgcttctcaaaaagaagataataaacatattttaacctttcttaatttttagggatcattattatggccatcttgttttttaattgtcatatcataatttggggactctttccatcaaatgtcaaatttcacttctgtcaaaagcccccacctcatttaagtttgcttgtttcaagttttgtagtctgaagaaaattaaaattattacatttgtgtgtaaaccaaaagacagtttattttgtgaaaattgaaggcccttctgtaaggtaagatgggacagctatttaggatccccgggatctttgctttctgatttcaggatatttctgaatatcctaatattgtcttagttttgtgttcatttaattttaaaaaggtatacttgttagaaaaagaacaaaggttattttaagcagcgatgatacgtgtgcatgtgcctagccttctgcttaaacactgatgttttcttcttgctttccccagcaaactggaggaagattttttatatatggcctatgcagatattatggcaaaggtaaataagtatccttcctgattttcatgtttaattttaataaagggaagtaactttcatctgaaaaggataagaatctgtgtatttcattaatttcaactttttgtttgtagcatgaatctccgttctaaattccatggcaggtcatcattgtttcctacttaaacattttatttatgaggagccataactttttctaaacattcattcattcaacaaatatttgctggacatcaatatattggagataacatgtgaagaagaaagaagggcacacactacacctttgtggagttttttgtctgatggggaagataaagtttaagcaaatggttgtagaaaaaccctgatgaacttaatggcagagaaatgtatccctccatttttacactgctataaagaattacctgagactaggtaatctataagggaaacaagcttaattaactcacagttacacatggttggggaggtctcaggaacttataatcatggcggaaggcaaaggggaagtaaggtacatcttacatggcggcaagagagagagagaatggagtggggggctgtcaaacactgttaaaccatcatatcttgtgagaactcactcactatcgtgagaacagcatgagggaaaccgtccccatgatccaatcacctcccaccttgtccctcccttgacacttggggattacaattcgatataagattttggtggggatacagagccaaaccatgtcaagaaactcttaggagtattgggaacaggtcccatggcatagtagtgaggtctgcttaaggaagtctttggctgttgaaccatgagttggccatgcaaaaatagtacagcttagtatttactgagtgtttatgtcatttactcctcttgacaagtggataaattgaggataaaagtggagtgaaggttttgctaaggcttctcacttgggtaccatgtactgagatggctgcaccagaataattacaggcctggggtgaagagagaagaaggcaaagtaaattgtggatgcgttaaagatgcctgtgagacatctaagtggaggtgtcaaacatgcaattagacattcatgtctgacattcagtatctcaggtaaggcttataaatatagacttggaatttatcagcattagaagccgtaggagtagatgatcttacccaggaagagatgacagcatgaggagaggaggaggcctaggacctagcctgtaaggacacagaacattaaaagatggttagaaggaaaggagctcataaaaaagttggagagaaccttaagtgtgagctaacataggagctagaagctataggacttattgtgtggtcaccaaaatcatgttctgctgtgagattgagcaaggtagggattgaaaatctccagatttatttcatgtatatcacataagcagagtaagaacagcttctgcggtttgtggagaggggccatggagtggggacatgctgtagtgtgagaaagtaagtagtgattcagatgtgaacagaaatagtatagttgtttcttcattgcaaagattgagagggaacagaaagatataaggtaacaaatatctagatggaattgtgaggttgaaggggattatttttgtttgtttgccatttgtttgcttgtttttaaagagagagccatctaagcacacatatattctggtgagaaggagccaacagaataggaaagggaatcatttgtgaagtgaggtctggagtccatgagacctgctggagaagacaggttacaggacataagggaaaagccatggctttctaatttattttaaactctaacctacagcaagaaatacatttacccggtacagtcatctctcagtattcatgggggattggtcccaggacccccagtgggatatcaaaatccaagaatgctcaaatccctgactaatggcatagtatttgcatgtaacctacacacatcctcctgtatacttagatcatctctagattacttataatacctaatacaatgtaaatgccaagtaaatagttgttcaactctatcatattgttatggaataatgataagaaaaatatctgtacatgttcagtacagacacaatcacccattttactttctccaaatattttctatccacagttggttgactccatggattcagaaccaatggagggccaactgtatatttatagaaacataaaactgtatgtttaaagtaacataaaaatatatgccatgaaagaaaagtttcacaaaattttactcttcctatgagcaatgtagtctgaacttttccattctatttaaacagagttgtttttattttatcatgaatcaccaaattgtttttatgtctgattgatgagctgaaacacatagtttaataaacactgggttaaaagataaaaggatagggctgggcacggtggctcacacctataatctcagcactttgggaggccgaggcggatggatcatttgagatcaggagtttgagagcagcctggccaacatggtgaaaccccgtctctgctaaaaatacaaaaattagccaggcacggtggtgcacacctgtaatcccagctcctcaggaggctgaggcaggagaattgcttgaatctgggaggcggaaagttgcagtgagccgtgattgcaccactgcactccaggctgggcgatggagtgagagtccgtttcaaaaaaaaaaaaaaaagataaaaggataaaagatacaaagggaagaagggaaggctgccaggataatgggaggttggaaatgtttccttttaaggttatttgctcgctctctctctgaagacaaaaggacagtcacctgctgacacctaagtgtttgatgaagtctataaaggaaggctagaggagagagagaagcaaaggaaggctggaggagagagagaagcactgaaagagacatcgtggcaattggcatggcacatgggctagaaattaaaataggactcacggactgtgaaggaagcctggtttattttaggctgttgtctacgaatttgtagcagtaatgctccccctggctgtgtgaggacaactagcaattctcagaaccaaatgcaaattctgagaagccaggaagttagattcatcaagggtgaagatttctgccagactcttgttgagaacagtagatcaaagcaggtttgtatgttgctaggaggtggcttgtaaggaaatgaagaaagagggaggtgagaaagagattgtagagcagcccccagcctgggtgttctctgcagctgaagaatcgaagtgggctgaacaggtagaagctcctggtttgagaataggtagaagctcttgatttaagaataggttgtttctgattgttagagttcttccttgtgagtgaaactgaatttgcctccatattgattttgttggatcctaaagctaaatctagtttcttttgatagatggtcaaatatttgaggagggctaccttgttgatgctttatctcaaattttccccttcataattaaataatcatattcattttattgtttaatgtaactcagggatgtccagcttgcaccacgcagtttgttacactcggcacattctccagtatattcatatgtgccacccagaagttaatcaaacacggtattccagttacgacctcacctgcgtagtgtgtatgggaactgtaccctcacttgcactgccttaggatcttatacatttgccatcaatggcaagaatgcattaaattttcagccaggtcatgtcagctatcctgtattatactgttgacttttaattttttaattaagtatatgtcatcatttctataattcaagtcagaccattgccccaggctgaaatctttctaacatttgattctgtcatacactgttatctctttccatttgtgttaaccacaaacttaagtgtgattgatttctctgtttatctcagttggtagtgtgcagctgaaatttttataccctttcccagactggttaacctactttgttttcaatccatctaaacatacttttataaaactcatatttctcatctcctttcatgagattcttaaagaaatcaagatgttactgtgattgcttaaactcgaattctaactttggtaaaactgccaaagatggatgagtattcctcagtgatttgcttgataacccattttagactattgttgattattaatatcgaacttcctagcgggtagtttttggaagctgtctttcctcattttaaaaattagcatcccagttgtctggaactttcacttggccttcatggtttctcggtttaccaacagtcattctgcatccacggatgttacttttgctttgagtcttgatacttgagacttgaactcactttaagagactgttgtatgtgtcttcctccaccactgcaggtcccttggaaggcatcatttatatcttacttaggtttttgtttttcagttttaattgttttttaaacttaggaacacagagttgggttaatgataactctgaattcatgatacacagtcactgttagtccactagtgtctacttttaaagttacttagtcatttctaataatgtagtaactacccataaacccacttctgacaagaaacaacctagagaatttacgtgttatcctatgggcttctcattaacctataccctgtctccccacacaaagaaaccatcattctaaaccttgtgctcaagatgcccttgcttttcttttcatgtagttttcatttatttatatatagatagataaattttcatatatatataatttaagttgttactgacttttaaaagggcagtaggctgtgtgtaatattttgggctctacttattgaattaatagtgttttctaagattcctccatacttttttgtgctgttggagttcatttttttttattgttgtgttatttccctttgggcagatataccagagcttatccatttacctttttcgttgatagacttttgtatcacctctgtgtttttgctaatgtgaacagggattgaatgcctattcttatccatttcacctatcttacaagagctacagggtgtacccattttcaaataaaggaacaaatgtcatactgttttccaaagttactgcatcaatggacattcttaacaacaatggttaagagagattctggtgatccacaccccctccaatatttgatatatgagttactgacttttgtcaaccaaatgggtatgaaatggtattttgctggagtcatgattttcatttctcttggctaggtacttttctgtattacaaacatcacttctttctgaaacaaaagagctgatgagtggttctgcacgtcctctctattatgatgagtacagcatctgctctaaatcatgtgcttactgctccttgttgaccatactttggtgataatttgaaaaatcattttacatctttgtatctttcaagccacacttcattctaaactctattcccctactcctatcatatatacttcctctttaaaaaatcctatggagaacttcagtgcatcccatcggtttgctgttgccacccctttttgtctgcatcatgcctaccctgctcgattccttagaatgtctctttaccagctgtcatccctcttggactatttgaagctgcttcaccccaacggtggttttaccaatttgaataaggtaacagtatggaggaagatatctgcaatgatatcacaaattaaacactcaacaatgttgctgctgttttgagtttccagctaagggaactctttcctcctagttctcctccttctcttattaactttttaaaatatttaagatacacatcgttatgcctagtgttccattctttcttggttaaaagtataaaatgctgcggtcacattcttatgagtttctctcttctgtctcacccatgagctctctgttagtcagatttaaatccacaatgaaagtttctgggttttgattccttagtcttctgcggagttatcaaatcagaaaggcaactaaggaatgcatgaaatatacttctgtggcagaatgaaattttcagcagatactggcaagctgaagagccctcattactgtgttatgtattcgtgctgccagttttgaattctgttgtggatacctgaatgatctgacatatcctccattttatttattttcttcgaaattatttattccacacctgcccctttatgtatttagcttattcaccttttccttcctggcaaaagaaggactcttccttgtctagaatttagcattctgatccagaaagccaaatcctgctacaggactgtctaatataacttcccatttgcttagcattatcatctatgtcacgtggatgccatttgctattgaagaacatatcttttgttccagtaaatccttctgtttctctacagtatattcaaaagctgctagaaatctgataccttttttgtttgtgtgatcttagcatattctcaagctaattagtagaagtttaaagtagtttttataggtttggtgaatttgtcagatacagtctgtacaccaagtaaattcaggtttaatagtttttaaaaatcacaaattttaacttcattaggagcaaatctcattaaattttcctaggaagatttttttaaaacagttaaaatattttatttcaaaatacttttttattaaaaatttttttcagctagtgctttaaatggattatccctttgtacaaaagcaaacatggcttatgaattttatggcttaaaaacatatcattataatcccaaataacaatttgtctgaatgtattctttatctcaatccttgtgtctctcctatgtttctgaaggtcatgaaatttttatagaagactatgtctttgagaaaatgtaaaatttcatatccttgagacattgtatattagtgttctaatttgcatagagagtaagcatgcttgttatctgataaaattcctattctttttactcctatttactaatgcacactgctaattattgggaataatgggagatattagaataggtagtcttaaggagcagctaagcaaaattcctctgttttcgacattagatgtacagtatgtattgatggaggactgcagatttgccttccaaatctgttttgctaaagttctcatgagttcttattttttaaatcctggctgactaataacatgggagacagagcagcagaaactcaaaggagaacatttcctgctttctgagggaatcattaacatctttgcttttgtgatgaaatgtgcagtttaacatattacccagacaatgaaactgtcctaggcctgcgtccccacctttatttcctcctttgcaaactatgctcatgtgcctatcattataaacagaaagcgtggtgctatcatgataaacagaaagggtagtatatatttgttgaatgaatgaaagaatatgacaaaccttttagaatttatcacggagtgagtggaagggtcacattgtttaccttccctcccatccccagttcatctccatgcccagagtactgtgtctcaccgaattaaaaatatgtttatgatttgtagcttatatttcattatctgccttcatacaccccatggaaacattgaatgcttaccaagcagcagaaatacgtgtaagggttggaacaatctaactttgatgagctgtagggttcttcctactatagctattggttaatgaccaatttcttttggtcactattatactacagaccataataataatagcagctgagatgtattaaaagcatgtatttttcagactcttttttctttattttatttttttgagatggaggctcattctgtcacccaggctggaatgcaatggcacaatcttggctcactgcagcctccgcctcctgggttcaagcaattctcctgcctcagcctcccgagtagctggcattacaggtgcccgccaccatgcccagctaatatttgtatttttagtagagacagggtttcaccatgttgttcaggctggtctggaactcctgacctcaggtgatctgcccgctactgcctcccaaagtgctgggattacaggggtgagccacctcgcccggtctaattttaactaatggtcattatatttgcctgtattcgtgcattgcaatggcagcataaaaaaaagagaaaatccttttaaggtttgcagtttggtttgaatgaggcaaatgtatgaataagtagcgggtatagtatgatgtggacctcatagttatctctgttacctataaaatatgtaatttaatattttatttttgtaaaagcactatatataattttcatgtcatgaattcattgattatgtcatctaagcattctatcttacatgtgtttaaacaaggttgatgataaattaatacaaatgatttgctcttctatgtctaatgttcttttgcactttctaaaatctcaacatattcctgtctcctttttttttttttttaaatatacagagttgtcatgatgaggaagatgacgatggtgaagaggaagtgaagagttttgaagtaagatggatctttctggatttgcctttctttctatcttgaaacattgtttcatagcttataactgacatttatgtttcttgcttcatggcttattgcagcttattgtgtcaaggaactgcatgtcagagctggatggacaaacctgagtcctaacatttgctgaagttaagaccaaggatcatagaatagttaaataatataatgaagcacatatgttcagaatgagtgttcctgagaaccctcagagatgagacggcttcaaattggtctcatctcagcgatgtggtctggaatttccaacagacgtgaggaaaatatttattgaagaacaacatgatgtcaagtttttcagtaaacccttggtttgatattttttcctgaatagaagtcttaaagatttggccttaaagacttctgcccaattagatcactcattccatgtacatatgcagatagtggcacacaacgcagtttgcttgcatgaggtaggagtccatatatccctaggactgtattgtagtttacaactattttctcaaatgctctcagcttttaaatgtcctacgtaatttgaaatgctgcttaatgttacttagcccaaaggaaagttaatagtattttccccctttgcttatactgtactttcgttttttatgaggaaaagctagttgttgctaactaccgctttttttgtttattggctctttttttgttttgttttgtttttttagaattttcataaagaaattaagtgcagggaaatagaaattagattctttttcttttccttttaatttacatgtctggactttgagctagaagtctggaaatatatcagtagccagcaatgagtctttaattaaagtggacccacaaaaacgtattagccaatgaataagctcagagcagtgaccttccaggatgcatttgttatgaacctctctgcagcattgaagtcaatgtgtcaaaaatataaaaacaatctaatttgaggaacccatgactattgctggctgagaaaaatgccataagattaatttctgtatgatttctataatcttttctaatgtatatgttttctattctcaaagtcatctttattgataagaaagtgaggtcagtttagaatgagctgtgagcagcagataatattgtttttctgaagtgcacagcatttatagtctatccgttgtcttcagagcaattgtttattgctattttgcttcttgtcctcatccttccttaaggtcacaggatcccaacgcagcaaggtaaaactatatatatgtgtgtatttgtctgggtctgagtttcggtttcttgtgacatttacctttgttagacccaacatcttggattcttttgtgaaaaggaggtcttgaaaatctttctacaagtttgtagctccaatgcatttggtctcttcaggatcccttcctttgacacaagtttattcttcttgcaatttaaatgactcataatttgaaattttatcctccagctaactttgagctgcatactgtgctgggataaaggagtccagccctttggatgacaaactttttaagccagggacttctcattttcggtgcaatgttctgaccttatccctcttgatgtttttcaacaccagttttattacttgaaaacagacatgataaatggtattgctggtgagattggaaagaagcctgcttttccattgtgctagtaatcacttcaattagtaactggagattatattccatgatttcaatattgatttcattgttgcattaaagggaagaactagatgactatttctctcttaatattttgaatactgggaacatttgctaaaagaaaacattttgatatagaattacaaaattacttacattaatatgaaccttgttaagcttatgttttattttcataaggctatatggtaggaaaatcaatcataaacattctgtgaagatgatacctataaagactttagttttgtttgtttgtttaaaaaaaaaaaaagctttttaggtggccaggtgcagaggcttacgcttgtaatcccagcactttgggaggctgaggcgggtggatcacttgagatcaggagtttgagaccagcctggccaatgtggtgaaacctcatctctactaaaaatacaaaaattagccgggcgtggtagtgcacgcctgtaatcccagctactggggaggccgaggcaggagaatcacttgaacctgggagaaggaggttgcagtgagccgagattgctccattgcactccagcctgggcgacaagagtgaaactccgtctcaacaacaacaaaaaagctttttagtttgtaagtgtaaactattctactttgccttctttttttaaaaaaaaaaaaagtgaaatatttgctgccaaaatgaattttagactgtcttgaagaaactattttaaaattcctttgtaattttttttttttttttttgagacagagtctcactgtgtcaggctggagtgcagtggcaggatctcagctcactgcaatctccacctcctgggttcaaacagttcccctgcctcagcctcccgagtagctaggactacagtggcgcgccaccacgcccggctaagctaattttttgtatttttagtagagacggggtttcaccatgttggccacaatggtctttatctcctgacctcatgatccacccatctgggcctcccaaagtgctgggattacagtcctgagccaccacgcccagccactttttaatttttttaactcactgttatagttggaggaatatatagttcttgtatcatcatccttgcaaatttcaaaatgtaaatcatgtatatactatcagatgcagctctgatccgatggatataatggttaatggcatacaatgggcctaacacttaataatatattatgggcttaaataatagataataatgggtataataagaatttggtagattttgattttttatcacgaattatttcatataaaatttatgtgaattgttgagggatgaaaatatgaagggctctcctaacattaagtaaagaactgatttcctaagtagcataaaagttaatgcctcaagaatgtgttgatagttgtatgatggggctggatggcagagaaggtgttgctagccaagaaaaccattttaccttgaaagaggaatgcagtttcagggagatcggtttgataaatagggtcaaatttagtgacattagaaaggctcctcattcagaaaagaagtccgaaagacgacaagtgatggcatcttaatatttagacactaggattcaggccagactaaggacaagaagtcaaatgacatatggagcatgacctgagagaaagggctacctttgaacttagaatagtggacaagttcacatggtggtgaaacctggcaattaatcccaaaacagaggatacagaccagcagatatgactgtctcagcaagagacaggcttttaaagtgctgggaattgccacacatttataggtgtaatgcaggacaccagatttggggatttgcgcttcctaatgagatttttttttttttagtgatctccatctgatttgggactataatttataattcacacctaatttatgtaacatgctactcttaacaaaatactgtgtatgtggtatgaaatattacaaagctgagaaacagagatatatataattaattccctataaagatactcttctctgaggttgactatgtgacaccaacaaaaccactgaaaaatttattgtttataaatgtagtaatctaccatacttttacattgagatgtctatctgacataatttagacatagtctaatagtggagttattcacataagttacaaatatgaaaggctacttgtcagtttcaataattcttataacacattatatcaaataaatttggaaataacataaagtgtgtggtaattgaattctatccctatacctggttaattattaatatttgctatagtttctatttaaattctttccctgtaaaatattccataaagtcattgagaagagaaacgaagtaggtaaaaagaaaagtgctattatagggaaattttccatgaagaatgcagtaaagctcaaaaaacatggaaaacaaggaaagaggaatgatttgccagctcttttcttcttccatcatatatatatatgtattgttcatatgatcctgttaaattaaaacgtgcctgatttaacctgattacaaaattccctgtttcatctgtaatataggtaaatatgctttcctgtaactacttattaaataactttattgcatatttagttaattattttttaggtttggagctacttctctatcaaaagcattaaaaagaacagttaaatcttataaagaggccgatgttaattgaaagggaagaaatgttttaccagttacctgaaaaaaataattattggagttgaatgctagatttagctttttaatttttgctaagggaaataataataaataataatgtttcaagtcaaataacatcatttttctgagcattatgggtttttctcacctagatcaacaaagaactttgatactgcagtagaacacatttattaactatgattttattaaaaaaactcagaaacattctttagatggttacttcttttattgctcttctctaaaatctgagcatatagcattaaataataatttattgaaagcatttctttagaatattaaggtactgtagtatagatttgttgttgactgtgaaatctaaattaatgacagtgaagcttagataagcaagaggaatggaatgttaacttgtcttccagccatctttctcaaatactgggcaagctgcatcttccttttggcgaatgcccagtttctaattgacagatgaattatctgatgagtctgaggtcctatttttctgtactattgattaaagagaatttcttgtgtgttaaattctaaatatgcctgtggcagagttggtaattctgtaataaatacttaggaaaccagcatattctctcagatggatctgagacacaaataaaatattgtcatacctgctaacatactcaaaccaatacccagctcgtatcccacagtatgcaccattaagtatggaagaaccaatttaggtccaaaatgttttaaggattaatattatatagcactaccccaatgatgaaaagtttttgtctgacccgcccatgaatctaactttcaatagaatacaatgttttggtaatgctacaagaatgaatgggctgtaagatatactgccctccatggctacataatttgaactttgaatgggtttatttggtgcttttcatagtaacagcattttaaattaaaaagtcttcctgaatcttagcaaagagaatttttaaatgcataaaaattaaagatatagctacggatataaaatattgaaacaattattccttatatcaagaaaatttataattctttagttcctactgcaggaggtatatggtatccaaaatatggactaaagcattaagagttgcttttcatgctattgaatcatagaggggaaagagggaaggaattctgagggccagtgttctccagtactcacgctgattgccgcaatctgccaactacatttttatacaataaaattatgcatctcaagtgattatctcgtgtcttagctcagatttcctggaaaacacaggcaaaagcttacgtgctaacactttattgggggaaggggtgttaaaatcccagggaatgaagagttagggaaatagagaaacgatatggggaatgagggagggcaagtagaagatagagtgttcttgagctgatcacagctgttcagcagtacagtgtgttgctcagttgtgtgggatgcctcctgagagaccatatgcattacagaacagaacagtgcctccccggggaaggaggataggcactttatatgcaggttccttacatctcctgtcacttactggtcacagagtgttaatttcatcatacttcctgttgatattaaccagttcttccaggcaacccctggggaagccagagctgccttgaatacagcctgttgagtgtccaggcaccacagtctctccttatccattaacatggggtctccttggtgagtggtaatgatggtagcagctggctttcataagtacactgtgtgggggcagtcatttctagggccattctggctcagaagcaaggcaagtagccaaggcttagaaagaagggcataggttgggctggggggtcctggccttgacacaaggaagattcccagaaagcacaaccctctatattgtatatggtaattcatgcatatgagtatgtggaccaaaatagcagtctgtatagaagacatgcagctggccctctttatctgtggcttccacatccttggattcagccaactacagatttaaatattcgaaaaaatatttgcttctgtagccaacaagtacagacttttttcccttgtcactgttccctaaacaatacagcagaacaactacttacataacatttacattgtgtattaagtatttattataagggatctagagattatttaaagtagacaggaggatgtacgtaggttaagtgcaaacactataacattttatataagggacagatgttaatatctgtaggatgtcctggaaccagtcccccacagatactaggagacaaacatgtattgaagcagcatatatttgtgcacttttcatgtgcacagtaatgtaacttcatgtgttgtcatttaaaaaataatctcagttgaagcttatacaggagcagattatgtacagtaaatgcaaggcagcagactcattaagagcagacactcagatggacttcctgtgtttgaatcccagcttgaacttctagctgtgtgagcggaagcctcaatttttctatctataaagtgtggctaattatagtatctacttcacagggttgttatgaggactaaattagtcaatatatataaggcactcagaacattgactatcacataaccatctctaaatatttgctattattattattattattattaatcaatttcactttctctgctgaaaacaagtcagggaagcccatagataaacttttacagtgtggtgaacataaacaacacaacacaggagacctggattatcagccaggtgctgtgtgacctcaacctctctgtttctcagctttctgttctttgaacaaagagttttcaactagatgttctcagatgtcaaatctacccttaacagttgtgtggtttgctatccaggcataaattctcttcatttttaagggcaatttcgcagtttctctaattgcataagtattgatgaaagcatgcaagtttttatcactttttatcatttgtggaggattgaaaaagaaaataaactccctgtgttttagaacaggaatgtgacacaaaaatgttttatagaaaataatgtcagccaggtgcagtgtatcgtggctgtaatcccagcactttgggaggccgaggtgggtggatcacctgaggtcaggagttcaagaccagcccaggcaacatggtgaaatcccatctctgctaaaaatacaaaaattagctgggcatggtggcgggcgcctgtaatcccagctactcgggaggccgaggcacaggaatcgcttgaacccaggaggcggaggttgcagtgagccaagattacaccattgcactccaggctgggcagcagagtgagactccatctcaaaaaacaaaaaaagaaaaaagaaaagaaaatgtcttctgtacatacatacgtatcccaccttttcctagtttagtatttaaagaatcatggaactatacataacacagtaagctgaaggggaaaaaaaaactattgaaagacaaagagtagggccttccaagaatagaaagaaacccatgccatggagtcttgtcagtttgatgtgaattgtcagaatatttgactccaagctttctaggagccaacgtgaaattacatacatttcacataaattacatgaaatgacataaatgtaaattacataaatataggagccaatatgaaattacataaatttaataatataatgaactttatataatttatataatattcataaatttcataaagttcattataaatatcaatatcattaaatatagtatgtaatatataaaacattgatattaggtatattaaatataatactatttaaaatatagtcttcctgactgggaaaaacaaatttctgaagtaaaattcaatagcatttttttcccctgaggatgacaaaaaatgtcctcaacaattcagttaacaccattttttgacaatttatacaatagagtccagttgtgcagatgctacctgaagatggattagcataaaatggctaccaagtatctggaagaattgaagaaatacatatgtaccacctttccagatggtctccagaaaaatcctcttcccagctagacagataattcttggcagggaatttgggactgtatcaaatacttggagtacagctgtttctcaagagttgatctggggtagggttaataaccattcatgaagatctagaattacaaagactagagcttctatagttgtgagttttcaaaattcaagtaatgagctgctgtgatccaatctatgatcaaagttattctgacttctcattttcccactaagtagtccaacactctggcgccctcatgacctaaccatagctttgtattcttagtggtcccaagttttcttcttgttcttattctctcttttgtcaggctatgccaggagagaaagaactgcatagtacttgctttctgtattccaggcagtatccagtgctttttaaggcttaaacaaataagtgggtaaatgaccgctgttttaaatcaatattgcatttagagataaactacattccctctaatgatgagtcaacttaactttgctaatttgatagcttctgattttagagtttctcattcttttctttccttgttataccttgttaattaagctttcagtggtatagtgtaaattgtgtcaactggaccctgaaatagaaaattatttcaacttagttgagttttattgcttttgcatagttttaaattagttctaaatatgctgtatccctgagaaataatattccacccaaaatgcaagtgtatataatattggaagaattaagctgtaaagtcacattacacagtatatctaacgtcaaagcctctagtgcattaactgaattacttgaccctggtttagtgtttcttttgtctctgtagattagtcaaactttgataccatttttacagagtgttaaagagacagcattagaaactttgcttatcctatcaagaagcagaattctggaagatcattacactgtttgaaagatcagtaataaagagagtggataatgatgaaagatctgaacaaaaaattaaatgagctaaagcccacaatttgattattatttgtatatgtataattctgaagacctctttaaacatgaactgaaagacaaacttttagagctactaattttgtagcacttcaaacaaaaaagataacatttgtaatattttagattgtgatcacaaactataggatatcacatcatttagttctgtcatttattcatgcaaattttcttgaatacctattattttcagagaactgtactggatgtacagtatgtgtgtactggtgtggttaaaacaaagaaagcccgctctcttcatggatcttctaggaaacttcatgtttgtttgtttatttatttatttagaggcaatgtcttgctctgttgctcaggctggagtgcactggcgcaatcctggcctcaggtgattctcccacctgggcctacaggtgcacaccacgaagcctggctatttttagttttttgtagagacagggtcttgctatttgcccaggctggtctagagctcctgggctcaagcagtcctcccacttcagcctcccaaagtgctgaggttacaggcatgagccaccatgcctggctcatttatttaattaaaaaaaaaaaaaagaaaatttaggaaccactcgttttaaacaaagttgtagtcttagtattttcccatcactgtgagtcaactctacagaaatgtagctaatctacatttttcaagaacttaaatacaacagaaaaaaataattgaagtagataagttgtctcttatccatacttttgacttcccttagtctgagttgacctgtttgtgctgcaaaccaaattattagtacaatttcactccctttcttcattgtccccattgttatccaattaaatcttctatttttctgtctttttatttcgtataatattgatattcaacatcaccttgtaggtcgtaactctcagatgccaattaaaaatatttcatgttgacttatgacgttactaaattatgggaaatttaaggagttttgttcctggatatttctattctcttataacttgctaccacctacagtttctgaggaaaatattatgaaaaccttttctacacttgttgaagtcatggaaatacaaacaaacaaacaaaagaacacaaagtagatgggctcattttgtatgatgcacagatgatagatttggtagattcagcctgtcagtcgctcaggttctgccccagaggtcaatgtagctgaggcaggtccttcagaaacaatgtaaattcctttcctgtaaccaggctgccctggtttaaaatatcttttcatctccattacaaagataaactattaggtcagtggcaaaaaccacaattacctttgcaccaacttaatattttctccatcgatgacgagcaagggacaattgtaattccccttatttcaatatttttttctcacataagacaagttgtcgaagaactaaatatagttgtttctcttcaagcctttctacttgtttccccaagtgttaaaagcttgacacactcttagacaaaatgaaataatattagcaatgttattacaaacttcagttataaccaaaagcaaatcatgatgtaaaatacttctgttcattaccagtgatttgaacatgggtctgaaatatgaccatattcgaccttggaaaaacctcctaacaagcttattaggatatgcactgataattcttggttgctcttggcaatcagaatgttttgcctaagggaaaatttaaattctggagctgctctttttttcctcaccttactgtgtaaccttgaaataaccttgaaataacacaaagactaaactgcaggtggtgtttatttaagagccttaggcagtttaagcagaagctgctgtgtcagagaactctattcttgaaaaggtgccttcaaggtgttattttcctgagtaagatgcttataaaagatctatctacaatttgtttagaaaagctaatctgcagtttaaaaaattgtttttacataattcatcttagtatctgaaaattttctggtttagctttcagagttttttttttttttttaatttataataaactttccctatgacagattaaattacatgcccagaagctgttctcaaagggcaaagtactggaaagaaataatattaaagaatcctgaagggagagcttccaatttcagttcaacaaagaataaattcaacagagaggttgacttgatctctatgaaatacagtatttttctgcgtctagatcagtatgtctttttggctcaatgtttttttttttttcaaatgactttcatcatcttcctcaaaacattgattattaaaatttagatgcgatgttaaaaaaaatgagtgacctgtccagggagtttatttttaagcaaggtagtctgagatcctgtctatttcttggtccttgtaaggttcatacatcatgtgttgatttcagttaggttaccgggaccttacaggctacactgcaagttgttctggcaggtctttaactgatcttcccccttttggagcacaaatggcaaattgttgttttgttctgttttttctcaagagtgtgtggcatgttgccatcttccatcttctgtgagtttcctgatgactgtctttatgtgttctattaggtcaatagaagaacttcttcctgactcccttgcctctttagttgatgaaaatgataggacagtttcatgagcgaataatttcttatcattttcttactgaaaaactctctcacaaaaggagctggttaagctttaagcgaaagttccacatggagctctggcaatgggaggaacataaaagattgttgggtctaaaaggaagaatcagatgttgctcatcagttttaaacaacacctgaagagcagacgaaagggtcctctttcagtttttctgaaactgtgttgtaatgacaaaatggttttgtgtgtctgtgtggttctgtttctgttttgtttttgacttcacaggaagaggtttaaacatgaaggcaaaccttatagatgttagcatggctacatataaagcaaagctgcctctttttttttcttttctctgcttccatttaggcctatcacataatttaagaaaacataaaattaaccacaggagcgctaactatagtgtgacaaaaaaaaccctgatcaattttgttttcgcagcacgatattatcaaagatttaagaaacaaatttgccagcctcggcgagaactctctggtaacagcataaatgtctgtgttggttgcttttgatttaaaggtttcttttttcatttgtttgagcccatttcttttccccctccttttagttcactttatttttcatattctgtaactagcaagccttcattttttaaacctcttccatcttccagtgtctattttctgtattttggatggaaagtttatggcagcaaagctgtcattctggctacctctgctgcagctcttcctgctcttaggtcatatatgttttggccgttgtgtttatggacatgatactaattgactgtttcatgtcccattgactaagcttctctaccacgccatttgatggactcactgtcatagggctctatgcaactttcattctgcaacttatactgcttagttccttctcaattctccagtgaactggattgctcaagtgaatggtcataccagtcttgaacttgctgtgcctttatattttatttttattttcttctttatgttttcagtggtagcttaagtggaaaagaataaactccagccattgctccagcagtaccatgcagtatcgtttgttaccaccagagaatacaaaatataaaggcacattgcatctcttattctttgggggtgactggggagatctgtatcataaatccactacttcgttgaagcctaccttttgattcatatcagctttcaattttacttaaacttcaagacatctcagttaatgtttttctgtgattcagtgatactttgcaactcgagccatttgctgagcagtatcaagttatggccatggcatgggagattattcaaaacgtgacaaacttatgcacaaatgtataaatcagaaagtgcaagtttcattgatgaagtacagtacttcaaaactgtgatacaggctttgaatgaatcaaatcattaaaattgagaaaaaaaaatccatgctgataaaccagtaccaaaaacatatcaagaaaactataaagggggaaaaaaaaacaatagttgaatatgttaataatatctgttgaagaacatcgttggtgttgaaatggtccataatgttgtcatagagcccatacatgaagagatgactaaaaatatggtctgtagaaatctgttgtgcttactgataccctcaacataaatggttgggatttgtgttcaggaaaaagaaatggaaaagcaaaagcttctataccagcaagcccgactccacgatcgtggcgcggctgagatggtgctacagacaatcagtgccagcaaaggtaaggttccttgagttcccctcacgagtgtctgttcttcagatttcctcgttgctctcaaggtcctccctcatttcaattccactgactcatttagtcctggggtttctggttcatgactatatcaggtgcctattcacaaatacgagctctcattgtttacggagaccaatgttaattttttttttcagagtcttactatacagattcattttcattctgttctttaagttttggaaactatgttataactaaaccttagcagactgatcctataaaatgggggtgcacgagctttttctttaaggctggagagtcaatatgttcagcttcgagggttatgcaacctgtcacagctcttcaactgtgccatgttagcaggaaagctgccagacacaataagtacacaaacagcgtggctgtgttccaaaaaaactttatttacacacactttgtttacacacataggtggcaagctgtaatttttttatgtaatttatggtattttgccatagtttgctgactcttgatacaaatatggagacttttaaagtgagacttttttaacaattaagatgctgtcatatatctcagtagccagctgtttcaagatgattttttgtacattcataatagcttctttgtgaaaacattttaaatataatttgtaatggaatggaaaagtaatggtggtacattctgttattaggtacccttgtccttgaatagaagattatttatatttctaggataaatagaagtgaacaatgaaaaatgaaatatgttacactaaataaaattttgttattatccgaattacttaaaattgagaatagtctgcctaataaaccagatgtcaaacatattaaaataaaagtgatacaatgaaaatgatgaaagttcttcatatataatactgttgagggaagagggagagaaattttctttaaagaaacttttaagtagctcatacttattttaatgtttattaaacacataattaatcttgaatcttaataatttcaggtctcgatatttcaaaatcagttgtcttcctattctgttacttctatatcttcttatggtttcagttcttagatattatagagaatttattaaaaatgttgatgccaaatatgcattattattatgttagcattttttggaacataagtcagtctccctatgccattaaacagattgcctgggggggcataataataattttaaaagtgcagcattggaggtagaataggttaatatagaaggcgaaatgatataaggaacactacttttttatatttcttaggtgaaactggaccaatggtagcagctactctgaaacttggaattgctattttaaatggtgggaactccacagtacagcaggtaacagcttccagtcattcatataatgtacttttcagacaaatggaccatatagtaaagaactatttgttgtaaaatgttttattttctatgtacaatatggctcaattttagtttaccacagtactgaagagagagcaaaagagggaaaaagtaattatgtgatagtgttacaaatccaaacataaaatgatgtcaaaatatctgaaaacatcaagtgtgaccttttatcatgtcaaatgaattctggtgctgaggtatgaaccactctctcaccatgcgtttaccaaactgtggctctctggttatggaacctggcaggggtaaccagctcgttctgttcccagaataagtgattatatagctttgaaaaaagaaaaaataaaacacttaatctctccaaaacatttatcaaaaaataatgtctcctgcttatgttttacttaagaagaccctcattacttagtatgtatattcagaagtccttagatccagagacaggagtgagagatcctgtaatgtatacttcttgtctatgtggaacttgtctgttttctttataacttcaaatatatatcccaccatctcctttgatcctgcaagccacatccctttgtttgaaaaaaaacaatgattgtttcattttttatttgaccaaaagttatcacaccccccgtaaatggctatatggttttgtgtctatgtgcgtatatatgtgtgtctgtgtatctgtgtatcatacctacactacgtgtatatttgctatttgtgcatttgtgcgtatatatatatatgcatatgtgcatatactttgtgcatatgtatcctttacatatttagtttgtattgccttcgctatctgaaaaagattactactaaaatttagtctgcttaactgagccctttttagaacagcattgataacaggaattgttctgctcttccagatttgtagagaagcagtattcttatttccttaaacctttgagcatgctttctatcatcttgtatgtgcttttacatttgaaatctctaataaattttaaccatgtcagaaatagctgtttcgttatgctatgtaacagtaagctaacaagacaaagcattgctttagcgtttttttacatgtatgtttaaccaaaattttgaccatagattctggacgtcattctgagaacaaaggagaacattttaatagccaaatgattcctattgttttttcaatttacagactatggtaatggaaactgaatttccgtctatagcattagcatatggcagtcacaactctcagattgtaatgctgttcggggttttttgttttgttttgttttgttttttgagatgtcacccaggctggagtgcagtggcaccatctctgctcactgcaacctccgcctcctgggttcaagcaattctcctgcctcagcctcccgagtagctgggactacaggcacatgctaccacgcccagctgatttttgtattttttagtagagacggggtttcactatgttggtcaggctggtctcaaactcctgacctcatgatttgcccacctcagcctcccaaagtgctgggattacgggtgtgaaccaccacgcccagcctgtaatgctgtttaatgacatcaccttggtatggaaacctgtgaataacatctataggaattttcttcccagttaacttgcactagagtatctgaatcaccaaattactttaagagtgaccaggagagaattaagagtaatatattacccctgacatttttggtgcttgtggtgatgtgtaaggcaactaaccctcttattccaagtttgcgtaactatcttgcttcgaggtgtgttcctacttcatgataaagatggcattagtcatgtttgtacgcagtgaatattttctgtctattctagaatggaaagcctgttttggttgtttatttatttaacaaacaataagatttttgttcagtggccacgtggtttctataattcccatagaaaatgcttgactacctcaaggagaaaaaggatgtgggcttctttcagagcctggccggcctgatgcagtcatgtaggtaaggactcacttccttcttgggggttctactcagtggttgtattttttcgaagcatttgtttcttactctgacgataattgcacatagaagaatagttaatgattaacaacactttaaagtgggataatcggcagtgtcttgttttctatcttgttttaaggggttggtaatatcataattaataacttacagaatggtaataatgtcttaaaatagctttcccatagtactataatcccagagctttgggaggaagagataggaggatcccttgaggccagcaattcaagaccagcctgggtaacagggcaagactccatctctacaaaaagattaaaaaaaaaaaaaaagctaggcatggtggcaacacacctgtaccatagtcctagctactcaggaggctgaggtgggaagatttcttgagcccagaagttcaaggctgtagtgagctatgatagtgccactactgcagcctgagagacagagtgagaccctgtcgctaatttaaaaaaaaaaaaaaaaaaaaaagccttccccgtgtttaaatagggatcttggagaattagcgtatattctgcatacttgaaaatgagttgtgtatgcttttttaaaaaagaaaattctatttagttttatttaggagcttgtaggccatttctcattttgtgactaaatgatcactaactcatttgcggtaatcgttttccattttttttcaagatttaaaatcattcagacagcatttgactaaggaatctgacacacatttaatgtaagaagctattccaactgcaaaaacataattattagaattttatttctgcacatctgctggctttgtaatgtactccccatgttgaaacctaagaatgctttcatgtttgactttcacatggatcatttcagtgtaggcccaggggagacactagtctgccactaagaaaatacggttggtacgcaatgaatggagacatgttttcagtgtacgttaacatttgcttcatcttccaagatatatggtgtttagatgtttgctctcctgagcaaagaaaatgttctattagtcctctaaatgtttttttttcccttgttattatagtgtccttgacctaaatgcatttgagcgacaaaacaaagctgaaggtcttgggatggtgacagaggaaggatcaggtattaatgacttacattaaaaggatcacctgtctcccttccctccctgaaacgagtcaattatcaattacctttcaagtagagagataagaagttattttaaagttgatgaaatgcttacatgactcatttcaaagttcatagttggacaccggtcacaccctaaaaccaaccttccacgccggtcattaactccttgtgtgccagccccattgccagctgcctttccccttattgggttttcaatgaggaataatggttgaatgaaggatcaagatcctttattagagaattttctgggaaatcataaaccacatagatgaacctttcaagaacatttgactttctttggccactttagcaaagtcgggctctcagattcttttatttccttaggatagtgatcctttgagctccttcagtctactctcattcctattccctcctcttcccttccagcacagtgatcctcaaatccatacatgtttgcaagtctagattgatgaaagaaattagagaccagttatttcgcttaaataattctgtgcacaaaagcagagatacacgtgatcttagaatttttctctctctaaatagatgctggtataaactagaaagtttagcatacaatgcatttaaagcagaaataacctttgctgccctttcattttagcagtatttattaagaaaaaaatcttcagtagtttttggtttgatttgtttttattcttttgtgtttgatttttaaactagttttactcagggccccgtatgtttatctgtttttgtttgttttgtgtggtttggatatgtcttcttgtcaattattagttttggaacattgggtcttttattggactaatcttatttcaaaaaataattttttctcccatctgccatttgtagtctatgtttatttctctgaaatattttaggattaactaatttatctatgtatttttttcttctcacaaataggaaaaacaacatttcttattgtattttaaagtttattattaatacccattctgacattgctaccactatgtggctcccgtgtttattttattttctgcttgacatttggatgtacaagtgcagtcaacaaaaataagtcatatggttactaaactgagttagctaccttcaagaacaatcactgacaccattctataacttcttaggttttctggcctaaggttctggcctgaggttcagaaggccagacctttgagaaaagtcaccagtgccactctaaaccgacttaggttttctggacccatctgcagaacttggagccactgcagatctcagggcctatcacctgcctacctccagcatctctccaaagtcctaagcaattttcagctataaaatttctaaaaatgaatgaagtctctgtccaaagcctgacttccctgtcttggaattagaaatcaatttcattttcccctgtagttattacctaatgttccaggggctcctaccgcaaatccatagtcattcttagtcgctgttcatatcagctcccaaaaggaatagcagccacttaggttattttcctcagcctcctttccttcgtcaggcggatatgggttggaataacattttcgagtcccaagtcagaaagaactttgtgagagtgaccattctgatgtgagaattctttatatctctcaaaaggagattgatttaacttgtgcattctttttcaacacataagaaaataattactcaaaccgattaacacgttttgtattatttccttacaaacagaaaaacaaaagcaaaatctcaactttttttctttttccccatttccttttctttcgactactgtaaatgtactaccctcccttcctcagtcatcactcatgagcgtggtaattattaaaaatgaactgtcttttgtttatttgctcctttatttgttgttagctttgtgtacagacttgatagtgacaatttccgtgcattcttttttgttgtagactgttttaacaagtagattatttaatttccatcattatgcatcctgttattttttacatttacacatctagctttcctccttttctttcttgtttctatgaggatgtacagttattagtatgtcagatatgaaggggcaacaagcatttcaattacattttcggattggttttgttgcttttcagttaaaaacctttctggtgggcccagcgtctgcaactgttgtgtcaatgaatgatcctagaatgtgtgccctagtctccctgtggcgtttctgtcttgaacatgctgtggctttatggctgtactgattggtgcacgggaaatcggtgacagattcaaggaggacgtgacaagctgagtctcctcctcgccagtgtgctctgccagttgccttccaagtattgggaggcctactgagtttttcctctattcctttgaaaatctgacagattacaaatcatttaacatcaaaactaatttttatttttgtgactgaattcaaagagcagtagaaacaatagcaactatttgctcctcaaactaatatactagcaaagatgccattagtaattcaaagtagtttctgaaagacattctatgcagtggaaataagggatgagattttagatagtacttaggacgccaacaaggcttccaagattaaattgtgctttctgaatacatgctattgccttaatcaagagacctattaggagcatatgtaagggccactcattagctctattaatattacagtatcttccagattgttttaagaattcctatacagacacttttggcatgtttaaatatatctgttttgagatcactcttttgtttaagattctgtaaaagttaaaaaagcctacatacactcacaggagaagaaaaatcaatcatccctcttggaagggatagaaaaggctgaaaaagcaacatctgttagtgatgtcacttgcttcaacacttgaggctcagagagcatgggcttagcactgagaaaataatctgttgtacctgaatcttctacatccttgcccactgtttttattaagctaagtctcttcctaatgacgacaatatgaccataaattatatagccatggaaaacgtataagctcaaatgcatgaacttttgatacccgcaaccctccaatgaggtagctattaccttgattttatagataaggaaacagaggaacagaaaggtttcttgacttgtccaaggtcacacagctaagcggcaaggctgagactgaaatgcaggcattctgcctcccactgtttaatttacagatcccacgagtgaagtcacttccctcccatctgttcatattcttcaggggcttacttcatgtctaccattgccttaggtagcatttttttttttttttttttttttttttgccccttgacttactgtttgtttatttaattctttttgagatggagtgtcgctctgtcgcccaggctggagtgcagtggtgcagtctcatctcactgcaacctccacttcccgggttcaagcgattctcctgcctcagcctctcaagtagctgggattacaggcctgccaccacaattggctaatttttgtatttttagtagagatggggtttcaccatcttggccaggctggtcttgaactcctgacctcaggtgacccacccacctcggcctcccaaactgctgggattacaggcatgagccaccacgcctggctgccccttgacttattgttctttgtccctttccgggacacaaatctcttgccaaattttgcatttattgttaagtttcaaaattgcttttgaactttttatggttacaaatgttcctaacctggtattgagatgccatgaggaactgtgtgtttctttgaggtttgtatctacagctttcagatgaattatttatactgttttttttctgctgccattattgtcatgcaagtttgacctctgtctcctttttatactaagtttctctcatttctgtgaaagcctgagcctcccagttttttttttttaaaggttcttcaggaaatgtgttagtttgtaatatgctcaatgctgtctgtgctgtatattttatatttatatgtgttttcttttaatgacttaatcaaattcaaaaacaaaacctgtatgaatatttaaaatgtcattccattcttggatttttaatttgcttttttatcagaaccattaaccccattaccaaatcattatgacattgaaagtgcaatttttctgctttcaaaattcttcttggaatatagcagaagatactgaattttttttttttgatcatgaggtagtcctggacttcataaaagcaagacaaagttttgaagttgatccgatttcttaaaaatagtttgattttttaaaatcctcactacaacattaactaccaattaaccttccccacctttctatctgtatctgataatttgtttcactgaggttcttactgatatatttataatcatctaatcaaatttatgtgaagttgaagcaacacaaattgattaagcaaagagattgaattgatctttaagtattggttaccctaactttttgatactcttgattgcttaattatttatgggctaccttttcctcaagattttccaaatactttcacaagtgtagtttagtattctgtgtaccttattctgccattcttgtgggtaaattttctcttcaaggaaaacttgtgatgttggttcgtggcaccaaatacattttcttaacatccttgcagtttttaaactttgaagcgctcatttaaattagagtgactattatgtgctagatggtgtcctaggcattggaagcaatttaggagctcagtactgtgtagacagacttgtaaacaaataaattcagaacaatgctttatgcatataaaggaatttaggtggaagtacttagcggctgggatgttgcggggctgggggagacgtgtagtctgaattaggaatcaagggggtggataaggaaggcaaagacattccaatgcgagggaacagcatatgcaaagttcaaggtaccaaacacggcagagaatggtgactaagctgttatgaaggaaaatgatcagactagaggatggaaacatagtacctgggaggccacgaaggaccttctctgccctgccaaggaatctacactttatctgaggccacagagagccattaaataccacttaagtgatactatgtgtattgttaaatgatccacctagaattgagttcctaacgtttattgttcaaataatgcttctgctagactccactaacagtacaatgtagatttcccatttctcagtcatgctactaaatagaaattgactcctccaaagatagtgaccagcattattatttccttcatggcagtgggagagctctgagttatgcctaatgatagattagagggaattcttcagagtagacttttcacagttaaagaaatccatctgtttaccagggaagtaggataattggaatggtgcttttgaaaaattactcataggcaacattgtgtgagataggtatcagagtctcaaggcagggagatcagtaaggatgctgatgaatggaatggatgaaaaacaataagaatttcagtgagagtcttgacagctgagaagcttaggctttggctataagagaaacaagatgcaatcacatttgaaagcaaagggattttttttccgctccagctagtttaatttgtttaagaagttaacagaatgtactttaattctgttatccgtgggacaaacctgatttatttcacatagtggtcattttcgttgtcttggcatcggaaataggaatgcattgtatacaacgctgtcagactgttaactaaattttaacaaatgcactctggaatttatagaacaaacaactgtcatacaacctacagaaattctgtaacttagaaatttaggtcatttgacctaaggcttcacatttatttcttttgtgctttgtagacttcaaagcacttttaattgtttgatccaattcgattctcccaacagtcctatgaaatgaggagttgaggagtttgttcatctctatatcaacatgatgaaacgaaggctcagaacagtgaactgactaaagtcatatatctagcaatggttttcctttgattcttaaattgatgaaaacaagcacgagttcacaattatttaaataacatatagtatatgtaatgataatcagtcaaagattttattagttactgatggtaactttacaacatttagaaactatagcacactgaattcagaaaggccatataatactgaaattatctgtttatttcctgtatcttccattagactgtgaacttcttcaggttcgagattatgttcacctcacaaggtgcctgccatagaagagtgaatgttttttgaagtttactggaatcatactctttaccagtcgatagctatatgacattggttatttaatttctcagttgttcactgaaccacaaaatggcattacatttagctaagttacaggattataataaacctgaattgaaatgatgagataacatatctagcacaatgcctagcacactgtagtcactaactaaatattaactgtaagcttattttttaaatttactttttaattgaattgtaatataattgaagcagtcatacttaagccgcttaaacagcaatattaaaacttcccacatggaataaaatacctgacttttcactattttaaaatatctgtagcatttttcagttttggcaagatgcagaatcgatcttaaggtcccctcaagatccacaatcagcataatttcctctatggcagcggggtgctttagagtcaactgtatagattataggggatcctttaatgtggccagtcctatgcttcatgaatcaccttttacctgtgcattattgtagatattgacatgacaggacctgataaagagaatgttagtcttttggagtctatttatcctaattcaccaattgtaggtagaatagtagcctttaaaaatttgttaactttattagatctttaaaataggacttactgtttcactcgtagcttggttaaataaaatctacctagattatttccaagaaaaaaatgtaattttgagaacattttaatccatgaagatggtgttcaggagatataaacacaattaataaattcaaatcgctttattcagcagcttggcatgatgtttccatattttttagtattattgccactgcacctaatatattaacctttccacaatttacaaaaaattaccacagattatgaagagccagtgacgtagacagggtacgtgttatctttattttatacaagagaaaatgaaggcgcaaagaatgaactcagaagcagcaacaatattgaaatacctctccctttattacagtattaaaaatcttaagcctcttataacaatgaaaccaaagggatgtccttcacaatatgtaccttgagccctcaagcagcaattacaaatcataatttaccagtgtaagagcactttcaactacatgttactccattccgttatttgttattgatcttagtttccatcttacaatggaatttcttttgcacacatcacaaaatagactgctgatcctgtaccttctgcagacataaagccatcatccatctctgttactctaccacttatttgcagcatgggcaatggcagcattttaatcagataggaatgtcttcattaagcaacagtaccccagcttatacctggtatcacctgatggtaaacgaaggcctgactcgtcccctccctaacccctcccctcttcccattgttctgcgatgtacggtgtgtccttatataagtgaaattacttgtacgtgtttcggtatacagtcaagaaaatactgtgtgtgtcgacaataaataaaaccttatgttataaatcattatgcattgtgcagagcatttttaggtacacaggtagattatatttatttcagtgtttttctgaatactttctagtaagggttacttctttcacgaatatatgaacacttaaagtgtgtacatggtttattgaattgatttgttttttgaaaaaaaaattgcagatgggctcacagggaaagaatcaataagcctatgtaatgaactcataatattttgatttaaatatcactttaaagactcttctgattaaggtgactcatgaaaatggaactaagtatcaccaatgaagagtttagtgcctttatttgcctaaaacattctccctttcgtttcctatcctgtcgtgaatttaaacactgaggaatggacttatcagccaattatgggagattcaacacaataatgtgcctataacacttaaacttgccacgtctgatttgcatacgtggtgattttcacatagtcaccaaatttcatatcttgtgggctaacagggaaatgagtacagtgattttatgtactttttttaatgtttatattagttttcaaaatggttttgcttcctaaccctaccattatatgaagcctctcactttgaaagtcacagactgcggactggtaagtccatcagctctctgtcactgtgatcattcataatttcacttaaagtaaacatacgatcattgcctcattttctttctcagccgaaagtatttatttccattctgtaaaaagttctttttttttttttttttaatatgtaagtccattcattcactggcttttttgtcattttgctttctaaacaaatttagattttggagcagctgctcgtaatgtggaagtgttttttttccccccacggacactttctgtcttgaaaatcagcttcatttgtgtggtgctgttctgtgtttgtttctttccttgtgtttttgctttcaaagtaacttgtgatcaagatacctttaaattgaaatacaagtaaactgagcccttttctgaggttttctccttgccccaaaaatatttgttagtgttggatgatgcagaggaacttctgtaactaggggacgcctttcttttcacctttctttattagttttagctctcacaacacgagccaccaaagtctgtcttttggtttcatatttagaattaaggttgtttgccatttcctcctcctatggaagtaatgctcaaaccagtcacatctctattttagatttcagaaatctttctttttattcagtagtcaacctgataacaaagttaattaaaacaagttaatcaacaattttctagtgatttacagctttcacaaaaatccatgaattattctttaataaaagaaactcttggccccgcttttttggatacacagaatgctttccattgaatcatttggtcataatccgggtacaaagcaaatttaacacgtgtgagagatgcagaaaaaggtcccttctatgtacaccttgccaaatacaagaacataaagaaagaaaaaagcaaagtttaagcctttaggtcatttgtaaaatgttgccaaacccatgctgctacttttaacagagaagtctgagttttaaaattcaaacgttcttttcttacaaagaaaaagtgcctctatctgccaagcgcatgatcttatgagcttcagatagaaaagtggctatgacttgtgactgtttttggttcagaacaatgctagatcaacatgcaagttgtatggaggtggggacagaaagggagcggcaggctggggtggctggtaatgtttgatccctctggatttcccacaggagaaaaggttctgcaggacgatgagttcacctgtgacctcttccgattcctgcaactactctgtgagggacacaactcaggtttgtgagtccccggaacttctgatgatactaaggcataaataatgttttcaagccagtaataacaagagcctgttagttccaattatgcatcgttctagagacaacaaatcattctagagcatgactctgcattgggaactgggacgttttatatattgcttccctgctttcacagtcctcggatatccatttcacttgagtcttatcaatagttttgatgttagggaagacacatgaggctgggtgcggtggctcacctgtaatcccaacactttgggaggccgaggtgggaggattgcttgaacctaggagtcccaatatcagcctaggaaacatagcgagacccccatctctacaaaaaatttaaaaaattatccagacatggtggtgcgtgctcatagtcccatctacttgggaggctggggcaggaggattgcttgaggccaggagttcgaggctgcagtgagctgtgattgccccactgcactggagcttaggcaacacagcaagatcctgtctctcaataaaaaaaaaaaagacagaggatttatgaaaaacatataaatagttatagagtaatatagagtatcatttcttttgcaccacttctctttaccttgagcgtatacatacttcattgtactagttaacataatgtatctccattacttgtttacacatctaactctctactaggcttgtgcacccctgaaggcaggaactccatcttaattttatcttggctgaccccagcactttgcacagtactgaggaacaagtgattaatgaataaataatttccttcttatatcctcaaggatagcaaccttttttagtcattcgtttgcccagagctctagaactaggaatgaagaaactgatattagcaatatctgagacaaaaattgaatattgatcatcaatggagcacccagatacacttttggggtgatcactttttatggaaaatataaattattttcatagtaaaactattagataaaaacactgcactaacccacaatgattttgccatagaaagcatttgcctttggagttcttagaatgactcaacttgaacttctgagcaagcattaataacatttttttatcttgcatagattttcagaattatctgagaactcagactggcaataatacaactgtcaacataattatctccactgtagactacctactgagagttcaggtatgttgctttccatattagtaacaaattaaaagggttggtatgttgaaacaatacggcagagttttaatgtgttttggtttataactagaaaggagtttttgagatagtttatctctgatcacaatctctcagcaattcttagagcaaaacagccactgttatctctgcttctgaacgtgcctcctacttttgctcattattttatttctgtaagtagagatttttcgcctgtttttttagcttgatggtattttaaagtcattttcattttgtaaagcacttttatactctgctccttcttctacagttgttagacaaattggggaagaatatttggaacatttgtaggaataggaaagaaaggctttgcaactactaccatacacttaaatttgatagtctaaggtcagttcttttcagctgtcctaatatttgcattaattttcacaccacattgcttaaaaatctctgatattgtaatcatatttgagaacgttaatcaaactgaattgaagacgtaggcctcttaaataatgagagccctgtacaacttttttcccctcattttatttataagctaaaccaggcacagtatttttaaaactataaatgcagactttcagctttttccttaatctttgagtgtgtaaaatcacaactttttttttttctaactgaaagcttaatgtggtgggggaaggtgcattttgaagtcagtacaccaagaagtgttgctgaaaacacatttgtcattttaaaaattgtctgaaaacccaaatgtagttcacagctcaactaaattggattatttacttatccaaccaaaatatctttaaaatgtatgttattgttaaatacatctggtttatagagattgatcttatttagatatttgtttacaattgttagtatttacaaatttacaagcaatccaaccagtttcctcagggacagacacaaaagccatggatatcagcgagttctcactgatgcaatgttattagttttgttggagaaaatggaggccagatgtcggtaccccaaaaaagattgttccatgattcatctattttctgtgctcacatagtaaacatctaattttgctcatgcataaatatgctccagtcttaatgaattcttatgtttgtgaagttcaaggttatcagacagtaatttttaaagctaagttttcttcttcttgtcttctcttcagttgttagctatatctaagaaggaggttcacatattgtatgtttaggaaattcattgaagaatgatatttacttcacagatatttttgtttgctaccatatctattatttaaaatacttctcaggcataaagtccaagactggttagtcaatggtaactttagaatgtgacttgataataaataatatcatctctatttcccaggaatcaattagtgacttttattggtattactctgggaaagatgttattgatgaacaaggacaacggaatttctccaaagctatccaagtggcaaaacaagtctttaacactcttacagagtatattcaggtaaacatttaaacatggctgctatctgtagcactgaactccatagaaaaatgcagtatatctagagtagtttccatatctcctattgacccctttctgagtttctttgcaaattgctacaattaaaatattaggttgagatgtgaatttatatggaatgaaattgcttcaccatttggcaggttgagatatgattaactccttagaggcatgggctgtgatgttagctctattgtacctccagggcctggtatatgtattaagcacttagtaaatattaaggaaggaagggcgagcaggcacaacatttaaccattctttctggtattccactaaaagtgggaagaagtttcatagaaacttaagaaagagaagagtgtttgaaaacatcgcatatgtatattatagataaaattccaaatagcgtatagaatattcttttcttttttacatcgatttgttttatattctccttggactaagcttctagccttaacttcagattttttaaagattttataaaattctgggtttttctgcaatcaccaaaactttgcttgatgaccagtcatctttcctttctgtcttgtctcagtggacatgttaccctgaatcattcactatgtttgacgtgccccatgctaaggataaaacaggagggagaaacttataattggctttgtgagactaaacataagcttgtggggagaagaaaggttaagttaaaaataaattgtatcccaggagcgtaacagttacagctgtttgagtaaataaatgactcatggccaagtacagccaaccaagagtaagtgctgtagaggtaggaagacctcctccaggctcactcgcctctgcattcagtcccttggaagcatggcactttttctattttttgccttggtggggaagaggaaccttatttcagcatttccagatggaaacgtcacacttgataattctaataacatttcctttaaaatcaaataaaagtgaaagcttaagtcagttttggtctactcacagtcccatttccttacctctcctggcttccattattgccttagtattctcatgcatgcctagaatgataccagtacaacaacattcatgtgtcatgtcctgaataaataacaggattgactgatgacattagcaagccactggattttccagaaatgggaatcaggatgatttctataatatattccaaatgaaacataaccgccatttcagctaagagtaggcatttcttggttcctaaaataattgagattcctgaatgtatcgaaatctagaagcatccattgagctcttactatatgcaaaactctagggtgttgtcatagaacacagatttctatgtgaatgtttaaaggatattggataaagtcacatggcttattgtgcttggttcaataagaaccaaaaaaaaaaaaaaaaaaaacagaagtaacaagtaacttctcttattacttattttttatatgacattttaaaataacaatcgtatctgaaatatgtattttggaataattttagtattcagaaaagttgtaaagatagcacagagggtttctgtatatgattcacccagctttccccaatgctgacattttatatactcatggcacatttgtcaaaactaagaaattaacatcggcacatcctgttaactaaattacaggctttattttgattttactagtttttccattcacgttatttgttttttaaaattctgggatacaatccaagttaccacattacatctagtgaaatatattttagagaagcttgccttagtggtatatctgctgataaatattgatactatgaagataagcttatcattagcttcgtgctgcttctggactgccttttagattacagcattgcgtattgctttattattcaaacttctactaactatagaaagttatataagggggagatccaacaccattgaaataaatggaattacctataagattgtaatcccaatttaataaaaggggaagaattgtttgagtaagaggacgttgtattgtcaaggttcctacagtaagaccatgaggtagttgttgagaaaagagaaagtttgatctgtccttggcacaggtccttctggtagttagcaagggttttccatgttgcaggtacatacgtcatgagaaaaagaaagcaaggcaccagactagggagtttacagctcccagaagctgaggacctaaggttgagcaagccctgcaaaggacattctgtgtgtttcaggttttaaaagaaaaaatgggtactttggctttgggcttgcaactctgtcacatgagggttggccaaacaacttttggtcacctaggggttgcaggagagcacaaccccttgtaatgcttcaacttttgatttaaaccttaactatcacgggaagaaaattatttctgacttgaagaaaaaacaagtttattttcctaaaaatggctatctagtgttcacctcttgcacttttcctcctccctaatttatatgccattggaataccaagctgacactgaacatcgaccacaggaaaatcctaaagatctattgctttcaaaccagagctgtaatagccagttgggactaattataaccagggatgaaggaaactataaagctactatatctggtacattaaatgagctggatttaatgacctacagattaaaataacctgattccttctcaccactgtcccttcagacttgctttgtcgaccatttctttaccactagaaggaatcttgtgcactggccactttcagataaataaaatcatgtcagtcactttgtcacaagaataatctcatttcagtaaaacttccgcttacccttgggcctgattttcagctggaaaacctagagtgagggtgcaggcaagaactcccatctggatgttgttcattctggaaggagtccaatctaggctttttttactctcccccctgaaggttcttctctctctctctctctctctttccctttcccctcctgattaaccccaggcttcctctgggttgttgctgtgggagagaggaggtatggggaaggaaaggtctcttccggggcacatgtaatcccagagtgcaccacggagctggccctctggtgtggtgtgttgtatttttttatctaacgtgcgagcctggccctcttagtcctccagtgcctggaaatgactcttttcccatccagtttaaagttattcaatcagacctcaagcatctggtggcccccatccaccttggaattatgttaccatttcagactgatttcagatggggcagaatggccccttcctgagtagtccatataagaaacacatctttcttgtcatatgctgtctgtcacactttctaataccagaccttatgctacccaacttcagaagacagaaactgagctcacatgatggttctcctgaagcctcttctctcacttggtgtaaggggatgcagaagtaacgaaatggagaggctcagcacacggagaaccccctccaaagtttcccccttttcaatttcaacccctttgtatccttagagtggaaatatctatttttagtcaccccttttgcaggtagtgagtctactgcttttgtagacagtcagtcgttctcatagtcatctgagaatacatagtcagtatctcagctgtagggcctcaagagatgctgagacaggaaaaagttctatttcaacatcttggatctggccatctcttccaatcacttgtttctagcataagatctgaaatgtttttatgtggcctgcaatttaaaggtattataagttatttgcctaaaggaatgaaggaatttgaagttaagaacggtattttatgtacttttttcctttctaagtaaaatccctgttatttattttcatggttgatgtagatgggtttacaaaactgaatgatggtagaattttttcattggaaagtgaaaacagaaattggctccatgaaaacagtctgcgtgctacagcggatccaccctagtattgatacttcagaagtgtcagctaagagaacaaagttaggtttgttaaaagataaacttaggcacaataacatcttaacaagtttatctgagcattcaactatttatgaatggagcaataccagaacactaatggttcagcacttcaccaaaggtgggggcacttttataaggcgttcctggaagcaagacaagaaatttgattggtaaaagtgcaaagtccctagttagaggttagttggcagtttctgactggtgaactctctagttagaagttagctggcagtttctgattggttaagcttaaatttacattgagttgggatttggttttcttagggaggaacgcaagacactggagccatctcagcctaatgactcccaattagttattttaaccacttccaattgccttggattctggattcgtgaaattaataagcaagtattactcttttaaaacacgtcattggttgtaccatttgtaaaatagttgttcaattaagaaaacgttgaagaggattttttttctctatatgaatgctttatccaggttactatttaggagtaagaggtaatcacctctcatctaaagcatattctcagattcttttgaatacaaaatagtgactattgattgatttgactaaatagccaaagcacccagaccttattttttttcctctaaatagaggagatcaaagccagaccaaaaaaaaaaaatgattcacagaatataaaaatccttgagaaactttttttggaatatattaaatgttttaaagaggaacgtatttctctcttaaggatcattatcatcactgtatctccttctttcactttgagttcctatcttttcagataacgtgctagcagtgaaatatatcagcactaagtcaacttttcccctgttattgtacagtttgttttggcaaataaattatgaggaataattgccgtttgtctgtttatgctccagggtccttgcactgggaatcaacagagtttggcacacagcaggctgtgggatgctgtggtcggctttcttcatgtgtttgcccatatgcagatgaagctgtcgcaggtaaactaactaactgccttcctctctcttaaatgacaaactggagactgtaatcatcagcaaattaaacatgctttttgatgttagaatattatctttttaaaatcactttatcacttgtctttttaagatcattttatcatgcctcttttgctcattaaaattttttaaaaataaaaaccgttatgtaacctgagaatagacaggagtcattattcaaatttgagacaatggatattaagaaattgaatgtaatggacaaatgaaacagtcgagtccccaaacattgtacatttcacaagcttcatcttcctggccattgctcactggaattttccttccccttacagataattgaaataggttttataatctgttacaagggagacaattttgttacagggtcttaaacaagcagatgttctcagtagggcgatgcttacccctaaccagtgtatttaattttgtgacagagaaaaagtagctattatatggataagcaaatgaagaataaacagattttctaccatgtttaatgttaacttgagggctattgaaaaatatcagcttgtttgctcactgctgtatttgtttcatttgaaacaaaaagatacacaaacagaaaagttcttgtgaatgtgtctcttcaatgcagtgaattttgatggtataatctgagaccttcagagtgtgagtatttgccaggcggtcaggtagaagaatgtcagattaaaagacagaatgctgtcattctaattcctgagctgccatgacttgttccacccgtgtgggccaggtctctcttccctgaggccttgtttctctgcagtaaagtgaagaacctatccctcaggcctgcaaatgacaatatgcaggatatattgtcaaagatcagcagggctggatgctagtaaaagtggtaaggatacatcttaatgtcaaagataaacaaagctggatactagttaagcgaataaggacagattttaatcagtagtgctattgcaacaaggaaaaagagttcagcatgaactgaacctgatttgatttgtacagaggtgactgggaatattaatgggagaatgaagattagagaaggggcgagcaggagctcagtagagtcagaggagtgaaaagttacaaaaggttcattggtgtaaatgtgattagaccagctatgtctgctaactggcaattgtcaaagttagttagttaggattctgtcctccagagtccttatccttagatgttgtctggaactgttgatttttttatcagcctggagttttcccaggcaggtactttagtggagggctgggatcatccttgacatgcagtcttgaacagttagaaactatatttattagtgtttgttcaagtctttatagaccaaagttgaggccaagttgagaagagggctcagaggtacctgactagagtttggtcaaggagagaatgtcagtatggagttattggtgacttcagcccaatagggaaattccagtctttcatttaatcactagggatattttggtaagtaaaggaaaccaacatatgaaccaaatgtagaccctcacaagagagttctcatcctgatgtttttccatcagggtattaacatctggtgctacctagcacttgttcatggtttataaagtttccataacagctatttagaaagaaaacgtctcatcttcccaacactgtatagcttcatatgtaccaaaaatgccttgtacaaattttttaaagaatagtttaaaaaatggatgagatgtaaagttgtgcagatgtaagtatgatccgtatttccagggactatagctaagcgtagtgatgtttagacacaatatgtctttgaaaaagaatgtttctttatggtaaaaaatcaaaagcaaaaacaaaattttaaccagagtaatactggaaagcttaatcaaattggtaaataagatacattgtgtaatatttattagtacaatgttgtactaataggtaatacctgtgtaggtttttggttaatttatctaacaaatacatttataagtttatcttctatggtgcttatatgcctatatttcttctatatgaagttgatttttacataatagcacctagaagaagttagaaagttagaagaaaaaaatgcaggcttttcaaataaaagataagatagatgtcaaatgtgcagaaggtcttgagtcttgcttggcattggagaatattccactgttgtggttctttcatattattgctatatatgttcattgtcggtacaaatactttttttttttctgagacccagtcttgctctgtcacccgggctggagtgcagtggcgtgatctctgctcactgcaacctccgcctcccaggctcaagcaattcttgtgcctcagcctcctgagtagctgagactacaggtgtgtactaccctgcccagataaatttttgtatttttagtagagacgggtttttgccatgttgcccagcctggtctcaaactcctgagctcaggtgatctgtgcgcctcggcctcccaaagaagtgctaggattacaggcatgagccactgcgcccggcctacaaatactttaaagaacatgagttgaaatcagtaatactttttaattgtaaagtataactatttttaatatttggccctcctttagttccataatgcttcaagtggttactatttattgccagagcagcatcctttttgtgagaataagtatgatgttcctgctgcatagttttcttgtattatctcaaatgcaatgttcatattttcaggattccagtcaaattgagctattaaaagaattaatggatctgcagaaggatatggtggtcatgttgctgtccatgttagaaggtagttttgatttatacttttaaattctctttattatcttatttaaaggatcagcatgggcttatggaatcagagtgtagcatagaataaaatagcactcagatatgatagatgccttggatttcttgctggcttattattctttttctcacattagtttttttttaaagggagatcctgcatatctcagtttacatatctacaaaatgaaaatagtagtactttataacagtacttttcatttcatagtgatatcgtaaaaagtaagctctccagtctataaagaatattttatttgttagtgtgtttgtccataatcagtgggggtttcggacatttgggtaacagtcagctgtgtaagctgctgctttgaaaagaccacagagtcactcctttgggttcttaaagccgtggcactgctgggaaagcctctgtcccccagggcagctggcagtggtagtcttgttctccccaccacagcctcagttttaattttctctttttttttcttcccagcttattttgttattgctttttttttttttttttttcctgtagcaggcaggaaatgtagcagttaagagcttgggctccaaatccaccgccagagtttaaatcctggcttccttacctctgggaggtatgacccttggacaagctacatctccattttttcagtttcctcctctgcaaaatagaaatgatagatattgatatgagaattcagtggaatcctataaatacaaccaaaacaactaagaaatgtttggtattacggtgcctatcactttttcttaacttcttcctattttctctccgtgtctgccatacatggcgtaactccacttcagttaactgaggcagctgtcacgcctcgtgctaggactttgaagtggcagcatctgcttaaagcccttagtcggtggcaacagtagccactttataccctttaaacacaggatccatttttccatgcatggccccgattcgaattttgggttaaatactaacaaacagcaacaataataactgcagtagcagcaaccacagcagtgacttaaaaccagcctcataacgtgccagatactgaattaagtacttatttaatcctagtaacaagtttatcagttcaatggtaatattatctcaagtttgcaaatgaggaaactgaggtacagagaggctaagaaatctgcccaggttgctgagcacattaagcctggattcaaacccaacaatgtggctccagatcccacactcttaacaccacggtgcttactgcttctccgattgactctgtggacctctgaccagcgacctttcttctcctgcctgtctttatgatatatagcacgttctgttcaatgaataaaagcattctgtgatcctgtagttcaggaatctgccattttctaacaactatacacactgactcatgaagaaatgtagaaaggtgcttttcattatgaatcagaaaaagcgtacagtttgctctcaggatctggtctgaagacctggcactaacctttaataattaagtcacaatgggcccattaatttagtcttgttgaacttcaatttcctcatcggtaaaattagggttaacaaaaagtacctgccttacatatgaacattaaatcagatattgtctatgatagtgatttttcaactctaaagggctgagcaaatgtttatttttattattaatatgaaacgattttagtttctggctctttggctcattttctttatctaaaacatgttgcttctttgattgaggggaaaaatgtcaacttttgttgaaatattttatgtgtgtcagtctaattgctctgtaaatagggttatgcatgtttgtgtaatcattttttaaactatagtttataaataattatctttttatagagtgagagataaacagggacatatccttgattcagatgttattaaagatctacattgttatcttctgtatgatcactgattttgttagtttattttaaacaaatgcaactgctttaccaccaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggtaatttatctctaagtcacagcagcattctctctggacttcaggtgggtataataaatgatcattagaccaggtttcatgctagtgccagaacggtgttacctatgtgacttgaatttccaaagagaaatgctttttggtagacaaagttagtgtttttaagagtccttatgaattattaaattatcttaaactattatggtgtaagcttcagtacccaccctaactgtagcctacatctttctccacgtttatataattttatatgcacatttgaaaagttgggaaaagaaagaaaacttttagatacctgtaagtggcattattctcacagagcattgaaattttctcctctgttctgtgattttctttggcatgttttcattgtatgttctttgtagtcattagtccatagagccatcattccatccatgaatatggcatattttccaagtgtctgacagacaccactgggtatcatagggaattcaaaggtaagatggggtcactgccttcaaattaccttaaaaagtttattccagagataaaactaacacacatgaagaaactagaaaagggttaactgtgaaatagtataggcagggcagtaggggttgcttatgttgagaaaatggcaatgccgctatggtttaaagtagttagataagaatgaagaggtaggacttaaactggcattgaaggatgagtaagattttagtaggtgcttaagataaagaaggatatttctaaatgagaaaagagagtgaaaaggagtccagaaagtttgtccctgctgctggtgcagtaggtcagtgtgcagaagaagcgggagatgtttggccctataaaatgaaaaacacgtggcgcttttatcgtggtataagcaagagggtatcttatataggttatggtttgacacatggtcacatggctccctcaattcattcaaaggtgatgggtaatcctggttttcttttccccattgactcattcaaggaacagaaggcaaaagaagaagaaaaggaagaaaaagaagaaaccaaatctgaacctgaaaaagccgagtatgtatagtttgcatatacttttccttcgtttcagtttgtcattacatctctttttcttgtactctgtctttgggagctgcaagggagaatctcatattgtcaaggagccacagaactaattgtgccatctccgtggagaggctctgacagcgaggacctcaggccatgggcagggatcactgtagacgcccccggggctgccagtctagtcttttcctctcattccatggggacctccatttgtgtgattccctctcagcaggaaagactccagtgattgcatggaatgctgtttgtaagaggactcagggccacaattctgtctttaaaaatcactcatgtctttctgtcctttccaagaagggaggaaacaaacattccaaatgcgctttcatagaatcctgtggagtggtgctccttaaaccatagacccaggaccacatgcataaaagtccccgggagagttggttaaaacaaacattcctgggccccaagccatagatcctgcctcagcaggtctggtgtggggcctgggagccttcattttcaccaacactcctgggatcaacgcagcaataaaaaagagctggatgtgaggcgatgaaaatgcataactccctcataacaccaggtttctctgaataatcgaagcctacatctttctccacgtttatagaattttatacgcacatttgaaaagttgggggaagaaagaaaggaagcttttaggtgcctgtagtgccactattctcccatagcattgaaattttctcctctattctgttattttctttggtctgttttcatcgttatgtttttgtagtcagcactattcattgtcatagatctcacactattgggtcagttgtaaaaatggccccataaaaagtagacacaaataacagcaagacaggcatttcaatggcaattctttaactaatatatacctcatatgagttaagattaagtatagcttatatatattaatatttctggtttatgtattaatacatatgacttcactttaatttaatgaaggactgatattttgcacctaaaggatatcaaatgtcaattcttctaattccattattgttggaattaatatatcattactataattcactttattttatttaataaaattaattacaattaatatatgtcagagtataatgatacactttatacatgtgaacaattaagtgtgtaggcctctgattttaaatcttaatggaaaatgttaaaaattgtgcattaaaattataggctgggcgtggtggctcacacctgtaatcccagcactttgggaggccgaggcgggcggatcataaggtcaggagttcaagaccagcctggccaacatggcgaaaccccatctctactaaaaatgtaaaaaaaagttagctgggcatggtgtcacatgcctataatcccagctacttggaagactgaggcaggagaatcacttgaacccgggagctggaggttgcagtgagctgagatggcgcccctgcattccagcctgggtgacagagcgagactctgtctcaaaaacaaaaaaaaaaaaaaaaaaaaaggattgaaattataatttaaaaatagggtatgtgggacagtcatagcaaaatcattcatcattcttcatttttttaatgtttcattgcagaattggaaggaatctgctatgcataaagattcttcaagcctataaaatgtcctctatatttcaacttcacagaattacccatctccaggggactgtgatcaacagaaaatcctacccctgattctaaaattcagaatattatcattcaccggaaaagaaattagttttcaaaagtaatatgatggcctaaaatatttgttcacttgggtaattttccacaacacccgtttagttctttagtttctggagagcttatgttttgtttgtttgttttcataggggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctagtaagatgttttagaatgaatattgttactgatatagtgcaataccgtaataatttaggctcagtaaatgtttgctgacctctccctgagtggcagttagggaaccaggttagtccagcacatgtttgatttgctcattgtagtgtgtttatcttttatagtgaatgtctctggcccaccgctccctactgtcaaacccataacctctactcatgttcacactccctgaaaccctttcatttggttcctgccaggacagtgctcccagtgtctgcccacaaagacattaggacaagtgaataaacatagtctaaggacctgcaacagattttaaagcaagatgtgccttctaggacacaagtaattcaaaaatgttccagaactagattagtcagtatttctataacatcaccgttttacttaaaaatccaggtataaaaatattagctaattgagccatagtcagtatttctataacatcacccttttacttaaaaatccaggtataaaaatattagctaattgagccactttccattgataataagaaggtctattcaaaattgttctttaagagagggattacagttctttatatactgtcctgtacattttacagaggtgttcccctaattagtaaagcacacattcatatttggaaaacaaaaggtatagctctctctatgtctattcatatttatcttgaaattcttaaaaatattgtttgaaaggcctttattaacatgcatgtgtaatgtcacatgtatacacatatatgtgtctcctatccttttcctccatgcttatctcctatccttttcctcctttataaaaattaaacatatgtgtatatatgtataatttttataattatatgtgtatatatgtataattatatgtgtgtatatatgcataatttttataaatttttataatttttataagggaggaaaaggataggggataagcatgtagaatccacctacaagaggtactgaccagtgatgttagacctagaatttaagaacaacaaccctcataagaaagccatttgaacagcagagtcatatttagtgttttttagcccttgagaaatcaaaaattgacaactcagaacctcaatgaactatagaatttcacctataaggaaagtggactgtcctcagtaattatatattctaaatgcttatctttaaacatggttatgtattatatattttatgcaaatatattttaatttagttgtaactacatttcctaaaccatcttgtattttccctatattgtttaatacagagttcactgaacagaaatgtttcctagataactaactctgaataattcctaatttggtatgccataatggcttccatggctgcaggtatagttctattataggtcatggctgcaggtatagttctattataggtcatggctgcaggtatagttctattataggtggtttaaaggttgaatgggcgctgcagcaccccagtgggttcctgaagaatgtgtttaactacagttgtgtaaaccaagtagttgagattttgcttccagctttcactgtgtcagggttcacatgttctgttgtctctgcacagctcctcccttttcctgcatctctttgctatctttctcggctcaccgatttgcatgcacatgaccagtcatggccacatccgtctaacaaaggccccttttcccctaagtgagagctcagcctagctaactcagcctctgtgacccagatccaccttccaaggacaaccagtgaaactgacgcagtctgggtgtggtggacagccttgttctaataagctctggcagtaaagatggggtcctgtgtggggaaatgacacgaacagagatgggctgtgtacacagaggggaatatcattctgaggtgttacattttgatgtagctttattatggtaaatcccctgacatatccacttaaattatattgacatctcccacttaatattaaaacaaatgcttaatgtccaccataacctattactttaaacccacttctctaggctttattttttcccagcccaataaattgtaccagctgttcccttagttgctgaggctcccaaattcagaaggtatcatctttgaaccctctctttcccaccttaaatacaacccaacgataattattctcagttgttccaaatacatcgagtctgcccagttcttgccatctccacaggtaccattaagtccaatccaccaccatgaacctcacctctgcctgacgtcttgtactaactttctaacgggtcctcttgctttcactgttgttccactgctatcagttttcacatagtagctggagtgggccttccaaatcataatccaactgcaccaagtcctcctgaaatcctctaatagcttcccatcccacctagaataaaataataattatactggaatattacatttattatagataatcaacataataattatattaataacgaactttccctatattaactcatttcatcttcaaagcacacttaagagttaaggtcttttgttattcccacttcgcatgcagatgagcagagtgatgctacagaaaagattaagtcatttgtccatatcccacactaggaaatggagggaggcaggcttcatatccaggcaatgaggcctcggaggttgtaaactgaaccaccacactgtcaaagacaagacaaccttttatcagaagcctacaaaaccctgccccctgctcacctgtctgatcacatccccctgccacccccacacatcagtctcccttcttctcactgtgtttccttctatttctcaaacacaccaacatcactcctaactcagggcctctgcccttgttgctcctctctttgacacactctttctttccccaaatatttgtatgacttgctccccgcttgtgcattcaggcctctctgttcaaagcttacctcctgagataaaccttcccagaccaacaccatctaaaatagcacccctattccctaagctcctaacccgatgtagttttcttcttagcatttaacattctctgaaattatgtttttcacttgcgggtatgcttttttattctttgtctcctccatggtggcagaaatgttctccctcacttttaggtctgcagcaccaagaatggtgcttgaaacagtaggcttgcgatcaattgtttggggtaaatgaatgaatgctttatttaaattgactgcaggtttcaagcctgttgattcagtgaccttttcataatgtttttcaccctcagaactattttgctcgcaacttttacaacatgagaatgttagccttatttgtcgcatttgctatcaatttcatcttgctcttttataaggtacgtacatctcactgttttaattactggtataaaactccaaatagaaatgaatgtaaagatttcacgatgaacgtatctactactgctagtgaacatgtctaaacctattatgaaatactggtgcctaggcactgatatcactgttatctaggaaggcaagatagatttgttcctgagaagtgagaaatgcctcaactgaagggcatttgatttagcagagggcttccccacagtattcccagcctaatttagctgaatatcttatttgtgactatgcctgggtgtggcataccgtattatattacattcttttgtaattgagaagagagcttagccatctaattttttagcatgcattggaatcctcagaatttttggttgaataagaatgaattttaaaagtatgttcattacttgcctttggtttttgaaaagctatcgtttttagcctttgctattagtcctttcattatgcagtgacttcacatccaactatttgctgaaaaggctgtatttcttttgtcttttgcttgcaatggtatcttagatgcagcaaactgactctactttaaatgctttgaatcaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtaagatagtaaggcaccaaggtacctgtgtgtgtgtgtgtgtgtgtgtgtgtgtgtgcgtgtgtgtgtgtgtgcgtgtgtgtgtgtgtgtgtgtgtgtgttttgcaggctggacttctggggaagcagattctgagctggaaactttgtgcacaaagtttctgagggaatgctccatgaatcaacatgcatggggcaaatggaggaaggatgggacagaggggaaagctgggctactgtagacagacacagcaggtgccgtctccaaagctgggatgccccttcagggctgtcctggcctggggcattggagcctggcctttttatgtctacattgactagtctgccctgggaaggggctatggccatgagctgtcttaaagtagctttctttcatatactgataattattcacatagagaatttcgcctataacttggccctacagaagtgagctcacccacccactatgtctcatggtaatgcagtgatacttggtgtattaagacttatagaaatatattgtgtcaatcctgggagtcattttattgttttattatgagggaagtatctactgctattcttggcagaaatgcctcatgatttgtcacacttcacccagaaaataatgcagctttatccccagaggcctgccaagggaacaatataatttggtgaatagaacccaagataatctctctgagtgctcagggctgcccattacctgtccaaacctctttatcttttcctagcaaggtgcttttttactgtaatgcctttatttcactttcactgtcctctgcctctggttataaatcttgcagaagacgtgtgaaaaaccagggctcagagtaaaagactagaatgtaaagagttattcaggaactcctttcctcccgtttattctgttttatgggagtgcatattcttggctatttccagaatatcagtgtctatctgctatctgtgccttgtgtaaagtctgtccgtgtaaaaagagaatcattatgttctagaaaatcattatgttctggaaatattttgacaaactgacagatttttgctgatgtcgaaattaaaatttatctcaaaatagtatgtggtgatgctgagcatgaaattattaaagaggtttctcaaataaaactgcactttagtagcatgcatttgggaacattgctgcaattgctaaattttatttcattcattcatgttgagagatatatgtaaacaaaatgattttgcataatcatcttttcatctttgaagtttaaaaatgatttcactagtgtaattatctataagaccctatgtgtttaaaaacatatgcatatatgtaatatctattctatcttctgtttttccaaaaccttctagatgcttcttcctgcttgaatatagctgattcattttcattccatttttaccttcctagaagtacacaggaaatatttctttccaaaagctgttttgtaaagatagtgaccacaagatatgccagtaaatctaaactaattttaacgtatttatttttcctatgtaggtcccattggttatttttaagcgagaaaaggaagtggcacggaaattggaatttgatgggctttatattacagaacagccttcagaagatgatattaaaggccagtgggatagactcgtaatcaacacacagtgagtaaataattatatgagactttctgcactcaaaaatttcagacatgaaaatatttggttggagttcctgcagatttgtcaaaagtttagcagaggtgaataatagttatatattcagccaagaaaaatctaaagactcagtgctgtccaactcttaatggtggatgtcctcaatttttgccctctgagttctgaattccttaattaaaaatggcttagagttcatttccacagcactgatggaacttcacatccattactcagcgttcagggatgtgtgtagcaggaagtgcatgacctgcaggcagggttatctcatccaaaagcagaggcaaaaattattcattaacgaaaaagttgtagcattaaaggaaaatgcattgaattttacaccttgaatatatctgagttatcaactttcagtaccatcaagcaccctagcatgaaactaactaaatattaggacacggtgtaaaatgtaagacagaaaaacaaatgctttttctatccaataaacatttagccctgtgagatcaagacccaaactactagctgctgttctgagtataagtccatcacaaaagtataatttttcactgtaaaaagaattagtgcaatagttgtaatagtttatatttactattcgagtgaaatctttttaaaattgtgattagttttgctaattaaaaagtcatttgctaatgggttccgagttgtcaaatggagattatttatacatgatacatgtttatcctaaatgctaaatgttttgtttagcaattctaccattaatactaatttctaagcaagtcagtccctttaggcaaactctctatgtattagtgaagacgctagagttgtgctttgctgctatgctcgaagtttctgtgaggataagtggtgggaaagagatttttttcttcatgggaaaaacaatgacaggtttctagatactttaatttttaaaggcaattgataaacaggtctatgtactgatatgttataaacaaataaatataacaatgctacctaataaatatgctcatattcttctccattaaagtatcagcttataatcttttgtatatatttacatgttaatatttaaaataatattcaaatacctatgatgcaggaaattatgtgatgttagccaaattcattgtaagtttacgtggcaggatatatgtttacatattattttaagtatgccatatatcccaaatgatatgttattatttgtcattaaaaataatactatttacttctatgcttttgtatattttaggtcatttcccaacaactactgggacaaatttgttaaaagaaaggtaatattacttggaatcctctacatttttcttaaagcacagtttagatttttatttgatgtgattcagatgtagaataagatattgaggtataatttatctgcctattaatgtctccattttttttttttaatttttgagatggagtctcactccgtcacccaggctggagtgcagtagcgcgatctcagctcactgcaacctcagctgcccagttcaagcaattctcctgcctcagtctcccgagtggctgggattccaggcgcctgccaccacacccggctaatttttgtatttttagtcgagatggggtttcgccatgttggcctggctggtctctgactcctgacctcaggtgatctgcccgccttgacctaccaaagtgctgggattaaaggcatgagccaccacatccggccaaatatgaatttcaagaatagcacataatggccgggcgcggtggctcacgcctgtatgtatatacaggtatgtatgtgtgtgtgtgtatatatatatatgtatatgtatatatatatatatatacacatatatatatacacacatatatggatacacacacatatgcacgcgtatgtgtgtacatatgtatgtgtgcatatgtgtacatatgtatgtatatgtatatatgtatatacatatataaatgtgtacatgtacatatatgtatatttgtaaatgtacatatatatttttttactttgttagaagcaatgtgttcgatttttatgtggaggaggtacaagtgttttgttccctcgtgacctggcatcttgagtcgcactgcgctagtgcatctgaggacacccaaattaggcaaaagctgtgaaagaataattttaaaatggttttaaatagataatttgaacattttattcctattatttaatggaataaggaagaagcttctaaattattaaagcaagagtttcttgctttaatgaagaaaactctatatctgtagtcaaataaataggtaaaccataatggcagctaatcctgttcctggatttcccgctatggtacctaatttgtcctgcagggaatgtgaggacacagtcccgagagaatcccccggctcaaatcagcccagcccatttttagcactgtgagaataatgcaaaacaaatggttttaattaacctaagtagttcatgttcataggctctttcttttggtttcttttaatttacttgattgcatacattcagaaaaagccaatttttatatctgttaatcccttcttttcatcagtatatttccttcttcattcacttcaatcttgttcagtatatttccttcttcattcacttcaatcttgtattttcacattctgtctccttttctaatcttttctcctgtatagtggactccttttttgctaccagtgatctctcctcctgcttgtctttaattgcttttcctgttccctccattttctttttttgtttttgagacagagtctcactctgttgcccaggctggagtgcaatggcatgatttcagctcactgcaatctccacctcctgggttcaagtgattctcctacctcagtctcccaagtagctgggattacaggtgtctaccaccatgcctggctaatttttgtatatttagtaaagacaaggtctcaccatgttggccaagctgtctcgaactcctgacctcaaatgatccacccacctcggcctcccaaagtgctgggattacaggagtgagccaccactcctggcctccattttcattactgtgtaagactcactcaggaggtatatgaaccagaggccaagaagagctgtatcccagagttggacataactgagctcacaggggagctgtgagcacatccaagccctgctctaaaaacatgacaaatgggcaaagccaggcagatgggacagaagagaaataagcaaggaagctgaaggggattgttaagaattattctaatgattgatagacatggaatctatactagatgctaattaaaatgaggatggtgacaaggttgcaggtcctggtgttttactgaagaattgctggggtcaggatactcaggggagtgggttagaaagatgggcattgtggccagagagttgaagggttgaaattgagaccatggaaggatgccacccctgtgatgtgccccctattggcatgcagaggtctatgcagaagatcattggctggggagtcaggcatggcctggttgcttcctggacccatctcttgctgagtttagcaaacttaggcacattacatgaagttttctaaggtacagtttctttatctgcagaatatcaataacgtgaaacctacatattgtgacagtcacatggaatgaagcataatttctggcacaaagtattaatttagtaaaggtcgttctcattccatttccctccatttcttatgcttttatttcagctcatcatcttctttggtatgactccctctcttgaatgagagagaaatcttgttcctcagataggtattatgtaagatgctgtgaatttgtttagaccttaagcagtgtgatcacagaaggtgagccacacactagattttaagtgattgttagggcaaatatacagtaagtataaaaataattagatgttttatacacacatatagatgatgttacttaatggttgaagccaacaaaatgctttttctcataccccaaggttatggataaatatggagagttctacggccgagacagaatcagtgaattacttggcatggacaaggcagctctggacttcagtgatgccagagaaaagaagaagccaaagaaagacagctccttatcagctgtgtaagtgttacttcggctctatcctacagacttagattgaaaggggaaaacattaatacatttttaaacttgtgcattgatttcctttccttcaatgtcagaagaatagatagatgaggaaaacagaaagtatataaagtctacttttacacttcttggtatttggaactctggaattattggattttttttctattaatttttggaggtaccttttaatatttataagagaacagaaagactatgttttttacttaatttgccttttctgtctttaaatgatccttaaatctaagtaaaacacatgcaaaaactcaatatatggctgttttctggtaattcctgtttgaaaaaacgttaattttcttatgttttggaaaagggaactatgtagcccttgtatttaaaatgttcagaggaactcatattactttactataagtattgtattgttttgaacagcaaaggcttagtgcgtcagaaataatataccatcataccattacttgtaaagtttacttcaaaatgaaacactctttatatactgctttcatggaataatatgtttctaaaccagttgagttgaatgcacctgaatttaaatgtcacacacacacacacacacacacacatatagtgtgagtgtacagatatatacatacatccatttagcaaatttgatcaactgaatctctggaataaaagtaaaacatgcttttaaaaacgtaattgcttattgtagtcacttaatgattttggaagaaacataatactttctcttaacatgagtagggatgtgatggttactttgaaaacatatttctggttctgtgaagcagtattattttcttaatctgttagctagcattaaaaagatagtttagctggcctatctcattggtcatattgtttttatctatctgaaaacttattaaggtgaacttgtttttgaacttactgaaaacaacttggatcagcaaatatgaattaagttccaaaatattacttgagtactctaggaaaacaaatgtatatttaaacgttgtgccgctgcctgtaaaatgaaacaccgatgggcaatccttaggatctgtgttccttatgttagaatatcatgaaacaagaactagggtgtgaggctgagcatcccacaaacattttcagatccttaacaagcaatatagaattaaatagttttactgagttatgcattttctgtggtcatatttgtgactctaaaaaaaagtctgaaaaaatagaagggaagtttagactgtttttctactatgaagaaatagttttaaattggcatagttttctaccattatacatagtaactgtttgtaagtaagtttgacccctagcaaagtaccaagaagttcatatggcatttaacaccttgacatatggagaataaaattagaagaataaagttctggtaaataatgtacaactaggaaaaagatttacatataatgtctctttactaaagcatttaggaaggtcaggttttaaaagattatccgatttctatatgaacgctatcttaatgggaacattcaaatacaaaatgatttatatatttatttatcaaacacataaggcttggtatgtgcacctttaaataagtggccagctccattcctgggggtggaatagctgcaagcagtctggaaggctgcaggtgtcttcatttgcgtcctcactggggaggaaaggagctcatgtctcaaaacatctccaaaactcaccttcctggttatagtttacccttgactggagctttggagtccccccgccccccaaccaggaaggccgtgttctgattggcttagctcagccatggccctcccccagaggtggggtcagcctcaccgaaacaaacagcatggctgccacctacgggtgagaaatgagtgctgtgtgatactgatggtatattgtcacactaatgtatgctagagatggaaaataactcataagaataacttttaaaataaaataaataagaaaccaccataggaaattcatacatcctgatataaaccattattctgttttagattgctttaatgtaaaataattatgctcccatgcaaactactacattttttcccccaactcttccttttttcatttaagaaaaaaaattcttatattgaaacctgttgtaaatatttgtggcactttttttaaaggctcctgtgataataaaattaattatagttcaaagataactttatttaaggaaaaaaaaattgtttttaatcctggagtaagttaaatgagccttaacccttagtgaaaaaaatctcctaaaaagtcaccttcgatttgcaactacttagcatttataatttaagaaagattcgcttaattaaaagaaatgattaaagaagtcaataaagactaaaacattaaatctagagaaaccctttagaaaataatattgccattatgttatattgcattatttcatatcaattacttagagctggaatattggaaaggctgggaaagttacaatttctagcctataaatcagtggcaagttctgaaaaaatgaaaattaacacatatattttaatatacgtgtttgtaatctgcaaagatcacaaatatttactttagtatttatccattcaacatatatgtatttagacattcagtgtgtgagctggggagttcacagacaagtgagagaggcatataaccacctacatgcatataccagcacccacaactgtaagacaatgtggaaaataataataaaaggaattgtctacaaaatgctatgagaactgaggggaagggctaaattcctgcctggatgtaaaaggaaacagagaaggtgaattttctggaaatgaagtaaaaacaaaacaatttaaaagctctttcatttataaaataaggtagttgtaaaataaatgtgtatatttatgctagcttttattatttgaatcaaaagttattctgttggaatgcaattgcaagtgcatatgaaagtgaggaaatgtttgatgtgtacatatgttggccaatttagtacagtttcaaggaataaatgttatatgtagctgggcacaatggtgcatgcatgtaatcccagcacttcgggaggccaaagcggacagatcccctgagatcaggagttcaagaccagcctggccaacatgatgaaaccccatctctacaaaaaaaaaaaaaaaaaaaaaaaaattcgctgggagcggtagcacatgcctgtaatcccagctactcgggaggctgaggcacgagaatcgcttgaaccggggaggcagagattgcagtgagccaagattgcaccattgcattctagtctgggtgaatgagtgcaactctgtctcaaaaaaaaaaaaaaaatgttaatactgaatgtaggaaagggaaaggtgaaaaagaaaggactatttttaaataacataagacgaaggtgatgatgttttgttttccaagatcctctaagaacacatcatgaaactctaggatacagtgtcagagttggctctcagctcctcccttggcatctgggatagaactcgtttcccaagaaggtgtccaagtcttgtcccattgaatgtgaaggccgtcaggctctcgcaagcctatgagtctttggttaatgtgcataactacgcattttttttttttgtcattgcagactgaactccattgatgtgaagtatcagatgtggaaactaggagtcgttttcactgacaacgtaagcctacttcattatcacaaaagaaaatgcactctgattagataagactgtgggagttctgcagatggaaggctggttatttagaaaatgtttcgaataccaattcatttcatacagaccagatctggagagagacccacagaatgatatgattaatgagcccatctctcattccatttctttcaatagctgaaatagtaaaatgaaaatatatgaaaaactgagatgcagatttgtgagtacgttcattaaggttttaattggacaatggcatacttcagttttatagatgttaaaaagaaactcctaaataattttaaaagaacattaattgtgctaaatttaggttttccccaaattaagtacattaacttatggagttttattttattttttttattctccttttaccaaagagcctttggagactaaatatagggccgtaatatatatccaaatagaaaaaaattacctattactaaaaaccgccaggtgtctcaagatttcactctttaattttagcactgacttttatagttcacgttagttccattctcctatttagaagcatttgatagcccccaaattctcctgcctctatccttatcccttccctcatccagccatgggcccagaactctgggtgtcttaggagcattctctaagagttcaaaatcaggtcttccaagtatctttcagaaccataaactattaatacactatcttacaactaatttctcatccaaatgggagcaactcccctgaataacaagagggcaacctcagctttggctctagttggcattttccactgaagtggccagtccatcttaagttctgcctgctaagctcaatcttccatgccacagtatttgcatagcccacttttgcccagatgcagcttctgcccagatgcagcttatccataatattcatcttgctttgtagtttttttgtcctcttgataacttgggcatggatagatccaggatggagtctttccttagacagcgttctgctattttagtaggcttttatccacctgcagtttcatggcttctgtttggccaatcacctctcaacatgcattcattcttcactattactgtgtctctctgaaacatagccatggttaccagacgaaattcagaattcctagttaaatgtaaattttagataagcagaaaataatatttagcataagtatgtcccaaattacttcatgggatatacctaaactaaaaatcatttattctttctctctcattcaaattttactgtgcagcaagcacatgtgtagaccacacatgcacctttggcccagcttgtcacttaggtcgttactcatcttatgcccataaattttccttttcctcagtctttgcatttttcttttttttttgagacagagtcttgcactgtcacccaggctggagtgcagtggcacactctccgctcactgcaagctccgcctcctgggttcacaccattctgcctcagcctcctgagtagctgggactacaggcgcccgccaccacgcccggctaattttttgtacttttagtagagacggggtttcaccatgttagccaggatggtctcgatctcctgacctcgtgaaccgaccgccttggcctcccaaagtactgggattacaagcgtgagccaccacgcccagtcttgcatttcttaatgcctccttagattagctccatctgaatgtcccatggcaaattttcatcttccttctcctctgctcctccccaccaaatccagtcttcggtctacaattttctcttttagtatttttgttcttcttactacctaagcttaaattattcatatggactcctcctcttctttctccctccaatgcatgtatttgattatttgctgaatcttggtcctgtttgtgtcctctgtaattctcccttctatctttaccacttttgctgctttttttggctctggtaacctcaccctggggtttgtccagtagtcttctaatttaatggctttgccacttacaatgattttagacaatagcttaactagagcaagctcacttcctcatatataaattggggctaaacgtgcctattcatcagagatcttgctaaaataaaaaagagaccatgtgtgcaaatatattgaacgttgaccagcacttagtaggtgctaaagaaattttcctaaaatgccatttttcacaaaccgttatccttctcatggtactgcagtggcactcaagttcctgtggggtacacaaatgtccttgaacttgccctcaagcctctccaacactgccacacttttccaacttggtcttgcaaaacaggaacccaccactcaaaccaaattttccttcccaagcaaactctgtttagtcttacctcagtgtgctttttaaaaatgctgttttcttttctgccacttgacctctagcttcagttccacatggtccttgaaatccctttactagctcagccccctctttttattctctgtgaaagattaagatatcttacagtcaaaatgaaggtgtccgccgcttccccaaatgggtggtttctgactccactagcaaaacattccttatggagcagagactgtagtcccataagtaagagcagccaccatatttttattctgcattagtcctggccctcccccaaaagtgtattcattttccagcctatgtgaataatcaacattaattataacccaggagacttctacaacagtaccaatagtattattaggtgtattatagctttcagtgacgtcacatggtatttgggtttctcctagacttactgtggctcacgtaaagtgagatgcttggttaataaaacacttcatataatttcataactagtaggtctcagcaaacactgatttagtcagtgaataaatgaaaagcaaagaagggaagaaaaggagggagagaaagcgactggttcttttgttggctgtagagcaagggttcttctctactggggaacagttttgtctgctaatgatgtttggcaatgtctggagacatttttggttgtcatgactcaggggagaggtggggtcggtgctattggcatctagttgatgctgcttgccatcccaccatgcacagaacagcacccataataaaggattatctgaaccaaaatatgaatagcgctgggttgagaaagcctgctgcggagtaggaagtcaataaatgtttctctgtcggaggataaataacaacgacaattcctgaaacactttaaaactgttttaaaggaggatgacactgaccttttcagaacaaattaagtaaaaataaaattcacaaagaacaaactgatacagctaactagaattgtaaaaatgtatagtgagccaggcgcagtggctcacgcctgtaatcccagcactttgggaggccgaggcgggtggatcacgaggttaggagatcaagaccatcctggttaacacagtgaaaccccgtctctactaaaaatacaaaataattagccgggcgtggtggcggacgcttgtagtcccagctactcgggaggctgaggcaggagaatggcatgaacctgggaggcagagcttgcagtgagctgagattgtgccactgcactccagcctgggcgacagagctagactctgtctcaaaaaaaaaaaaaaaaaaaaaaaaagtatagtgtacgaagatgaagtaaatggagtaattataacagagtgaaatcagagttactttttaattgtatttttttaattgacatattcatggggtacctagtgatattttgataaatataatgtaatcagatcagggtaattagtatatgcattatctttaacatttatcacttctttgtgttgggaacatttaatatcccccttctagctatttgaaactatatattattgtgacctgccgtcatcctacagcggtatagaaccccagaacttattttttctatctagctataactttgtatcttttaacaaatctctccctattcctacctctcctttttctccccaatctctagtgtcctctctcctactttttacttccatgagattaactttttaagattccacatgtgagtgagaacatgtagagtttaactttctgttcctggcttattttgcttaacccataacaatagtcatgcgttctgttttctgacatgttctttccccccgttttgtcttaatagtccttcctctacctagcctggtatatgactatgtctgttcttggacactataacaactttttttttgccgctcaccttctcgacattgctatgggattcaagacattaagaaccatcttgtcctcagtaactcacaatggcaaacaggtaaacagtttatctttttcctcccttgcagaaaataaaaaagcaacaaataaaacaaagaaaaataaaactacccctcaaatgacaatgtacagttttaaagatttttttgaagggagggtctgcacctgttctaaactgcagggattagtagtttgagggtctcctaggcctatactcaagccttggcttgactttggataaattaactgaaaataataaaagtacataccttaccagatttttgcgaaaatgaaataaaaacaaatgtgtatgccttaacacagcccctggcccatatcaagcactcaggaacttagttattattttgttcctagtatagtatttgctccacttgctattatggagaaccaaaataggttacagaatcctgacccactcattgtattcgttgtaaaatatgagatgctgcattttaatgtagtatttttaagctggatattcatgtactctttacttttaaattgagcaaaaaggataacgtttcatatttgacaaggtcatgctgactcggaagaaaactggtctaggtccagaaaatgcacttacgttccaatggaacctgttcttaatgttaagacttcccattatcctgaagcatattgcagaagtgtgcactgatccgttcacttgctatttttcaagtgtccactgggtggcgacatattctgtgttagttatttggcttaacagactccttcatttccagagtcttgtagcccagcacattttaaaataattgcctctctaaaagctttgaactgggtccacagttaagtccacattatcatcagttttctaaatttcagcatgattcttacatatgtcactttaggttctgagtatgactgtgacgtgcacggcaagtcatgggtctagcgacaaaaaagtctatttatctgtcagttaataagatgtgtttgagctcccaggatatgcagtaaagaactggagatgccaaatgtatgtgtgtttctacataaaaggtccggcactactttccatttctgagctttgtggggtttctttttgagggatcaaattttctttgtttgtttgtttttaagacagagtcttgctctgtcacccaggctggaatgcggcggcgcgatctcggctcactgcaacctccgcctccctaggttcaagtgattctcctgcctcagcctcccgcatagctgggattataggcgcgtgccaccatgcccggctaatttttgtatttttagtagagatggggtttcaccatgttggccaggctggtctcgaacttctgacctcaggtgatctgcctgcctcggcctcccaaagtgctaggattacaggcatgagccaccccacctggcctcaaattttcatttgcagaaatatgtagagctttatagtcctaacaggtgaaacatgcagaaattcacagtaaccttgcacttcatttatagaaatgaatgaaaccctctgttaaggtaacatgttttctccagataattataaagtgattttgtaaagacttaatcagcataagcagttgcagtcaagaccataaagatgtgctgtaatcagaaaaagtacacataaagataaagcactgttagtatggtcgaatttctgtgatgaaaccagaaatacattttcaccaactgggtgaaaagccacatttttagcatatacatattctatcaaaaatactctacaattctatcatatacttatagctatccaaaaattaaagtataatttggaattaaaaacagattacatagagctgaaagacctttcaaacagagacatttaattatagattgagaaaaatagccttcaaaacagtgttggtcactagctgtggtatttttcactttggccattgtttacaaagcaagatttctcagttttaaaaaatatttatattataccttattactagttgtgtgtccccagatttcaggggcaatacaaatttctatttagtttaggatatgattgaaaatttaaaaataatttacagtcataacaaaaacgaaatgcattttattaggaatgtaatttatagaaaatagccctcataaaatgaagaaagggccgggcacggtggctcacgcctgtaatcccagcactttgagatgccgaggcgggcagatcgcctgaggtcgggagttcgagaccagcctgacaaacatggagaaaccccatctctactaaaaatacaaaattagctgggtgtggtggcgcatgcctataatccccactactcgggaggctgaggcaggagaatcgcttgaacccgggaggcagaggttgcagtgagctcagattgtgccacagcactccagcctggtgacagaaactctgtctcaaaaaaaaaaaaaacaaaataaaataaaataaaataaaataaagtctgacaacttgataaagagaatatgaaaataaatgtctgcatgagggggctaagaaaggtgagaaataagttatggatcccattagcttctagtaaacacggctgtgttctcactagagcactcgccgcccatgtagatgtcacgtgtcaattgtatgtcctacatttctaatacctggtccttgtcacattgttttccagctcgtattaaccgttggcttattagctgttgttgtatacctatacactgtggtggcattcaattttttccgaaaattctacaataaaagtgaagatggtgatacaccagatatgaaatgtgacgatatgctaacagtaagttcataacctttgatctcacataaacaaaaatgtctcctgcttctgcagtctaagtaattgtgtatttattctctaacagtacaaaatagaaaatagtctaaacaaataaaaagttgcagggctgtttaaagattcagcagttttcaattttagcagaacataaaggagcatttctgtcaattttccatatgtgctgcacagcctaataattagaattgctgagtaatgtacttagaactcgaaggagtaatgtcatcacttaagcctgttgttcacatatcccaggacaacgggtaaaactatttcccagagaacatttggaagccttagttttttgttcaccttaatgactttaactgaaattactaaatttcaaaaatatatctcttcctagaactactggtttttgcttttatattgagtatcttggcttaaatgtcttttttggtcttggttttcaaaaatcaacagctgttaaagctttcatattgctttatatcgctgttctacaacctgtctctctaatattggcagctgagaggtaatcatacatgagatcttagatcaggaaggggaacatgagacaaaatatatatcactagctggaaagagatgtatccttcagtaagctcctcacgaaaatacctacatcatttgtgttggggatgtaggtatagaggctgatataatgatacataaattactctagaaaaaatagcccaaaagattgatgagaatgaccagtattacaaagactaacaattaagataattttatactaaagaatgacaactcagtgggacagagtagttcagaaacagatgcaaatactcacggaaattaaaagatgataaagatcttttgaagtaatgaaatgaaaaataatttaataaatgacattagtaccatggacaagctatttggggggaaatgataaaaatggatgccaaccttgctttttaaataaaaataaattctgaaatgagcatattttaatgcaataagaaggaataatcacaagacagaatttgatgccttaaataatagtaatactcatttttacatggagaacggtctgagtatgacataaaactcaggatctatgaaagcataaacattatttgaaaaaagagcaactataaataaagtcgtaaaggcaaatggtaaactgggaaagatatatttaacaccataacaaagggccattttccttaatctaccaagtccttatcacatcaataagaaataagccaatagaagaacaagtaagtcacatgaccagacaattcacggtaaaattaattcagtgggcttgcaaatttgaaaagacgctcagcctctgtcaaagtgaaagaaatgcaaattaaaacaatgaaaaaaacactttttacctatcaggtttgcaaagtattcacgtttgttaaaacccacagttggtgaattgatgggaaaaatcagcattttcatgactctggttgggaggttgaattgacaacaattttagagaagttttgtgacacctatcaaatttttaagtatatatatcctttgacctattaattccactgctagtactttacctaaaggtttactcacaaacaagcctctgtatgttcaagaacattagctgccctcacaagctaggaataatctaaatgatcattagtagtgtcctgattaagtcagttacgataaatccataacaagtatgcatctgtttgaaaatgagagaaattcatgtatacagatatggagagatatataaattacattttaattaaattacatttaatttaaaaaaacaagatcttggatcagtaatgataggatcctaattgtgtgaaattatatatacacaataattcatatttttgatatgctggaatatgcataacatttttctggagggatttattcataggacactgtgaacaaggattcctacaggggtaggaccatagatcacaggggaaagaaacttgtttgcttttcattttatagactttactcctgtctgaattattgatactatttctttttaccataggtatttttttatttttaaaagcctaagacagttttttccccaccatgttatagaagataatctgccttcagttattcccacaattagtataactacatgcagtgactgttccctggcagggaggagagaacagaacatacaggtggctgacctgagggaattaaaggacagaggttgagggaagctctgctgaaactcgatgttacattttgatccactgcctgttcttgagccatttatttatagcccaaatctcttatttgtgtaaagaagtttttctgtatttaaaactttatcataaatgatcattaatatagaattgcccatcctttctctcctttaaacaagtattcttttatttactaatttagagagcttcagacaagattgtcattctttagcttttcaatattaagcattttgttctcttcccaactttctttttaataaaaaaaatcttaagaataaataactctcaaatgaattgcaggttagttaaaaattggggatacataatagcttgctgacataaaaatattcacttttcttaggtcaagattaaattttcgaaggcttggaacttcaaaaagggatgcttttgatggagaatgcagggggaaaaagctttcaactcatccttccacacatagttgacagcagagcaaatcatattgttcatgtgaaaatcatctgtaattttcaacatttcctgtcacgattgccgttctgaggtgtttcacatgtgactttgtggtttccacgtgctagtgacctacttggaggacacggagtatcagagctgaaaggactctgatgttcatggttgttcatccataaacttaattcctcaactggaagaaaatgccatcccagttacaaatccacagtcttgtagattttttttatttgtcaagtgcttatatagcacttggctataaatgctattgtcccaggcattgtctcaagagctttacaaatattaactcagtagtctcctaccaactttctgctgcaggttggcactgctatcattcccattttacagatgaggaaactgagctaccaagagtttgagtaacttgtcataagtcacacagttaggaagaggtgacactcttcaaccagtactctaagttacactacctcacagatagtaacttcattcatgcttctgtcattaattttagtgctatttttataccaggcactcgttaaggataaggcttgagtaagtacagtccctgccttcatggaatttgcatggtaagcacctttctagaaattctgctaagctcgttcttttttctgggatcctccaagaaaagagtgccccagaaattccagaagttttggaaaaccttgtggatcagtattcctatcgcatacagaacatttaatatactatacaaaaatagtggattcaacatcactgctcaaatattgcaattgagaagttgctttaggtggctggctactagacagggaaatagaaataacttattaatgtcacatgataccacagggtggaagatattgatacggacatagatcaagtgccttaatacttgagatccattttagtcatcataagttgtcatgactgagatgtaatacttacttacatttgctagtcttcttctccgattaattgctggacaaataattcatgcaccttgcctggagcctcctccctgactgcctttctatcaccccctgatttggcccacctgcccacttcttaaaaccatctcctatccttccttttgctgcttttctcgcaccacaaagcagagaaaaatgtataagttttttttttttttttaacttacagcaactgtaagaaaactggattcaatgcaataagactgacccgttactagtgacgactctccatcagagtcactaacatgcaacactttaccccctcctcccacgcctattcattcattccaggcctagggctgaagatgtgttaaggatccttcatctcctcttccatgcgctgcctttaatatcagctgtgctcagagcctttctaccctgtgaccctgaaggcaggaggggagtgggaggccaggaaaggctacaaggcacaagggaggtgcagaaggtagcagtagcaggtacattgcctgcagtgacttccaggaaattcagttctattctaggacaaacacccgacaaaatttataaatctcaatatctaccagcctcagggcagaaagtttacttaggttatgtattcctaaaggctatgatgctcagagaattgctaaaaattaatagaaaaataggaatgatttcagataatggcattcagtgacctgtatcaggtagtgagaacaatatgtgactttagatcttccttttgtaccacagggagaccccagcaacatcctggtctctccttttattatgcagtcgtcatagttgaccccattcaagttgtaatcataggatccttaaacgactacattttgaacctcactctcagtatgcatttccattacttttgttaattttgcttaggaagacaactgccttcacctggttgattttgcctaatttcatgggggcatgaatacagaagacagagaaacttggttccggtgaggaaatacggcctgttgatgttctgaactatggacttagctagagcctagatttttttcagtttgagggatttctgtcctcatgagtaagactatttatgaccagctctgttgtaggtttttatatctctacacataacaataaacttactatcttgtctttgactgggttgagtatatgtcttagatgtttcttccctgcaagagaaaactcagttccaagacacaagccactttttcatccctagctcattcacagtgacgggctgctgccaatcagtcaaaccagacaggagtctgtgtagcattacacacgctcatatcccagtaattgtccctaaaaactcccacatgggaatggaggccacattacctagattgacattccaattgtagcgtccaaacacttacttttaatttgcttcttaccagtacttgtgcaggggcttctttaaaaagccaacaaaatttaaaatataactgatcacttagagtagtgcgctttcaaagtacaggcttattaaaaccagcctgccagcaagaaagcagcacagaataggaaacaaagatttaatttctttaatttagttctcaaaagatgatcctttctttatgacagtctcttgaacgtgtcctttcacagggcgatgtctatattctctcttgagataaattttcctcactcatgtcacattttattcacttcatcctgagtttctttgttgtttctggttgtttctgtggctctgagagaacatcttaggttttgcaaataggcaactcgccctcctgtttttcataatttacagtagggggcgccatagctgcagtgttatagacaagtcacagggggatttttttttttttccagattaggatgttttgagcctgagaatctaattaaaccagcagtatcctgatagaatttgaacctcctctacaagaatgtaggaggagaaagagaaaaatgatgtaaagtccaaggtagaaagatgattgtggctagatagccagggagtctgacttgacatataggacgatgttcatctcagatggagagggaccccctgaaccagaggctgcaggggaaggtgtcaagacttatgcactttgggaaaaatagctttccaggtgattaagatgaaaagtacactcctagggaaataaacttgcttaggtaattgttctaaattacctcacttaattgttgtcacttactttaccctactttcccaacaaataatctgctccttttttcttttttctttttttttttttttttttgccaagatgaaggcctgataaggatcttcaccagcagctgaccctcagtgttccctaaagccaatagaaactatgatcaacctcagaatgaatctgtttaggagacggatgagggagggaagccacagactataacatcttggaaatcaacaacttcctcttctaaatttttgtaggaccaggcaccttccttcctcattactcagattgtctgaaagaagcacatctttttgtctcacagcattacttctttccacctccagctctcattatcaggtttaggctgattctatgaaaagaaaggtggataaaaggattttcagttgcagcaggataatttggtagctgaaagcctgacagccatgtattggaagttattcaccacatacctcctattccagcaccacagccaactacatacagttgtctaaggctgaccaggtagtaaaggatgaagctgggaaaaccagtatcaacatcccacaggtgaactgtacattttattctttttaaatttggtaatttattaagcctaaataatcagatgcacaagactgtcttttcagcatgactgttaagtccactaccgatctctgctggaatcccttcatcacaatgcataaagctgatgtaaaatgaaggagagcagtgaggaagggtatttccaggaaaggttgttagatggctgacaagagatctgcaaagaaggagacattttctttggtaatttagcctcattccttggtcctgtcttcaacattacatgtctagaaactacaagtgaatcattcttttggggacagactcacattaaccagtattacataagcctgatgtacgagtcagaataccaacatgctactcattaaaagttaatgcaacaagttggcacattctcttccctagacaaacacctctatgggaagccaaattttaacccaagacccaaagactcccaagtgcaagaccaagagtcttggtcagcaggaatcaccaagaggaactgatggatgatcagttcatccatcagttgctgggcaatcttagccactagtgctgtcacacgcagttcctcaaagaagcagggatggagagctaggacattccaagacctggactgggaactgcacaatccactgttggctcactgtggggattggaatggggacccaagagaccagaacttgacatggaggagtaccagtccagaaccaggtatactatccaaactgagtccccagagaaatccccggaggagagttgcaaacacaaagctacttgtgaagtcagagaaacgtgggcaatgggaaagatggtctaactaaagaggaaagaagctgtgttaaccactctttgttgatttcctgtagtcacaattaaatacatatgaagacacagatttggagaaaagcaatccaggctaggcacggtgactcaacgccagtaatcccagcagtttgggaggccgaggcgggcggatcacctgaggtcaggagttgttcgagaccagcctggccaacatggtgaaactccatctctaccaaaaatacaaaaattagctgggcatggtggcggacacctgtaatctcagctacttgggaggctgaggcaggagaatcgcttgaacccaggaggcggaggttgcagtcagtagagaatgcaccattgtactctagcctgggagacggagcgagactctatgtagaaagaaaaaaaaaaaaaggaaaaaagcaatccagttcttaataaaagtaagaaatgtgtggtaaaacaaattcaaacagtatgcctgagtatatggtgaaaatagtttccccttctcacagattcactgttagcagtttcaagcaccaagttttgaaaaactacagcagtagcttcaggatatttttttaagtgatggatggtctgtaagattttacttccagagattgactcagtaggtagtaccaggaacccagaatgttgccacgtccaggagactctgatatgaggttaggcttagaccctatcagcctaatctggctctaaggatctcctgacctttctgcaaaagagacccctaacctgggctccagatcagatcttgggtgggcactggctgagctggccttataatgctctttattatatgccaggctgagtctacaaccatacgaccctgaatgtgcccaatctcatccttgtatgccaggctgataaaacgtttccaaatgacacatttaattctgttccctaaattccagccatctaacccaggagactttttctcctctgcatctaacagatccatcagctgttgaactcatagttgaactatgagcattttgatatcaccttgttgactgctctttgcctacacattgtgctttttaaagtgtcctgagaatgtgagatctgtgggttgaggcagtgaaggctcctcattcatcccacaaatgatttgaggacttaccatgtgctggacgttattttaggcactggcaacagagtaataaccaaagcatttcttgttggaatgcagtcagtcctactggaatgagatagacaccaaaaaataagcaagctggatacccaagtgtggaattcaagaaaaagatccaggctggaaatagaaatgagtataattggcacagagatgatacttaaagccatgaaactgggaaaggtcccccaagggagtgtcctaaaagtaaaaagctcaaagaacccagtcctggggcatttgttcatgaagctacagggagatgaggaagatttggcaaaggagactggaaagcaatggccagaaatgaagcgaagcagaggagtgtggtgtttctgtgttaaggcttttgtccccatcattctggtcagcagcaactaactaggttttgaattgatgggtgacacatccattaagtcagggtatctggaacagtctaagaaaatctcagaggaaggattattaatttaggccctacaggatgagtagaaatggagtaagaatggaaaagcctattgcaagagaaggagaatgtacgagcaaagatctggaatcaggaatagttcacttggaggaggtatggggagagcggagagagcagagagggaagtttttgggaaagctgagtgtggctaaattcaaggcctgaaaaaggagttggaacttagcttaaatgaggataaaatattggatgctccaagccagtgactcaatccagcatgacttcatttgccaccccctgccccaggacatttggtatctggagatatctgttattgtcactatgaggtagggtgctattggtatctaaggggtagagatcaagggatctttttaaaatagcatacagtgcacaggatagcccctgcccaaggaattatccagccaaaaatgtcactggtgctgaagccaagaacactgccctaaaatgcactttagtgaacccctcattttttagcagtaggcacaggcagctgtacttgttggtggctttgacgttttagggtttaaacaataagatgctatttcctccccaggtctcctctcttttgtattctagatattaaagtagaaaataatttcagcatcatatttcatatatactatgtgagggaagggtgttagtatgttttcttctagcttaatttctaagattccatcttattacctgacctttccaatgtctgttatgtccaaaataaccaaacaatacaatatagttgtatgtccctgaatgtgttcgtaatatgattacctcattagcacagatggttcagagccaagatactagatacaagatgctagaaaattttccattttctccaaagtgagagagaaagtgctaggcggagtatgcagtatacacttttgtttaaaagacagcaacatgcaaaagccaaatgtttgcttcacaactagaaatactgaaacaaaaagaggcaatatagaatgcaaaaattctcatttccagagtgaggattaggaactacagagataactcgggtttgtcgagaaaaaaaaatgggtaatgtccctccaagaagtgataccatgtcttttttccagtgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtaagtatcctcctcactgaagctgatgaacatctagaatttgagccacatgttgctgaagttaatattcaaggtagggtaatgacgtcaagtgtttcctggcaaagccaaatcaaacttttccttccagtatttcttcatcatgcaatctaccgggggaaatataaagcggtatggaaccctggtatgaagggaagatacagtgttattttgtcttctttcaaataacataatggaaaaggcactttccttggtttgattctcacctctgggtttcagactcatgaaccccagctttacaatcttgggtgggtgagccatttaaccctttaaacttctaagccagctgggtgcggtggctcatgcctgtaatccaagcactttgggaggctgaagggggatggatcacttgaggtcaggagctcgagaccagcctgaccaacatggtaaaccccatctctactaaaaatacaaaactagccaggcgtggtggcacacagctgtaatcccagctacctgggaggctgaggcaggagaattgcttgaacccgggaggtggaggttgcagtgagccaagatcacgccactgcactccagcctgggcaacaagagcgaaactccatttcaaaacacacactcaaacccaacaacaacaacaacaacaaaaacttctaagccctgtggttgttgagatttttaaaaatgacatacaggccaggcgcaggggctcacgcctgtaatcccagcactttgagagactgaggtgggtggatcacttgaggtctggagttcaagaccagcctggccaatgtggtgaaaccttgtctctactaaaaatacaaaaattagcctggtgtggtggtgtgaacctataatcccagctactcaggagactgaggcagaagaatcacttgaacccaggaggaggaggttgcagtgagcagagattgcaccattgcactctagcctgggtgacaagagcaaaactccatctcaaaaaaaaaaaaaaaaaaaaggtgggggagggagggtagctggcaagatggccaaataggaacagctccagtctgcagctcccagtgagattgacgcagaaggtgggtgatttctgcatttccaactgaggtacccagttcatctcactgggactggttggacagtgggtgcagcccacagagggtgagcagaagcagggtggcgtgtcatctcacccaggaagcacaaggggttgggggatttccctcccctagccaagggaaactgtgagagactgtaccaggaggaattgtgcactccagcccagataccatgcttttcccatggtcttcgcaaccagcagaccgggacattccctccactgcctatgccaccagggccctgggtttcaagcacaaaactgggtggctgtttgggaaggcagcaagctagctgcacaagtttttttcatataccagtggcacctgggatgccagcgagacagaaccattcactcgcctggaaagggggctgaaaccagggagccaagtggtctggcttggcgggtcccacccccacggagcccagcacgcgaagatccactggcttgaaattctcgctgccagcacagcggtctgaggttgacctgggatgctccagcttggtggagggagggcatctgccattgctgaggcatgagtaggcagttttaccctcacaatgtaaacaaagccactgggaagttcgaactgggtggagcccactgcagctcagcaaggccactgcagccagactgcctctctagattcctcctctctgggcagggcatctctggaaaaaaaaggcagcaatcctagttatttacttatagataaaaccctcatctccttgggagagagcacctggggaaaggggtggctgtgggttcagcttcagtagacttaaacgtccctgcctgacagctatgaggagagcagcagatctcccagcacagtgttcgagctctaataagggaaagactgcctcctgaagtgggtccctgacccccatgtatcctgactgggagatacctcccagtaggggccgacagacaccttatacaggagagccctggctgatatttggtgggtgcccctctgggaggaagcttccagaggaaggaacaggcagcaatctttgctgttctgcaaccttcactggtgatacccaggcaaacagggtctggagtggacctccagcaaactccagcagacctgcagcagaggggtctattagaaggaaagctaacaaacagaaaggaatagtatcaacatcaacaaaaaggacgtccactcagagactccatccgaaggtcaccaatatcaaagactaaaggtagataaatccatgaagatggggagaaaccagcacaaaaagactgaaaattccaaaaactggaacacctcctctcctccaaagtatcacaactcctcgccagcaagggaacaaaactggacggaaaatgagtttgacaaattgacagaagtaagcttcagaaggtgggtaataacaaactcctctgagctaaaggagcatgttctaacccattgcaaggaagctaagaactttgaaaaaaagttagatgaattgctaactagaataaccagattagaggagaacataaatgacctgatggagctgaaaaacacagcacaagaactttgtgaagcatatataagtagcaatagccgaatcaatcaagcagaagaaaggatatcagagattgaaggtgacctcaatgaaataaggtgagaagacaagattagagaaaaaagagtgaaaagaaatgaacaaagcctccaggaaatatgggactatgtgaaaagaccaaatatacgtttgattggtgtacctgaaagtgacgggagaatggaaccaagttggaaaacactcttcaggatatcatccaggagaacttccccaacctagcaaggcagaccaacattcaaattcagggaatccagagaacaccacaaagatactcctagagaagagcaaccccaagacacataatcgtcagattcaccaaggttgaaatgaaggaaaaaatgttaattaagggcagccagagagaaaggtcgggttaccgacaaagggaagcacatcagactaacagcagatctcgctgtagaaactctacaagccagaagagagtgggggcaaatattcaacattcttaaaggaaagaatattcaactcagaatttcacatccagccaaactaagcttcaaaagcgaaggagtaataaaatcctttacagacaagcaaatgctgagagattttatcaccaccaggcctgtcttacaagagctcctgaaggaagcattaaacatgaaaaggaacaaccggtaccagccactgcaaaaacataccagattgtaaagaccattgacactatgaagaaactgcatcaactaatgggcagaataaccagctggcatcataatgacaggatcaaattcacacataataatattaaccttaaatgtaaacaggctaaatgcccaaattaaaagacacagactggcaaattggataaagagtcaagacccattaatgtgctgtatgcaggagacccatctcatgtgcaaagacacacatgggcttaaaataaagggactgaggaatatttaccaagcaaatggaaaacaaaacaaaacaaaaaagcagggattgcaattctagtctctgatagaacagactttaaaccaacgaagatcaaaagagacaagggcattacataatggtaaagggatcaatgcaacaagaagagctaactatcctaaatatatatgcacccaatacaggaacacccagatgcataaagcaagttcttagagacctacaaagagacttagactccccaaaataatagtggaagactttaacaccacactgtcaatattagacagatcaatgagagaaaattaacaaggatatccaggacttgaactcagctctggaccaagcagacctaacagacatctacagaactctccaccccaaatcaacagaatatacattcttctcagcaccaattcacacttattctaaaattgaccacataattggaagtaaaatgctcctcagcaactgcaaaagaatggaaatcataacagagtctctcagaccacagtgcaatcaaattagaactcaggattaagaacctcacttaaaactgcacaactacatggaaactgaacaacctgctcctgaatgactattgggtaagtaacaaaattaaggcagaaataaagatgttctttgaaaccgatgagaacaaagacacaacgtaccagaatctctgggacacatttaaagtagtgtgtagagggaaacttatagcactaaatgcccaaaagagaaagcaggaaagatctaaaattgacaccctaacatcacaatttaaaaaactaaagaagcaagagcaaacaaattcaaaagctagcagaagacaagaaataactaagatcagtgcagaactgaatgagatagagaaacgaaaaacccttcaaaaaaatcagtgaatccaggagctggtgttttgaaaagatcaacaaaatagacagactgctagccagactaataaagaagaaaagagaagaatcaaatagatgcaataaaaaattataaaggggatatcaccaccgatcccacagatatacaaactaccatcagagaatactgtagacacctttacacaaataaactagaaaatctagaagaaatggataaactcctggacacatacaccctcccaagactaaaccaggaagaagttgaatccctgaatagatcaataataagttctgaaattgaggcagtaattaatagcctaccaaccaaaaaagtccaggaccagacagattcacagccgaattctaccagaggtacaaagaggagctggtaccattcctttgaaactattcccaacaatagaaaaagagggaattctccctaactcatattatgaggccagaatcatcctgataccaaaacccggcagagacacaacaaaaaaagaaaatttcaggccaatatccctgatgaacatcgatgcgaaaatcctcaataaattactggcaaaccaaatccagcagcacctcgaaaagcttatccaccatgatcaagtaggcttcatccctgggatgcaaggctggttcaacatacgcaaatcaataaatgtaatccatcacataaacagaaccaatgacaaaaaccacatgattatctcaatacatgcagaaaaggccttcgacaaaattcaacagcccttcatgctaaaaactctcaataaacctaggtattgatggaaggtatctgaaaataataagagctatatatgacaaacccacagccaatatcatactgaatggccaaaaactggaagcattccctttgaaaactggcacaagacaagaatgccctctctcaccactcctattcaacatggtgttggaagtcctggccagggcaatcaggcaaaacaaagaaataaagggtattcaattaggaagaaaggaagtcgaattgtctgcagatgacatgattgtatatttagaaaaccccatcatctcagccccaaatttccttatactgataagcaacttcagcaaagtctcaggatacaaaatcaatgtgcaaaaatcacaagcattcctatacaccaataatagacaaacagccaaattgtgagtgaacacccattcacaattgctataaagagaatacctaggaatacaactttcaagggatgtgaaggacctcttcaaggagaactacaaactaccacttgaggaaataagagagaacacaaacaaatggaaaaacattccatgctcatggataggaagaatcaatattgtgaaaatggccatactgcccaaagtaatttatagattcaatgctatccccatcaagctaccattgactttcttcacagaattggaaaaaactactttaaatttcatgtggaaccaaaaaagagcccgcatagcccagacaatcctaagcagaaagaacaaagctggaggcatcacactacctgacttcagactatactacaaggctacagtaacaaaaagagtatggtattggtatgaaaacagatatatagaccaatggaacaaaacagaggcctcagaaataacaccacacatctacaactatctgatctttgacaaacctgacaaaaagaagcactggggaaaagattccctatttaataaattgtgttgagaaaactggctagccatatgcagaaagctgaaactggatcccttcattacaccttatacaaaaattgactcaagatcgattaaagacttaaacataagacctaaaaccatgaaaactccagaaaaaaacctaggcaaataccattcaggacataggcatgggcaaagacttcatgactaaaacaccaaaagcaatggcaacaaaagccaaaactgacaaatgggatctaattaaactaaagagcttctgcctagcaaaagaaactatcatcagagtgaacaggcaacctacagaatgggagaaaattttttgctgtctatccatctgatatacagctaatatccagaatctacaaagaacttaaacaacttcataagaataaaacaaacaaccccatcaaaaagtgggtgaaggatatgaacagacacttctcaaaagacgacatttatgcagccaacaaacatatgaaaaataggtcatcactggtcattgaagaaatgcaaatcaaaaccacagtgagataccatctcatgccaattagaatggcgatcattaaaaagtcaggaaagaacagatgctggagaggatatggagaaataggaacacttttacagtgtttgtgggagtgtaaattagttcaaccattgtaaaagacactgtggtgatccctcaaggatctagaactagaaataccatttgacccagcaatcttattactggggatatatccaaagaattataaatcattctactataaagacacatgcacacgtatgtttattggggcactgttcacaatagcaaagacttggaaccaacccaaatgcccatcaatgatagactagattttaaaaagtgccacgtatgtaccatggaatactatgcagccataaaaaaaggatgatttcatgtcctttgcagggacgtggatgaagctggaaaccatcattctcagcaaactaacacaagaacagaaaaccaaacgccacatgttctcactcataagtgggagttaaacaatggtaacacattggggggcatcacacaccagagcctgttgaggggttgggatagcattaggaaaaatacctaatgtagatgacaagttgatgggtacagcaaaaaccaccatagcacgtgtatacctgtgtaacaaacctgcacgttctgcacgtgtaccccagaacttaaagtataataaaaaaaggacatacattcaagtacccagtctaatacctgatgcatagtcagtgctttataaataattataaagctattaatagtatcattgttgaatacctactatctgcccagcacatgtattaactaattttaccatttcaccaaccttatgagaatggtgctcttattttatgcatgaagtaactgagccacaataagtctaaggaacttggccaaagtgcacagctaaacagggctggaatccatctatacccaggcaatctgcatccagaccccttcaaccacggtgctgtattgacccactagctcttccttttacttccgggcaacttggagtgtggtgtttttctctctcagaaaagtcatgttatcttttccgcttaacacatgtatcctggcttgaattaaatgtctgtaaatgtgacaatctcttttaagttccacagacatcaaatgacactattttttagtcaaataccatggacaagcttaagggactcataattcattcattgtgctcttattgagtgtaaaaataacgtgttttctaagagggcaaagttataacttcgaagaaagtgtgaagccagcaggtctcaggagggaaaaggagcttaaaacagctcaacacagtgtttctgattgtcacagtcaatgaaattatggaagcttacttataagggacttgtgaaaaaagtgatttggggcctggcaccatggctcatgcctgtaatcctaccactttgggaagctgaggcgagaggatcgcttgagcccaggagtttgagaccagcctggtcaacaagacgaaaccctgtctgtacaaacagaaattatcagggtgtggtggtgtgcgcctgtaatcccagctacttgggacgctgaggcaggaggatcgcttgagcccaggaggttgaggctgcagtgagctgtgattgcaccaccgcactccagcctgggtgacagagcaagactgtctcaaaaaaaaaaaaaaaaaaaaaaatgacttgactgggcatggtggctcacgcctgtaatcccagcactttgggaggccgaggcaggcggatcacaaggccaggagatcgagaccatcctggctaacacggtgaaaccctgtctctcctaaaaatacaaaaattagccaggtgtggcagtgtgtgcctgtagtcccagctgctggggaggctgaagcaggagaatggcatgaacccgggaggcggagcttgcagtgagccgagattgtgccactgcactccagcctgggtgacagaatgagactccgtctcaaaaaaaaaaaaaaaaaaaaaaaaaaaaaagacttgaggcagatttcttcgtttaagtggtgatgtttcatttctacattagtacttgaaaaatctgattagtggagttttctgtacttataaatctcagctgctctttttcggcatgaagtatgtaataacatctgtatatgccaagttaacaaaaggtttttcctgctgtcacttcattttaaaacactcttttcagtgagtgtatgtcccagtaactgcacatacttctgtccccaaagacagaacaccgcctcctttctcctaggagtatcggatatgtagtcacgtttaccatgttctgagcattttgcaaggtagttgtacatctcccctttccctggggggattagccaaggaactgaattattcattgcttgataaagattaaattgtgtttttatttaacaccaggtctaattattgatgcttttggagaactaagagaccaacaggaacaagtcaaagaagacatggaggtaagcttctccattcatgactcagcttctttgttgtcctgggccctcgttttcctcactacctttatcaatagaatcatgaatgtgggaaggaggagggggaagggcacaacttgtggtttcactggcgtgttttccattcaagcaatacatatagttgagctgcgtggtcggctgaaattgtggtggacgccacatgcatgcaaacagcgataggacaccatcctttccctccagaagtggagagactattcattcgaaaccaaagattcaatgacaagtaaatagatgattacagagcagtgtggtgagtcctttatgggagtaaagccctggagtggtagggtctctagggctggtatctgattcactcctggatggtcagggaatttcctagaagaagggatgtctgagctgaggcctgaagactgtggaagtctgtgggtttgataaggagagaggaggacagtttgggcaacctcccaaccccttctcccacaccatggacatctccaggggtaccattcacagtgggacctttgagcccatcaccacctgaaattatataccaagactgattttagggaagttgatgtgcaggtttttttcttagcagcctcagtgctaccagatgcagattaaattctgatgatgaggctggagaggaataccagtgaatgaagaatataatcactcatttgagaaatttacagtttaatatgtgggctgtgggaagcaagaaaagggctttaagcagagcagccagatgatcagatttgcattttaaaaagataactatggtttaaaatgtgaggcatgaagtagaaactggcaagaacagggacagggaagtgggctgtcagcattttccaggtgggagattctgaagcttttgctagaggtggcacatgggagttgggcaagtactgcctgaatccatctagtttctgcatcctcagcgagggacttggtgactgaccaaatggagaagatggagcaagcaaggggatatccaggcttcaggcattagccaccagatggatggtggcatagttagctgacctagggaacccagaggaagaacaggttcatcggtaaagctgatgagtgtgatttgagccacttcaatttaagagacatcattggagtggtatgaagacctgatcgattgttctccccagttgctcaatgtgacctatcagctgtcagcagttgttgatcagtaaggcaggaagaattttatacactattataatcatcttgattgtagttcctaaaatacagggtctcataaacatgcttcagatggcataaaacagcttacaactggcagggaaggatgagcaccagagtcacatgggacaattattgaatacattgcttctccttgggttttgtggaccaggcctgtctgcaaggggcagacctaagcaggtgcccctctacagggtgcttaggagaggcgtggtccagagaaggtggaaccaagaggaccaggaatctggtccctagtgccgaaagttgttctccattcacatccactggctaattctgtacctagcacagcacctggaagacccttgctaaactgtagatgggatgtctcatagcttggtatttgatttggccttttctaaaggaaagtaatctgtacctattcccccttggtcgtccgactttgtttgggtgggtactaagtttgtagtttcagttgaagacacagttaatcctgcttagataactttagtcaatgtcatgaacaagagttgatcactaagcctggacattttcacctaggctagagaaaggaagagacgttgcttttcagccatcatcatcatcatcttgttccctgtctgcgtctgctacttcttgctgctggtacctgtgtcatttaagccaacaccaagatatagttacagcgacagttccatttatattcgtgggcttggcacagcctccatgtgatgatctttgacgtgtattgagtgaaccaaataatagctgcccctacatggcgagttgtgttttccttttgttttgctttctgaactctgacgttaatatttccctttgttttctagaccaaatgcttcatctgtgggataggcaatgattacttcgacacagtgccacatggctttgaaacccacactttacaggagcacaacttggctaattacttgtgagtgtgcccgtttcagaatcttccacctctccagtagacgccactggtccctgcccatctcagaatagagaggaagtttttgtttattgtttaaaaaataattgctgcagatactttaaaagaaagtccaacagctaatggctctcttttcctctggagtaggttgacttaagaggttaagttgcagctcttcatgtaagtgatgctttctagaacttgaaatgaagaggtggacagggaggagcagggcctctgtgggagtcttggtcatgtttctcattttagataggaattcttaggctgcttcctagggagatgcgagtctccgtttttcttcttacagatcttaagaggactttcagatctcgtcaggcactgttggataccaacttaaaagctgcatttaaaaaaatattaatacatagaaatctttccattactcgagattagccaaaagtatagtttggtaaaatgctattcttactcattttccgacccaattttagtatcaaacagaagagatgccgagtagcattatagggaaaaaaaattggcttaactatactcagtggaacttgatcagtaaattacaacttctcattaagctagtcttcagttctaattcatcagtgttgatttgattctgaccagtgtgtatattcctaacttgaagcctctagggtcaaatagcaacagatcagaaaagtcaggtccacagcctttcctctttctggtacactaatttttccaaaaatttgcatgtggcgttttctctgtgctggccataattgattgcaaccatacaatttatctaaatatgccctgtttatcctaatatttccataccgttcatttctgatcagtttctctgtatctgtaggttttttctgatgtatcttataaacaaagatgaaacagaacacacaggacaggtaggtaaattattacatgtcatcttctgaaagaaatgatagagaagctctaaatatcagaacaaaatgtgtgcattaaacagtgaggcacggaattactttcagatattagttgtggtatcttgatgtaaagttcctgttatgttgaatgagtatggaaaagattgcctttgttaaagtagaattctgtactaagtttatgtaacacaataagcttttactaactgaaaatgctggatttgagttttgaattccattattttgaaaaattgagttcttaattattgcataatgtctttgtttaatcagatagatgatttccaatgaacttcaaagtattatgtacaatgcatgttaaatgcctaaggtgtttaagctatttgaaattcctcttccactgtgcagattgttagtagtttgaatttgaaggatacgatattttaagagaaccctcagaagcataaatgtatatatatacacacacacatatattttttgagacaaggtcttgctgttttgccaagttcaagtggcatgatcaggacctactacagccttgacttcctgggctcaataaatcctcctgtttcagccccacaagtacctgaaactacaggcatgcaccaccacacctggcttttttttgtgtttttttttttttaattttagtacagacaagatctcttatgttgctcaggctggtcttgaatgcctgaactcaagcgatcctcccacctcagcctcccaaaatgctgggattataggcttgagccagtgtgcccagccaacatatttttatcattataatggtcaggatgaagattattatgagacgttaaggtctggtatagttagttaggaaccatctaaattaatgtggacttctctattccgtgcgatataggtaacagaattgagtttctaccttatgttttgttagcacacactttggggaaaatgttaatacatttccttgacttttgcaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcgaagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgccccccccccccgcccccgcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggccattttttaatatcaaagctgaagcaatatccattcagggatttcatcagttgcatcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaac

SEQ ID NO: 1412 - DNA, 1114032 bp, Homo sapiens
tgtgatagtgttggaatttaatcacaggtttacttaacttggattccattgtcttttatagagaaaaagcatatttatgaaattagtattttaatattgtttgcaactaatactgtatgagtttatggtttctggcatatcaagatgaacaaatataacaaaagtacatttaatggctacatctttaagtgtatgaatatagaggtctttaatgactagttaaatccagaaaaaagagagtcaacattcttcctctataatataaggatgggtcttcccttcaaatgcagccttctttactttcccacttaagcacgaaatggtgccgcatataatttttaaaatcaataaatcacagttgtattaagaaatattttattaacaaaacagtaaattccacttgcttagcatttccaataatggataaattggccttgcaacagaaaaacaaacaaacaaaaaaagaagaagaaaacccctttgatacccaatcacacaaagcactagaagggtagggttatgtggcctttctttgatgtcttagggattgaccacttcacacgttattgtagtatttgttcttttaaaaaaggcaacacattacatggataaaaaagaagcataatcaatcagaaaagttacagtctagagatgtaatcaaatttatgccaagtcgtgtgaaatcctcaatcaactgcaaactatgcagggaaccctgatatgtttggtatgaagatacttgggattcaagtcattttctctttctaactctgttcctctcttttctttttccattgaggaaaaaataatttttgctagagtttgtgtaagccaataatattagaaataattttgctgataataaactatatcaatcattgcatgtaactttaaaatttacgctggggagaaacattgaaatcaatcccaaacaacacatttcatagatatactgcttaaaattaccattattcaatttattttctattatattttagaatctttccagatggaaactggttcaagcttaatagataaaatagaaaagcaatcttaaaaaaaaaaacccttcaagctgtaaattagtagttttacacttcccttcttatttaactggctttccctgagtaagactgaatgagacgggggaaaagaaaagactcgtgaattatttaatgtggcaaattaaaaaaaatgaaaatctagaaaagaagcaatggatattaaattttcattttataccttctactttctgggtcataaaaagccactaaatttctttgtacacaacaattacttggcaaccatagatagtggtgatttgctatgaattatacatatttctaaggtgctgtatgtctgaaatccaggccacttcttggcttttttttcatcaactaaagtatcacaaaagatgttttgcattttttgcctttgctgattaaagctaattggaaagatattcttctcttctacaaaattttttatcgttcttttagaaggtattcaagtaatgcaaccaatttttcctgaaacatcaacttgcaatgtaataatgcattttttgcactaccttctcatattagtaatttattgctgtgaacatcattgaataatatgcaaaacaagtgtataatctatacttttccactacttaatgtgttaaactaaaactatatttaatgatatatatgtaaaaccagaaaagttaaaacatagtcaataattaacagagaatgattttttaagtgggtagtaatacagaatcaaaaattactgaaaaatactttcttagtcgagagaaagtgtttactttccagaaatgttcatcatgcacatcagattcagagatatatatattattttattagaaagaaagttttcaattgcagcagccagagttaaggtgtagattaaccaattttgcttccataacctgcccacataatggttcttattcatgcagcagtatatcagtgatattctatttgataaggaaaggttcatttctttagggactaaaatcttcttaaggttacctgggagcaagatctcaatgaagcaaatcaccccatttgtcatcaataccttggcacaaccctcttccttcctgcttttcaatttgtcaataaatatttgctactgtatgcacgtttggatcttccagcatatctgatggattgctgtggattcgtgtgtgtgtgtgtgtgtgtgtgtgtgtgtgtgtgtgtgtgtgtgtgaaaatagtgaatgtatgtgggaatgtgagtatttcagggagaaaagattataagatacatatgtatatatgtgactttctaattcacacctttcatacaagtactaaaacttaattgcaacagaatgaaggctgtacatataagaaaagaagtagctgagtctttgtatatacattcatacatatcttccttagaataaacactacactgtaatttctttaaaaaataaaagtaattgtggcaatttataatggtggcaaaaaaaaagaaaaacccaactgaaataattgttgctctgatgtcataaaactccctatacttagcaacacttataacattgaatttaccaaaaatggctgaagagcagagatatattttgcattttctatacaacaggctataaaacgtcacttatcacagtccagaaagcacacagagatggattttatataaacatatgtaataacataataagcgtgcatgaaaatttcccaatgattgcatctatgccctcttgtttttgttttgaaattttgtgtgaaaacgtgccttatatttcacatttttgaaaataaggcctccatacttttttttcctctctcacaaccagaaaggggctttttgaatgtgttcctacacaagtcttcaaaaaagccagcactttgtttcaaatgcaagttccaaccactgctccagttgcaccaggcggcaaactcttaaaggtttgcaggttgagtcactcaaaaggacagtcttctctggcaattggactgacttctcaggaaagcgctagcactttggctaaatccaggatcataggtagcttcttttttgtgttatgttttgtgttggtttttgtgttgtgccttgatgctgtagtactcctttgctttatgaatgcgtgcggtcatcactgtcttttagaaatgttccagcaacataaagacaagcagagtaaatgaaaacactgtggatgttagggaatttattggcccctgttttttgttttttgtttttcttttttgagaaacaagagcatgagatacttgtttttattttttaaaaagtctttccttcctgattgcattccctgtcttcttttgtatgtgcttcataaaaaggaaagtaaataagtttatattatgtctcagataaaatgaagactatttctatacaagtgtccatttaagatcttgggatcagacataatactctttatccttgtttttcttatttttgttggagcttttcgcactgctgggttgtttctcctttacaacagccccattggactgtgctgagttactgatgtagtttcgactctcgtccacatggtatgagccttcatcccggtttctgtacttgtacatggcatagaggaggataaggatgcacagggcggcagcggctactatcccaacgaccatacccgtggtgctgctggactcccggatcacttctgctgagcctggatacggctctctgccgcctgctcgggttgggttggctatagaaaagaggatgagaacaaacacaaagtgatcattgagttcactgaataccagagagctatattaacatttattatctaattctaacagcacctatgctttaggaaaggtatgctattgataaatgtagccatccctttgcctcatggttactaaaaactagggactgtgatttaaagttctctgggagatttgttgctgtgtcttctttcttcacaaatcaattttgttcacagagtttggtaagcattgtcccaaataaactccaattagctctaaagggccatgtgggtgacttaagtaaaaaaaacccacaaacccagcataaagaaaagcagaacagccctaccctataatactagagggaatcataagaatcaaataggtgttgctctagaacataggtctaactctagactgaatcaggacaactaaatttaggattactttagaaatcatattccccttgtattttaaagaatacagtattgaacaataagataatccatacattttaactgtctgctttttaaagtataactttagttacatttttataaataaaaatagactaatttccattttgttggagattcatttgtttacataagtatgtgtgtattttattaattgattggggagctcccaagatgaactttggaggagaaagtaataaaatattctttctcagttttaaatacagtctagattgattttttggtcaaaactctgaactacctaatagattagataataatagaaggctggctagtctagttttattcaactgacaaaacccttcttcagtcttcccaaagtataaataaggctctttcttggatgagaccaatggattttggggtgcctacgtcttcttgaaggcctggtcaggcactgaaattgatgattgatggggaagaatggacctgagatttaattggtagatatgaggagaaggggcagctcttttcccctatatataataaacttttttgatataaaaggatagaaactgtagcgagagaagaagattctatcctactctgactgtaggtcattttttccttgtgaattgtgttttctgtttttccctgaatctctatcctctcgcttgtcttacataaaaatattacttttcagatgtaatgtattaaaaatgctacaactttcaaaacactattctttgccaattatgtataatgaacaaataatctcatgattccatatatattagataagaatgtgtgtgtatgagtgtgtgttcatgtatatgtaagaactgaaaactcaagaagactaaaattgtgcttttatttcgctactactaaacatcatttagtaattaattttaatatttctgcaaaagttcttgttaattactgggaatcattttaccaaacatatggctctatactgctttgtaattccattttcaaatatcaccaatatttcttttgcctaaacgtgtgtgtgtgtgtgtttttctgtgattttcttttccttcctcaaataaagccttaacaaatacagccatttccaaagtagtagctcttagtctcaaagtagcaataagctatgttctggtgctacaaaatgtagcaggtaaaactttttatgctgaatgtgtcattgcttgttttacaaaagcccacggagtgtggctgaataaaaagctttggtgttgcttctgtggacaaggtgaaaggagacaaagactataatccacagtatttgattacaggaattaatttcctctcatgaagaatagaatctactgcagtaactctgtcactacctgacaaaccaaaggcagcactttttcttttaaatacagtcatctttgccaaagtgtgccaattaactcagctgctttcactaaatgaaaactttcattttacagagcattcttttactatggtgtctcaagagctaaaaagggaattttgtttaaatgttacctaaatcattttttccagcctgatggaatgctttcattttaaacacattttcacaattacctcacttttactctgtctgccagaaaggaatagggagaatggagataacatttgaatcatttagcttatgacagtaaaatttgagaattttaatggagtggagggtttatattttgtatactaagaatagacatgtatttttttcaataaggaattgatatcgtaaatggactatcttatcaaaaaaattttatttttatctgctaaaatatttctgagaggttttcaaaacaactatgcacatagcatgataacagcaactttgtgttaaaataagaatgaggtcacaaagaccataacaaagcctgaaacacttcaactgtgccatatgcatttgaaaacatctcctgtttaaggaaaacactttcttttttgcaacactagccaaattgttgcttaagtcatatgaggcctaaaaatatctctacacaaaacccagatgtaaatcccagatgtaaaaattctaaatatcatgtttcttaaaaatataacctagaaaatctctaccaaaattaaaatctaaacccaataaacatgttatctttcttttccccagattcacattaaaattttaataaccatcatagcagatattattataggtatgttcggaataggtagttactccaatatctaactgattaattaatattctttttctatttatgcttcaaatctgaaggctaagtgaaatttttcttaacttttcttctgagactagaaatatttatgtgttggtcgggtgtggtggctcacatctgtaatcccagcactttgggaggccgaggcgagtggatcacgaggtcaagagatgcagaccattttggccaacatggtgaaaccctgaaatacaaaaattagctgggcatggtggcatgcacctgtagtcccagttacttgggggattgaggcaggagaattgcttgaacccgggaggcagaggttgcagtgagctgcgatcgcacactacactccagcctggcaacagagcgagacactgcctcaaccaaaaaaaaaaaaaaaaagaaagaaagaaatatttatgtattaatgggacatctctcccagatatgcaataacaggccaaagagatttaaatatattcatgaattataaatgtggcttctcttattgtcgctaatgctttattttgatgatcactgagaaatctctgatgaaattttatattaatgtaaatgtagagaatagtatcaatgactaatatggttaaatgtctttttatataatttgttcaaaatttatataaaaggtaaatgcagtcatctcatccatttactaaaatgtgaaaaaaagagaaacataattaatttgtatatttcatggatttaagaattttgcattccctctacactatataataaactaaaataagacatttttaaaaaattaaagcaatctgcaacatgtttttctcttagcagtgctgaaatgtgaataatgtaattaattaaaatttactttcatccttttctttctttgtcccagcacgtgacaaagaaacaagtgaaagagaataacttgttaaaaaagatttaacttgttaaaaaaagcaagtaaaagagaataagggagggggagctaaaataatggcatacacacaaataagcttaagtctttaagtcttgaatcttcaaagattaactccgacgtgtaggtaaaattaagccgatgtagccagttcattatattgggcccaggggcataaggaactcggttcaatggaaaacttcagtaggactgacagtggtctactacaagcaaggagagcaagaatgcacaccttcatcacaatacaaaggcttttgacttttgctggcatttttaacctataaatgatttggaagctaatgattattctagcaaggaaatagagcagtacaacagttatgacccatttcatatttatattcacttctttctcacttctgagattcatttagccaaatggctatagaaaaatccctgggactcttgcacttataaagcatgttaccttaaaggaccactgaaaagtagtttttaatccttcctctctcttctagcatttggtaagatacggtggtctctagaagttttccacatggtctgctttgtccctgtagatttatcaagaatcctatgaatcttcttgttttttgttgtctaatatgtattgtggtaacttcggtaaacacgagctatcaaatgtttggacagttagtaacctatttctgcactatgctctaaatcaatttgttcatatctgatgataattcagatgataattcattgtggaaaatgaacagttactactaaaggcatattctagtgccttgtcacatagaaaaaataaatgcaactgttgctctccattaaaaagtaaaaaaaaatctttaagattttaatttgtcttttgctgagatagttattttaaacaacaacaggaaaggaaatcgccctatgtattatttatttatttttgatagtctttgatacagtatctgtgaaagaacatcatttcctcaaattagaacaaatttagatccaattaagaaacacatggggaaaatatgtttgagacacattagacttcagtacagaccagagagggctgtcagtgcaggcttcatctcttaccagcttcttgcaccctctgttgcttcctccattctcctctgtatttctcctcccacttacccttctttattgcctctgtgccttgctcttccagctcctgaattatccttgtaggggccctccccacccccaggtaaatgaagaaggtcaggccagcaggggccaggactttttgcctcatgggttagcatattactcaggaaggtgttcaataaaccacaaaatttattttcaagttctgaatttcaaaacacaatgtaaaataattcttactggcacaaatgtctaagtgtgactatttcaccagaacaggttttgtgtttcatattggcatgattacttttaaatataactttctaaatttgtttgcaaataaaattgtatggtttggcaaaacaaataatatttgatcactaatttaaaagacttttgtgatgcatctggtgatatgatgggggcacattaagccattaaactttgcattgtatttatcagtttgcattgtttgattatatctaatcacaccttagcatatgcaaacagaagttaaagcttgcaattacttagtacaatgattcacaactgaagtgctaaaataactaagcaatttgaaagatagatacatttttgaatgttaataaatttttccaaggagatttccctttgcaatggtgacatccttcatttttctttttgaaattggaaacagcaatcaattattgtcattaaagaaaactgctcttgatctatgtttttgcaactctgcatgataaatggtgtttaaaatcctaattcctgatatagaatggggtttggtgggtggtgggaccttatctttctattgacaagttcaccaaggcattagcatgccatcagatggtctttttatcactcaaattgtcatttttatgaaattattttgtatacttgaatgagctgttcttccactgtaatcttatatatatattttggttccaaagttaactttcaaggtaagtttgtagtttctaggtaatttttcgggctggttttatttcttcagtatagactgttaatgtatgtgtatgtcgtcaactatgaacctggcacaccaaggataaagtaagagtatcattataacctgatgacaatggaaattcagcttttgagctttgagaaaaagattgtaagaaactaccaatcttaggaaataataaagaaaaaaacatgctagtggttaaaaaaaaaaacataggctatatatttaagatcaggaggggaccataagggatcattaaactccataatgcccagcacgcatcattctgctaaccagaattgttagatgtcctgtcttgcaatgatccttaaaaaaaaaaaaaactcttggcaagatgcatttactgaatttcttctcactaagagtttctgaccagtctttctggttttctcataaattaagcttaaagtaatagattttaaatttctgtctccaccccacctaggaaagagttgcctaaaatgatctcattagaccagagttctatactgtgtctaatagatgtggaagttattataattctaggctagacttgaaagtgattttggatttatagggggaagatttgacttttccaatactcagtttcattaatactgtgaaaagaaaattggaattgtagcctcctggggtgtttgtgaattgagattagcacacttttttcccccatttgaaaaaaaacaactcaaagtttattactttttcccatttttttgcttcaatacagtgtaggccagaagaaacaattatgatgcaatcattcacaagaagccatgtttaaatactacatttgtaggaaagcagggacacaatgatttatatgacatgcattaatttcgactcatgcggtggttttgtaagaagtgagggatgctgactgtttcaaattccttcccttctccctcccaccaattccacccatgcctgcacattctgaagtacacttacggaggtcagacaagtcttgagagaggacatgtctgacacatcttagcccttccccaatacatcggagatttagaaagaacttggaaatcaataaacctttgctacctgcctggctgctgtctccgatattttcctctgcttctttcaaaaccaccaaagcatgcatttgaagggcagttaaggggccaccactctgatattgagacgttcattatcttctccagagatctaggtattgaatgggaagggatgctagacacggaaaaactcatcatgtgcctgcatgatggagaaacccaactaggacaggctgctacctcatatggtaccacatcgaacagaagagacaatggatgtccacactctgtatgaccttggtgacactgaagacaaataaacagaggaacatgcacaatctccctcatctccaggggaagccataggatcatggtatttacaaatcttattcttcaattattcactatgttgtaaactatatgtccacagcttagtcatctataagcttcatagactttttacatagtcattgtatccttgtggtttgcatctattatggtgcttactccagcaccatggtccttactgttcccatggccattcatagtctgttcacagctacctactccaatttgtcttccatatttgtcaaaggaagttagagccataatattattgctgtccccaactcctcacataccaaaaagagttcaacctttatgccttgctcatataaccttttatctcctgcctgtttaaatagtacttatttctcgaagcttggctcaaatgtcccatcttttatgattttttttctctaagaaaatcccctccttctatcaacgagtatataatgagctatagttaacattccagggactatatgaggtcctgagggtataggagataacgaaacaaacttgatgtatatgtcctcatggaccttaaaatatagtgaggcagagaggcatacaagaaggaatcacacagttaaagtaacagctgggatatgcatgatgaaggaaaactgtaggtaccatgcaggagtaggacaaaggtttctgattgcaactgcagaatcagatctttctgaattagtgacacttatgataaaaatgagtagagagtcgtcaagtgaaagtgggtagagaagtctacgaaaaacatgtcgaatgaccttgaggaaacaaagtttacttttcaggaattaaacaacagttagagtggttgtagcacagtgagatttaagggagagtgagaagaaatttcaaggtggacatgaaatttatcacagagactgtagactatggaataaagtcataataaaaagatgagcgtatttaaccccataaataacaattttatgtggcaaaagccataatatcattaacaaaatgaaaatgacaaaggagggaaatatctgtagtacatatgacggaccaagagtaaatacctctaaaatacagagtgtgtgtcaactgataggaaaaaagacaaacaacctaacagaagtatggagaaaactacacacaagcaagtggagaagagatctcaatgctggtgagaatattcttaataattatttgattgttattagaaagtaatccaataacatctattaaattttttaaaataaataaattctctcaaccgtatatcacatcacaaattttaacattaattctatactattgtaaaatctcacttaaatgtttcatccaatagttttgtcttttttcaactagactgttggtcctttgacagtttcctgtgactctgtttctctttcttattagttctctcaccttccaaactctaatgaagattgaacacactggctgaaaactgcatgttttatgtatagttagatgaaagcttttgtaacttgataaattttcaagggtaaactaggttgaatctaatcattaagaaagtgtgaaagtgtgaaagccaagaactgtgtggctcacacctgcagtcgcagcactttgagaggctgaagccaggtgttcaagaccagcctgggaaaaagaacaagatactgtctctagaaaaaattaaaacaaatattagttgggcatagtggtgcacacctgtagtcctagctactcgagtccgaggtgggaggaccatttgagcccaggagtttaagaatagagtgagccacgatcatgtcactgccctccagcctgggagacagagcaagaaagtgagagacctttgattttaaagttttgagtaaaggtgctaagcaagggggttgaacactgacattaacatctcatatttctttaactcactacttctctaaccctcaacctttgtaatatctgcagtaaaaacgataaatgtaatatttacttcattaaatcagaaatcacttcttctgtgctttggagaattgggatcaatatacaataatgaaaatactgcatttgctttccctatgcttcaaggtaatatgtcacttaatcccaatgactaaagtcactaagctatttaaagttaactgagtcatcagtttgattcatttggatgccttatttacatcaacatcatctgacacccacagtactgcaaatagttgacagctaacttgagctcttttttcaattcagagtagttgtagaaatttctagggtgcttttcagtcctgttgctattggaattgaaaagggtctctttactcaggcccaactttccataattgtcaagcagaagaaagccatataggcaataattgagaaaatcagtttcaaaactagggaccccagagagtctgtatatgtttttcctcaaaatgtattacattccagaaaaatgcaagaagagttatattttgaaatgtggatgatactccttattaactgatttcaactcaactgagcttcttgataccaaaatagcttctcttcctgggagctcattgactacaacacccaaaaatatatacatccagaaatcacttttcttaagatccatttccttttttatatatagataattgaataatctatctttacaaaataatgagatttattccacagaattcttaaggcctgaaactagaaatttttggaaaacctggtttatagtaagacaaaaatggcaacattatagctagagtaatgaggagtatgtgtgtgcatgtgtgtgaatgtgtgtgcatgtgaatattgcagcattccttccaattctctctcagaagttgctgagtttgctgggcatggtaattcatgcctgtaatcccagtgctttgggaggctgagagaggagtattgcttgaagccaagagttccagactagcctgggcaacaaagggaggagactctgtctctacagaaaatgtaaaaaaattagcctggcatggtggcgcatgcctgtagtctcagcttctggggaggctgaggtgggaggatcacttgagcccagcagtttgggggtgcagtgagccataactgcagcactacactcctgctgggcaatagagaacccaattaaagaaaatgctgaagtcattcttcttatcctttcctttccttttcgctttccttttccttttcccctttcacctttctttctcctttctcctttcctttccttcctcctttccaaattaataggtaaagccaagctattaaatagttccaggaaacctttagcaataacttgggggtaaacttacttaactaagtaatcaaaaccctcatcaaaaccttctttcttacattcttccatatattttaacattactcaattgtcaacttatgcttaacagagctactatgacttccctgtaacatctatattttgtttcttattttatgtagttaacagctattatttttactattattatatggtaattgctgtgctatacattttacacataaatttcatctaatttatttctcataacactatgtggtgtaggtattatcattacaggaaagaaaactaagtctcaaagagcttagcctatttagactttataaatggcacagccaaaattcaaactcaggtctgtctatggctactaatattttatatactcagtgtgtctgcatttatcactgtggatcaatttgttattgcttctgattttattcctgtgttaagtgtaaaaacacttagcactttaggtgtattttctttttttgtttgtttatttttgtttttgtttttgtttgagacagagtcttgctctgtcgcccaggctggagcacagtggcgcggtctcagctcactgcaagctctgcctcccagattcacgccattctcctgcctcagcctcccaagtagctgggactacacgcacctgccaccacgcccggctaattttttgaatttttggtagagaaggggtttcaccgtgttagccaggatggtctcgatctcctgatctcatgatccgcccgcctcggcctcccaaagtgctgggattacaggtgtgagccactgcacccgggctttaggtatattttctaagcagttgcccagttctagcccttccagccacattcctcttcacctgctgccaactctctgtcctttgctgtgggagttaacattcccacagaatcttagaaaagcagtgaagagtggtaaaaagaatatcgaattatgcattaggttctagtctaggtcctgtccttaactttttgagtgacagtttgcagttcattatcctctgctaacattcctttatcagaaaccatgataatgacacataaattatttatatcccaggggttactgtgggcatcagatcaggtagggcattcagtatgaaagtatctgaggaggatgaggactttgtaaaaacagtgattatctgattgttttctctacatcttccacacagaaggtactgaatcagcagctgtcccaacaattatacagttttgcaatatgcactgcacacagtgtctcaatcagctgtggcagtgaccatcaaggacattatctccccgggagtagttgtatttgaggacttccctttcatgaaaagaggccttgtgaattcaggtggcaaaaatggtcctttgcattgtagggcatgttgtttcaggccattaactgtggtgctgcatgtggagcttgtttctgtttttctgtgagacattctatctttaatggatcagtgctctctggctcctatggttggagtgaattacatttctctctctttcaaaattttattatgatattttatgttttaggtgtcataaaatcaatcatctaagactattctttggtaataaatagctgacagcaaggcttattatgttggtaaaaactcctttgattaggtttcattgtttctttctaaaattgttaagtcaattttcccccacttccttccctgctctggaattgcacagtgtactccggatgaaatccaaaggagactttccactgcagaggtgcatgctgggtcctaggtgcacccacccctccaccagggtgcccgcacagcatctatataaacctgagtcattctgtgtaatggggcagtgtacaattttcctgatttagaattgggtctctttgctttgggtgatcatctttatattgctgtcatgaggctatttctgtctcaattttcttttgttgggaaaaagatcagattctttttggtgaaaatgcaatagctaaggtgaaagattagataacttcccctctgagcccattagagggaagtgtgtcaagtctagcattaggaaatacgaaagacaaggcatccatcatggtggggaggctgtgtgggtaggtgtgcctggtaagtcatgctgctgggagtattcctgagtgtcttaggaaggaagcaggaaagttaatcatttcttctctcgaaagcactctccctttctctctctctctctttttgtttagtataaaaagcccaatttttttccctccaaaaataaagtaagaagagcagatgatacgtgccctcctcctaccataggaacctaaatttatccagctaaagcactgctcctgtcttagtggtcactgagaaaagttttatgctgatagaatttagaaatactttgaaaaacttgctagatgctgaagtatccatcattaacatttccctttcttgtttggggatatttccatttatgatatggtttactatttagttagtttgctactactactaataaaagctaatttatgttatcaaagctttcctgtggtagactatgttaagtgctttagatgcattgtctcatttttatcagtacagcaatgtcatgagtattgaacattattcctttcattttgcagatgtaaaaagctgagtacacagagattcaatgacttgcctctaattacacagtaggtggccaaattgagatttgaacacaggcattgggatttctcaagtttactcaataaaacaaaatattttagtgtgctcttagatgtgacaacgtcagtatttttctttctcctatttttttttaatgtaattaatggcctctggctatactggcatctttaatacaccatttttaacctggaaatgtaaagtattctggtctttgctattatattgccagtgtcaggcttcttataacattttgtttatgagtaaggagtaactcatgatgagagtgatctaatcgacaagttactgtgttgagatgagagctgaaggctaaagccaaatgtagcatttgctgccccttggagcatatgtgccaacaatgaaagcatattggctcctcatggaggcagcatgtcctctagattggaattcagaatatgcttgctggcttacctctgatatcatctgagcaaatgtaattaatgaggtaccaagagaacgccacaggaagccaatttcattatcaaaacaggtatttgacacaaattacaagacaacgtgactttatccttcctggatttcatgttttcataagaggtaaacttaccttatatttttctaaacctgtgctacattcctcccttcaaggtggttaaatatttcagagcatggatgtgcatcttgttatcttcttccaaagctcaacaggacatgtgccatactgttaaaaggctattatattttagcatcttccaataaaaaattgtgatgtgaaaccgattattaatgctctaaggctggatacatacaggctgcctaaaaacttatgctgtactcactactgaacagagttttctgttgcttattgtaggaggtttctgtatcagcagccatctattttttacagacttcaagtaaatgcttaatctcacttagcaaactcacttatatgctaagtaattattataagtggccaatcatatgttagttaaaacattttaacagaacccactctgtctaatacctaaagagactgtgctgattttttactcagatcaaatgcataatgccttatgagcgacctcactacaaggcagaataatgcctccattggcacataaccagtgctagtagcagtgggtcctccacctgtcattggatgtgtgataattatttgttaaacccttagtatgtggtatgttccagacactctgccaagcattgtgtatgaatcctctttttccaatctcataattaaccgtattctccccattttacagactaggaaactgagcatcaaaactactaagtaaatttcccaagaccaggaaagggctgcgtctcaaattagttctatataattccaaagtccttgccataactaatattcatttctggtggcatgtcacagttcttttaaaatgttgttaagagcttttctaaagtgtagcaaccattatattgttaaaaaaaaaaaaaagttcaaacctcagaaaagggtcaaaatagttcaattaaatacaaattgctatattctaaaaaacaaaacaaaaaacatatgtacacacacacacacacacacacacatatgaaataccttttgcttgtgattttgttttctgctgaactcctagtagaaactaattttgttgaataaaaactggttgctgggaaagttgatgtcaagttgaccaaacaaagataggcttcttcctgcctctgggcccctggccttccatttcttagggcatttgtaatttcaaatactttatctgtccctttgatgtgtaaatatggaggacttgggagccatctcttcgtaatataaacatcagagaagatagcgcccctatctcctaatttctgtggaaagggtgggagcctaactttagtgggctccatgctccaaactgtaaaactatccccctgtcatgaaaacatgagatagtttgtttacatttcctttgggtgaagcccatttgcaagcacagttggtcccaaatccatccatcccagcacttaaataccctccagccttttttgtttgtttgttttcagtgagttgccctcgggctgaaatctggcccacctctcctattgcaatagccttgactaaatcttccttgcctgtttaactttgttcaatataatttttattctgacattactgccttcagaaaagcaggggaaaagtgagtaaaaatgatgtgtgataaatctcttctactttaaccatgtactacttatttttattccagtgttctggacaattaaatttatatggaaaaaacatttcctacaccagcacgttgcacactgaaacccagctagcacatcagtttccaactccagctgccccatcccgcacctgaatgatgagctgggccctcagcgctgattctagcctggtacacaggagatgctctcgatgttccctcaaatggaacactcattgctactgtttttctggctgcagctcaaaatcctccattttgacagcaatgtgttggctattacggactaattaaagtcacttttgaataattacataataaataacacacatttaaatgtagaacaaaattattttctaatcaagctctaaaaatatgacccagcaagacagtccttgaaatgattgtgatgacttatttaatgaaaaggtgcaccttgttcaatatacatatctttattcctaatgtgtttaatggtatcaattgaatagaaatcccttgaccttttctcaaaatagcacactgaaaaaccactgaaaattgcatggtaattgcaacaaatttagcttaatagtaatacatgtaaagaatatgacatgaaattatttaaatgaacttttgaaaaatcgattctatatttgtgaggtgcctgaattttagaggaaaaaccttctgtgttccaagaaactataagcccaccttttctaaactagagaatacaccagctctctcatattacatgacataacttaatctctctgaatctctttagctatgaaaatgcttcatagtttcataaaataatgagatagaataatgtttgtaaaggactaagaacaatgatggagcgcagaataaatcttcaccaaatactagttattattgctatttatcattgcttatgtaatctgaaccttgatcaacatgattcctctgataggcaatcaacagttgtcttttgagtggttgtactgatgacctcacctcctgtgttccagctaaagagatgccacaaaaatgggtgatccttttcttcccccaatgactaatgagatattttattattcaatggaactcttcttttcctagttttacaaaagtttaattgatttgagagtggcctaatatcccattagctatccatcccctaaccactcacagagaattgacgtattattcttagcactgtaaatctaacaggaaattgtccttcctaaacagggctccagaaaacaggaggcaggtctggttccctttgtaacaaatgataaattagagttatttattagggagctactacagcaaagagggtctttatcttcatttaggatcttgaatatcaacataaaactcacctttttaaaacttcttcaggagttttcagaaagggttctatttggaagagggcccccaaactaagagatactgacatgattaaagaccttcttggaacttaagtggttttgcagtgttgccattttgtcaatttactaagtggatctaaaatgtaaaatttcaaagacattttataaaaacttatatttgtgtgaaaaacaaagtcttggaaaatatgtgcgtgtgtgtataaaaataacaaatactaataacaggaaacactcatatagcacttattttgagcaaaacattttttctataacatacttttcatatattaactccagcaatcacatagcaataactatgctggagcaataactccagcaatcacaatttttttctctaggctgagaaaaatcacggaagctgtaaacgttttttgagaaaaattatgaaaaaaatgttatctatctctcatgtgtctacgcttcttaaactgggcactttaggacaacactggcctgtaacattgttaccaatagctggttcaggtttctacctgttcactaagagctggggttcaattagccctcctccatcacatagccaacattttgtattctgaagccatccttttgtattctgaaactgatcatatcaatgtgaagttatcatccaatgctaactgtgcaggacagtgtggctaaaatcaagtataattgagttccatgtgttcccacccaggatgttgaccctgatctagttttaacatgcacagttcccatcaggaggcctgagtggtttcatcagttgcccaccaattttcagccaggaaaagtaacagcattatgtaaaagggaaaatagcttggaatattctttttgtataactgaattgggggaaaaagccaccatttatgttctacattatgccagacattgcaataaatgtcttcaatatattaattaatatagaactgaaggtataaactttctatttttgctcccagagcttagcagagcagtaggtatatagtgacactcaatacctgatcaatgttgaagctgataacccaccaaatatataacttccctgttcattaagagttctgaatggaaccacaggtaattccaatttatcaaacatttgataaaaggaataatttactagtactcaagatgatgctagatttttcctgtttcttccattaacagctttaggaaggtacctaaataaggaacataggacattttcagagaaaaagccattttttgaaggtgggggagggtcagagtgattagaaaactcatgagtaaatacttagggagagtgaggtactcagaagatttgggcaacgcatctataaaggtaatggtgcatctccttacaaagatttgctctcacttgcccaaggactagcaaatgtgcatagaagatacatctgtttcagaatatttacctcaatatgttagttttataaaaagccagtatcccaaaatatagcctaatatgtgaaataatttttatttaagtatttctaacatctaatagcagcagctagaattatccaatgtctaataacagcagcagctacaattattgttatattattttatgtttgcattcaagatggattgcaagcaggaaaaagaaatttaagaaaaccagtacattaggaaacaatgacctgcaggaggggcagcccatgatgaaacattattcagacttaaacaggattcaaaacaaaaacaaacagaaaaacacaacccatattccaagaaaaaagttggaaaataggaaaacatcatataaactaagaatttcattagaagctatcacataaataaaaccaatttctgcccaaagagccaccttcatatgaagcattaaagacaggcttgagaaaaaaagtaatagggaggtggacagaaaaagctaatgtagaaagagatttaacatcagaaatcgaaagtgaaacaatttatggcatatattatcaagaccgggggagataagatcagaggacaggtttacagtgaatgatcccattaacacaaaataatctgaagttcttgttttaacaggaattgatgaattgaaaactgaagagtgaggagggacaaactgaaagagaggagaaaaagttaaactaggcttggtacaagagtgttaaagtagctgtcgttagatagaatcagtagctggtgtgttttgtattttgggtaacagactttggtgcagtagaacagaactaaaattgacagaacaagtccatgcaggcagcaagaaaaacagggttcctgcttcatggaatttaccttgtggggagattcaagctatacattaatgaatgaaaaacaaatacgtaaacatgattgtttcagatagtgatagtgtggtaaagaaaacaaaggtagaaagattccctggagtatggcaattaataagctgctactcacttttcattgtgctatgatatttaacaaagcagacaaaaatcgggtgaacaagcagaagacgatggcaaaagggttaccccatccgccttttctctcctctcctctaccttcttcctccaccatcttgttcttaggtctagtgtcaccagagcaaaagacagacagtaaactagtccataaggaatggttaatcagacctataagcaatggctcgaagaactggatcattcagctgagctcacgaagaaaaagtgacaattttaagtgcaattagttactgtgattcactaggtactcaaggtaaggattctgcaacaagagtatgatagcctatacttagacagtaaaagagggattcagcaagtcctgtaattagtaagaacttcaacagttttcatcgctgtattaatactgtgtaaaatactgaaaaatggattaccctgaagaaaacactaattgagaaaacaaaatcaactataaataacacacaccccaatatacaaagaccagactttgttacatggataactcatgctagaggatgtcagagaagatgagatagaaaaaagaatgtcctggtgcaaaagattaacaccaggaaggttgggcatgtgagcgtagaagaaatggggaagggaaatttgagggtgggaaaatgcagagatgggactgatataatgacagaaaagcaatagcaatgactttttttgttgttgttgttgctaactaacagattaagcataccaatgaaaaccaaggcaagatcttagtaaaggggcctaggatagtgccatgatgtgactttatctgtcacgacaaccaagagggaatgattgcagaggccaatgagctgggagaatggaatggatgatcgtgacagagctgatcattgtgaatgatagatgtttctgggagctgagagtcctgactggcactgtggagccaagaggaaagaggaccagagcatacccagcctggtctcccacgccctgtcctgttgcgaggtgactgccgagctcttccccctccctggcactcagcagctgctctctaagcgctacagtcagtggttacaatcagtgggggaagtgatattcaaatattcaaaacgagatgcacgacatacatcccgatttgctctaaagagcggatttactctaaaatggtattcttcacaagaatgcaaattcattactttcttgtgacatgaaattctcctgggattctaggtgatgtcaatagacaccactagcagatagtggttagtccatatccacctcactcattttgttaatgcaaacaatattattattattattattattattttattattattttgagacaaaatcccactctgtcacccaggctgaagtgcagtggcgtgatcttggctgactgcaacctctgcctccaagattcaagtgattctcctgcctcagcctcctgagtagctgggattacaggtgcacagcaccacacctggctgatttttctatttttggcagggacagggttttggcatgttggccagggtggtctcaaactcctgaccgcaagtgatctgcctgactcaggttcccaaagtgctggaattacaggcgtgagccactatgaccagcaaagaacattattgaatttaaatactgctttaccaaaaaccaaaccaaaccaaaacaaaactaatggaaatgagcctaacacttgaagttatgaatatttggaatcaaatctaggctatgaattcattcatttttcaggggtctacagccaccacttaatggtataagggctgtatggtaacagtatttacgttagtcacatcagaagatgcaaacatatcataaagaagtaaaatgtttcagcttgaattttagggaaacatggcaagactcaaatatttctctattaaagatatcaacgagtctacctgctgtttgttttactactgctataatactctcacttccgaaattcagaaatatatcacttaaggtaatttgctggcagagtgagtggtggggactttttgtcagtagaaaggtcaaataattttgcacaatgtgctgcaaatttttagctttataattttactataagtgacccaagggaaagctcattatattgttacacacaaaaattatgttgtgagctaatggaaagtgaacagtaaggtagaagccctgtgtgctatacccactgctttttctgaaatacataatcttggcatgttttgtttttaattttttcaataaatgtggaaaaatttatgtaaaaaataagagtcctcatctcacaatcaacgatggtataggagggtagccttctatacatgaatataaggcccttctaaggaatataacatgcaacaaagatttacagtaaagccaaggaagtaagaaaaaaagttgactaacctaacccacctgagctcggctcacaggggtcaatgtcctcatcatcgctgggacactctgctgaggccacaaggatgtcatctgtggtctgcaaaagaatcacattcagtagattaatttaaagggtcctaacagattctctcatctttgtctcattgacaagtgaaatacaatttgtttatcaagaaaccaaattcactatttccctttctaaagacacagagcttacattttagatccttcatagaagtaactgcctatttgtgaaaacttgattacactttagtttacatgaggacgcagaaatggtgacagccaacttgtagatacccatccactcaaatgcagatagaagctgcacacagtatcatacagaggtttaaaacaacctggcagaaacagatgatttgaaatttattacagcctggagtgctacaatgtatgcatcagtgggctttatgtagtacttgtgcttggcttcctaaaagcagaaaagccataaccttttacactcacgactatgtagagtttgatgaatctttgagatatagcttgttattggaggaaacacagattaagtagagaattagatagctctttcattggtgcaaaaaggcaaggaaatacaatccatttaagacactttcattttcattatgatttcacacttgaagctcatttttgtaatgttcagatagcaggtattgcttcctcatcatccctttcatcattatggtttcataataaatgaaaagtgtattcaaagtgggggaggggaagaggtggcagttttctctgtgacattctagttgcttcattgcgcttacagcaaaaaagatacctatctctgtaataaaaagcagagtccataaatcctagcagttagtcacataatcaacacactgataagcacgaaaagttgttctttattgccactgacaagctgcagtaaattcagcatagatattgcatggaatctgtaaaggcttccatcagagttggctctgctaaggtaaaacagagaatccaatgtatacaaataaataaaaatatctcattacatctactaaggactaaagagattagaattgttcaaacaattctcagaattgcaacattgatacagttctcatttaaaagtggaattaaaataacataggtcttacttcaaagaaaaagcaaaaatacgatatgagcacctaatattaaaggagcacctaatattgtcacagattaaagtataactaaatttttaagaaagttgtggcattttgaaaaatggagacgaggggtgatgaacttttatagaaagtattaggcttaaaaatctttcaagtgcagagtctttaagaacaaagaatttgttcagatgcgaatgctttacaatataactttaaataaacacaaacctttaaatagcattggagatggtttcatgttactctgctcttacttcttctgagacaattgggagagtttctggattcatgcattttgctgctgctattttagaaagggaaggtgaaaatattggtttgcctggaagtgtaagtctttttttttaactgttgaatttattgacaaagttattcataatattctcactttttattcttcaatgtttgtggcatttgtagtgctaactcccctttcattcctggtatttgataatttgtgggggttttctctttttttttttttattatacttttagttccaggatacatgtgcagcatatgcaggttacatatgtatacacgtgccatggtggtttgctgcacccatcaacctgtcatctacattaggtatttctcctaatgctatacctcccctagacccccaccctccaacaggcccaagtgtgtgatgttcccctgcctgtgtccatgtgttctcattgttcaactcccacttatgagtgagaatatgcagtgtttgattttcagttcctctgatagtttgctgagaatggtggtttccagcttcatccatgtccctacaagggacatgaactcatccttttttatggctgcatagtattccatggtgtatatgtgccacattttctatatccagtctatcattgatgagcatttgggttggttccaagtctttgctattgtgaatagtgtggcaagaaatatacatgtacatgtgtctttatagtaaaatgatttataatcctttgggtatatacccagtaatgggattgctgggtcaaatggtatttctggttctagatccttgaggaatcaccacactgtcttccacaatggttgaactaatttacactcccaccaacagtgtaaaagcattcctattctccacatcctccagcatctgttgcttcctgactttttaatgattgccattctaactggcatgagatggtatctcattgtggttttgatttgcattgctctgatgaccagtgatgatgagctttttttcatatgtgtgttggccgtataaatgtcttcttttgaaaagtgtatgttcatatacttcacccactttttgatggggttgttttgtttttttcttgtaaatttgtttaagttccttgtagactctggatattagacctttgtcagacagatagattgcaaaaatttcctcccattctgtaggttgcctgtccattctgatgatagtttcttttgctgggcagaagctctttaattagatcccatttgtcaattttggcttttgttgccactgctttttgtgttttagtcatcaagtctttgcccatgcctgtgtcctaaatggtattgcctaggttttcttctagggttttttatggttttaggtcttacgtttaagtctttaatccatcttgagttaatttttgtataaggtgtaaggaaggggtccggtttcagtttcctgcatatgtctagccagttttcccaacaccatttattaaatagggaatcctttcctcattccttgtttttgtcaggtttgtcaaagatcagctggtcttcaaagaactagaaaaaactactttatatttcatatggaaccaaaaaagagcccatatagccaagccaatcctaagcaaaaagaacaaggctggaggcatcatgctacctgacttaaaactatgctacaaggctacagtaaccaaaacagcctggtaccagtaccaaaacagatatatagaccaatggaatagaacagaggcctcaatgtaactcttaatgtcagtgaagatcgttagcaattggcacgataatcatgtaggtatctttttaaaaagaaagctttaaaagcaaagacccattctccttttggcacaactacatcttgctgggtaatatacaaacagacttgataatgacgtgttattgaattatgtagtcttgccggtcagttgctccaattccctccagaggagataatcagctttttgtttttttccccccggaccaacatctagcggaaagctacttttattctcaatttcaaattaatttcaaggttacagataatttctcattttctttgaggaatgttaaatatattgatgaaatcaatatagtgttgttcctattggtgttttattcttgttagagggaggaggatataaataaattctttaaaccaatggctctcacatcagcagtgatattgccaccttttccttcctccacctggaggcacgtttggtaatatgtggaaatatttgaggtcacaattggaattctgaggtctgctactatcattgtctctttttgactgctaaacattcttttctttcctcttcctctcttctccttctccttttttctttcttttttttttctttttttttttttttttgtagagataaggttccagctcagtctcactgtgttacccaggctgatctagaactcttggcctcaagcaatactcctacctgagcctcccgaagtgctgggattacaggaatgagctaccacacaatgcctaaatattataaaatacacatgacagcttgaagacaacaaagaatgatctaacctgaaatgttaataatgccaaagttgagaacccctgctcaaaacatttaaaaacagttctgtcttattgttctcctaaaaatatggacagcataatagtatctattgttacaaggatgaaattagtacatgaaaagtacctagaaggggacaacactgtaaatgtttattaaaactttcaatattattatcaacttttttcaatatttcatgaatgtaataccaatttaatttttgcactataattacaaataatataattatagatattaaaccgaaacttgtacatatgaattattcttgaggtctcatgttaaaatttgtatcaaaatacagtagctacattggtattttgttgaactaagtaccatcttttactgtccaactttgaccttttaaaaggcaaacatcaaatataaacttaaaaaactgcttcttaaaaaaattcatgggctacaactgtgtgactcagtgggtagtgtttcatgcagactaaattatttacgcaatacaagttaagctttgttttaaaagctgacctattttcttttggaacaattctacactaaccagaacgtgtgagaatgttctcagtgttaccttctgcaaaacacaattcctaaaataacaaaagatgtcatacaatggtacttcctatagccctcttacagtagaaaaaaataactacaaatgcgacccttttgtaaaactatattttactttttaatgtaatttccctggtataatgaaatacgttcttgattttcatatatgtttttcctccagaaattaaaaaccagcaacaatcttgagaataaaagacctcaaatcaatagatggcttggcaaaaatcatcatcgcagtatgaaaaatcaggaagtggctcaagtgtaggggaagaaaatcaaatttcactttagaagctgaattaactgcacaattttctagccaaagctgtgtaatttaaatttaattcactgtgtttggagctgctgctatgacttgctgttgagagagtggtagaaagaaactcaaatatgtcacattaatcaattctattctttagtatacttttccctgatgtttataacctttttgagaaaagagacaacctgctgaaaaagacagaagcgtgatcaagcagaagcattagctttacataacagtccatttagatgagtgtctctaactgtgcatttaaccacccacaggtgaaattgctatgctgatcttccttaattcagactggtctgtacatgcacatcgtaagcatctcttcttgttgaaaatgtgcactaaaatctaagtctctatacttttaggaagaaaatgatttgaacagaattcaagaaataaaggctgtaaaacttaatccatccttttctatatttgaacaccaatattttgtagggtttgagaaatatgtcaggacgggggcaaaagaatgttcttaatgaatggtaagaaggtagaccaagtgatttaatacccagggatattaaaaagagggagcatttggttggggggaatttagagaaacacagatgtatgtttgttattttttctcacttataggaagccttttatttttcaacatcattaatggtggaattttctgtatatgcatttgctgtcactttaaaaaatatagcttaactgcatatctgtgtggtaaaaatatacaaggaaagcacgaataaacccagtatgtaatattatatccctgctaagaataacattccaagactttattccttatgataaacagctttcctgaagactaatatattccaatgaagacgcttacagaaaactatactattaagacaaatctgttttgtaaggaaaagagcaatttccaattgtaaaataggatattcattgtcagtatatgatacccacaaataaacccgatttattctaaaattttaattgaaagtttatttctaaacagcaacagtgtatcctgctatacctctaaatacgaagccaaaagaattgtctcagacaatgacatgagcattgtataacattatttagcctaatatttaactgttgtgactgatatttagactgaattgatagcaacagttagtgggtcgaggacagtgctggctgaaatatgatatctttggttaactgatgggcacttgttcttgctgatacttttctgtatgcaaagctgctttggaagagagagcgctctcaagtgtggttttcatgaatgaatctaatagtttctccagaaaatatttatcactaggtgaggttccttgaaaaaaaaaaattttaacaggattcaggattagtatcacaaattcccaagtaaggtccaacccagtgtcctgataacctatggagcaagaagtttctaggaggtaagggaagtcataattctcaccagaaggaaaaactgcagaaaataatccacttgtaatgtgtatataggtatatgattcccaaattgcggtctatttgattaaagcaaatcagtaaagaaatagatcaaattggcaatttcagttaatgaacaatcctattaaggtgcaagaggaatttagaggctgtctagatcttattcttgtttccactgtctcaatgaagttgcctcaattgacataaagatgtcaatttcatggctcactatttaataaacataaaaataataagctgagatccagtatgtggaggatgaattttacctccagcacatgaataagaaagacagtgaggcccaattactcaacaatgaatacaaagcacctcatctatgcgtagcattttctgataggcataaaatattctcagtacacatgaaggtataaattgtggttccgatatgcaaataatttactgttctctctctgttctgaggcaaatgaacaaataactctttaatacaaataacaatgaagtaaattcaaatagcttatttttctcggaatgtaacaatgttcccatatccattacttcatttacaattcaccaatagcatccttatctggaatgcagatggaggtactgttattcagagtgttatagttaagtgtctgctaaaaaaaatactcatctgtacactcatctacccaatttgaatgtgtgaacactggctttcatgaatatgtagggcaaagctcaaataccccttaaaacagccactttcacatttctttaatgttctttcccaattgatgccctaggctattacaaaaagtgaccataaatcagctgtctgcttgggaaaaaggcagacttgaaagccattcaattttcttcgaatttttttcagctgtttaaaaagtatgcaatggttccagaaccactaaagtgggtttgagtagaagaactctgccgtggtaaagaaatcacatcttactcagtctaacgttcatttttatgtacatttgatactggttctcctaacaggcaaaactcaaaggaaaatataggaatatggaaataatgtcacagaaatgcactttaattaagttatggggaaaagaataaaactgaatttttgagtaatcaaaaaataacatattttagcaaacttattcaaaatagaaaacctacaaataaggaacctgctgtcagggaacttgaaattaaatttatgtttaaaaaatatgttttttattatttctttatgctactgatgacctctatgctcatattgcatttccatttttagccaaggcaatgtagaaggactggcaaaataaattaatatgaaatttaaactttcaggaagccatggaacaacctatttttctgaattctcactaattagaatttgagaatgtcagacctccaaagactgctggtaatggagtagaggtactgaatgagtgatcaactgtgtttcccgtctctttgtttcgcttttggacaaagcactttctgaaataattttggccatttccaaattaaataaatattgaaagatgtttacaaatgtaaatttaggcttctagctgtatcagtatgaatatctagtcctattatggattagtcacacaggttgaaatgaaaagtagggttctaagctgtatcaacatgagtatctagtcctattaatggattggtggactaattaatagattaattagtcacacacattgaaatcaaaatccctttcggtaaaaggccaaaataaaaccagactttatgattgcaaaatgcctatgatggataatttcaactagcatgactccaaatccaagctttcattgttgccatgttagggaatgaaaacatgttttagttaagcagtcatatatcttcttgtactgagtcagatcttagagatcattaatctaagctcttcattttacatattgggaaactgaagctagaaaattttaattggccacagttataatgctagttaatggcaaatctatgagattatccgactcccagtagattatgtttttctattatcccagatgacttctacctatccattcatctatccatccatcccaaaccatcttgttctctaatgaattttatgtgatttacgaagatacatgataagataaacttaaaataagtgaaaaggttgcaaaggtagagtactggattttagataagtaaccactaaaattgtcctgaagaaatacacacagacaggaggtgcatattcacagcttctgcaccatttgatatggcagcacatcatgtaacactaaaaggggagcacaattaatgctagagttcaacttttaaaaatccaattacagaaattcaaatattgacataattacagttattttgaaatggagttaacccagagagttctttatttacttgtgaaaatcttttctgaaattattgttttaaagaccttacataccatgccctcagtctctgtacctaaatgcataactaattttttggtgacaaaaagaaaatgcaaattattgaatctctttctgtctttttatctctttgacttagaacactgcaggctatgctggctacaaaattaaatcaatgaactccctgctctcttctcattaagccactgattaaaatccttccaacttccaaggtctctctcttactaactactgtcttcacaatgtaagtgccaatgagatattcatctttgtttctctcacacaactatcattagagttctgtcagattatttcttattacatcttgggaataaatacatggaagtgatcatttattagccatattggtagtttctccagaaacaatttaaacatgtattgatcaactcagtcttattgacacaatgaccttcgaagtgaaggttcaagatcaaagatgtagaaggagccacatttacctttggacaagcagccagttataaaaaacatttctctgctactgggtagtactatgaccaatgtcacctgataaactttaacttggggatagatgagaacttccattccacacgatgcttggagtatagaacagcaagaaatatggatgtggctggaaataatcacttagttaacagaaggtgtattttctgattttgagttgattcatgagttgaatatatgcaagactcaggactgcatgcccccaaataagccagtatctgagtagcatctctatgcttgtatctatccagtggtgattgagaataaacattatctggctcagatgtcacaatgttatcttgttcatgtgctaagaggatccagtgtcttctagttctagttaaactggaactccaagcttctacacttgactacttcattccttctggtgcacattggttctttaatacatatttacgatgttgtactgctgaaacacctcagtttaatttatactatgctgaccaataatgcaaaataaatactactccagaattcaagtctcacttttagttttcatgagcagtacacatcatcttggactggtttctgtgttctaaacatgacatatgaatatatacatattatacatttaaatacatatatttatatatgtaattaattgtgtctcacaggatgttaagggagtcaaatttcatatgtgtgaagacattttggaaagtgtaaaagtgcccacgatgcagtgtttgtataaattattattatagaaaacacatggacaccgggagggcaacatcacacaccacagcctgtcagggtgtgggggacaaggggagggagagccttaggacaaatacctacttcacgcggggtttaaaacctagatgacaggttgatgggtgcagcaaaccaccaaggcacatgtatacctatgtaacaagcctgcatattctgcatatgtatcccagaacttaagaaaaaataaaaaaattattattataactaataatttttgttcctcacatgatgctacaaaggagagctccggatagtgcttgaagaggacaacccaatgtccatttacctgaatacattttattttaatgtcctgaaatcctcttgtccctcagttgaataggatctgtatctctcacttacactagcccctcacacagatgctgttcttgggctgcttcctattatgccagcattgaattcattttggcattccttatttagggcatatgtgtggatctcactggtaacttacaaggtaggtagcaccaatctatgtctggcattatgattacctttcctccgaccagatctcctggagagcttagtgcacagactcagggatacttgagctctctctaaattctaagttctactcattagattgtgagaacctgatttattttatcactgcatccagaatttaccactctgttaaaactacagcatataaatgaacagatgaacagggaaaaacagaccacttagcaaacaatgctaattaaaggagagaaagagagagaaaaagggagagggagagagaaagactgaatctctaagtgtaattcatgcatgacaatgctccttacaataggagtggttgtatttgtagttataatatgactttacctatggtttgtcttctatacggattaataatatgcttatcaactcctgttaagacaatgagctatcttttcttagtgcattagaatagtgggagtacttgccttttgaaatcatcttgaaatctaaaagtatgaagactgcttagtgatatgttttattttatttcatatgctgcttttgggtacagtttatgttttatgcccccagggcatctatacaggaattcagtagagctgacttaaaatgacataatcactcaaaaacctggcttatattcttaaagcatttgcgtgaataaaaggattttttgaaaataattatgacttgaaaaataattgttatgaaaatacagcttagttaaaagtgagggattcatcttgactttaaaaatagaagaaatattatacatgacacttgaatttactagaatcatcacattttaaataatcttactcttgatggtcatccactctaagctcactacatttttggttatgaaaaaggcatgattgtcacaattgctcatttataccagctaattaaatctcaatataaaattgaacaagtatagattattttctaggaatacacctaagagtgggagatgagaattgtggcaaaataacactttttcaaagattttatctgccttataacatctctagaagtaacaatgaaactttctaactggcttccacattataccccatggctggaaatgtatggtagagaaatagcaaaaagtgacattatctttaactgaaagagagaatgactgaaggttagaaggaaggcaaagctaaaaatgtcttgcaataagttggtcttcctgcttttatgaagcattcctgtcctttgagaaagcagtaagataaagcctactctgtggaagggactgagaaaaacatagttaactatcattttgggttttttttttacctacataatattcctcaactatctctatctcttacaaactctcttgcaatagtctattgcattataaatgcttttacttagttgcaaaaaagaaaaaaaaactattcctttgtaatgttttccttcaaaatctaactacaggatgaaagctttatctttttcctgaaagaggccagccataagattcacaccaagaaatagtgtaagacagaatgcactaatcaaatctatatctactgattctgccattcattcattcatccatttgtactcatttgttgaatattttcatttaataaagagttatacaggcaaggaataaaaatacaattttctgactcagaacatttagaatactgtggtggcgcatgcaatccagtttcttttgggtttggagaaggcatctatcattttatgcattaatcttttacccatgtattaagtgttcacactgtatattcaaggttgcatccccagggcctgccacagtacctagcatgtaagagacaaatatctggccaatcagtcagaaatgattccagccagtataatcagaaaaatagaagtaatttgataggaaaaataagtccaacactaccccatcatgctagacaaaacaaaagtaccttagagttttacaaaaacgtttccaaatgcaagggattgacagaaccaaagatgttctatgttctctgatacttcagctatcagctgattagaaaaggtatcaatttgaaaagcaacgagaagcattgtcatgttaacttttttggaaaatgtgactgctaccaccattcactgtaaggcaatttgtgctccttcatttttacaactaataaatggtgccagtgtttatttttctccttttccctttgatttcatttttttcatctcttcctatttcattcatggtgtcccaactcccagaggagctacctcaggaaaaaagatctcacatagcaagaaaagtccaaggagcaaatgctgtttgactctaaccaacataccgtagcaccttaggtccatgtataaatttagggaagagaattacatgctctcttccagttattattatatgattccataagtcaaagaaatctggaaatgtttctatgagtagaaatttgtgataaaggagatagtcttttttactctgctaaaatattttttggtacaaggaaggtgccctgtatataactgttgatttaatttgagatatcatgagccctgacacttgacttttagttctccaatttaagttactaagctgcctacattcgatcaggataatttgccatataatcatgaatgggtaggggaaattggcagcttttaacggttctcaaaggtaattcctaagagaggtgagttggaactgatgaaattgagatagatgctaagtgaccaggcatccctgctttgaattgtgaaattgaacttcaatgtgtaacaaatgcaggccttctatgagcagcaagttgctttttccactactgagcatggaaggagcatgaatgttggagctgaacagactggtcttaaatcccagctctgccacttactagctgtgtaaccctgggcaagttccccaacttctctggatttctttcgatgtaaaagtgaagttatttacacctattttgcatgagtattacatgtattaaattatctagacctagataggcatactatctagcacagtagctggtatatggaagatattatcatgaatatttattacatagatacaaccagctttcaaaatgaatggctcttgtagacattttcacattattctcaccgcaatatggaaattaaactttattcctagcactggactccctaatctttagagacaaacacacccttcacagagaaagtacaagtttctcacctaaattcacacatccatgtttaaatattctataaacagagaagattatatgtttgataggacagcgcttgtaaaagcacctcaaaaaatcacattatcagtatattgaaaatacaaggagcatctcttctctctagctacacgatgtaatcaagcatttgtcaaatcatatttggaggctctttgaattatgtgctccagttcccttttaggtaaagagaaggaaaccctaaattggcatggtcaggtgtgggtcagatgtacagtaccaaattactgcactgcactgttcaggagggacttaggagtatatcccagtttcctggctctccatccagttggcgtcttgctccttctactcctcctagtttcatgtttgggtatggggcagataaaaataacagcgggaataatttactacttttcccaagtttcttatacataacttgactttttaaattcttccctatgtcttactgaaattttaagtaaggcctttgaaaaatactagggaatgatgccgtcactcacagctgccagactggagagcactcagtggctggtgcaaagcccagtaaaatccaaccaaagaacacaagtgcagaaacaggacaagaattttgctaattgtcttctttgagaactaggagcttcattagagaatttgcctttgtgcatgtatttaatgagatgggatatgctgctgaactcttcctgcaggtatttcagtgttttatttagttatgatattgcctaatgacctctttttttggtccactattcagacatttttgggtcatttaaaaagttgttataaataaacatcacttacataacatttagatttctaagtgattaaacatatcctctcttggatagctttcctcttgccagccttgcatttacagtctgtctcactcaattctgacatatttcattgcagttgttatcacgcctctgccatctgggtttgtccttttccttcccgcacacctctgcaatccccgcctgccctcttcccttcgttatcattgcttagatgcctactaattaaggacaagaaagaaacctattcaacataaatataccttttatcatcatgcgaacttacacagatgtagctttttaaacagttcagaagacaaacttttcttgatgatttggtgtcatttttatgagcacgagggctggaaacacagtagtgatctcaaagagtattgctgactattctccataggtacccaagttgctcgtttactttttagtctatgaaagctcaatctagcttttgtcttttgtcagcctttatagacctctttcttccttccaatttgccccttcggatctgctttgagctggaaatccagataatcaaagttctccgtcctgagaaatgagaaattggctataaggtaaaggatatcagagaggttctcaaatgagaaagcccaggtgcatgagagcactcagtcaaggctcatggcttaaaatacacaagacctgttagtttcttccaaatgcaaagttcttcgtgaaggtagtatatttatttctaagcgaatctcagtaatattttcactatgataattttcaaatgggcttttcttattttattgagtccaagcatccttattgaaacaagattccacatttctaaatttctattttccaagatctattcaaacagaagccaagcctccttttgtgttccactgagttggctgggagggagggaaatgaagatgaagtaatataataagaaaggtggctgtcttactgtcattgactgctttgctacctgaaaaactcgaaggtacactggtttatatttttacgtagaacctgatgcagccatgcaggcatccagctgtatctatccagagtgggtgattcacctggtgtaccctgaagagacagagaaatgctcttcacggtagcatctttttggtttcctaggaccagttgtttgcttgacaaattgagaagccctggtacaggttatgggatcttacaatgctgctttccagtgatctgctgcatgggcattggagtcagacttacccaagtttaaatctggactgtactatttagagctggtagaacttgtgtgatttatttaacctctcatttgtaaatgggagggatgcactgccaatctatgcagtagttgtagggattaagaaaatcatgacagatgatatacttaacactgttcctggtgcgtgataaattcaaaataaatattggctattatcaccttcattattattttataagacatacatatgttacctccagcatgctgaaaataacgtttcttaataaagtaggcaaaaccccagtatcctaacattcacaagaggtagacaatccacttttgtccttgcctagcatattgtgaagtggaaggggaaaaagccaaacagtgcatgaagaatgcaaatgtattttttttcctgaatgttctcttttgctttttgacttttaaactctactttatttcaaaacacagtcccaaccattccaaagcatttttgaattggaaagccttctttttttgtttcataataagctaactgcaggtgcaaactcaagggagacagaccttggaaattttaagtatgttgccatggcaatggtttgcaagaatgtgtatgagtttcatcttagctttcaagcattcaactgagttcatacgtggaggttcaaatcactaggcacacaatgtttgccactcattgtgtcctgaaaggtttggaaataactatctgtgttgcttatagcaaccagaaaccacaaaattctatttatttatttatttatgcaaatgtagagatctagtcattcatatctgctcttaggtggcctatctcaccagtgtggctgctctaagagaagctgtacacataatttcaacactaatcattttcaccattgttgcaaacacagttgtactcccaatatggagtagctataaaaatgttccactgaatatcacattaatttcctcattcaaatttgacagatccttccagaagcatgataattatttaaagatgttgcattaaagcaaaatttcagtctaatgaattgtggagtatttccttaaaagtgtctcatcctatagtggaagaaagaaagtgaaagcacacaatccagtcattaaattaacaccaccctccccagaaaaagcaccagcaccggcactgccaacaaaaagacatgcaaaaaacatcattttatcacatattactaccccagtggttcttaaatggttcagctaatgcttctaaattccaaaacctgcacactgaactcatgcttcattgacagaggaggcaatggttcttgacaaaagcattcttttccccataaatggaatccatagcatactataattgggtaagttttaaagctatctattgggtacgggaaataattattaacaaattctcttcaaattacaaggctttttttcatgtaaaatgagtactaaacaaataatatcatttttaattaaataaatgatttatttaattaaaatccagcaagaaaaagctggatttctaggggtgtatgttcttcatgttttctagcgaaaacttgctgcaaatgattcatcatgatacagcagaatgccctacataaaaacatggccacaggagaccccagtatctcctgcattttgttactgactgaacccttcacaaacgcattattagctaccaaaccctggcagctatttaaaattcgcattgttgctttaactttgacccatcttccaaaatgcctgcgcacgcatgcacacacacacacacacacacacacacatcaatctctcaatctcccgtcctccttgttgtaacattttgttgacgtacttcaaaactgcagtagagcttccctgccctgaccctccattctaagaagcttacagcaatgctggaattaaacaaatgagaacacaataattagctatgcaaactgtcaactagatctaaaaagaaaaacaacccagaaaacacaacaatcagcagtttcaagccctaacaagaatctgcattgaattctcatttattttaaacaaaaatagattaggccttttgaaaaatattcagtgaaatttctatggaaataggacaaattagcctataggtctttacatctctaatttctgtgttgctgatacagtagaaaagtccaacactctttccaaataaatgctcttctactctttaatagccagatttacttccaaaggtgagtagcaccaaaaatatttccaaagtggatatgaaacaggttagtggatcaaattatatggtgtgacaccgcagttcccaactctgtccccacaacctcaccctaatcattttatcaatggtaattaaaatataaagggaaactgtaagggaaaaataattcttgaaatatatggtgtggctgggtatggtggcacacacctctagtcccagccacctggaggaggccgaggcaggagggtcacttgagtccagcctgggcaacatagtgagaccctaacactaaaaaaaagaaaaaagaaaaatatctggtgtgtttgtggtatatgaaggggagggaataggtattcaattctttgggtggagagtattgattatataatttgtagctaaatctctcagtttcttcatagataccaatcaactgcctcctcacccttcgggaaccatcctgagttctgatgaagcaacatggattatctctatgatacagacactttgaatgaatactaatctaatgcttcaattgactgttaaatgttctcttaacccatttgcatcccgtaatagaaatttggatttttttaaattgagaattgtaatgactctgtaaaagttttgttgcttcaagtcttttatctttaaacttgctgaataactgcctactttataaattgagaatgtaatatgtaatgcctgaaactagtgtaggacaagaaatagtaatctaagttttgactaagagttctatgtaacccattgacctggggcaaatcactcctcatcctaatataagtaggttagagtagatgacctttcatatttcccatgcaatgatggagagtaacacaagggagtcctgtggtaacggtagagggtaatatcttgattgtggtggtggttacaagaagctacacatgtgataaaactgcatagaggccggacacggtggctcatgaggtcaggagatcaagaccatcctggctaacacggtgaaacctcgtctttactaaaaatacaaaaattagccgggggtggtggcatgcacctgtagtcccagctactcaggagcgtcaggcaggaggagcccttgagcccaggatatggagacagcagtgagctatgatcatgcaactgcactcagcctgggcaacaaattgagagcctgcctctaaataaataaataaataaataaataaataaaatgaaaacaaaatacaaataaaatgaaactgacaaaataaaacaggaaatatcacggattcactaaaaattaaatatccatatttatatcccgaggatgctgccatttctgcccagttagctacccctacaatgtgtaatcttatttttcaatcctcaaatcctgcagaatccttatttatctgataattcaattgtgctcaatatgcttccttttaacgtcacagaattcggtgaattttcctgacttccatgtggtcgaaaaataatggctggtgacttagaaattttactgctatgtattggcttcaaaatttgtctttcaagtgacaggaatggggcagaaaaagacagtagatgccactagcagagttctggtgtaggcaaagtagaagaaaagaggcaaaacaaacaggaaataactaagcaagagaatgagcagaaggaaggagaaaagctaagaaaagagttcctccacctatgtttgggcggtggcagagtgtctctgtccattttacaagtgacatctatgatacagctatttcatatttaggaaagtagaatgaatcacgcaatgagatgtgaaataagtcttgattacagtattctagaaaggggcttaaaagaagcaaaagactttactcctggtaaacaccaaaccttcagacacagaacagaaatgtgccgttagaagatccctctcacccccatcctttaacatctttcaccaaacaaaacagggtaaaacaaactcaggcagtttctcaattactttcattaaaatgtctatgaacggtgaattaaatgacgaatctctttcagaacccattaatactttttccagagctaatactatcagtaaattttaaatagtgggaggaattattataaaagaataaaatatgtaacagatgctgaatcggtcatatgtcccagagctgctgtaacatacccaggcccgtacttcatgtgtccataacgaaaagagctggctgagaagttatgaggccacacctcacaacacctcaccctgctctctccctagtcccacagaggcacaatgcttctaaagctttgaagcctgaagttcagggaatgctttaaagatgaagtgtttaagctattttctggaagccaaatctatcattttaagattacattaaaagctacacttctactgttcatatcaatttacgctccaaactgctggtttctcagagcatccattgaatcctggtgggaggtaaatagtttctgtttagattttgacagaaaattaaaatttaaaacataatcactacatcttccatatactaagaagtcttcggtggctcatgctgtaatcccagcactttgggaggctgaggtggatggattacctgaggtcaggagttcgagaccagactggcaacatggtgaaaccccgcctctactaaaaatacaaaaaattaatcgggtgtggtggcgcacacctgtaatgccagctactcgggaggctgaggcgggaaaattgcttgaactagggaggtggaggttgcggtgagccgagatcacgccattgcacttcagcaaaaaagccaggcctggtggctcacatctgtaatcccagcactttgggaggctaaggcaggtggattgcctgaggtcaggagttcgagaccagcctggccaacatggtgaaaccatgtctctactaaaaatacgaaaaattagctggacatggtggcgggcacctgtaatcccagctactagggaggctgaggtgggagaatcacttgaacccaggaggtggaggttgcagtgaaccaagattgtgccattgcactccagcctgggcaacaaaagcaaaagtccatctcaaaaaataaaaaataataaagtcttgaaatgataaatgtaaaagttctttattttattttttgagacgagggtctcactctgtcacccagggtggagtgcagtggtgcaatatcagatcactgcaacctctgtctcctgggctcaagtgattctcccccttcaggcccctgacaggtgcaggtgcacaccaccacacctagctattttttgtatttttggtagagacagggtttcaccacgtttcccaggctggtctcaaactcctgagctccaatgatccacctgccttggcctcccaaagtgctgggattacaggcatgagccactatgtccggtttcaaagttctaattacgtttccttgtgtctaagaaaaaattttttctgcctaaggtttctaattattatagacaccagcaggctataaatatgtatatatattttgagacagagtgtgcctccgtctcccaggctggagtgtaatggctccatctcggctcactgcaacctccgcctcccaagttcaaacaattatcttgcctcagcctcccaagtagctgggtttacaggtgcccaccaccacgcccagctaattttttgtatttttagtagagacggggtttcaccatgttggccaggctggtctcgaactcctgacctcaggcgatccaccctccttggcctcccaaagtgctgggattacaggtgtgagccactgcgcccagcctaggtttttatatataaattgtgaacagtcataaaaataatttgtcctacacaagtttttgtgcctactatagactttcacactgatagaaaaaaaaatgcttacaaagcctttttctcagaggatctcatttggcagttttgaaatttacttttccacaaatctttatcagtggtaagaatgtttctgaggctgtgctgtcaatcacttatgtcaccactttccttcccacttcattaggaaccacactgtactttatttcttaaaggagaatctgaaactgatttggggaagaaggacttttagtccagagtatgcagcattgtataaaatatgtattgatataaagcctaaaaatacacacagtaggtacagcattcacatacgcaattatttagcaggttcagctggtgtgattttacaccacagtgttcttcttacgaataccagagagaaaatcaaagtttcttgacatatggtaataaatattttcacttacagtaaataatttttgctcttttggcatccattgtataaaagctagtttgaaatcattccaaattagcaaagctagaagtttggtaacacaaggggaacgagcagtataggcccccataccttcgttttcactgaagtgtgcttgcttttgagatacaacactgagaaaacttcctcattttcaagatgaagagatgttatttcttcctattgtgtttctaggactcgaaatgagcatctgtattcttcattatggaaatggaaaatgagtttgccctataattaatgctagacatgacaatttttctggcactaccttcaaaataaaaattttcaatatgaaaatctcataagaaaatctcagatgcagattcatctcaaaatccaggtgacataattcaacaaaatgaaaagcagcctgtttataagaccaattttctttaaagcatttcttttttttttttaaggaaacacatttattcacactctaaaatcatgaaatgttagacctgcgaactcctcaccttacaaacaagaaaatcaggtatcagatgattaagccattaagtcttcaccagtagatacagaactttctccagtacaatgtcttcacataaatcaattaaaagaaaatgctctaaaattagataagctccaaagagtaatctgttcacactgggacatgttgaatttgaggtgaactgatagcagttgtaagggtaaatctgaagttgagaagagaattctgggctggggatcatatagatttcccaacgaaaccaaaagagaaaaggagattctgagaccaccttcagaaaaatccaacatttaaaagggtagaaagaaaaagcaggtacaaacaaagaactgctttcctgttaattgtttttactcctaaaatatttgattgaatgtttccaagtggaaatctgaggagcccagtgaagaggattctcttaggcaattggtggattctcttaggcaattgatcgaacccagtgataaatttcccaaagtagtcttatgacacacagtgcatctatgacacaaaaactgtaaagtaaatcacttttcaaaagtaattcaccttaaaaattgattaaaattaactgaatgttaatttcttagtattgacagatatacaacggttatatgacatattcacattagggaaaaatgaacaaaaagaactctctaaaatatgtttatgacatttctagaatctcaaattattctgaattaaaatatttatttttaaaataaagcatgctgatctgattaactcccatatattacatataaaatgacaaagctgtgatatttataaatacattctcttttaaaaaatgatggagatacattcaacaaagaaaaatacaaccacaaccaaaacaagcaacctacaaattcctccccacttttgttacgtttatagacataaaacatgcattatccttgtttgaatggcatgtctttgaaaatgtcctcccattttagagtttcaaataaaacaagcatatacttttctacttaatctcatcaatttaaaccttcatatcttttcttaaagtactgcaaagagtagatgcatcatttagggattgctaggtagagtgaaataggctggagtcagtatttattttgttattgcaggagtagccttctgtttaaaatgacaccttctcttgcaattgaaatcttactggctatgtggaaaactagaaagtcaggaatctagaaaacacttgttgcagtggatgtcttaagaagtgtcctcagcttccttttctctagcctgaggttttgtaaagcaatcaagagctattcagtttaatgttttatacctaggtatcatttcagtcagttttaatgaatggttcacaaaatatcccataattcttcaccatattttaagctgcttactgagaaaataatactattgatgaccattccagtatcaagagtaaatggtttacataattattattacttattcaaaattgtttcacctaaggccagattctcatttactgcccagacccactcacactcacctacccactccatcccaccaaaaaaaaaaaaagaaaattaagagctggcgaaggaagtagaataaggcaaacaaagaattattgctacagcaatttataagaacgctcaattataccctaagggtctgagacagttatgcagttatgccaaagtgtccaatttactttttctgaagaaaaacacttagcaacaatggctaattttaatgaataaagagaatgaatacaaactaaatatgcagatgacttttaaacaaaaagttgcatccattttgcattacttttatatttcataaagcatgaaaccggcttttaagaaatcagtatgttgtcctgagaacatgtagaacaataggaaacaacccccttgactgattttgagacaagctacttgggtcctctctggatattctagtaccctcggtgtccgtaatgccattttagaagcaggtattgatattaagggatgtgtagcctacctgatttgacctgattttgtgttaccttttatttcgtgactggataactagtgctgctcaaacacaggaaacatacagcgaaataacatgaatgtatctccttgaaccacattaaactctcctttctccaagctaccttgaaatatatagaatacaatgagcaaatatattgacaagacaatgagcaaatatatattaagtaatgctatagggtaaaatagttaggccttcagtgctcctctagttttatgcctatttgtcttgaatcctcaattgaacttttaaggcagcaagtgtctcatttttctttgcataacccatgacatctagcagtgttctggcatagatacaatcatgcagtacatattttaacagatcttaactaacaatgtacaaaagcactgagaggggtgcttagtaattacttatatattttaattttcaacattctggaaagagatagtaaaattcctaaaggctaagaaacctcttggcaagtccaacagtagcttatccccggccaaatttttggcttgctatatgtacttttaagcctattagttaatagctacatgtttaacaatgttttacatagacacacattttatacaaatgttgtagtcccactacaaatctaaagagtagatgatccactcaaatctagctgtgctaatggagggatgcatggtatataattaaaacaatgattttgaagccaatggagggtaactggtccaaaaagcacatctaatcatgcaaaataattcattatgtagacagttcatacatggaaaattgagaattgactcccaaggctgtacatatgcaacttctaaataaagtgctttaaaaaaatcaaaattctatgtaaaaggtttgatctgacaataaaatggttttgaagtcataatggcagccttagttttatatatgtaattacaccttattataaatacattttattacatatatataatctatacatttgcatataaagtatttttttcattataggtaaattcatttcactggacgactgattaggaaagaattttgtctttgatatactctcccatccgagtactaaccaggatcaactctgcttagcttctgagatcagatgagaatgggtgcattcagggtggtatggccgtagactgatatactcctgtagagttttcaacttgaacgatgttaagtcagccaggtaatggcatttccccatactgttaagccttcactgtatccatgactttactaataaatttaggctgtgaacttatgtaatcatgttttccatcaaaaatctgaaataggcttagagccaagatggtggaaccctacaagactcattacattttaataaaaaagcagggggaacaaaggtgagagcacaaagactgcagaactaatttctttcgggaactgacttattttggctccccaaaataatattcaagtcattcccaccatgataaatagtttttgtctttcaaagtaatgaataaagtaatggagactttataacaaaaggctatacattatagtcatgggaaaatagtaaaacaagtatttgaatgttttttattcccaagaagatgaattgtggcttaacccacagatcaaaaaatatatagcacaacactgaaaaaaattatcattgatttttgggaaatctgagctagttacttatgattaatcaaatgaattaaaataaaggtgaaaatttgaggagcaaatggaaacgggtagtgataatacacatagtttatgatgcaaaaatataaactatctctcatatatttctgctttttaatagttgttactcagtttgaactcatattgtctttaatgtgccaaaagaccctagatatatccatgaatgtataattgtctgtgactctctccaatttttctgtatactggaaattgcctacctactccacaatattgtccttagctccattctctatgctagagtgatgagggaaggaggccttcaggagattcaaatatcagctgtcaagtaaatgtaaataagatagcagaaggtaaaatcagtctttctggtcaatactggtaactctagtgtaaattttaaaaacttaaatgctaaagaatgtataaatctaaacttagtgtcattatactatcttgaatttgcacaaagattattgtttatgtctttaataatctcaagttctgaagcaaatggatgccatttttttctatctattggtgtttgagtccataaaccacaggtaaagcaacagaggaataaaacactgggagcagggaaaatgggaggtaaaagagaagactaaataataaaaggcaccacttgatctaagtatgattaaatattcattaacgctgttcagctgtggattttggtagtgctcataatactagaattaacagcactaattttgatagggtgaaatctcatttaaatgtcattttctaaatgggcagagtataagttcttaaatatttaaacttaatatagacaaaggcctaaagtacttggctacatgcttttttcccatttgaaaactaaaaagtgtcagctaagagggcttttcctatcaattagcattctggttactgaatccatcatatagttaattgattgcccttgtaccttatcaatgcacccagatgctgtggtatgaacacatttcataaattaaagaagcatatggaagtgacacagacagtagcatttcatcccagaacatctttaatatgcgatgctacatcactaattattttgtaaatatgtaagtatttccctagttaatgtgttggtgagaagtttgcttggcagttgagcccaaatgttattgtaaccagacatttaataacagttcaggactcttgtagtttcattccattctgcccataaggagaatgtgtctcttagcctactgggcaaccttgattgtgcaaagtcaatgaaaatatttatcctttattactgggtaattttccttaatgaacagcagtctactctccataatataaatatctgtccaaagatcggtctggagactctttctaaaaatgttacagggaatttgccaagtgaggagcatattgctgcttagtgaatttttttccattaatttctaaggatagaatatgaaggaaattgcagcagaaataagttggctttattcttcaactttgggaaaactagtataatgatctgagtatattatcctgaatttaccttaaggtaccaaaagtaaaaatttttttcttcttgtctaagtcataatttcttgtcaagccaagtttcaaaagttaagtcaaaagaactttttttgagaatggaaactttctttggagaatggaaattctctacattaattaatgtattaatacaaaatccactagataactgacaagtgagctgcgggcaacccaaaagattgcatttaaacattttaaatttgtgtttctgttacattttagaagcatgatttttgtcagattaatttgcacttaggactgaaaactgtatctgggttcaactagaattttgtaagagtcattaaaatcagaggattcagaaataagttgattttcatcctccttcagtcctatgacttttctgggcaaaaactgtgtccagttctctgggagctgggggtgacagagggcttgatggaggctgctgagagattaatttcatttcagaatttgaactgggtattggtcaggctccacgctgcatgataaaatcaacaaatacttaaataaaatattcaaaagttattctgtaaatggccatctattaaaaagtcagaaggaaaataatagtagattagtttgcatggctctaaacattttcagaattgaaaacttatttagggaaaaatttggtaagccctatagatgcttgaatcatccaaagtctagtaaataagtttagtattaattgccacttttatatttcgatgctactaactaaaataatacaatagcctactgttaatttctcttctgcttttcctgagcttggcaaagagaaaaatgtgacaaacaccacaaatagacaacacaccatttgtaatctggtaaagcaacttctattcatggaatttcttccctttatgaagcgagggctatctaatttaatgaaaatagttgtcaccacagatatgacattctgtctcctaattaaatgaagatgcaatcagaacttcccttgaaaagagaggccaggcttccttcactattaagcacactcttccctaagggcaccctcctaccctttttctgatatgcaatcccttctgtcctccatctgctccacccccacctattgtctccactcactccaagcatgccaatcccatctggctatactcttgcttctgctagctctaattctccacaggcctagggaatgtttgaatgccaaggcatttttgcttttctcgagaataaggactagctaggagggtatcaaacaattccccaaggaattcacacacacatgaacatgcacatggtctctcacatacacaaacagcagtttagaatcctcctctaggatataatttctttaaaaatgtttttaattatttcatctgggaggcattttagaaaattaaaatcttactattgttgaaataatcaaaattaatatttcagaaataaacactttcattatcccagacacgcatttttttcagtaagcagaattaatgtaagtaaatgttactcatatcttatcatgaaatatttacattaatcaggtttaatcactgatcactaatacgttttctgttttagcaaacatgcatttaattcagacattccatctttacaaatgctcatgaaaatcccactctgccacaaaagcatgcatggtcagaatctaagcatatttaagcaaaaatttcagcaagtcattaacaataataaagcagtctggcaagtactgaaagcagcttttattcatgcttttacttgaactaagttaatacatatatacatacatatgcacacacacacacacacacacacagacacaagttttggttgtttttgccacaagcatgctgataaacccctgaagctcacacaaagcagcagacaaaactagaagcaaccatgctcagggtttaaggacattttaaaatttaaaacaacctttccacatttcacatacagcgtgcataaatttgacatgcaatcttcaagaagaaatattttaacataaatcttaaaattagtttatccaaatgagtttattcttattttcattattattgtttttaggcttctggtatcttaaaccctgcatgctgcagatctaagctgtgctcagcagcggctgtgacagaagaagctacctgcaagttttcacagtgccatctcatatccatgtctgtctggctaccctgcgtgcttagagcttttttcttaattcttaatggaaatcctaggaaatttagtccatcctctgaaatcaatactggtgacaggagagctccctgactcagtgggagatcaagatgataaattgcctgcgcatcagcccggcctatcagtgccctgcacacagatgggcgagaaaagacacagaaaacgctctgtcagtcacgtgtcactgaggagccaatggctgacgcactacggcaggaagggatgctgcagttccgtctgcagttgacgaggctgttggtacacagcccagcccggcaccactcaaaaagtctcagcagtcgttgcttttcaatttgctcccctaacgagaccgcataggtaaacagacctccctctaacccccgaccgaaaaaaaggcttattttcatgcacgaacattttctgtatattacattcaaatccagtgtgattgctaaacacagaggggaaacttttttttccccagcccttaaactgttatgtgtttttcttgagataattatctttttacctaatattaaattagaagacttaaaactgtgcaattagcatggaaccctcctagtagaatctcctcgaagccttgtaattgtaattacaattttatttgtaagttaatgaatgacattttttgaatgccaagtttataatgagtatttttatgggatgagtttgtaaagacaattatgcaacattaagaaatacattcttaggcttttttttttttggccaattacaactgttgctctttaaagacaatttaagtcccaataaatatgccattttatcaatcattaaaaataaaaacaagcaccaaaagatgcacatcctgtttcccaaagcctgaagaacaaatgtattattcaatgatgaaaatatgtacttatttgctgccttttctctgaaatttacaataattatttggtaagcaaagactacacatctggaataccatatggaactatatccccaaatacatctgtttccagtgatcatactgtaataacagatatgtttacacacttcttcaatgtgagatgattatatatagttatatatacatatacatacaattatatattatatatatgattatatacagtctgacagggtaggctataagtgatgagaccggtgtgtgtttcaaatgacagtatcacggagattttttttttaaagctcaaaagtagcataaaacaatcttcaggaataaaatttctagaagaaaaattaccctagccaccctggcacttttattgcttttcattgcccagttttcatactattcatacatttgaaagaattaattctaacatcttttagagtctggcaacactatttagaaaaaaagtgtattggaataaacattgataggtgtgcctcataagtaaagcttatgagttgtagaatgctgaaattccaaagctcaatttgtcttggcaactatttttttaaactaaacacattcctgaaagattgaaccctgtcaagtttttttgcaaattctttctttcattcaatattgactatcaggaaataataaagcatttttcaagttttttaaaatagatgttgtcatgtgtttttttctatttattcagactattcaataataacgtaattctcaacaaactttattcttaaaaaatattatgactcagagcacctgtcattaaaaacaaaataataataaaacatcaacactaaacctattcattagagcactgtaatagccccaaactagaaaccaccttaatcactgatagtaaactgagtagataaactatgatacagccttacaggtgaaatactcttcatctgtaaaatacaatgtggtaaatcatatgtccttatatgaagagatttctcagatacatttgaatgaaaaagccataaaatttaaattgtgtataggctatacttacttacataatacatgcatgtatacacacacaaatgattgcatatgcggaagaatttttttttttttttttttttttgagatggagtcttgctctgtcacccaggctggagtgcagtggtgggatctagactcactgcaacctctgcctctcaggttcaagtgattcttctgcctcagcctcctgagtagatgggattacaggagagtgccaccacgcccagctaatttttttttttttttgtatttttagtagagatggggttacaccatgttggcctggtgggtctcaaactcctgatctcgagtgatccgcccaccttggcctcccaaagtaccaggattatagaggcatgagccaccctgcccgacctacaggaaatttctgtaaggacataaactatcagttaatagtggccaaatagtggctacatctgaggagactgagttcaaaggtaggactgagacatagttttattaggtatcattttatacattttgtttaagtctatggtttacttttctaatttaaaatgaattaagataatgttatcgatgttcatgtaggtttagaagagcatgactggtatgttttgagggaaaatcttgagggaaaggaaggaagacagagggaaggacatgtggcctgctttttttcatgtaaagaaaatagtgtaggtgtgggcaagaagggaactgtaaaataaaggttctggcaatctctgctgaagaccttcacatctcatatcaacttgaagttcttttatctatgaatgcaaataataatacagacatggattaagagctttacaatttagagtgacgattaacccaaattttgtctgattcttccaggaacgaatgtaaaaggctgagaagtaaatgatttgtatatttacccagacatgggcaaattaacctcttcaagccttagttttctcagctggatgcaattagcaaaaagtggccaagctaaacttgaatttcaatttagggtattgttcactgctgcttcaaaggcaaaataacatccatgtttttaccaataatggtgtagggctaaagacaaaacaaattttcacgtgtttcctccccagaagcagcttatgttgtccaaaactgaaaacttggcttatagattctattgttggctcttgttgttattcagattcttgtaactttaagagatacaaacctaaaaaaaaaatgaattggccaaattaagtcaaagattacaatttgaataatttaagggttttggggttttacataaaagtgctgtaaatcagtggtttcggatggtgattttgctccatcccaccccccagggaacatttgacaatgtttggtgacatttctggttgtcaaaactggagggtgctagcagcatccagtggatagtggccaagaatgctgctaatcattctataatgtacaggacagtccctatcacaaataattatttggacccaaatgtcaacagtgctgagatagagaaaccatgttctaaatgctaaacttttctaccttctttccgaaagattaaataaatatattctgtattatgaagcatatattgtaacgtgacaagatttagatggagaagagaaggggaccaaggaccaagccctgggtttctccaattttaataagttacagaaaacaggaaaaaacagcaagtgaggatgaagagatgggaggacaactcaaaggatggtgacctggaagtcagtggtaaaagtgtgttagtaaagagattagggtcaatttgttcaaatgctgtgataggtcaagttatctgttcttcataggttttttaaaagaattaaagtgagaaattaacctaattgaaattaacagtatacttgaagtctttattgctctgcatgatatttgcatttttaaaggtatggacagaaaatgtagcggggcggtggctcacctgtaatcccagcactttgggatgctgagtcgagtggatcacgaggtcaggagattgacaccatcctggccaacatggtgaaaccctgtctctactaaaaacacaaaaattagctaggcgtggtggcaggtgcctgtaatcccagctacttgggaggcagagccaggagaatcgcttgaaccagggagtcagaggttgcagtgagctgagattgcaccaccgcactccagcctggtgacagagcgagactccatcccccacaaaaaagaaaatgtagtaattacagggatcacaggaggactagctgaggaaatatataaaggagaggaaacttctgtaactctcaaattataattctgaggctactttctctacaaaggtgggcttgtgagcaagaaagtgaacaaatcctatcttggaccaccctacaccacagcttgcatgggagacagagtgccaccctctccccttagaaactatgtctgcagttcttgtcctcgggctctcacgaagtgtctctatccatagataaggtttctgaaaacagagttctaaggactaacttcaggtgcttttcctcctgggactcctctaatgctaatccccacactgtcaggcctgtggtgttcagggttagtgcagcaaggctcaaagacagagccagctggaggactaggacactggagcagctttaagcaaagctaatgcctttgttgcaaaggaaatgttagaaatctcacagaaaaacagctgggggagggagggcagaggagagagagagagatagccataaaaagaaaagagaggccacaaaaaaaaaaaaaaaaagatgaccacaaacccatggatattattacaaactctatggtgtgggagaaaactacatgtcacaattctcttaaaactagatagatttttacaaattgaatagtccaactccttcgttttagagatggattttaatgtagagaggttaaataatttgttttaaattttaagtgaaagtgacattctttaccattcaaagcaatcagtgaacctgatattgacaaatttcaaggtgctttcaaaaatcatcatagataacaaccagggtaagacttaggggaaggaggtcgggtgcgggggctcatgcctgtaatcccagttctttgggaggccgaagcaggtggatcacaagatcaggagttcgagaccagcctggccaacatggtgaaaccctgtctctactaaaaattccaaaattagccaggcgtggtggcatgcacctgtaatctcagctacttgagaggctgaggcaggataatgccttgaacccaggaggtggaggttgcagtaagccaagatcatgccactgcactccagcctgggtgacagaacaagactcaaaaaaacaaagaaacaaaaacttagagggaggggaaaagttgatgttcagtaagagataaatctccaaagccttctctttcccatgctgatgctgtattaaggcacggagagcctttgctatcagggagaggaagtattatcttccaaaatattccaatgagtatttataggttatgaaatacaaaagaagaagccttgagtattctcctttcagaagaatttaagtggctgctgaagttttttttaaatgaaaattctcatctctatttgcactacagtcatgatgaataggatgcatggatgactttcaaaagacatatgtcagaaagtaaactccagttgacaggaactatagcatagggaaatattttggactgttttcagtttttaagagatgggaaaaatagaagtggtggaaaatccaagcagattgtcttagttttttattatttttcctttttctccttataattgaagcactactttgagactatggagtaccattaaattcctattaactattaatttaatatttgcaagtatggattagagataggatggaaattaatgtccaagtgagtaaaattccacatagtcttatattgtttttttggttttttttttctgctactgtattcttgtgggttttgtttttcttactctggttgtttatctaggtatatatgctttgtaaaaagcaaacagaaacaaaacatctgtggccccaggcaatcttttcattaacattatatcctaaaaattattatgctaatgttaaaaataaagaaattgggactcagagggattaaataacatatatatccatgaagctagcaactgaaagtctacgactacattttgaatgttctctccaaatcagaactagcgttccagaatagttgttgttaaagtttattatgcataagaaccaacaaggcacacgttaaacatccagatttctgggcccttccatggagactgattcctactctaactcagatggattccaagagtctgcattgttaacaaacattccatcttccatactttaagaaccttgggaccatattggagtttcagcttcggaattcttctttgggaaaagccatatcaacaagatttcaatgaatagaaatgggaagctttaaaaaaatagaaaggaaagttggtaggagtagttttttaccaagagagaaactggagcagagaatagcttcacagcagagaggaaaaatgcagatgacttagagccatccattaagggatagtttcccatattgagttagataaagtatgaagtattttagttgaaaatatttttgagcaaggaagattaatgtgcatagaagaaatgtacaaatcatagcatttagaataggatgacccttttgaacctacaaatagggcacttggctgaattggttcctacctccactgctgcaattagaaaccatgaatgtgcagatatacaggcaatgtcattttgtatatgctagaaaataatttattttcagaggggttttcatatgatgggtttctagacctctagagagaggtaaagtttcctttataagatgagaacctactgaagtcagatgaaaacctccccaattgcttgacaataaatcttcccagagaaaagtcctcagccatttcatgtgaaatgatgactcatgaaaatgaaatagtacactgtacagaaatcttgcaattctagtttttctcctagctgacttctaggttggaaagcttaaggtcaaagattagtggtgccaaaacatgctcattttaggctaatctctacatttcctactgccagtctctgaccagtttttaaattttctgagctttttggcatgctatgtatttctcttactttgacagaaggatgacatactattcactttgatccaacctcaagacccaaaggataaggttaataaggaactgaatctttcaggacaatgcagtttaccaaacagtagtcagtgactaaatatttttggtaactgattgatgaaagcactcatcaaaaaaccatagtccatggacaagtccatcagaagaaattaaggaaaattggaaaaaaggaagaatgaaggggagggagggaagagggaaaagaactaaaggaaaaatgaacataaaaccttacatgtagttgaggcacaacaatggactatacgagaaacttttggcttgtcagtgaatacagcttgtcaggcattatcaagtgtaaatcctcttcccccccacttttcccgctcttgataatgacccaagcaataatattttatgcaacaagaatgacttaaataagacacctatgaagaaggccacagatgacttcataaccctatgcatatgtacatacagaacccacatggagtgaatgttgcctattaacaaaactgtgaaatctgagttagaaacaaagctcagcttggactgaatatataaaaaaatcagtgaacagaagatattttcaaatggacacttacataaatacagcattccaagggaaaattccagcctcagatgcacttatttcatgaagactcaatattttatagcaatggttttccaaagttaagttgcttaagatctagggtgcttattaaaaatgcaaagtgtctggacccaccctgatctaaggaattataatttccagggatgagagtgaaaatctatatgtataacatgtactccaggtgatcctgacgtaggttgttttagactttatttgagacacacactctccaatgtacataaagtcaagaaccagattcttctccaaccatttcctgcagatagtcacaccagccttggacatgccgggtcatccaattcaattattaaacacaatgtctttcatttggagagatagaagattgataaatctagaaaaagattaggaatgatgagatgaatagattatcaatagatttcatgaaacaggttcgattcaatttgggccttgaatgatggtagagttaattattttggcaaaggcattgaggtataaaatgtttttctttaaaactgttagaatttattattaaaatgataaacttctttatcttttcagctggagggcttagcaatgcttccagcacatatgaaatcaccaataactcttagttgaattagtaaattacatgaccacaaaaaagtaaatctacttaaaaaaaacacacaaaatcccaccaccttgacaaaacttcatgatttttgttgatgatgctgttgttttgatttttatttcaaattcttcatttcttatttgtatagtttgaatagttatagtaataaagatataattttctttggttttataagttatataatggcacatacattttccatcttgatttagaatattcataattattctagtagcaaaagaataaataaaatggatgtattgtaatgtacatacctattctgtgttttttagataatggacgcatttctattctgcatttctgctttgtaaataacaattttcttcctttgtatttttttcataacataagtgaccataaatgagattactagactaaagacatagtgtttttatagatcttgaaacaatctgttaaactacttttcaaaagacttgttctaattttcacattgtctcaagcatgctatgttctataacatctttactggcatgaacatgctgtcttttctatctggggacgcccttttcccatttaaataaaaaatcttggtaaactcctacacattgttttgtactaagctcaaatgctattctttcttgcagcctttccaaatcctctaggaagagttagtcattatttccattgtgtttccatagtactttgtaataatactatttgggacacttattcaaatagctctgtgtttgttatagtttgtatatttcttttctttttcctagattattagcaactcaagggatgagccgctgtccacttcatctttggaacatcagcttctagcacaggggctggttatattagacattcaataaatgtttgttaagcaaatgaggaataaatgagtaaatgtcaatgtgatactcaagtcaaaatctgtggctgtatgttgggtaaaaatgctttctttccttaagtcttttataggtcatttagtactaggaacatttatatttttacgggtcttttaaattatatttttatacttttaatatttatatattttgtaggtctacatttttaatacctttgctgatgactttcaggcttagatagcacaattctatgatatgctgtgagtcagatctttgagtcctttagataatgacttttaggtattctggaatcagaaaatgtctttttctagttcatacagaaacaacttttgttaattaagtgttaggactagtaaataagattagaaaccacctgtggagaacacagcatgtacatggccccactgtagatggaataaatgttttaaaataactgctgataaattatttaacaaaatataatcaataattattctaacatatatcactgtgcattttgttgcattacatatattctctcattttctctctaccaaaactggtaagaaatacaaagactggacactgtggctccttcctgtactttgggaggctgaggcaggaggattacttgaggccaagagtttgagatcagcctgggcaatagagtgagatctcatttctactaaaattaaaaaaaaaattagctgggtgtggtaatacagcacctgtagtctcagctactcaggaagctgaagtgggaagatcacttgagcctaagaggctgaggctgcagtgagctgtgatcatggcactgcactccagtgcggtcaatagagtgagacctggtttcaaaaaattaagaaaaaaaaatcagaaaaagcaaatacagacaaagcaagtataccataaatgtaatttgaaagataagtaatctaacacacagaaatgtggctagcaagtggaaaaatcagaaccagaattcacatattttaagccacattttagccttcattctagtaaaatcactacacccaactgaattttgctaatttcaaactgagaaaatgagatctgacgtcgtataaactaaacaggtgttttaaaaacaaacagaaacttctctagcaataaaaactttttttccaaaataatgcttatgaataattcaatataaaaaacaatatcagaggactcatattgaagtgagtggccagtgaaggggggctcctttctctcctcttttatggctcttggtagttcctagagcttgcactcaggaaagcactgtattgggccatttctttacttagtcattcagtcattaatacatcttacagcctaactaggtacaaagaattgtgggaaagataaatacaagacaaagtcctttgagaacacacaaacacacacacacacacacacacacacacacgatagtatattataaatgccacagaagttatattgcatagtagtaagcattctgaaagttcagagaagaatgatgtctagtcccataccctggattgagttccacatgtccacctaaggacacacagattttgtttcttatttggtgacttggtacaaaccatttaatctgcctatttgggcatccattcctgagaaataaaagtgatcaatgttgccaatccaatgcatgtaatatgtgactatagggagagaataacttagtggagagaatggggcagtgaaatcagacagatctggttttacagctttggcacttagattgagctagttagttcaacttctctaagtcacagctgtttcacccataaaatgagagtaacagcaatatataccttttgaaaatttccataaggtatcaataagataaaatataacacctagcagagaaactagcatagattcaatggtcaataaatagcagaaatccttattaactattaagatgaagaagttacatctaggatttgcatagactattttgattctacgattcaataaattttatttttgacataactcattcaccgtggaagaaattagtgttctatatttaatgaagaccaaagactttggcttggtaaatactattcttagaattttcctccttttcaagctgtatagattcatgtgaagcctggaaaagacgctactatgttttattttgcaatgcactagattttgcttgtactctttagaaaatgttaggctttatttcagtcgtcatttgtgcataaactctagtcagatcaagcaaaaacaatgaagtcattagtgtgcactgagtttagtcacttctttaaatgctacattaattgctttgagattctctacttccactgtgacaagcaagacaaatggagtttacctgcaggacacatcaccagtcaccttcccagcaagctggctacaacctcatctgctccttttcacttaagaaggcatactgtcatgcaaatgagtgagaatgataacacagacaaaatcttgaatctacattgcttgatatttacaacaaaaaaaaaatattcactcactttggaagttaaaccattattagtaatactgacaacacatttcacattcgatggggccataccaatatgtaacaatttatggtacagaatcacttcatggtatgacccaaggaaatgtacttcatttgtggaataattaaaagtccatcctttctgtgaagaaaatgctttatactctgaagaccactatcatgaattaaaaaatccagtatcacaaattgtagacaacctaaaagaatgttaacttaataatatgtgacttcgatctaaatgaagtgataaattggccagaaactcagatgccacagggcacatatgttacataaataatcacataaataatctagcatttctctaaagcagcgattctcaattttggtcttagatcttattgtcactgttaaaaataattgaaaactccaaagacatacatattgtttatgtagattacatatgtggatatttactctattagaaattaaaggtgataaaagttaaatatttaactgatttaaaaataacaataaacccattaacataaatttaaaaaggaactacattttcaaaaacatacattttaaagaaaataatactgttttacatttttgcagatcttttcaatatcttttaaattagaagactggggctcatatttgcttctgcaatctattgcaatatttcatgtcatgtagtctttaaaaaattccactgtatccttatgaaacaatgagaatgaaaagggtaaagttttttctttttttgttgacatataataactacatatttatgagatacagagtgatattttgatacatgcatacaacatgtaataatcaaataagtgtaattagcatatccataatctcacacatttatcatgtctttgttttgggaacactcaaagtcctctcttctagctttttgaaaatatacattaggttgggcatggtcactcacacctataatttcagcactttgggaggccaaggcaggtggattgcttgagcccaggagtttgagaccagcctgggcaacatggcaaaaccccatctctacaaaaaatacaaaaaattagccaggtggggtggtgcacacctgcagttccagttacttgggaggctgaagtgggaggaccacctaagctgggcaggttgaggctgcagtgagccactgcgttccagcttggctgacagagtgagaaaaaaaaaagaaaatatacattaaattattattaaccatatttaccctgcagtactatagaacactaggacttattcctccttatctaactgtaattttgtatctgttagccaacttctccctattcttacttccccctttacctttcccagcctacaattctgctctctatttcaatgagctaaatttctcttagctcccacatatgagtgagaacatgcagtaaaattttagtattattttgaaaataattttgacctcactgaaaaggtcttacaacactcctttcccctgtcctaagccttggcctcccaagacttctagatcatattttgagaaacactgctctgtttttataatatttagagcatatattatttattattttttgtgtctaatttacatatatgtcctattgttgtttccctatttgaaattttcctgatggagatcatcattacaaaccttaggtatcactttacagcatgtggtaagcctgcctggaaccacagtgtacctcaacatgtaatattgattcaatgacccattgatagattgaagcctatagtgtcttatggtccctttaatgacctttaaaatatgtgatatagtagtatttttatagtttgtcaaattttgagcccattatgtcaacattctacctaaatagaaggatgagctaatcatacataaatttattctagatgaaacaacgtttttttttttttgactcagctgtgacttttggaaaagaaactagaattctagagaagttattattatacatttttttcctataaaatttatcctaacatatcaggcaatattttaaggtctaatcaatttatatatttagttgtaatttcacaattacaaaacaattgaaagcaaaaatatgaaaatcatcagtttgaattgatttgaagctatagtttcctatgtctatgagtggaacaaaaaaagtaacaaatattacttttatgtgttctactgccaaatcagatcctttgaaaggcacccacttagtaacttggaaatgaaacatttatacattcatccctgctaaattgctgcaaaatgtgatggttgggaaatatatattaaagagtgaaacagtcctcctaaattaaaggttttcttacataataaataatttctttgactctttgaaaatggttccattatctcctgatctaggaaacccacagagaaagacttagtgtctgccattaccttggtaatcagataattattctgactattctatcagaaaaaaaaaaaactgtacatactgaaaagaagactctttcctgctaaaatctgggtaaacaaaatagctgctagactgggaaacaaaaagaggggtcacagatctgagttgactcttcctttttcatgagtcataggacagcagatatactagttgtcttttgctttcagaagagttttacattacctaaactcatggctgaatcacaaagtacatggccagaagacttagtgacttagtaacagagttctcttagacattttaccctccttaaactaattttggtcttgacacagttaactattaaaaaaaaaaaaaaaaaaaagccctgaagcctgcctattcacctctgatcactgagaatgaattgaattatcaccgtacaaataaatttgggaagcaagataatgggagggaaaagagatgattaatatttgaactgtaaaggatatatgtctgaaatttaattattaacaaatgtgcattgatgcaattatgtaccattacatagcagagttaagaaatctaaattaagtaaattgcaaatgctataactaaacttataacaagttattttaaaaattaaaactctcatcagttgaaaactatatccaacagaaatcaggcaggaatttctaccacctgttcatatgcatgtacagtgggaatctgaagcattgcccagcacaatgtggcagccagactctagattattccatttgagttctgagtaactgtaattgtatgctattttaagcttatgaatgctaagattgtttaattcttaataagctgataggtagcccttaattgcatgatgaaaatccaagtccaatggcttgtgtgccacttgcctataaaaagcaaataaaggacttacatttctggttcaggttgtaatccaccaagtgaaaccttggggtctttaagctaaggatctttacttgaaaatcactgttttatagcttattaaatttccatgtcaaaaatatcaaagaagtcattcaacaaacatgtattgggtctactaagtggcaggtctctttaggactctgcagatgcagtagtagcaaatgtgataacaaggctctaagtgaattcatcttctatttgaagaaagtcagaaaaccaacagccaaccaacaaaccggtcaatgcactccagggaaagaccatgaggagcatacctttacttgaacaagtgagtttattaattgttgtagcaaggaagaacacacaccacacggagccatgaagtatcttagtaagatactaagtaagggcattagtaaaggcatattaaaaagaattcaggcttattcggtgattctggggagggtttaagaaaacaggactttgttctgtactggatgctgccagaaagtagaagcaattctaggattggatagctcaataaatcttatctatagcaagagcagactagagtgagaataaagttatgattggtaggaaagtagtattcaacttaaccaataagatggtttgacattttgtgggttatatagtgacaccaatttttatctgttttttaatgaaaaaatgacatagcattattttcactcactttattatggtcttagtgtgactgtgtttcatgttggtactctatgaagttatttctctctaatgggtgaacaatatcatctacctgtgggctccaggccagcttctaacaatgctgaggcctcacttacggattagatcagttcccagacaacaggggctacttttccctttcaatcatgcaaccagccaagcaataaatttaaaaaaaaaaaaactatcaaagagtgatagaacatagtaaaagggatggccctttatattgggtgttcagggaaaggctgttagatttgaacaatcagaaggagccaacatatgactacagggggaaaaacatttctgtcccagtgaataactactgccaaggccctaagataagaaagagtctgagcatcaaaagaaagacagtgtgatctaagaatgatctaagagcacagcgaggaaagacaaaaggaaggagggagagccaggtggccagatggaagttgtgtagggtaggtagggtattgtgactttattctatatatgataggaaatcattgaaggttgtaagagcagaataatgacataattttatttatatatttaaaagatcatcctgtatgttccatggagaagcagagatgtgagtcaggaggttttgcagtttaggcaagagataatagtggcttgccacaggtattggtggtggagaaggcagagctgactgttctgaagtcagtgttcataagacttactgataacatatcagtaagtaatttgggaagtgaaaagcaggaagaaatgagtgaaggatgatcttaatagttacttggttcttaatgtcagtgataatcttattcatcatgttattcctaatacctgattcacagagggcactagatatagaatgaaagaataccttttgtagctaatgttggcactattagcaagcttcaaaagtatctgcatttattaatctccagttggggtttggttcctaatttcttctgttgatttgcagttaactcagtggtggtagcaaggtacaaaataccccaggactacacagaacaacacaatcaaggtagaattgacacaaataactcctaagaaaatgtttcctacatatagagtaaataatttactaaacatgcttaaaataaataaatttggaaaaaaataaaataaatagaaaacttcctcaaattgataaagaacattcttaaaaacttattactaacatcatatgtaatagtgagaaacttgacacttctccactaagactagaaacaagacaaggatatctccctttcaccaactgtttcaacatcatatgggaattactagctactgcaataagacaagaaaaaaatagtaggaatacagattcagaaggaagaaataaaactatctttgcttgcaggtgacacaattgtgtatgcagaacatctgaaagaatcataaaaacctcctggaactagtaaatgattattgcaaggtcacaagatacaagtttaatatataaaagttaatctctttcatatataccaacaatgaacaagtaatattcaaaataaaaaaaacataataacatttacattagcacccccccaaaatgaaacacatagatgtaaatcaaacaaaatatctaaaaaataagtagttttcttctatataaggagaactacaaaaccttgaggaatgaaatctagtaagtaaataatggatagaactaaataaatggatattccatgttcattattattgtcaaaatgtcagttcttcccaacttgatttatagcttcaatgcaatcccaatcaaaatcctggcaagttattttgtggatgttgacaaactgattctaaagtttatatggagaggcaaaagaactggaatggctaacaaaatattgaaggagaagaacaaagttgaaggactgacatcatctaacgtcaagccttactataaagttataacattcaagacagtgtggtattaatgaaggaataggcaaatagattaatggaagagaagaacccagaaacagacctagataaatataatcaactgatctttgatatagagcaaaggttacataataaagcaaagatagtcttttcaacaaacggtgctagaacaactagacatccatatgaaaaataatttagagacagacaattgacaaacattaactcaaaatggatcaaacccttaagtgtaaaatgaaaaaccataaaactcttagaagacgacacaggagaaaaacctagatgaccttgggtatggcactgactttttagatacaaaaccaaaggatgatccatgagagaaataattaatgagctctacatcattaaaataaagaaaaaacttttggaccgggtgcagtggctcatgcctgtaatcccagcactttgggaggccaaggtgggtgaatcatgaggtcaggaaattgagaccatcctggacaacatggtgaaactccgtctctactaaaatacaaacaaaaaaaaaacaccccaaaaacaaacaaacaaacaaaaaaccaattagccaggcatggtggtgtatgcctatagtcccagctagtcgggaggctgaggcagggaaattgcttgaacttgggaggcggaggttgcagtgagcccttcctgcctagcaacagagtgagactctgtctcaaaaaacaaaaacaaacaaaacaacaacaatacttctgttatctgaaaaactctgttaagaaaatgagaagacaagccacagactagcaaaaaatacttgcaaaagacctatctgataaaagactgtgatccaaaatatacaaagaactcgtaaaactcaacaatgataaaacaaaaaaagggccaaaatcttaacagacacctgaccaaaaagagatatagatggcaattgagcacatgaaagatgctccacattatacaccatcagggaaatgaaaattaaaacaacagtaagatatcattacacgcctattagaatgaccaaaatctggaacactgacaacaccaaatgctggcaaggatgtcaagcaacaggaatgctcattcattgctagtagaaacgcacaatttcacagccattttggaagagagtttggcagtttctaacaaagctaaacatacttttaccatacaatccagcaatcactctgcttggtatttactcccaaaagttgaaaacttacgttcacacaaaaacctgcaaagagatgcttatagcggctttatttataattgccaaaacttggaaccaaccaaggtattcttcggtaagtaaacgggtaaataaatggtggtacacccagataatggaatattaatcattattttaaaaaatgagccactgaaccataaaaagacatgaaggaatcttaaatgcatattactaagtgaaagaagccaatataaaaaggcaataatatggtataattccaaccatatgacattctagaagaagcaaaactacagagacagtacaaagttcactggttgctaggggttttatggataggatgaataggcagaacatagaggatttttaggtctgtgaaaatactctgtatgacactataataatagatccatgccatgatatatttgtccaaatccacagaatgtacgacattcatgtaacctctggcctttggttgattatgatgtgtcaatgcaggctcaccaattgtaacaaatgcactactctagtggagggtgttgataatgagggaagctatccatgtatgggggcagggagcataaagaaaacctctaccttcctcttaattttgctgtgagcctaaaactgccctaaaaattgtcttttgagaaattaaaagacatttagaaatcatggaaaaaatagaaaaacgtaaggcaattgctcatcatagcagataaaaaatccaaaggttctgaattctgtcccaaaataccctcaatagggtgtccacctttacctcattaacttatttgaatggtacatttgtatctcttgaagaactcttagaagaactggctgtggtgatgttttctgccttctgtcaacctttcaaaatcacatgcccatcagatggcattctcaaatttcctgccctgtaccccaagagaactgtcctcaggaacaatacagaaactgcctaactaagtatagtcaataaaccactgcttcagaatcacaccggggatcctctgtttcccttcacaagcagagtctctcaggaagcagtaatgaagcatagtacgggggtgctcctccttaatgcctatgaagactcataattggaacccaaacttgctcttcaatgtgttgatgactctgcagacaaacctgggcttctctggtgtgctttcttattgtggaaaccaacaggtcaaaatattaatatgtgcaggcagaaataggtgtagaatataagcaagaggcctctttctttctctattggtatgtttgaagcaatatgactaatagacgaatccagtctgttttagaggtttagtttgggaaagtccttgtaaggcattaaaggagtagttttaattcacagataatacgacactcagatacaatgccagaatatccaaaataatttattgcattctacacccatggattcctgaaggttagagtatatttaaactacaccggtaagagttgttgggaaaaatacaagtatctcagagatcacatggtcacaacctacctataaggacctcaagccatgtaaaaacatcacagctgagggaactacttcaaggaaacaaagacagaacatggtcatcctaaaccccagaggcaaacttacagccattaaatagactcctttggccagtcatgctcattcattctcatttaaaataattatttgatgatacagtcaaacaagaaagtattctgctttttgtaaggcaaaaggtgagagtgaatttctagaagttaataaacaggttggtagttttcttccactttgctcataacatcatggaaaaatcactgaagtgtgagaaacaggattctgtcacaccagtgcctcacatccaatgctgcgagagaatgaaatattgacaatttaggtgtagttctcataatttcacccaactcaaaggaatgactgaaacactccttgataacaagaaaacacctgaggaagggagagaaaataatcattctctccaaccttctttgcacctttcgatttcatatagctaaggatacacatttctcacagtgattgaagagggtggcaacatctgtcaaatctgtagagtcaagacatgaaattcaattttaaattctcagtagaggagaaaaatgagagaaaggtaacttgtaatttcttccaattagatatacaggaataactaattgaaatgaatgttttataaaaaaccttcttttactttttaaaaactgaatttctacattttaataacattgtcatgtgtaattataggggtgttgaaattttgtttcctcttttctgagccctaagtttgccttctgagagaaaatcttgaaaatgtagtcatattttaaaaagtggtaaagcctactactgttcatatcattttcaaccatcagtagaccttaaagataggaaaagaggccgggcgcggtggctcacgcctctaatcccagcactttgggaggccgaggcgggcggatcacgaggtcaggagatcgacaccatcctggctaacatggtgaaaccccgcctctactaaaaatacaaaaaatgagccgggcgtggtggcgggtgtctgtagtcccagctactcgggaggctgaggcaggagaatggcgtaaacctgggaggcggagcttgcagtgagcggagatcccatcactgcaatccagcctgagcgacagagcgagactccgtctcaaaaaaaaaaaaaaaaaaaaaagataggaaaagaaagaaaatagcctgtacttcaagtatgaaagcaccatgctggatagtaaaaaaaaaaaaaaaaaaaaaagaaaaaaggatttagagagcctaagtgtatgccccttgggtctcatgactctgtcaaaatgacagggtgatttccagaaattcattaatcctttcaatgaatatttactgagcatccacagtgagcagtgatctgcacaggaagctaggagtgggatggggtgagtatgatgtacaatgataaatgagacacagaaaatgcctttgaggaccttatggtgtagaaggggagaacacatactttctcctaccttgtattaaaattatttgtgtgtgagagtcatgagaagtataaataaggtattatgaaagttcacagaggtaaaaaattaattcttacagggaggaattgcagaagtagaaataactgtctttgcctggaaggatgaaaaatctcaggacatgtagagaaggtagaagaacattttctttgaaagggatgggataagcaaggacattaaaaagatagcatggtgtacccacaaatcattcagtttacctgaatcaagaggaggacaggaatggaaaggaagattggggatttacatagtatggtaggctaaatccatctactttctaatctctggaatttttaaataagttaactgacatggcaaagtctttgtaggtataattaagactcttgagttggagatattatcctggattgtctggtgggcccagtgtaatgacaagggtcctttcaagtgaaagaataaggcaaaagaatcagagtcagagagagagctatactaatggaagcagggatcagagtgatgcaaggaaggggccataaactgaggaatgcaggtggcttctagaaaatgaaaaagacaaggtaacatattctcccctaaagcctccagaaggaatgcagctgccctgcccatccatgctagacttccaacccctagaactgtaagcaaatttatttgtgctgttttaagccactatatttttggtaaattgttacagcaacaggacacagatatagagtggaatgttttgaatatactacatcttagtccaaataattatttatccattctctcttggtgtacctcaacttttacttattatttcattacaacatttatgttgtattttttatttttataaaatatatttgcctgtctgcttcgtttgagttataaagaaggtgaaagtactactaacagaatacagaaaacccacaaagagaaaaatatttaaaagcaagatgctgaaatctttttcgaacacagtacgtttgaaataccaatgggtcaacacggtgggtggacagttggagatggaaattcatgcctcctgcttgaagataagagcgcatatctcttggaagcaattacaaaaatttattatagctcacaaaagagaatcattgaagtgtgactattgaccattgggaaaatttaaatagtatgtattcatgagaagggaattatttaatcagggtattttgacataggttgctggaagaagtgattttatattaagtattattagctaaaatattatcattttaactacctgtgattacctataggcaaggcataaggcaatctactggagatgaattcacgaatggagaaaaagaccttttaaagaaaagtatgtcatctacaagtttcttggtttttgaaatatctctagcaggacattaatccctcaacttctcaagtattttctgagtatctactagtgcaaggtaaggtcctttattcatttttatcctaacatagcctttggctttgagaagcttattgtctccttgccatgtaaagttgtgtacttcctcaaaatactagaaatttagaattttcctaaattatgattttccccaagggtatataagttttaagtctcaaaagcatacatggcctatcttacagcctgttcctagagttcatctctctaagatgagtctgaggtcactctctgcctgggaatctgaggaagctgggccgccggggtgcaagggagacttcacatagggaaaggaggcaaggaaggcttaaagtgagggcaataaaaataacctttacctgtttcaagtcttgggttggcccagactaccaccacttcagggatttttataaaatgctgctgcattgcttttgctaaaagagagccaggtcagcagagtgggatgacctttcccaacagaaatgccatgatgtttagccatcaagcagaaatttcagggacaataagatactgtagtctgcatgcttttatcccaaagtgaaaaccatagaggtcaaaaatatgagttaagggaggaaagaattaaaacttttacctgctctaaactctgaaaagatgatggtgtgttcatccctgaaccttgtctcaacacaatttcagagaactataaatgatgcctcctaacagactactatatgacccgtgactcctgaagtagtacaatgagaaggataaccttcaccacttgcaaatcttaatgcccatgtatatacacatgtacatatttttaattgtaaaatgtgtgtaatgaattcccttcaagatagggaggatataatttcccataatatgtacttggttgctttttatatttttttagaaacgtcaaacttttttcaaaactttttttggaaatacccagtatttttttgctacccaaaacacatgtgaattggagcatacttctttatgtaacaattaaaatgtaaaatgaaccaatttttgctgaaaaaccaatctgaaatgcagtattcacttccctgccttcttaatcaaaggatgatggacataatttaacctttttaaaaaaaataatgtcatggctttcattattatgaatgataattattctacgtcgctgcgatacacagagacccttagggattgctgtggtgtatggagcttcttgcctacacgaagtagtgtaggtgctttttgttttttcattttgagccagctgttcataaatttttctctgtcttttctcactggcatgctgtatgtgggttgccttttttactactgtcgttgtagtcagtcttcctgcttccatcaactcctagccaaacaaagcaagacattcccagtgtgccaaagctcaggcaaattaccttgtactagcattttaggccgatgcttctcgtactttagtgtactacaattaatctggggatcttcttaaaattcagattctgctttggtagctctggaatgggaactaaaaatttgtgtttctatcagcaaccaggtgatgcctttgctgctggtctttgcaacacaccttgaatagaaagatattagctatcatgactttttagaattgtgtctagattaaaagaaaatttgttttgagggagtgattggctactctcctataaataagatctaaaaatttagaatatgaattttaaatatgctatctccaaaatgactttccttatctttatatccctgacaccaccacataaacatatttcccttctctatactaatatagcatttaatttcttcctctcttatggaatttatatatttataacttattatttagatataagtcaagtactgaacatgaagaggaaccaagtcttacatatctgtattttttgaaactataccttgctcaaaaatggttgttgaataactgtagcaattgaaagctataaggttctttccgtataatttcatattctttgttgcatcaatttttcaaataagtaatcaggaaatgagacaatagtataataaatcagtataaatttcaaattaactgttaagaaagtaaaacatgttttcagagttcctgcctctttgtcgtatacttatttcttcaatttgcctcctcccaccacacctcatagaacacacaaatagatataaaagcacatacaatctaaacatatatcatcttcatattctttaatttctaaaaccttatttcaagaaagggcctggaattaacttacactaaaatgtaatgactaactgcagcataaagtatatttcctaccttcaccccaagaagggcttaaacgttttaatagaaatcaaagcctacatagtggaatgaagctgtggaagaagatttttcggtttttaatcataaaacaaaaggtatattaaatagaacctctcctaatactctcacattgggtgatgtttgcactgaacttcccctaactgagaattgctaatccacagctttcctgcacctgggctgtaaagttgctacatagtgataaactgcttgtatcctgatatgatgaactaatatgcacagaaaatcctcactaaaagtgcaagctatagaaacagtcaaggctaaagcagggcaaacacaaaagtcaatttggcagctcatttgaatctacattgtgcttctttccaatggcagacagaatttatcatctactggaaaagaataaaacaaagccccaatttccattaaacatttgtgtaataaaaagaaatggaaattatataactagagataattcaaatatgtaaataaaattgtcaatggaagcagacatcatcatagcttttgagttaatattatgtgatatccattttactaatttcatccagcacacaaatttgctacttatctcacacctctaattaaattagtggccacctacatgaaattcagaatgcactcaataacaggtgcttagaaggaaaaagtgaggcataaaataagatagtcaacataatttacacagatttatataaagttgctctgcatcaacatattcctaaacaatagagattaataagaatatgactctagataatagtcccagagtctagagtcatttctcttgttaacaggatatcaatgtggtgaaaagtgtacaaagggtatctggatctgcctttcctgactctgtagattgttcgctgtgaaaatggctaggatcagctgagaaatctgagcataaaactggtgagcaaggcaggctggaggtacagatgagttctggctgagatgcggtgcagacagctataaaatgaagttcttacagtatttgctttcttggtcatccaggggttgttcaattgtgaaagtcagacaacacggccttaatttcagataagataaaagtcataaaattgttattttcttcccacaacaaaacaaacccaacaagtcagcatattttgctcaaaaggaaagagagaataggtactagcttggcagtgccttacaaatctcagaccattgtagtcagtggctttagcatcaaagggacctgggtttgaagtcacagcccaagaaagcatggctgagctatttaacatctctaatttcagatttcagtgtccttatcacaaactgtggatggtaatctttatctcacagagaggttataggataaataaaataacatttatggattgcttagcaaaatgactgctcaataaatagtatttataactgcttacattgaagacaatcatactgaagtacaaattttatgatcccttccagtttatctgaaaattaaggagatgaagtgaatgcatactaaaattctttaatcaccaggggcttaaatattaaagtatgtaaagcatttagggggtatataaaagagtaagctattatcacagtgagccacagaatgtgttaagaagatagactctggggccaaattatcgcattcacatacctattctgctgctgcccagctgcgtgctttggatgagtaacttaaatgctctctgcctcagttttctcatatgtaaaatgagaataataacatttaatttttaaataaggtaaaaacgaaatgggttaataaacataaataagagattggcacataccaacttctacgtatttacatatatatgttttagagcacacacatactgttgtaaacagaccttagactgataagtaatttctgcctcctatatctacatcttattggaattttctccctttaagcgtggacatgacctgtgacaggcttctggccagtataaaatggcaaatgttaggctatgttataaagactccatcttaggagaaaggagtgccagactctcctgctggccttcaagaagcaagcttcttgatgcaagctgctaatggagagggtcctatggcaggcagcctctaagagttgagggcctcagttctccaaccagaaagaattaagttttatcaacaaccatgcaagcttgcaagagggccctgagctctagaaaggaatgcagccctgccaattctgtgattgtagtctagtgagagccaagcagaggacttagttaacctgtgccccgacttcagtcagaccacatgaactgtgagataacaaatgtgttgtctagagcttgtaagtttgttgtcattcattacacagcatagaaaactaatacacatacttccatatagaattcagagaaaagaaagggaggaaacgaaaaagcttattttctcagtgctctgtcttagtttcaggctgagcagccttgacctggccagtcattgctgagtctatcattgtaaagtacatttaggacagaaagatcttactctagtcaagatttctcctataggccctattttagcctctggccttcatgaatggcaagaatattaggatgtcagtgatagttgtttttccagcttcagattccagttaaggaattttagcaaaacaatatgaactagaaacctttttgagagtgggaatgagagatcaaaatatttgtcttttaacgtcaaagtttactaggttttgctgacaaaactaatcttatgtattactggctttctgatgagcttctgtcatccttccctcatttttctgccctgctctgtccgccattcccgagaaatagactaggagtcaagggatctgtgtacaagtttaagcttggcttgtagttagttgtatgactaaagatgataaagatgagccagctcaactctctcttctgttgacctgaaagtgttgggatgggggaaaatagatgaacaataaatgaaaataaagttcttgagaaaagttacaagggcagaacaaatacatgacagtaatgttacaaaacagtcttgaaacctcagaggaatctaggcaactcttaaaaagcctcaagccctttccaaagtatgaacctgcttatgatttagagtctgggccaaaagatttataggatttgagaaatgagaaataagtttttctctcttagacaactcctatataaaagcagtggttttcgagatagttatgttctaaggcttggtggatgagaataccctgattaattatgcatcaatatggaatagggtccatatataccacttctgtcattagtcccttctgtacctacaacaggtacagagatgagagatcagaggcttggggaagagaaatagcttgttaagattatagagctagttactttcagctgtgggacataattacaaaggaaatttgtacatttggttattcttgttaagtatctctatttgtaatgccaaacacaaatttttgctacttcaaaagctgttttatttcttaaatttgtgatgtctctattatattttgccaatgtgaggaaatgagtgtctaatcttgtcaatgtaatatttattctcaattcctgctatattcattcctcctaatttgaaagttgataaaatctgttggcaacctccttgaagctgcaaagcagttactcaaaacaattttcagaatgttcagtataaatgggcacatgaaccattcttgaaaaccgatgtgcctttttgcttcacatgtttaactaaagtcggttataaattttaaaattatttatttaactttttcacatccttgttttaaaatttccataccataatacagtgttctttcaggatcacatgtgaaatagataatatttccaacatttcatgaggagctatggggaagaaatgatgagcaattccataaggcactgatagacataaaataagagtacatactttcatgtcattccagatagaaatatcaaagatggaacattttccttccccttgacttaacagatgcccactctcatttagaactatttcctgacaatgaaatctagttggagagatacaacataataattcaaacacattgaaataagttttgcactgaggtaaaaaagccacagggtatgaaaaggcatggtgtagttggtgaaagggaggtgaggtattacttgagtaaaaagtttacattggtggggtggcagagataaaagaagatggagatagagataggcaggagttagatcatagtgaaagtcttgtagttattttagggaacccaggaagcttaaatctatcaatcaggatagtgacagggtcagatacatattgtagagacactcttgtgagtaaggaaagactcatttataataaaatatttgtggtagtccatatgatttggtcattctgcaatacatttatcaatatctcaaaactcacaagaacatgtaagcaaaagttaaggtatatatagagagagtggaagaatctttagtattctctggtgtcaatttgtatgtgatttttaaaaattgtttttggaagcattttattttctgtttagtggttgctgtagttttcttgagtcttctccctactgctaatttaggctatttggcatattcagcctcatggttgcaaaactggggttttaatattaaaacttccattgttcatttagatttttccttctgaaaatttgtagaattattcaaggcaatcttttatatacactttctaccttcctttgcctcccaaatcaacaacctgaaggtaggccgaattaatacacactagttgtggtaataatgtagttaagttgacactgtgagctgtggtctaggcagagaatgttacgtgcagagcttctattgtcttctttctcccaaacacagtggtaggttattcacattcattccttgctacacgcatctagttaaaataacttagactttttcaggaaagacaaactgaggccaaaagctattgctcatctcattgctaaaactctggcaacattttctgaattccacagatccacagtttgagaagatgattgtttaacttgtggcatcatgagggcccaacagtttagaaaacagtgggacagcctgttgccctgcagccaggtgataatccacagtaaccaaaataataacaaatattcatgaaaccactgtctttctttttcagctcattattgaatatttgcactgtatttattatttctgctgcaaagaaagtaagaaattaccaaccaatagatcatgttcttatcaagtgccaggcaaaaataattcttataactacacactaggaagagagtaggaaactggtaggaagggaccaaaatgttatacaacaaaatactatgcacgacaaagatatggtatactatagaaagcagattatttttaaagaagcgatatagacttttctgcaaatgttaaaaattgattcttattacttgagaggaagacaacttgctccaattctaaaatggctttaaatcattttctctttttaccagtcaactgctttcctacaggccaataatagcattaccaaccgggacaaccatgagagtctccttactcacagttgtccaaagcctttaggcttcatactgtggaatgtatcatctactttttaccagcattatcttccagaacctagagcaaataacttctcattactactaaaaacaaaacaaaagcacaaccaaaaacaaaaacacactcttccagagcttcccattacctagagaattagtctaacctcttttatagagtttttaatattctctaaacatctgctcaaaattattcacttccctgcattctaattaccttctgcaccaaattctacagttctcaaacacactgtgcatcttcacaatctttgctcatgctgaagcctctgcctcagacgcatttctgctaattctccatctgacgataacttactgcccttttaatgttagcatttttgccacagttagatctattaattttattggaatcaactttgccctatagagaggtttctgaaagtataacttgccaccggtgtccgtgctattaaaaacactcatgcagagaatgcatgttgacacaccttggttgtctacctcatcagtgactaccattgttcttatataacataaatcaatcctcagtaagtatttgtagacatggaacttcctcagcttgttccctttctctttggtatctcttctctccatcctcaaagctcataatcaatggccaattaattcctcttgtttcggcaatgttcctcttgcctacacaatattcccacttccattaccctagttctaattttcattacctccttcttgaactaccgcacttgcttccttagctattgctcagcttctagtctctcccttcttaggccattttgtagtcagctggtgaagtcattttcccaaagcacagctctaataattccattccctggcttaaaaaacatcaattgctctctaatgcctgcagaccaagtccaaactccttagcaggttttctatcatctgcccaccatttgcctttgcaaacttttgttatacattcccattatactcattctgcatgccagtcattccctgaggcattctgtggagtctctcccattccctgacctgatgtatgaattctctcctttgatctcttaggttactcttttcctcaacattgcctgttgatatacccacctttaaagaaacaaatgaaatgcctcttccacaatgatgtatgtcaagaatgtaattttagatttttttgctcctagagtatattcattgtattgctaaaaatgtattactccactttactactattgcatacaaaactgtgcttgtgattcaaatccccctctctgcagggataaatcatgttttgtttacttctcttcctggggttgggccttaaacagtgcaaacacaaagcacaacttctggatcatcagaacgatttagcaatgaaacaggctatctcgaagatgaaaaatatttgaagagaggctagatgctcatctatgaagatgactgaaggaaatgcatgcactaggcagatggtgagattgcatgaccttttaagtcccttacaagtgtaagtttctgtgctatcaagggaacaggccaggtacagtggctcacacctgcaatcctgataccttgggaggccaaggtgggagaatcacttgaggccaggagtttcagaccagcctggataacaaagcgagaccttgtctctacagaaaataaaataataattagccagacatagtagtgcatgcctgtagtaccatctcctaaggaggttgaggcaggaggatcatttgagcccacacatttgaagtcgcagtgagctttgatcccaccactgcactccagcctgagtgacagagcaagaccctatctctgacaaaatgtggtggtcacattttgacgtttgaggggtcaccacccctcgacaggccctggtatgtgatgttcccctccctgtgtccatatcttctcattgttcaaatcccacttatgagtgagaacacacagtatttggttttcggttcctgtgttagtttgctgagaatgatggtttccagcttcatccatgtccctgcaaagaacatgaactcatccttttttatggctgcatagtattccctagtgtatatgtgccacattttctttatccagtctatcattgatggacatttggctgggttccaagtctttgctattgtgaatagtgctacaataaacatacatgtgcatgtgtcttttatagtagaatgatttataatcctttgggtaaatgcccagtaatgggattgctgggtcaaatggtatttctggttctagatccttgaggaatcgccacactgtcttccacagtggttgaactaatttacactcccaccaacagtgtaaaagtgttcctatttctccacatcctctccagcatctgttgtttcctgactttttaatggtaagtgttattctaactcccaatgctgtctacctaatgtgaaagttcaccattctaagtaaccagtcctggctttgttatgaaatttggatgctgaatccaagagattaacaacatgatgacaaaatttacttattctctttaaatgtgtataaccatcaacaagagagacaagattatttatacatcaagatccttgccttattaatttcgtctccccaagtatctagacattcccaaaataggaggttcaatgttttaaatagcattgatacatggttttccaagtgacttgggagtatgatgacatctcctaagcaagagtgattggacccatgatgaattcagtttctaatgaacagaacactagagaactgggtttggatctaacttttggttcttttctatatcctcttggaggtagttagcttcctttactgtttagatgtggaaagggccttgtttgctaagtttggggaaatacaaaaagcttggcagtcaggaactaagcaggaatccaatggactgaaaactcctttggagaaggatgccattttttttttttttttgagatggagtcttgctctgtcacccaggctggagagtggcatgatctcggctcactgtgagctccgaggatggcatcttatggttctttttgattccttcctccctagaaaagtccagaatatgactctgaacactatgtaagatatgcacatagtaatgaaaattaattgacaaaattttctgtggaatctcaattgccttgcaagaaataatacaagtgcagatcgagtttttaaaaccctgcataggaaggagaagaaaatgaacattctgcttcaggattggagttttctttctgatctgctaattctacaaagtatataagattactcaacacgttttaagtggaaagcaacaagcttactctacattatagtagccataatgtcactagggggtgtatgtttggttgtgagagggtgttatcaatgttaattacaaagtttttaagagttgataaatttcttcataaaacaatgacataaaatatctcttcaaggtaacaaatcctgagagtcaaaaagctcaggatggtttcaatcaataactttataactaccaactatttgtttttccaaaattattaattaacaactaagaaattgctgaaagcctccttggagcatttttacaatctttgtatagaagtaaatagtatttatgatagtatcgatatatttggactagactttaccatggctatgggacctgctatagttcttgatgatcccttgtcatgaatggaacttaggtagctattgtcacaatctctgcagtcactaagcatagaaagtcctcactaaatgcactaagcatagaacgttctcactaaatgcacaagattcaaataagatggtattttccaattccttcactcagtcacttatatgagggctaaagccatggtaacatagaggctcaagtaacttaaaaaataacatatttgaaatttacttgctggaaagggacaccccaccttgattttaatgaatttcagagcaaatacaagctgtcctcagtggctttcatatgaattccctgcacagtcttcttcctttagaaatgcaaaaactatttcaagatttttatgcctgcatggagaaaattgctattgtgtacaattagcatatttactaaggtttgtcattacttttggtaattaaaatcgtacaaaaagagagacatatccaattcaagaaaattacacagtacagtaatatacaatcataatagtcgcctgacaattattaaaatacaccaagttctcccttacagtaaaagtattcaccagagtagcttctgaataagatcattgcagtgctttctatttaaatgtttttctgcacagaaaattataattacatttgcataactactgtaatcaatctagaattatggctgaaatttttattcttgaaatcactgttctttctaagatagtaggagctctgaggcataatctaggtttgtgggccattattctaatttgtaataggattaaatatatttttgcactctctttacaacaatcaatcactctagagacatagcagacgatacaactacatcacacaatttgttttcttctgtcttgaaaaaacaaaccaggctttaatttaccaaatccattttgtccaaaaagcaaaacaaaacgaactcaagttaaaaaaaaaaagtcaaatttataaaaggagaacaccaaatattatttcatgaaacagactcaataagaagtcaagcattcatctctacatttagatgctctgtacttactgagattagctgggatggccgagataatttctgtcccatcatggaaatactggctaccataaaccaaagatttcttttgaatgttctcctttactcctgctgtattcaacaggcttccttggagcctgatgttattgtcttatctttttaaaatatccaagtcagatctgatgaaaacgataagcagacctaaatacattaatctgcaaccagattctggtagagctagccttttgcaacgataactctaagaaaatgccctgctagccccttcttctgaccaatgagctgataatgtaagaccctcacagacaccatctgcatgcattctctctcaggagtgcagagactcagacactgtagcaggccagagaatgaggtgttctaaaatcccctctctctggtcctgctgcaacttgtttttggttacacagcccagctcctcaagagaatgacatctccagggatcaggccataacaaaagaaattctcaatagcacaaacaatatatatttcctgagaagcacaacataaagtcactacagaaagctaccctgaagcatttctctaacatgtggtttcaaaatcatttccatgttatcaatgctaattataaagtttttaagacttgaaaaatgtctacatgaaacattaatgacataaaatatctctgcaaggtagcaaatcattgagagtcaaaaagctcaagatggtctcaatcaataactttgcaactaccaactatttgtttttccaaaattattaattaacaactaagaatttgctgaaagcctccttggagagtttttacaatctttgtatagaagtaaatagcatttatgacagtatccagataagttcggactaggctttaccttggctatgagacctgatatagttcttgatgatcccttgtcatgaatggaacttaggtagctattgtcacaatctctgcagtcactaagcatagaaagtcctcattaaatgcaatgtctttttaacaaagatattaaactgaactcaatattttcatacttttttactttggaagatttggagctgtgctcaaaattgtacaaggaactgttttaatgaccaattaattcagattggcagatacacagaaataaacatgttcagagaataacagcaaagactacatagatacccatagattatgattgacttttggtgagaaactcagataagctgaggacaaacattaaatcagcagtggaattataaccttacttatctttgtgctcaagtgtttgtttataagcatagataatacctacctaagaaaaatggagcccagcaggcagctagatttatatttatataattttataaaataggttcttgcctcaccatcagaggctggtcaagttgccagcctctagaaaacattgagatctctaggtatagatatatccttatttggaaggtgtatgaagccaaaataaagacaattccaagattcctcttctttaaataaggtgaagacccttaaagatggagaaaaatagtcaaagaagaaggcaaagaatcatagaaaattggagataggtggatgttaagcacattttattttttattttcattttatatacataaaaattgaggctcaaacaaatgaatattcttagtcatgattacatagccagcaaatgcattgatgaatatacagctaaatcactttccattatacaacactgaatttgaagaaataagatcacattatggatgtaaggcaaacataatagcccagggtcaatatggcagagaaataaaagttagcatttttctatcttaaaagtattctggattttccccccatcttcataaggttggtaacaacaataatggttcatggacaacctagaatatttcatatttaaactagagtcttttctcatggaaaacaaaccatccatgtcttgatcaaaacaggggcatgaattactagaagaataagagcaaagaagaaataagcataaaatgtttttcaaggaccatcttgagataatactattataactgcatttacaacttgtatgtctttttaaatctgatatttgtagtagtgtatagattagcatacttatggaacaaatgtgtttctctttgtttaagacaagtaagttataattcatacaaaatattagtcatggtgtcatctcttcaccaattctattatcatgtataggtcacaagctatttctggttttcatttttctttaaaaaagaaagaagagcttgaatagatatagcattttgaaaattttgtcctgaaagacttttccacctccattcatcttacagatctgataatttttcaccaaggaaacagtctttgtcctggagtctcatatggctcttgccataacagtatatccaaagattcattcatttatttactcactgaataaatgaaactctacaaggcaccaagttctgtaccatggctatgtatactgttaaaaacaagaaaaagaagtagttgaccttttagaatttacactacagtgaatgggaaaagtccattttttttataatgtagttttcatttgagtattgttttgtattattaatagttaacccatggaatggaatggattgcactcctgaagtattacttctgtgggaccttcaatgcttgtggctgtgtccttctttgctgtggcacatgctttgctagtggaaagaatttgcaaagcccttttgtgggggagaaaccctacctgcttgggatctgatctgaaaacaaaacctacatttgttcatcaccactacctcctctctaaatcccttaaatatccctctactaacagtcactcaagatcatgatttaatcatttcatgtccaataaagtattgatttcattttcattggttatcttttatatgatcatttagccattttaggcattatatcttcaagaagaaggagatttgtaaatactacaaaggggttttcgttttgtgttgttgagatattactattaaagtttctttttttttttttggatacagctgtgtaaaataaccaagatctatttctcattctagcatgtggtctcagcattctgtacaaatgattttactggcttcgtaaactcccaagttaaagaatctctttaggaagaatcttaattgacctcttgaattgttggcctggtacccagagtaaaagaattgtgttttaataaggattacttttgtcgtggtttattatgctttagcaccacacgctaattgatgtagttgcaggaaataaggtaagacatgccatggtttggttaaaagcttcattacatgtatttatgaagagtcttatggatgaaataatttacaacatctattacatatattgaaatgtatgctactgcttccatttcttataatctgcggaacccaggtctgaaaccacttggtggaaaacgtttttaaattttattttggtaccaagtggcaataacaaaagttcaatgactggctgagtagcaatttggactgatttctaaatgtgggcacagcattaatgaaagacatttcttatttttgagataaagcaaacctacatgaaagagaaattacatcatttgggtactagtttcagtgaatgcctgacaatgggggagtcggaagagtggtgtaatgacggaatgctaaagctaggtgagttaggaagggttatttggagataagccttgagtaggacctcaaagaagggaagcaatgtggataagctagtaggaggctgatccagaagttaaatattaaaagtatagcactagagatagcaacaaccatgtgtctagactaaagagcttgttttttttttgtttttgtttttgtttttagaaatgagtatggatggagagaggggattatagcagagcgaatagtgttgaagtcttggtggggacattccgatttaataagtaagtatagtttctttatcaagagtaaccattcgaaaatgctatttgaggattagttaccaatgcaactaaacttcataatgaatgatgatcatggttagcacccactaagtgcttactatgtgttatatactattttaaaaacttcatgtatgtccttgtgtttaatccaggattttgtaaccatgatgcaattgacatttaggattaggcaattcttacttgtgggggactgacctgtgcactgtatgatggttagcagcatccttgacttctattcaccagatgccagtaatcacaccaaaacatccccacacaaccacaagttgtgacaatcgaaagtgtctccagacattgccaaatactcgagggcaaaatctccctagttgagaaccactgatttgttcttaacaccacgtttcagttaaatttcattaattctttttttattgcctctttttgtagttgaggacatggatgctaaataacttgcccaatgtcacatggttaataaacaaattttaaagcctccctgtgaactccagcgacttaattctagggcctggatttgtaaccactattgtctattacatccccataatctttctaggcaggaatctagcataaacaaaaaaagaaatagcccagtgtagtaagtctcgtttgaactgatatatgaaaaaaatggcagacatttaaattttaggtaatgctatcacagccggtgtagtcaagacttctgtcttttgttttgcaatttatcaaaaggctgactttctcatctaatcctatttcagtggtatgttctacataatttttaagagattttgttgtatctaaccttaaatcaatatcacagcagttttatgattttttagtgcctctctcatcatttcttctaggctttggctggacaaggggaataaaagccctgtgtttttccacaactataagaaatgcaattatcagagcatatcttgtactttccaagtatccctagattgtacaatatgcctaactgtcctaacacaaggggacacttgctgcacactttatgattagagctgttccatgttcctttaacgatatgtggaaagcaaggaaaagaatgctaggagggaaaaaggtctctcctttctttgatgtggaagttttgcaaatcatatagtgagacctcctaagagttcatctcactctaggcacacaggagactgtggctggagtagggaggaagaaatgagaataacatagaaatgattataaatggtcacagcctgtctttggctagaaaaataaacagggatttctgccaaaaaaaaaaaaaaaaaaaaaaaaaaaagacctgggcttgggaggaggcagcctggccctctgtgtgtggcctctgtttacccttctgtataatattatgacaggtccttttcaatgataatgttccatgcatcagtaataatgaatgaaaaacaagaaagcacttgcagggtttgcctattaccttaaaccactgaacatcatagagaaggcagcagatgtgacagacaaaaagagattcatagattaatatagctgaaagcacactgacagccaaaagcatgttttttttccattccagaaagttctacctgtgaaatctgagactctgccttttcatctataaaatgggataaaactatcttgcaggattttgtgaggcttagataaaaatctccaaggagatggaatttccaacagtatccatcaaaatacaggcactcagtaaacttacacgggctaaatagataaatagttttcaagtgaaaatgtaattgtgaagtgcagtttagttctctttgcctctctagggctttgtagaacatgaaaaaaagaagtaaggatctttttattttattttttattttaacaagacccatggactaaaggtaaagagtaatgcaatttaaaggaccaatgcaactaggtaggtaaagtcctacctagactcagaaagtccagacaccagttacaggaaacaagataaaatgtatgagtctcaggataagaccgagggtttcaacattactcacagaaggcaagatgccattttctacaaacttaggggcctttctttgcgtttagtcaactaaacttgaagtgagagaaggaactcaaataggagaaatggctaccatttctttgccggtgatgggggagaagtgaaagcagtggggctatgtattattctgttctcaccctgctataaggaactgtccgagactgggcaacttataaaggaaagaggtttaatttactcacagttccgcagggctacggaggcctcaggaaacttacaatcatcgtggaaagggaagcaaacacatccttcttaacatggccgcagaagagagaaattagtgcccgcaggggaaatgccagatgcttataaaaccatctgctcttgtgagaactcacttactatcacgagaacagcatggggaaaaccacccccatgattcaattacctccacctggtcccactcttgacatgtgctgattattacaattcaaggtgataatcagagcgcagacacacagccaaaccacatcaggctatatggaaaaaaataaatcaaagaagtttgtcctcagacacagaagcaacatttcacgttccaagacattctacaatgaagtgagaagcctggcacttccttcctccacttccagacttaataactggtagaacaataatatccgtaagtaacaaagagcctggaatggatgagtctgacaaagcccatccatcctgccacctcacaaactatctatatttgttcttttttctccagctttggagacagaggatgtgttccagctcacagactttcaggaataatactggaaattgacatctaatcagcattttatgcactataattgtgtaaacttttaggcctgctgtacaataatccttccctgctgtgtggtgagcactttggggccctctggatgctagatgtgatatgaatgggaagcattattattatttatgccttataatatgtcaactctatgtcctctgccacaacagacacttatttcaaatgtgcagtaacagcccccaagtgatgtattgtcaaaatatttttgaaatgaaaaagcaaaattaaccataaactgcccccttgtctccatgaaaatggcactgtaacactaccaaggaaaagcaatgttaaataataaaagctacaacaaaataaaagtcaaaaaaaattggaagagctctgtgtttggaagaagtatgctttggtaaatcacaacaatgacaatttcgctttccaattaaagtgtaatagtgaaagagcaaaccatcaccccagggtatcctcaagaacagctcaatgaattctggcttacttaaaaagaagttttcagtggagctgtttttcttgcaaaagattttagaaaaaaacacagcctttttttttttttttttggatttacattacgcgaaccctgatattatcagatatcatctaatgactcatcaattcatacagacctttaaggttggaaagcacatatttaaatatatagtagacagcaagtaacaaatgataggaactacattttagtgggtaaaatccttctgcaccatcaaagactttctaagagctatgggtttattactcaggtgattcagtttccattttgggacaggtcatattaattttcaggatcttttcccagaatgttatttaattagtgtgactaaatatctgaatcaggatgctacggtatttttaaaaaggaagatgtcgatttaaatgtgatagatacttaacagtttgataaacttttaacagactgtaaccttgatgctttccctggtgtagggaggcatccaagggaccctggtgaactgaaaaagttaatgcacttctctaaacattttgagtctggcagaatctggaactataaaataacatttcttcattaacatacaagtcacaatgctattcccataaagcacctctagcatataaggctggacgtttttcagaccatcatttatagggcgggtttatttttctttgtcttgacattaatgagctatgtattcagggaaatagaagatttcaatgcctgtcaaattacctttcaaattaccaaagcttgcttttctcctactcaaagagcaagcagggacttcttttagaatgggggaccaatggaatattcagtaaaaagggtcatgaaaataaatgtgaaggcagtaatggatccattccaaccatgacttcatgacaaaatgctgtgacttcagcatttcattacttgccatgttctcatcctttgtattattatcacacctcccctctctcccacgttattacatctttttgggaaaagaagatatgtgaaaatttctgtagttgtatgataccttgttctaaaatttagactgctgatttgatatgaaacacataatgtttttatagatcaaggctgccagttatttgtaaccattctgttacaaaaatctttcctgagcaatcttggtatatcatcttctgccacatccttagcaattaactgaagctaactgtttcactaacatttccttttccatttatgtagaatgggctgaatgtgttaatgcaatataacaagagaaataggcacagaaaaatcctctttcatatcgatctcagaatcctgtctgtgtctcatttgggatgaagagaaaaaataatcaagaaaatatgtgttggcagggttaagaatacaaaggaaatattactggaaaatatttaataggtaaatatagatgagggaataggcacaaggttaggtaacaagcagattgaatttcaaatttcctaatgactctccctgttttgcaaatccttccaaaacattacctcatctgtgctttcatcatccctagggtatagggttcgattactcatcctatccctttgcacaatggagaaatttacatgtattcagccctagccgtccttctagtcattctctcagtttagtacttacttgttttcttatttgggttttggcctgttctccataagtttgaaagctgtttgaggacagggatatgtttattctgtacttttctggtatcctcgcttggaaatttagtacttaagagctaggtcgggctgggcgcggtggctcacgcctgtaatcctagcactttgggaggccgaggtgggtggatcacaaggtcaggagttcaagaccagcctgcccaagatggtgaaaccccgtctctactaaaaatacaaaaattagccaggcatagtggcgggtgcctgtaatcccagccactcgggaggctgaggcagagaattgcttgaacccgggaggctgaggttgcagtgaaccgagatgctgccattgcactccagcctgtaagaaggagcaagattccgtctcaaaaaaaaaaaaaaaaaaaaggaggctgggcgcggtggctcaagcctgtaatcccagcactttgggaggcctaggcgggcggatcacgacgtcaggagatcgagaccattctggctaacacggtgaaaccccgtctctactaaaaaaatacaaaaaattagctgggcatggtggcgggcgcctatagtcccagctactccggaggctgaggcaggagaatggcgagaacccgggaggcggagcttgcagtgagccgagatcgcgccactgcactccggcctgggtgacaaagcaagactccgtctcaaaaaaaaaaaaaaaaaaaaaaaaaagagagagagagagacctagggagctacgtcctcattaactattataaggtggtttcagaggagcatgtagtgcactattgaagctcaggtttatcttaataggtgtatttgtatacattcattaagtatacgcagactaggcactcctcattttacactcaaaactcaagtagctgtaggactaaattacttatgattttgatttataaacagcagaagaacaatgggtaatccatattaaaaatgattgtgtatcatctcctaaagaaagcattttgaatacgtgtttatcctgttcttaaatggttttactctttgttatattcattctaattaaactgttctagtgcaaaaatgctaaagcaatttctgtagtttcattttttattctaaaattcttaactgtatactgaaagtgagcttatgaaacattcttgatatgaaaactcacaagttttcaaacataattctttatctttaaacacaatacctacctgaaattttgccagacaggcttatcctcagagtatgctttagtaggttaatactctgaagaattaaatgtaattcacatattaactactggtagaaatccatgtgcaatcatattgtttacttgataattccatatacatctttaaaatcaaaatgctctgtttcacttctcaggagcagttctgacacattttatactttttgcagattcaggattagccaggtagagctagcctgtgttggcttcccagttaaaaatcaataaattttaaacataaataaaaagaaattctctctttaaaaagtattttgaatttctatatgtgtgtgtatgtatgtataattacagtagtaaaaattttattaaatctctaccaaaatctctcctgacacattcctttctctttctacttttgagtaactataataatccttctcaatttttctagaaaaagaaacatgcattcaaactgatctcagaaaagaatttttctcatgccaagtcaaacaagttagcaatggtaaaatatatttcattaaaattttaatctagtcattaggtagggaaggttaaataacttaagccttttcttaactattaatagataatgtcaactcttgcctagcagcttcaataagcttttgcaaagtgttgaattccagtaagcactttcagaaggggtaagatgtatacgtgatcatctacttaggtcataatactgcacaaatagtgctaatgtgaaatatctgctgggatttttagtacaggttgtttttatagtttaaggatcaagttgcttagagagtgttcacttctctaagacatacggaaaatatctatgaaactttactatctgaatgtgtactacctgggcacactatatatagctagtatagcaggatggaaacttcttttggttggaaaatgcgtagacacaaatgacaaaatcaagtgtaagcaaagacagtaagcatattggaaattatcttggacaaagagaattttgcatttcttttgaatatctcctatggaatatatcacatagttactaaatgcttcccgttgagaaatagtgaagaagtatttttctaagaaataaattattagagactcaaatattaacccttattagccatacttacaagagacaaggatgttagttaaagccaggagaattctttagtgctgtctttctagacgttagaatttctcaaatgtattcagtaattaaaaacattttgaaaaatttttaaaaatgtaatatacaatcattttaacacatattttgctaaatcatctattcagaagtcctctagtttctttatgaccctatacagaagataattcaaaaccatggctacaacatatatgttaatggtaatatttatttatttatttagagatggagtctcgttctgtaacccacactggactgcagtggcacgatctcggctcactgcaacctccacttccagggttcaagagattctcctgtctcagactcccgagtagctgggactacaggtgtgtgccaccatgcctggctaattttggtatttttagtagagacgagatttcaccgtgttagccaggatgatctcaatctcctgacctcatgatctgcccacctcagcctcccaaagtgctgggactacaggtgtgtgccaccatgcctggctaatttttgtatttttagtagagacgagatttcaccgtgttagccaggatgatctcaatctcctgacctcatgatctgcccgcctcagcctcccaaagtgctgggattacaggcatgagccactgcgcccggctacaggcaattttttaaaacctgataaatatttattccttattgttccagtcctggatattaacttctagaatttaaaaaaggtgataccttagtactttctgatttaaaaattttattagctcttgtacttaatgattagatacatagaatgacagatcttctaatacaattaactctgtaaatcaagaatcttttcttccccaaaataatataaaaagatataaataatttacaaaagcaggggattacatttagcaccaattcaaagttcttgtgaaaacaattaaagaatgtgtgcaaaatttcaaaactgggatacaaatctgaaattttatagaatcattgtcaaacaattgcagatgcaagaatagtatgtttgatttatttcttcatactttggaacagaatcaagtttgtataaaaaaatcaaattctcaatttttacaaaaagagatgttttgtatttagttatactccataatttcctttcactctttctatgaaatctgtgatgagtagtcactgaaatatcaagacacaacaatgttagactttcattcagtggcctgtaaatttactggttgccagaatatcttatatagtaggtaaaaatagagcttctaggaagactgaattctatccttagttaatgctgaggttcaggctacatatattcccaattgttgctgaaattaagtagtactacatcattctgtcacctgccaagggagtatgtgtccttccttcctcactgatacccagggaagaaacaagaatgcactgaagatagtgatttgcagcaggtgctgaggctcccttgatatatgtacatatacatgtctgactccataatatactggaacccataagaaaggcataaattactaccaagtgtttctctcattcttcctggaaagaaagtcctactactttaccttgcttagtaaatctaggtgctgctctttcctaaatgaaattttgattaagaattattatatctgaaactcctttaacctccatcacttctctttttcaatgccatttgcaaatatgtgctgtaagatataaagaaacactgataagattacagttcccctggtactgtccaactaaaaaggaacccaagaacatttaagagcctggtgtcattttttttttctgggaaaatacatcccattttttctcctgtaaatgctttcaacctggtgacctatgacagctttgcagtgaaaatcttgaactggtttttacttactttgaataaaaggttaatacaaggcttcatggaggtttaatcagcaccacattcaaaaatgagggaagcaaaggcaaagctaatgaattgaccttttaaagagcaattcaatgggataattgccatagcacaattcacttcggggccgaatatgtgtatatggctggtcttccttggatccaatccaaggacatttaagtatgtaagtaccaaaatcatggtgggttggatgaggtggacaacaacatcacatacaacctagtggacctcaaatacatttttcataaaagtaaagctgtgctttcacgcataattttaacctaatcaaccagttcatgtatgccaccaagaaaaattaaaacattattaacattatctgccatctgtgctaaacactttatatttgttattttgtacaattttcatagcaccccaggcattaggtgtttttattcctattttacagatgaagttggatgtctgtctagatacattgccagttcttcctgaaatcaagtagttattcatccttctgttcttccaaggaattgtgtgtcctacctttctcactgatacctagggaagaaacaaggatacactgagaacagtgatttgtagtaggtgctgaggctggcttaatataggtacatatgcatatcagaggggtttaaataatatgcctgatagaccacggtggatgacattaggaactgagactgaactttatctaacaagaccttagaccgtgactactcacctactcttaacaaaaaggacaggtttttgccctgagtgtttttctaaaacatcttacatgtagaagtacccccaaggttaaactcaagataataaaaaggtttccccttggtcttatgccctacttttcctacctttatatttatgagaaacattacaatatatgtgctatcttataggagaaagctaacagtttcctttaaaggggggaagattgggcttttttctttaaatcaattatggctgtggctaaagaattaaagtttgagtgcagagaatcaggttttagtcccatttctgcaactagctttgtcaccagagtaattctttttttttttggagacgaagtctggctcttttgcccaggctggagtgcaatggtccgatctcggctcgctgcaacctttgcctccaggattcaagcgatgctcctgcctcagcctcctgagtagctgatattacaggtgcacaccaccactcttgactacttcttgaattttttttagtagagatggggtttcatcacgttggccaggttggtctcgaactcctgacctcatgatctgcccacctcagcctcccagaatgctgggattacaggcgtgagctactgtgcccagacaccagagtaattctttaggttactcacctataaagtgaaggttctgggctagctgatgaatgagattcacagtagttttcagatggtgtgatttcagtactgttcactcagcctatatatctacaaacactgcactagatactgtgaagagatacgcaatagctgacaagacacaggttaaattctgaatgggtttataatttggcaaattgggggtcggcagtgagtgaggtagagagtggaggtgcagcaacaaaaaatgttcttttatgaaagataatctttactaacccactacacctgcgatgttccttttaactgcatattcctacaatacatatatacaactctatccaaccacggctttacaatcagtcccaggagatgatttgtaaacaagatttggggaacagtagcaaatatgagtaggtagagaaatgaaattttaaagtaagaagactggcttatacggcgacaaggagttagagatgaggagtcagacatgttgaaatgaatggaacttatatttagataggcacataaatgacatgtgcaatgtcatatgaaacaaagctgctataggtcatggaagccacaatcttcaggaaagtagctaaagaaattgaggtggcagtgggaagagtaaatcaggaccagagcgtatgtaagaaaaatatgacaatgtcaagtagcagaaaatttgaaaatgctttggggtatctacattttaaaacacatttctggaagtaatattagtttcttaagcatctatagtgccaggaatgttgcatgcatcatctgtcataatttttacaatcatcttgcaaactcagatatactttcctattttatgcatgcttaagcaggttaagtggcttgataaaggtctctagctagtaaatgagaaagccaggaagagatcacaagtgtgccctgcagctagtaccacgtcaagtcttactccccaattaattttgcaaatatgaaaagtaatgactttagcctatgtggcccaacttcaggccagtcccaactgggaagattttataataacttcttagaaactgctactggctctttctcactggcttagtagtggatattaatctctttattttccatatacaggcatatggcttgcagacatggcatactgtgtgcataaaaaacttccttagaaaatacatcatccaagaagcaggaattgctgattatttcattactgcagcaaactcatgtttctaccatcccaagtccggactctgtctacaagagtagaaaaaatccactagatttttaattcaacatctattcaagttttgaggcacatgctatctgaaacaccgtaatttttgagtttgaaacagagaatttttctttagcaactttggccctgaaatgtcctccaatctcaatgtcaggaggtttgctacaatggtctggagagtgtagtttttcataaaaatatgttctatttttcaacaccaaatgaatatctctttcctgcatattgctcaaaatagccatttccttcacatggttatgttttattactcatgtcatcagatctggcaatgtgagatttatttagggggaacatttcatcaattacaaaacataaagcatgtgctgtctctcaatgagttcagttacatcttaaataagttctgagctgttgggagaattacaaagaacacacttttcctgaaaaccattaaaattgcatactcatagaattttaaaaaaattctatgcctgaagttttaatatttttatcccagggaagtggattttttcacttcctttttagattatggccctgagaatatatcacccgaaaatgaagcatgaaaaacaagacaacttgagagcaactcacagaaattagctgatttcatgatatttatgtgctactcacttgcattgtttaagtcttttcttttctttttttttttttttttttttttttttttttttttttttgagacggagtctcgttctgtcacccaggctggagtgccagtggcgtgatcttgattcactgaaacctccggctcccaggttcaagcgattcttctgcttcagcctcccaagtagctgagactacaggtgtgtgccaccacacccagctaatttttttgcatttttagtagagacggggtttcaccatgttagtcaggatggtctcgatctcctgacctcatgatccacccaactcgggttcccaaagtgttgggattacaggcgtgagccactgcacctggccctgtttacttttttcattgactctccctgccttaagagtaaagctcaagtttctaccctgtcctgatttatttccttctttccttccttccttccttcctccctcgctccctcccttccttccttctccttccttttctcttttccctttccttcctttgttcgttcccttccttccttcgttgcttccttccttccttcctccctcccttccttccttcctccctccctccctctctcccttcctccgttctttcctttgctccttctctccttttttgagacagtgtctcactttgtctccaaggctggagtgcagtggcactctcatgactcactggagacttgacctccgtggctcaagcaatcctcccaactcagctcctgagtagctgggactacaggtgcatgccaccatgtcctcctaatttttatattttttgtagagacagggtttcccagcttggccttgaactcctgggctcaagttatcctcccgccttggcctctcaaagagtgggaatatagatgggagccatggcaactgcctgagccctaccctgtttttgcagggccctgcatattgtagtctctgtctcctaaacaggggaaacttctatcctaacacctttgctcaaactgtgcttgccacctagaatatcttcccacatgcacagttatgggaagcctccttataccttaagggccttgctccagttgtaaataagccccgattcctattatgttgtgttagttttctctgggctaacattctgtcttcaagatctttgtgtttagatcctttgtatgtttcaatgtgtcttgggcataagtactgagagcacaggttaaatgcaaaggtgagagaggctgtggagaaaaaattaaaaaaaaaaaaacttttggcatatttagaagtcactttgcttctcttactgtcaatgctcttatttctgccctagccataactgtaagaaaatacttaccagttgttcaaagataggttgttcaaagtaaaacattaaaatgttgctctttaaaattctttttgtggatatactgagggagcttttataatcctataaatatagagaattgggtgcacatttcttctttaaagacaggtttttacccactcttcctaggtatctaacaaggagacatcaaggcattttaaaacaaaagacccagattctaaaataataatgtctttttttacactcaagattccaaacacaatttgactgaccttcaacagtcttgtaaatagccatatctagtctcactccctatagagagaaaatcaacagcatagtgtgtcctactgaatattatataagttgttagtatcagcattaaaacaagggagtcttactccttaggtgctgctacacatcatctggataggcaatctctcagcacaccacctaggccttatcttctgcacattgctcaggctaaggccatgcctggcaggtagtcagtatgcaacaaatgagccatcaaatataacaatataatgaaaggccattaggtagtctctagaaatatctgtccttaatcttacatttgttttttctcactgtatgtctaaacattgctagtttatcccagaaacctagttgcttcttttctgacagtggttgtattaggtaagatgggattgataaaataatcttggaatcttaacatgtaattaggtgaacaataaaactatataaccaaggaaatgtgctgggttcaagcataatcaagatacaaaatttgtcttcatggagcttgcaatgctgttagtgagtttgatggtctgaatgtttgtgttttccccaaattcatatgttgaaacctaatcctcaatctgatgttattaggaggtgaagtctttgagcagtgattaggtgttgaggatggaggcttcatgaatggaattagtgcctttataagaggctgaacaaaccagagttcttccttttcaccatgtgagagacaacacagctaaaagacagctatctgtgaagcaggaagcaggccctcaccagataccgaatcagctgccaccttgatcatggacttctagcctccagcattgtgagaaataaatgtatgttgtttagaagtcacccagtttataccattttgttatagcagccctattggactaacacagtgaagcagtcactacggactgaattaggtccctgcccaaatccatatatatcaaagccctaactcccagtgagtttgtatttgaagatagcatctttaggaggtagttaagattagatgaggtcttaagcatgggatcctaatccaacaggactggtggccttataagaagaggaagaggatgcacacacacatgctctccatcctacacgcaggaactaaggaaaggccatgtggacacacagcaagatagtggtttcctgcaagtcaagcaaagaggtctcgaaatgaaacctactttactggcatcttgatcttggacttcttagcctctggaaccgtaagaataaatttctgttctttaaatgcccagtctgtggtggcccaagcagactaagtcagcagtagggcacattgggctctgaatttaatatgaataggtttcaccacttgtcaactatttgactagagggactttcttagccttatccttaataagcccaaaggtcttttgaatgaaccttataagaatatctatctacctcaaaatattattgtgacatttaaaggagaaaaataaaatataaaatgccagctccatgccaaaatataaaataaaataaaatacccagctccatgccaaaaatgctcaaagatgcaaatgcaagcaggcatttaaaatgtctgggtaactatgtgtcaagtgggtagcagagacaaaaggactgtagaattttggaggagaaagagggtctctttggttggaagaatcaaagaacattcaagatagacttaatatttatctcagcttgactaaaggttagacaggttgcttcctgactataggcccatgaccttcttttccttagagcctttactttagaaaacttgcaattataaattctttctctgccccttttgaaatgtatctaaacctccttaaaagcctctggccagttctatgatctagggagtatctctctcaaggacctgcatgccatacttttcagatctaattatcaagaaagatagtgcccccatctcccagtctctgtggacacataggagtctatcataagtgaacaattagaaactataaaacactttatgtcatgcatatgtgagaaagtttactttctcctcctgtaaggataacaggcaaacacaggtggcctatgattctcctacatctgctcttaaaaactgtccaacactttgtttcttcagagttgagttcagtttctctcccctattgcaatagccttgattaaagtcttccttgcctgtgaaactttgtctagcacatttttctttactttgacaggaaacattcatagagaatatacaacttgaaatatgttgtaaggtatggcttagatattggtttggcaatgtataacttaaaatgaaaagctgcatgcattttcatgttagcagtaactagttatggcatgtctcaatgctttactcaagagttttcttgagatctttttaatatatattatttcaacagttactcagcacaaagtaagtattttttcaggctcaaaatcctgcactaacattgtaagctccctatggcactagagtttgtatatatactttcaggcagctgaagacataggtaaatctttgcaaatggggagagagggggacaaaaaagggttcctggctcataattttaaagcactacccacagtgggactgttttctaaagaactcttaagtatgcagcatatatactaacatgtaaagcacaccttttgcactaatcaaatgtgaagttatataaatttaatatccaatgacttaagaaagtgggatgccaacactcatctttatgactaaagtatacaattttatgaatcaatgtaaagaagccagcatgcttggaaggaatcttttgctcaaactcagattatgttattacactgctaatcttggtgtgtttttttaaaaacgtaacatccttctaatcaagcatgattagttacaaatagaatccaaagaaatatctcaaatgactatatatctaaattatcttgcttattacttatgggatatttttcttatccatatccaggttaattacaatttcagaaattatctgtacaaatgaataaaattcaattctcttagccaatgagttactttttccagtgtaaagtacagtcatttaggcattcacaatatatggaatttagaaatcttttaacatgatgaagttgaaaaaagtaaacaaatattactttgccaattctccaccagtcagaagcttgtctatatactaactgtgtatttagaaaatatcaatgcataaggaagagaaatgcaatttgtctcatccaaacgcatcatataaaatgaccaagtgctgttaagtgctagagatgtgtctcaaaagactctcaatgtctgtatcattttggggttgtttggaagttaaacccttttagtaagaagtattggaagataaatctagttctcagcccttaattcgccattcactggtgaggtgttcttattagagagcatgtctcctggtctcactagttcctaatgaatgtgtctggcctttcctagcaatatataaattctgagaaattggaagacatgattgctccctacccaattctgaaaagagtgaatatatcattctttgtaacagatggaatgtattaaaaatatatcaatatgtgttttcataaaaaagaaaatatctaccattcaattagaaaagtattttggagaataataaaaatgatagatatgctattttactgttactagccagccattattgttagaaagaatatgattctaaatatactgaaagtctggtgacatgtacaagacaggaaaagcacctttattcactcgtaataaatattttcctgttcattccctacataaactagaacaattaatattttcctcagctttcctggagaatgagatatttgacctgaaactttctctattgtgatactgctagcattaattaagtggcagtattcaagattaattggagacaagaagactagttgggaaattgttttgtcataaagtagaaaatagtgccatgatggaaggaatggaaaggaaattcaatttcagaaatttcacaaaggaaatatggttagatcattgaggttgaatttgcagaatttagtaatatacaccaagattgcaatttgagagctaaaagctgtttcaagttcagtgttctatggactaaactgtgttcccggaaaattcataggttgaaaccctaacccccaatgtgacttatttgaagagaggaactttaggaggtaaagttcaatggaattataaaggtggggccctaatccaataacactggtgtccttatgagaataaaaagagacaccagagctctttttccctgtacacagaggaaaggccactcagagagggtggctgtctgcaagccggtaagagagctgtcatccaaaattgaatggatggacactttaatattggactttccaggctcccaaactgtagcataataaatttctgttgtttaagctactcagtctgcagtgttttcttttatacacacacataatacacacatacacacacacacacgcccccatatttatatactgtgtatacacattatatatatattttgttatatatacatgtatgtatacacacatatatatataatcttattaaaatcttatatatgttatatttgtctctattaactaaaatttaagtaccatgagggcaggaattttaatctattgtgttcaccactgtttctacactgtctaaaacagtgcctttcccagtcctaagcaaaaagaacaaagctggaggcatcatgctacctgatttcaaagaatactacagggctacaataaccaaagcaccatggtactggtacaaaaacagacacatggaccaacagaacagaacagagagcccagaaataaggctgcacacctacaaccatctgatctttaacaaagctaacaaaaataagcaaagaggaaaggactccctattcaataaatggtgctgagataactgactagccatatgaagaagattggaactggaccccttcctcacaccatatacaaaaattaactcaggacagattaacaacttaaatgtaaaaccccaaactacaaaaaccctggaagacaacctatgcaataccattctcgacataggaacaggcaaagatttcatgataaagacaccaaaagcaattgcaacaaatgccaaatttgacaaacaggatctagttaaaccaaagagcttctgcacagcaaaagaaattatcaacagagtatacagacaacctacagaatgagagaaaatttttgcaaactacgcagctgacaaaggtctaatgtccaccatctataaggaatttaaacacatttacacacacacacacaaacccaattaaaaagtgggcaaaaggacatgaacagacaattttcaaaagcagacatacatgcagccaacaagcatattttaaaacgctcagcatcattgatcgttaaagaaatgtaaatcaaaaccacaatgagataccatctcacaccagccagaatggctattattaaaaagtggaaaaaaaaaaaaaaaacaaacagcaggtgctggtgaggttgcaaacagaagagaatgcttatacactgttggggggagtgtaaattagttcaaccattgtggaaaaaagtgtggcaattcctcaaagacctaaaaacataactaccattttacccagcaatcccattactgagtatatacccaaaggaatataaatcattctattacaaagacacatgcacacatatgttcattgcagcaccatcctcaatagcaaagacatggaatcaacctaagtgcccattattggtagactggataaagaaattgtggtatatgtacaccatggaatactatgcagccataaaaaagaatgagatcatgtcctctgcaggaacatggatggagctggaggccattatccttagcaaaccaacacaggaacagaaaaacaaatatcacatgttctcacttataagtgggggctaaataatgagaacaaatggacacatacagggaaacagctgacaccgggacctagtggagggtggaggttgggaagaggtagagtatcaggaaaaataactaatgggtattaggcttaatacctgggtgacaaaatagtctgtataaccaacccccatgacacaagtttacctatataacaaacctgcacatgtacccctgaacttaaaataaaagttaagggaaagaatagtgcctttttcatagtaggtgttttacaaatatatacttagtaaaggaatgaaataatgccaatatttgaatgtggttttgtatatgactcaaacccatatagatctgtaccctatttctatcatatttccattcctttctaaaaatgtattttctatgttgacttacctgaatactgttattctaaggtccacttggataatttatatatagtttcataaatgagtagattttagcagaggtgattggcccatattagaatgtaattcaaaacttgaatttattattttaaattgaatataacagcttggttctatgtgtcataagtagagttaaagtcatatacctttcttatatttcattcttccgtgtcatcacacaacaatgaagggtacataatgctaaaatgagcacattcattgactgcacatctcaggaagaaataaaagaatataacctgattatttgaagttacagaggctagatatggggacatctaataaaaagtttgaataatttcaaaacatatctttttatctttgtgagattttctctggtatttacattttcgtatcagcatttctcatgatctaggagttcctactacttgaattaaactatcatgttttctaattcttacaagctagatttttccttcccttacagagtctcatttctctacccacttactgaaaaggtagtattttctgtgtgtgtcttaaaatgtttttagattgcaaaacaaacaaaaaaactctcaaaaacatgctgttaacttctgccagctgtttaattaagcagattttataggaatgtgaacaataaaaagcaaaattctggagctatattgcaatccagataatattcttatcctcagaggaaaaaacaatgaccttcacttaagttctgctatattattggctatgatttgaataagaaagcttagtatgacaactgcaaaacatatacttggagaaaaatagcctaaaatataaaactaaggacaatgtaggagcatgtgtgttaatgcataacagacccacagacacagtgggtatcacaagcccttttaatcaagacagaaatatgcacatatatatcatgaacattaatgaaacttgtggaactcctccatggttccaaattatgtcctgtctcaaaatacatttatgtaccttatggtaaagtgatctttgaataatgggatcactgaccattacagttcaccgatgaatacttctaaggaggaaaggagagaaagctaactataagacttaaacagcacctgctgtcagctaaacaaattagctgccctgaaatcacatgtacccacaaggaatgaatagcacaacctttacctaggagactgccttcggaggaaaatgcgcagaatagaaatagccagtatgatatggcttggttgtgtccctacccaaaatctcatcttaaattataatcccggtaatcctcataatccccatgtgtcaaggaagagaccaggcggaggtaactgaatcatgggggaggtctcccccatcttgttctcatgatattgcgtgagttctcacaagatatgatggttttatgtgtgtggtagtttctcctgcattcattctccttcctgctgccttgtgaagaaggtgccttgcttcccctttgcctttcaccatgattgtaagtttcctgaggcctctccagctatgttgagttgtgggtcaattaaacctatttcctttataaattaccctgtctcaagcagtgctttatagcactatgaaaatggactactacaaggcttctaattgttatcccaaatttgttcagcttttgacaaatctgtatacacatttgtctttgatttttagctgtttgtttgactttttaactttttagctattaaattttatcatttactaggctagagcagaaatgataatacaggtttttcctcatttcttaaggtgtgattaattacaaacatggccaaaattcttgcaattcctctccttgaatttgggctgaccatgtgacttgcttaatcggtgtggcaaaagcaatgtaacgtgagttctgtacctgagcctcaagaggctttgcaaaattccattttcactcatgggattctgtgattaaaccggccttttggaggatggggcataagctgttctaactaattcatcttagatagccagtctctagctagcatggcaagctgatcaccaacatatgaactagtccagttgagatcagctaaacctagcccagatcagaaaaaccacctactgaagcccagtccaaatggcagaaccacagaattatgagctaaataaaaggctgccattttaagcaactaagttttagaggagcttggaacacatcaaaaactaaatgacacaaaaggttagctgagaaacattttttaaagacaaaatgtattttaatccagcttaaacagaatatctttattttggttaactttaaattaatagatgaaataggtaatgataactatacagggctaaaacattttatatatggttaggtttgagtgtaaaatttttatctcctttgttcttttttttaagtcagtttctgggcttctttttagcaaagcaaacagttatttggctctaattacaatcaaaatttataaaaaaaatttttgaagtcaaagtaaaaaatccagaatattggaatatggctaataaccaaaatcttcctctccttctaacactactttaatatctcactaatatttctattccttactccctggaataaattgaaataggataacaagataaaattatacctggtttttcattctgggttttcttcattgataaatagagggttatgaagtcagaaatataagactattttctcctgagatttcattaaagatacgatattaggaagactgaaggctattgtgctggcttaccacatcatatacttccaaccatcagaagtgaatgacaatgcaataatgcaaaagaactcagctcttatcaaccacagaagcatttagaatttctgtgactgctctttgagtacaaacgattattactaaactttgtcaaactgggaagattaaaagatttttcagggttgtgtaagtgcaataccataaatactcaaccaagtagaaactgcttcagcaggttaaactaatgtggggaagacactagaaatatcagaattcagaaacactgactccaatgcattgtttttttcatatttcagaatctgctaaaagttgaaaaccagattaattgcggccatagaaaagccttctcatctgtcatttgaatgtgaaaagaaattacttgaaatgtagtgggcattctacatttcaagaaagaaagagggtcgatgaatgaaataagcagaaaaaggaacagcttagaatatgatatgtagagatacctgaggataaagaaacagtgagagcgaatctgtagatagtctggaaggagattagcagaaaatatacataaaaaatcacatcagttgacatccctctactctgtgacattgtggtggcgtctaagaaggtcatcagtgtttctcagtatctggcattcctgcccctatgtaatgtccttcgcttgcatgtgggctagacttacagcagccaggaggaagtgtcacttccaagattaggttataaaaagcctgtggctcctatcctgggctttctctctctctctctcatctgtcctggaagaaaagtaaattgccagctgttgtgaggatccctgcacccacatgtaagataataaggcatgctaacaaccatgtaagtgagcttgaaagtgaatggcatcctacacacacagctgaaccttccagtgagactgcaggaatgatcaccagtttaactccagcctcacaagagatactgagccacaggcacccagctaagtttttctgggattcctgacccataaaaactgaaataacatgtttcttattcatagctgcctaatttggggataatttgttatacaggaacagatagctaaataaccacctaaaatatagaaaagaatagttttctccgtccttccctccctctcttcctccctccctccctccctcctttccttccttccttccttcccaccctccctccctccctccctcctccctttctttctttttgccaaaaaagcaaaaccaacaaacaaactaaaatctagacagtctttcttttaaaagcaaagaaaggctgggagcggtggatcatgcctgtaatcccagcacttttggaggcagaggtgggtgaatcacaaggtcaggaattggagaccagcctggccagtgtggtgaaacctcgtctctactaaaaatacaaaaattagccagtgtggtggcgggtgcctgtagtcccagccactcaggagcctgaggcaggagaattgcttgaacccaggaggcagaggtggcggtgagctgagattgccccactgtactccagcctgagcaacaaagcaagactccatctcaaacaaacaaacagacaaacaaaaacaaagaaacttcccagcactttgggaggctgaggagggtagatcacctgaggtcaggagttcaagaccagcctggtcaacatggtgaaatcctgtctctactaaaaatacaaaaatcagctgggcatggtggtgcacgcctatggtcccagctactcaggaggctgaagcaggataatcgcttgaacctgggaggcagaggttgcagtgagccgagatcatgccactgcactgcagcttggacaacagagtgagacttggtctcataagtaactaaataaataagcaaagaaactgtgcaaagagaggtaaggctctttctgtggatgttctctatttgggcattagtttgtctgctatatgcctgctacttccaaagaaaagcctgtagctctccatactctgtttattctcaacctgacaagcagtccagactggtgctaaagaacagaagatacacatcgagatccctttggaggtaggttgttgagggaaagagataaggtttgatagaattaaaactgtgactgggaatttaaaatgatgatataataaaggcaagagattcaatacaagaaaaaataagtatgttgagtagctcatggaaaaacaaaactatagaaaacaaatatgattcaaatataacgcaaaataaaatgtcctgatttctgagcaactgataagtgcaagggaatccacttgaccttgatcctagaggtggaaaaattctcctttgagtagtccaggtaatatgatatttaactcataaaaaaagaaaggtaatcttaacatataactgagattagtattggataatatttacacagtaatggtaatctaaatggtcttcattgttttccactttagaatcctcataatccaaataaaatatgggagatttagttgtggttggttgtcagacagaatgttaaagttaacatccctggaaataaaatgagatcatgagatgaggaaaagaagagggaagctagaggaatggggaggagcataaaaaatatctttagcttactaatgtggatacttaagagataagagatattcttgtaaattaatggaacaagaaattagatgcaactatattacttaaagcaacaaaatttatatataatttacatatagttttatctaatatatatcaagtattatatatataatattttatacacatacagacataattcacaggagagaaaaaagcaaaagaaaggattaaagcctgagctaatcctcaattttcatatccaggattgtataagtattgtataaaaggaataaataaacaaatggaacataagcatattatttggagatatggagctaattaccaaaaagaattattaaaagacatttactctggggaataagactgggagtgatgaggggataaatgtggtatcgttgcttttttatataccatcttctaaactatattgatttgtttttatgtgcttgctttatattaatgaaaacaatgtatcaattattcccacttacatatgtacaacaaagcaaaaaagtgaattctgggagtaatctgttactagtttcaggaatagttttaaaaaggaaggtataactggtatttgcaatttgagttatcatccatttaaatatattgtattttctttttttttctatttccttttgctttttttaaattacactttaagttttagggtacatgtgcacaatgtgcaggtttgttacatatgtaaacatgtgccatgttggtgtgctgcacccattaactcgtcatttacattaggtatatctcctaatgctatccctcctccctcctgtattgataggacgtatctcaaaataataacagctatctatgacaaacccacagccaatattaatatattttattttcaaataagccacatagcaagaataaattcctttgacatttcctaggctttatcaagatctgtctgttgtgaggaattcattccactacccaaacttcatttaagtctttgcatccaattagtgttatcccaacatgtccctctaatctcttcttttgcttctctagttctttgtacttcattcccatttttatttgcctataaaaaaatcatagtttttacatgcttaaactctgcaatgagtgtcttttaaaaatgttatacattttccctatttcgatctggttttctagatgtctaaatatcaaccttatgcacagcttgtcttgtagccctgtcaagagtcactggtgcaaactggttctgtaatcattaggcttcctagagattttcgcctgtttcttccactccccctaactggctgaagacatcaaaaaatcagacaaactgaaaatgtgaattctcgactctttgaaatgggcaagctacttgcaaaattgtgaagtaagttttagctatttgtctgtggctcaccacagacagcaaggaaaaggtaaactcctatgaagacaataagagatgatttcctgtagagaatttaaaaacaataacaaaggtgactgaaagtcagactgctttttattattagagtgtgtcaacaagtctaaacaatgtcagtgataaaatattcctcttgagaggggaccattaacaatgcccctcctccaccttggtacggcactataacccaaaatgatgagactctagtaaacctctggaacagggttttacacatgttaatctgtaacctggtaggcaaaattatgccactttgggcccgtctcttttccttttagggacaactactggtgcctccttcctagtcttatgagaagaatgtcagtagcataaattgaaatgggaattttgcttcctgcatatcgcatccacccctttttcttaaataaatatgcacatgctttttaaaaaaccaaacaactgtaatttcaaaatgtctttatactgcataagaaggaagttaattcttttaacatcttgttatatataccatctttattctctgcaaatattgattaatctaggaaaattcaggactgatacggtttggctgtgtccccacccaaatctcatcttgaattgtagttcccataatccccatgtgccacgggagggacccagtgggaggtaactgaatcagggaggtggtttcccccatgctattctcatgatggtaagttctcatgagataaggggcttcccccttctctcattattctcctttctgccaccatgtgaagaagcatgtgtttgcttcctcttctgccatgattgtaagtttcctgaggcctccccagccctgcagaactgtgagccaattaaacctctttccttataaattatccagtcttgggcctgtccttatagcagcgtgggaatggactaatacaaggactgagcaatacacaacatttatcttagcatcattttatgcattctgtgttcattatttattcaaaaaccacttactaagtgtcctttttgtatcaaacactgcattaggtgctgagcatacacacattaagacaaaggtcttgactttaagatgcttgtcaaaaaaaaaacttaaggttataatctctaacaggtagatcattatctatctatctatttaaatgaatctctattcatctatcttttccaaagtgctatgaaaacaggaaacaggttctgcttggggttgttcaggaaatcataaagtgaaatgcaaagtctaaaatcttcctgtgccattaacactaacaaagctttagtatttttcaaatggagaagtgtatcattaactagatcacaggtacagtcgcaaaacaagaaaaggaggaaataggaacactgctggcagatgagtcagtatatcagaaagtgggaagttgcattttgagtttaggcaatgtgaacagtttactaatagcataccaaatacaaatttcagactagattctttatacatgtgtttttttacttttctgaatcaaattcccaaacaatgtagaatgcaaagttatataagataattgacaaagttacataagataattgagccattaaataaaaatggaaaactccagtcacaaaaatgtctgaaactacagtgaaaattctctctttggacagtggaaagccctcagttcagaacagaacaagttgggcacttaactttcctgcagtgtcttatcttctatcttgtattagattgccatgtagaccctgtcaagaaacattaccaactgctagttaatgctgtgcacggaaaagtcagacttggtaatgtcaccacagaatttgaaaggatattaatgggtccttttcatttctgaaaaaatagagattagaaccagagaacttcccttcaaggacaatttcttttggaagaaacttatattccctttggatccatgaacacaagtacctacatcattttctagctgtggactcactctttcaaaacatactcagggacagctgatgcaaaggtaagcttggaggtgtagaaaatataaaaatcagtttttctcaagtgtgttccagggccaaatttttactgctgaattttaaatgctggtctatgtttaaggaagatcttataacagctagcatagcatggcacaacacatagagactcctcacttggttcattctccaatattttggggaatctatagttgaatatatttgttacttggtcctggagtaatgtgggccaaatggagaatcatttctcttatttgagatttgggtcatcatgtgtgaatctgtagtgtctagaataaggcctagcatatggaaggaagaatgaaaaaaaagggagaaagaagagaagaaaaaaggcaatagcacagtggggatgaggatactaaggaagaacaaatgagcacctgctatgtgccagatgctatgccatgagctttatttgtgcaagtttatttgatactctcaaagaatgtggcaaaacaaacatgattttaaagttctcattgttattgcttcatactttactccatgtcgcagttaaacattgaggttcacaattataacagtcttggagttttctcaatagcatataatttattccatgtaaagatgaagataaaaaaatgtagcttcccccatatgcctctagggtactctgtatgtcctgctgaagtagaaaagtcctagaagggagctaagggggccgaggctaccaactactctattaaatctacagacttgatggtaatgtctattttagaagaagctttccgcaaatgcaacttagattttaaagacatcagcaagagaatgtggataattccagagtgagggtagtgtctagcacattgccaacacttaagacgtgaaacacttaagaagcatgtttccccaatatgcttgttattaaaaagagtctaaaatatcttttctcctttaaatttgtctctgagattcaactgtgttagtgatgctgttaataatatactctaaatctgtcatgtacaaaagctttgctattgttgatgtagggcactttataatttatgtatagattcactagtaatctaaggtgtgagaaatggttcttcaaaaaaatcctgaattgctaggtatttatcctcaagaatagcataataatacctagcaaagtgtgctacatatattagttgcacataagattttgcaaatttgtaattctaaatgaaaattttgtggatttacaggcaacatatagcatggtaaaaaaaatacacacgtacatacactgcctattttgttttgttttgttaattaccatttggaatgcttactggataaaccattggttaacacaagtgctatttgtctgcttgagatttcatataaagagaatagtgataacaagaatacagtgaaagctgtttggtaaatgctgaataaaggcagagaaattacctgagccttctcctgaggtcccagcctaatggtgttaatgtattttttattgctggagaacttttcagtgataccaacaacaacaacaacaacaacaacaacaaaactaacataggctctagatgataaaacatgtaagaaattaacatagagatttaaaactaatattgacttagttttttgaacaagcttaatgtttacatatatcatgaaggagaatagcaagtatggttaacacacacatacacttgtatacacaaaattatcttttttgttttgagacagagtgtcactctgttgcccaagctggagtgcagtggcatgatcttggctcactgcaacctccgcctccgcccaggttaagcaatccttctgcctcagcctcccaagtagctgggactacaggcgcgtgccaccatgcccggctaatttttgtacttttccttcctccttcccctcacagacaatgattattatatgtaagagatgaataaatcaacaggtgtaacacaaacataggtatgtattgaaaatcagaagttcacaaagtattacagaacaatttgtagagctgataaaaactaagacaattaaactaggttatattcttgctacttagacaagaactaattatttaataaaaagatattactttgtcctaccactgagactagacattttagaggaagtgccaacttcaccagtcctgagaaaattcccactgaaatcactgtcatgtatcgactaggtacacagacttcattcaatatctccaatgctgatacagaatatatcaaaagagatatcgagaatcatgagcccaatctagtctaactcacagctggaagtacttgaagtttttcattctcaagttgaaaaattagtatataatgaattcttaagctccttaatcaaaatatgttatccaggatagatacagaaatcatatttgcaagattcagtatcacaccatgaattaccttctgtgtgtgacaactggggaacagacacaagaaacttcctgagtgctcagtcaacaataatttgaagttggtgaggaagtaggggaggttgcataaaacagcgcaagttatgggaatccttggacagctcttcgttgtccaggactgtcccagcattgcagtgtgtgtagtcctcatggacctcacgataactctctctttgtgttattacctgccctccactgccgcttgcttcccatacatacatcccttaggggaatggtgctgcctcattcaacagagaattcagcttggtacatgccacacaattgatgtgctgctgaagaaacataaattcacagctactcttcaagggcagagaaaatagctttaaaggtaagaaagatgctttaatttacagtgtgtacctgaagaatgcttctcagacatgactttcagatgtatggtgctcacctgtgacaggtactttgaacatttctttatattttaagatgaacatatgaaatttctattttttatagttaaaaactggtgaagtggccatcatttcatatggttcctatactcttgactcctataatcctcacaataaacttatgaggtaggaaactgaggtctaagtaactcacagctagtacgtggtaaacacaatgctgggatataggtgggcattttggcttctggagtcaacgcccttgaccactatgcatagtgccccaacatcccacacaagctttcagaccttagactcccagaacgcagggcctcatcatctgatcatgttaggtgtccagcatggaaccatatttataggcaatgcctaaatagatactattagaaggagtaatacatgatacaaaactcaacttcactcatgactcaaacacttactgtgtgaccttcgacaaatggttcccatttctgagggctaaacttttcagtctatcacatagaatgtatatggatgcattaaggaagggaacaatatgactgtatttgcattttcaaaaggatagtctgacagttgggtggagatcacaatggaggtggttaagactatgagaaagcaggaggtgatgagattctgaataaaggcaatacgtaagagcagaatatagatcacctcaatgtatcctgaaaaaaagtgggcagcatagccttgggtaagttagcttttctatgcctcaatttcctcctttttgaggaggaataataatatcaagttgtactttttgagtttccatctcttcctcagacatatatatatatgtctgaggaacacacatatatatatgttctgcaggatatgattacacttctgatttaattagcaaaatatttattagaagccagaggaccacagaggccaggtccttctagaggttaggagcaggtaaagtatatcttggtgttgcttttgatcttttctctggcttccagtttcctaagaaagctaatgctgccagtggcactatccatacagggtgcagtccttctgggtctgaagaaatgcctgaagattaatataccaaagttttatgaaattgatacctacatctcgaatactttacgcacatccattcaaaagagatttccatttcatggttcccttccacacacaggcatccccctcttccttcctctgtttttttttcttttttcctgcagcctttgacatcccacactattcgttttcttgtctattgcccatcttctccaactagaacataagttcggtgcagaaaagtctaattttgatcaatgctgtatttctacagactagaaaggtagtagaaaggtacctgagatatagcaagtgctcatcaaacttggttaagtgaatgaatgaatgggtatatgaatatatttatctcggactagctttgtgagaagacatctcaaaaccaagcttgcatctaccaatagagcattttgtcatctagtaaaacctccagaccccaaagaaaatgcaccacgcagaacttaaaaaaaatcctttaaaatgcattactctagtactttttcttgccagtaatgagaggagaaaaacaaagtctgaataactgttgcttacacgcatttaaaattacaatacattacactcttctcaccaggcaccattaagttcaggagaacatgcctttgtatatattttaaaatacacatcaaagtgtttttctttgaaatatgcactaaaatttgctgtaaaaatgtacattaatttaagtgaattcagaagattgattggactagggaaaataaattaattattcatgtcaccagtattttttaaatgcacagtggttatcaggaacatatataattataagtaatgctattattttttaatagcaaagttacagctaaggttaattaatatttttaataaaaataaaattttgttctttgaagttgcaaaatgtattttgttagctctaaatatttttcaaggaaatgtgtgtgaattctgcttacatttttcaaacaaataatattcatttttcatgagtacctccaaagcctccaagcaagcaacagaagtgtccaatatattcaaacattcttttcttgcataaacattaattgggttctttttcagaaaacccaactgggaatcaaatgctactgactttaataggatgtctcatatgtgaaatgaatgtctcttacaatctaccaatgatatttcttgaactctcaatagttcctttccttgagtaggtttgctaactctaccctgaaaaaatgcctaactgaaaccatggaactgctccaatacatttcactcatatttactgattctgtctcactttataatttaatttcttcccaagagttgcaaactatagtcaaaaaccagaatctctcaaaattttattctctctcttttctcaacattgttgaaataagataaaaagaaaataaaaaaggttatggattctaaaaaccaggcaaggataccacagacaaattttgctctgaatataaagaacaggacataatatgtattattcttatgaagtatgcttttcttgcaaaggtaaattttggatatgctgtaaaagtagagtataatataatttatagaccaaatggcatacttttgagagtcaaaaatatactattaataattacactgaacatcaggtatgcacaggtactatccaggccaactgggctgcatggccacatgatggaagacagaggtgaaatctatgttttggtaaataatcatgagaagacctaattaagagcatcatcactagaatcaaagaaatcttagagctgagtacaacttaagagtttcctagttcaacctacttattttacagaggcagcaaggccaaagtacaatgatgtgacccaagttgtccaagtcacatgacgagataggtggttgtgttgaaagtggaaaccaggtctcctcattcatcatgctctttccattatactacaatctctctacagtatgtatgtattctctatagtatgtatgtagcttgtaaaatattctcgaaggaaagaacaaaaagatcgtaaaatgtgctataaagaacattccagaaacgatgtcacaagcttgatcgtaaaagaaacagcacagttcaattttcctttctttgtggacaggcaaaggaaggaagtgttgtcctcttcatgttggcttacatgtactcatctcataagacattgcaagtttaattagaagagggggaacatttagcagccaaaaaacttgcatgatactcctgccacatgccaagaagctctcagaatctcaaagaactttataccaccaatagtttttgtgaatatttgctttctgagattagccttctggaaagtttcataaaatcaggaggccttatggaaacatttaaaaattaaatattccaagtaaaatgaattttataaattttataaattttatgtaatccacataaaaagtactatcaatattgttatattcacattaaaaaggaacaattcgatcagaagttttggtaaatgtccctattatttcttgatataaatcacatcttcctaaagtaaacattgggctgaaaattgattatcattcaaagcaaaacttcttttttttttttttacttttaaaaggatatttactttaagtaggaatataaacaggactttatggaggatattttgatgaacactactatattctctgagtctgtgaaaactgaaatacatttcttccctattactatccctgcaggatggctgaacaaacctcatctcatctatttgaaatgagtccaatttaattctgcctgaccaaaaatctgtttccatagttttaaaacatgcaatcaccccaaggtacattgccattgtagcttaagtggctcagtgttatcactgagaaaaatgcactttgattgagaaaacagtccagtgtggcttttgaaaaatgaaatgaccctttctgatacacaatttagtaagacagttgataaaagcaggcggatatggccactatagacaacatttaaaggaagatgcttcatccaacctgtaaaaataggtcaaagtttacagtttcgaaattaacattagaaatttatctcatatttaaacttcctggtttaaatattactgtatttagaggacaattgaaaagtcaattacgaattatggaaaattttcaacaaattattctgtcactcaaatataaataaattgctttcttccctaatgttttttccccatacatacatgtgttgttatctgtattcatatatatatctcactacttaagagacttttaaaacctattagcccaactttaaaatactgttgctactactgaatacttgtaacatattaagtcaaattctttaattactgtcactggtttattacaaagctaacaattttaaatatctatttttaaatgaacctaataatcttttatttaagtcaatatctcctcaaatgaaccaagtattcactaattaattagatcatttacatctataaactgctgctgtcttcaaacatgtaatagcttataataaaagaggctcttttcattggcaattaaggagcagttaactctttaccttctgcattttaatattataaaatgcataaatctttatttctgcatttctacgtatttagctttcaaatgaaacagctgttttgtacttaaaaataatatttcttaatatatgttactaattgacaaaatacataaaaccaatgctgataatattttcttcttttgggacacacctggtttatataggagatttggcaactgtaatctcattaatgataaaacaagactactaagaaaaatacctgattatttcaaattatattcataaaagcattcctaactctgaatgtcctcttgtgaattattttagataaaggaaagtctatcaatttatttgtttcatttttcctgtatcagatttactgtaataacttgcttatcagtaagtgaaccataaatctacagcagtaacaaatcattaatgaaacattagcaaagaatgttaaatggagctattgggcaaacataaatctttctaaagtcacaagtctttatccaaggaactaagtgctatgatgttattggcaaccttataaatcctaacgagagaaaatcaacaaaaggatcacattgcaggcaaacagtcctactaaaatgtatattctttgagggcaggggtttcgtttgctgttaccaatatatcctcatgcctagaaaagtatctggcacatgtagacagtgatcaataaatatatatttgtgaacaccctataagacatcccattttattttgtagccacatgcaaataggaaacgaaaagaaaagagagaaaaatgaaaataagtgcacatgtaggtacaatatatccaacactacatttaatttgcattttttgtattttttgcccatccctcttctaggacattttctcttcatctattctgttcctctcacccttttccattcaaagtaaaaatcagagtcaattttcttcattttctgggaaacatgttaattcatatttggggtgctgatacaaacagaatttgccttctattattttccttccaaactggatgcaggtctgtttcaaatgcaagaagtaaaagcaaatttaaatataattatcattcttgcttcttcagaatgcatttttctggaaaagtagggatcgtgtatttggaaaagctttaaatggcacctactgaatatactcactatcagtaaaacagaacaaaacgaaacaattaattttggaccaaggataatacacaattctgaaaaaattaacaactggatacatacaaaggctgcaaataccaacaggaatctaatggcatttgaacagcatctaacagcatttcgaataaggtttttttttccctgtgttcttcactgatggaacaccaatattcaaaccagtgcctgaaatgtagtaggcaatcaataattatgtcctgattgaattaacatacttccaagttgtgcaaatgccacatttaaaaatcatattcttcaaaaattttaggcacaagattgaaataagctaattagagttaattgtaggtgagggcaattaatcacatacacaaaatacctcatattttgggtttgtgtgctcagataaaccaatagaatgtttttttatttttaaataaatagtgaaagagtatacccatcattcaccaagaaagccacatggctggctatcaattcaaaactttaaacttcaaaatactatagaagtattgtactattaaaatatctcttttaagattaaatttgccttgattttattttgaagtgctgagcttaaacagacaaggttttcaaatatttcattaacttgttcatttaaactaaaaagtgaaaatcctatgtaattagcagacgatctactcagcttgggccagaggagggttatggaatcaagactatcatttagcatctaacaaaccaaaacaaaatcttttgtaaaagtccacaaacctctaatgaacaacatacacacatttcatattcaaacggaatgcattatgttaagctagtttcaaaggaagctgtagtgcctaagatcagaaaaatgttccaatttagaaaagacgcatatgcagaaaagcccactatcataaataatataggatgaaaatgaaggaataaaatccacaggctcacctggctaatgggttcttttgtcgggggctttcctcttctggctgtgctagtagccagggtcgtggtagtctccataattgatgtggacatctctgattgcatggcagtggctgttgactcagttgtcatagaggaaggcacttcaccaaccagtctcacatttcccactatggcgatgttggcatcgttttcggctgccatattcagaactttcaagccattgtagtacagcccagagagctggccctggaagggctggccctgctctttcccgccaattattatggttgcttggctattgaagattgtgagctgacgccctgtaaaaataatattacatacatgcaaaaatgttgattgtgaactctatatctacaatggatgataaaacagatcttttatggggtgaataatgagagcaataaactataagagaggcatttgactcataattcattgcttataaatgaggtgtccatgaaatgcataattattggcaaatacttgtaaattctcaacttattataaatgtagtgcttttgctaaaagaccaatcaaagatatgtattacaaatcagtttttagtggatcccttttcccttttacatcaagatcttatattgttggtgtctaaagtctaaattgttaaattttaaaaatgtaagacaacatttcaagtatttgtcattctgaaattaccactgacagaaactaatacatagcagctgaaatctaatttaaattttatggtaaaaatttcataattcacataatgtccacatatatctatatgttattctttagtgctgtttattttttgaaggcaattattcattgttatttgaattattctatttttccggcaatcacactgaaaagaaattcatggtttacactgagcatgtcagagacaaaaaaattccaaaaatatttttctgattggctttcagcaagtctatcaaaacaaaacaaaatgaaaaaaaaaaatagcttcagatgtaaaaagcggcttcaggaatgatacacaaaccgatggagaaattatggcacatttccatcaaacagcaatccttaataacagtaccattatcatcaaattgagtatccagttttagcagattgctctctgctcataaaagcatgcacacaactttaagttcagttttaatatgggcttgttcccaaatcctcttagaaggttgcaaatgttaaagggacttcattatgactggcaattcatattgcccactatttaagattcctagagtttaaacaaagagtttttgtttttttcaggaccataataaagatatcagaactacatatattttagttaataatttagaggctggaacatgtaatatagtctatgaatgatttatcattttgggttaatgcttgctgtgagtaccctcatagattgagttagtggattatatttaacagtccctttaaccttaagttaactgggtaagattattaaacagctggtacgtctaaaaatgtatagaaattattatacaaggtatgcaaatattactatctacattttactgttttaaagttgtttttaatttagttttacggaaaatttattttttatgtttattagtgttacaatgaagtactacttggttatgttcaaattatttttttatttgaagttttaatcaatgttttttacctttgtcgagtagccattcatcaactactcgaccaagtcgatatggaattcgctgtctagcaatcgccaggcgctcgttatcattgtttcctttaaagtttaaagagacatttcattggttaaaatctgtaaggtcaaaggttaaaagttaatacttaaagattgagctatacagttgccacatgattttttgaaatttggaattttaaaaagttctacctagaacatttcatgtttcagacttgtcattcattcatttattttattttagcaaacaaaattattcctatgttaattgaaaattagaaatctgcatttgagctaggttattaaacttatgttatagacagacccgaacaaccaatttaaacagcatataatagctttacaaaaaatgaccaatgacctcagggttttgtctttttgatgtttcttattaactagttaaacatgttcaggtgaaacaggtttaagttttcaaaatacattcaacctcttattccagattaataatttatgatcaccaaacttaataccatatttggcacactgaagcatctacaataggcctagcatactttatttcctagtcagaaaacagaaattcttattcacctcatttaagaaaacaacaaagtccaaatagttcttgtgtatttcacacaaattgatttatcaatcacttggacatcacaagagaatgcatcttgcatcatccagatacgttattacaggaaaaggctttgacaaaagtcactttatttgagtgtccttgagtttcatttaaagcttaacatgttgaagcaaataacatttgaaaaaataattatatgtatgtttttatatagtcaaatatctgctttttattaagttattctttaaaagcatgacagcttaaggaacgaatataagccacaaacagtggcccctattcatagatctaacctaagtgagagccctgcttctttgcataaaaaattatctgctagaaacactgtttaaattgaccttgaatattgcttgcaaatagatgagtgttttcttgatctgtagagcacttacgaagaatctgagacaccatctcggtgttgagttgtgtataatgcaagaagagattttctattccattagagttaactaacatggaaatttaagccaagacattttggcattagctcagatgaggactcagaggtgaaagaaatgttgaatggtagcactatctgcataaaaagactggagtgttttgttagagaagataaatgaatagatttacattttattcctctgatttacaataatttataagtgctttcttttgctactcttataatacattatacttaccactaataagcccagcataatactgattacacacttttggagagatagaaaagaactatcttttagacctcatcaatttgtcatctgaatgtctatatgactgaaaatatttcacacattaatatttaatttaaaatgtaaatatcaaagtcaaggcaaatataaagtttaatgaaaacattaatatgtatttctctgtattctgtgatcactaaaacattgtaaaataatattttataatgtgggaatatagttttgttaaactaataatttttttaaaaggacacaaatggtacaaaattccaaccctgtcttcattttttaaaagtgtacaaaatttgtgttctctgttgtgtgtttgcatatatgcatatttggaatttttttttaatgtaatattagttactttaggacagtgtgattattgatcaattacatgtttttggcttataagtgattttatataataagcatgtttgacatgtgtaatttgaaaagcaatcacaaaatattttcaaaaatacataccctttgctctatagtcttatttgtcactcaatactcataccaactcacattggcataacacttctgacaactttatgattaggtggttcctcatgtttttcatgctagagtcttccaatcatcaggcatgacccacattctctcagacaccatccgaatctaggtcgcaaatccctcttgcccaattactactacagtctattgacagacctctctacatcttctctgtgattaatcacacccattttccatataagccaatatctaatcatgtcacttgtctagtataacccttcccatttctcttaggataaaatctcagacccttagtgaaatttgtaagtacttccacaatctggtcccttcctacctccctgtcccctctcacggccatcactgcctcactctgctctttttatccttatgagacttctttcaattcttccaaatcttttctttcttctctctgggactttgcacatgtagcttcctttatggaaaatactctcccttgttcccacctcatctctatctttcattagctaaccattactaattaatggaatcttcttggtaggaacattgcttccccagaaggtattccctgatgtcatcaggttacattaggacacttgactatattatttgtagctcctgaaacatgccctttagaaagaagcattgaacctgtaatggcaaatttgatagtttgccttcaaactctgaatatccctccatgaggccaagtactatgctactatgtgcagtatttattatttcttcagtgcttacttgcacaatatctatcacatacaatcctattaatatctgtagaatgaggtagtcaagaaaaccttgtttttagttctggtagcttctgttgcactattaacacattcttacaacctaacaacattaaaaagaaaaagaaagcaaatactagtgtccagagaataaaccacttgtagctaagcctccctttgcactttccaaaggaaacaccataaacctcacttataattttattttttgatgaattgtcactgatttgaacatctctacaatcagttcattatttgtttaataataaattccccatgtcacaaaattggtaaacatagttattattagtagggaaaggttggggaaaaaaaggtctaaacaagacaggtagagaaaaatcaaagctttatagattattttaatgacttttaaaaagatcacataaacacataaatacattcacacatacatacatagaatttgtcctcaaacatttgactagtactaataaaataattgtgtgattgatatagtatgacagtatgatgtaagtcaacagaagctttggagatccttgctgagactcagctaaagcaagaacataaacactgaattcccaatgattaacagaggtcacctaacaacaacaataaaacaatttagaaaatcgaataggcagtagacacaagttatgaaaatatgtgataatatataagaaaggtagccacacaagggggtcatatcttcctactaccccagaatatcagatgcctactaattcagtgagcactgttttaaactgaagaactttttaattacaggacagactttattcttgtatgggtaatgaatggaaaatcagatggtgcttattcaattcaatatatacctactttattctctaaattctttgttctcctactagaataaaaaactaatgactttgttctcctattagaataaaaaactaatgacttttctgctgcaaaattatatgcagatacattgtgatatggtttagctgtgtctccacccaaatctcatcttggattgtcgctcccataatccctacaagtggcaggagggacccagtgggatgtaattgaattatgggggtgggtttttcccatgctgttctcatgagagtaaataagtctcacaagacctgatggttttataaatggcagttcccctgcagatggtctcttgcctgtcaccaagtaagacatgactttgctcctccttcaccttctgccatgattgtgaggcctcccaaccatgtggaattgtgagtccattaaacctgtttttctttataaattacccagtcttgggtatttcttcacagcagtatgaaaatagactaatatagtaaattagtactggtaaagtggagtactgttattaagatacctgaaaatgtggaattgactttggaactgggtaacaggcagaggatgtaacagtttggagagctcagacaaagacaggaagatgtgggataatttggagcttcctagagacttgttgaatgatgttgaccaaaaagtctaggctgaggtggtctcagatggagatgaggaacttattgggaactggagcaaaggaaattattgctatgttttagcaaagagactggcagcattttatgcctgctctacagatctgtggaacattgaacttgagagagatgatttagagtatctggtgaaagaaacttctaagcagcaaagtgttcaagacgtgacttgtgtgctcttaaaagcattcagttttattcatttataaagatacagtttggaattggaacttatgtttaaaatggaagcagagcataaaagttcagaaaattttcagcctgacaatgcaatagaaaagaaaaacccttgtcctgaggagaaattcaagccagctgaagaaatttgcataggtaatgaggacccaaaggttaactgccaggacaacgaggaaaatgtctccagagcatgtcagacatcttcacaacagcacttcctatcacaagccaggaggcctaggaggaaaaaatgtttttgtgggctgagccctgggtcttgctgtttgtgcagtctcaggactcaggtgtcttgcatcctagctgtggctaaaaggggcaaatgtacagctcaggtcgttgcttcagagggtgcaagccccaaaccttggtggcttacatgtagtgttgagcccgtgggtgcaaagaagtcaagtattgaggtttggaaacctctacctagatttcagaggatgtatgaaaacacctgaatgtccaggcagaggtgtgctgcagggacagaaccctcatggagaacttctgctagggcagtgcagaaagaaaatgtgagtgggagcccccacacagagtctccactggggcactacctagtggagctgtgagaagagggccactgtcctccagacaccagaatggtagatccactgacagcttccaccatgcacctggaaaagccacagacacttaacatcagcccatgaaagcagccaggagggaagcggctgtaccctgcaaagccacagaggcagagctgcccaagaccatgggaaccttcctcttacatcagcatgacctggatgtaaaacatggagtcaaaggagatcattttggagctttaagatttgactgccccactgtatttcagatttgcatggggcctgtagacccttcgttttggccaatttctcccatttggaacagatatatttacccaatgcctgcacccccacggaatctaggaagtacccaccttgcttttgattttataggctcataggcagaaaggatttgccttgtctcagatgagactttggactgtggacttttgagttaatgctgaaatgagttaagactttggggaactgctgggaaggcataattgattttgaaatgtgagggcatgagatttgggaggggccagggatatggtttggctgtgtccccacccaaatctcatcttgaattctagctcccataatccccatgtgtcatgggagacacccagtgggaggtaattgaatcatggggacaggtttttctcatggtgttctcatatagtgaataagtgtcatgagacctcatggttttataaaggcagttcccctgcacatgctctcttgcctgccaccatgtaagacatgcctttgctcctccttcgtctttctgacatgaatgtgaggcctccccagccatatgtaactgtgaatgcattaaacctctttttctttataaatcacccagtctctagtatttcttcaaagcagtatgaaaatggaaacattgtgaagacacatctaaataaagtacagcgacaatgtctttttaatagatgattccccaaatccttccaccattaggtataaaatagttcagaatgtttaggttctccagcgactaggcctatatttttcctttacctcatgattttcataaaaatgttgcatactaaaaggggtaatggaagtatattattttaaataatttctcaagatgtattttatttctttacaaattcatggtgatatttacttgtaaaatatcattcagtagctttgcatgattttgctgattatatttaatactgtccattgttcaatatacatctagaccttacatgcaatataaaggatataaaccatttgattgggaaaggtcaaaggcaaaaataatttccaatgaccttttcttttctttggaaaggttcaggatctaatatcaaatatgctgggatatagaagctttacatacagcatttgtgaatggtcagtgtaagcaggcttaagctggtaggtgagatgaaaaacaagtggaatgtccctgaaaattcaaatcaaaacaaagttgaatctttcgaagaagacatttttaccttcaagtattctaaatcagaggtaaggataaagcaataaatgacccacttttcaaagatctatacattccgggctataaaaagggtccaaaaggaatttcatctctttctaaaagcataaaactctactatagcaacatgctgagcaaataggcttgatttataaaagcagagccttctcattgaatagttaaaagataacaatttagtctcacacttttcccatgataaaagcaagataggattttcctttgatttctttttcctccagttaattttgtgtggtttgatctgttggtaccttcactgaaaatgtcagtgacaacatacatgcctctgccgaagtaattttcaagcaatgaaactgcatgtaaaatttggttttattttcctttgaatttcaaaaagaattaagtatttttgacaggaggaaagactcccttccccccaatccctgtagtaatgccattgcaacaaggtacaatctctaattgtaaggtattaaatgtcattgtaaggtattaaatatcattaatacttcaaacaagtttcctggggtgaagaattcaaaggaaaatctgatggcttatatttggaatgtataccctctattttgattaaatcccagataattttatttgcctatttgtatagactgaatgtttgtatctcccaaaattgatctattgaaaactaattccaaatatgatagtgtcaggaggtaaagcctttgggagctgattaggtcatgaggaaagagctctcattaatgggattagtgcccttataaaagaggctccagaaaactcccttccctccttctgtgatacgaggatacaatgaaaagatggtcacctgtgaagaatgaagcaagccctcactagaaatggaatcttgtacttcctagtcttccgaattgaaagaaataaacttttattgtttttaagccactcagttaataatattttattatcattgcccaaatggacaaaaataccatgtaacaatatttggtcacattttagtctatttattctatatgaacaagcagacttccgggaaatgagagtaattacaaagaatcaaggtaagtagcacaaagcaataaaactcaaatccttgacttggagttaaatttcatggtgtgactcagagaacaaagataaatacaattttaatcatattgttataactatcgatcagtagagacaagctatatgaacatcactgatgtatagtttttctcctttcattttagttcttcactcttgtgtaatttctcctcagaaataaaagtgtcagcatttgatatgacatattaatatctatggggaaaaagtaaagaaaaacaatgctatgaaccaaacatttgtgcagaataatatgaaaataaaaataacaagaacaaaaagagacttgcttctttggaaggcttcttatttcttgagtttttaacattgggaaaagaaacacaaaaggattctgaaagtcatctataccacaagagaagattagtaacctgtgtacagactgatttttaaatgagaacaagacatttggatatatctaggcccagaaggcaaagtaatagttttgtaaacatactctgattttaagtgcagcataatcacataattttcaactgaatgcaatgtgtattgttgtcatatagaccctgcaaataccataatgcctcacttggctgataatgttccaaataaatagattttgaatatcgacaccttttgagaaacaaacttttgaaaaatatagctattctaataaaacatttgtcttatatattactttatttcctatatcattaaaatgtaaaagccgaatacacatatataattggctccagcttactccagtttcatcttgaactacttttctctgactctttaaattagtcactttgtaattttttcaattcctttagctaagccaatccactttgaacccgacattctcctttgcattgcgaatttcttgcatccctgtgtactcaacatctctgcccacctcaacagacacacacacacacacacacacacacacacacacacacacatctaaggctggctaaattttttcttttttaaatatcagcttatacatttctcaaggaagcattccctgtgtcccctactgctccaccaaattattctacttaatgaattcttccactatgcattcttaaaatacttagtagcaatatctataatcatgatcaaagaagttcatgtaattgattctagattctagattccttgtgagcaggaaccatgtctgtcttgttcaatgctgtacgccttatgtataacacaatggtgagcacatggtaattgcttgttaagtaatttctaaatgaaaactgaacccatacagttatgcaaaaaataccacttgaggtaattttttgcatgataacatagtggtatttcttgttcaagatccataaggcagtgagattgttagtgtccacttacatatatgtatatatagtcacaaacaccattggattgtgagaggaatagaactttgcaaaacgttatagtaaattttgcttggacgtcagatttccttttttcttcttgaccatttagtgtccactaattacatatgtgtgcatgtctatttagtttattcagtttaccagacactaaactaaatagagataaaatatgtgtctctatatataatatatataattactgattcattatatatataaaatgactcagtaactctgcttatctttcatcaattttgaatttgccattgtagtacacaataggacaaatcttttaaatcttatttttatgattaattacaagtcaatgatttatagtctgaggtgagctctactgtggtgcatacacattagcagaaaaattaataccacgtgggatcttctttttttttttctaattgtgtagagagctgatcatgacaatctttgatttggtcagggggaaatttctgcaagtgcttcaattctctaatgactgtgtacaagaaacagtcttggacttgatgaaccttcaaaatatgtatcatctccaagactatattttctagatgaattttagtggtgaattctttcaaataaattgaaatgttgatactctggtttctcttcacatcgtattaatcttttactaaattgaatcttttactaaactgaaatgttaaccctccaaggagcatttacttccaaagttcatcaataaatacatcaatgccttgtaaagaaagcaacattcatttaaccaaggcaaaaatgatacaaagttgaagcttataaagtcaggtagtagaagttatggatcttctagcctttgtaacatgagggcagagggcttctagaatttgcctgatttgtggctgataaagagcagcgaggggcttggattgtcttctggacttttaagacctcactgaatgatgaacacacactaccagaatcaaaggatggtttttgtcagacagcaggactagaccagacagtaaagctacaattaagtttcatgcatgctgggaaatccagtttttccgtatgaaagtggtctgtaggtaaagaaactgaagaaaacaaaggaccaccagaaaataagaaaataatgtattgagtagcttcatgttttatgcattgtgttacttgcttatttaggttatcttgtttaatgctgatattgatcccagaccataagtaccttttattttactgatggaaaaactgaggctcaaagagatgacataaaactaatgctgcatcatacatcatagaaagagggaccatttgaatcaagataaagctgactcgaaagttgttccatggaatagttataaagtaatatctcttaataccgtgagtcataagggccaacatcttctccttaatccttatagcactcttttgtataatgtaagatgtcattaaggcttgtctacaaagtttctgtcttctagattctggggtgagatcgcccttatggacacatgaaatcagtaatcttccctaaatcctcaacgatttatcaggaggataattttatcatctccattttatagattaagacagtgaagcagaggtaagtaaagtgatcaaagacctataacagtggagatcccagtgagaagcagtattttgttttttttccttttataatgatgccttgtatgcatagctactggaggcataaaatgttccagacattccttgtctttacctctaacctataagaaaagccacaagcataataatccactaacttcagtgctttttggacgttgaacctctccagaaacacgttggaaatggagagaggatcctagttgtgacacaaaagaccactgtacttcattgacttgtcagagaaaaagaatattgtaacatgttacagtaaattttgcttggacgtcacatttcctcttttccttcttgcctatttcttatctctgcgtttccttttacacagctccagaaacccagtgctttcatgccacctgtcaacaactcaaggcgtatatttacaactgcggttcctacacatatctcatgttccaaaaatacttcaccttccttcttctctagtgccaataattaaaccctggtttctttagtatagctcggctagatgttagaaaagcaatcggactcaataaagtcaatatataagcagtgcccatgtactctgaaattattgtactctgaaaggcacacatcaatacatcacatggattctattgttgaagagcttacacgttgtctagggagtcaaggggacaaatgaggaaagttaaaaaataaaagatttaagtaaaagttcaagataatagataatgagacataagtacgcaattaaccaccatgtgaagtgtagttgccatagaagttcagagagaacaatggattagagcaaagaaggtgtgatggaacacaaacgattgcacctagatcacaatcaaaatgtcattgaaataataatgagctaaaaatttttcataatgtgaatattaatcctcaaaaggttgacaattgatcattatcctgaacttcataatgctattcacccaacatctatttttaaataaatagactctccaataaaacatatttagtctcaaaatataattacaagtatgaccaataatggttaaatattcatgtcacgaaccatgaaaaaaaagaaaaaactctcataaaactactaagtaaaatgcactgaaaatcggcaagaatttgagggcaatgtgtaaaagtgaaatatttgtgttaggatggagaaattaatggtgaccttttttcaaacttcaattttatattattgatactgcatgtatgcacatttcaactttgttcccactgcttccttaaacacatacacacacgctcatttctctaaattaaatgcgatatattaatgtaatgctacaggaagagggggtggtgcaactcaagagttctgtcagtcattctcacagctagaaagagcacgcacagctcaagtagggtgatgcgctgttcgtgactaatgcttcagatgacatcccagctccttatgtgaaacagcaggcttttatatccagttaaacaatatattcatgtgagactgctgtgatgttgggcgtagaaggctgcaggctgtctactgcagagttcaatggtgctttggggaagaaattagaatcttagtgcatgtctaactagcttaagtaatttcttccttcacatccctctcttatgtggatttacattaagatatctaagtgttttacacaaagatttgtacaagcacttgttcccactagctacttacattcaaaaattttggtttggatattgtttcatcagattaatttgaaataaatacaggtaaccttgtgaattttggatctcattgcctgtgtggaatgaacagtgatttaaattttcttccctacacctttaaatgctgtttgtttcccattgcaaaggcactggagtatcatatcaaaaaccagcagcaagaaatgaaaagcagcagggacaagcaggtaacaaaatacagaacttactctgataaattaaaggtcatactctgttatcatgcatactaaagagttattttgtgccagttgtgtagcatttaagacagaagaatggtttaacagctacaaaaacaggcagagccattgatagacatcactaaatactgagaataagaaaaatgaaaagtaagagcagccccacattaccttacaaatggcattttgccattttcccagatatgagaatcttgagtactttctaaatcataatgtcataacatttaaacctatccgctctaataaaaacctaaatatatattttttctaaagtgtcttttcccagttcttgttttttgaaaattggaaaattatgtggttcagctgaaatttctacactccattatcagtcttgacttttaatctagtcttcttaatattcaaattggtccacggaaaaaaagataggtgaatgtttcatacacagtctgatgtggcctataaatggaactgcgaaagttccctattctcaagtggaaaagaaaagtctgattattatgacattctgatcttattttcaatggacttcaatctctctcttccagttgtaactggaatgcaagatttttttttcaattagaaagatgaggtttgtccattgtatgcaaataatttaagattaaatggtctggaattgcaaaggaccaagagttggataaaggtgctggataattgctagccccattcaattttataaaatgtaaaaccactgaagtaaaataaccatttttttctttttgtagataaattgaatactatggatatgaatttaaattcctaaaataactttcccctaatacaagttaattttctctaccaccaattatttcttaaaagtaattatcctgtggtcagaatcactgaggaaagagaacccttgatggttaagataatgagctctaattcctaggttcaaatcttggcttcaatattgactagctggatcagtagcataacatcttttaacctcagttttctcatctgtaaaacagatatttgtaagaatagtatccataatatatgccaatctcttagcacaatgcctggcacatggtaagcactcagtaaatattagcccttatattgtagtcatgtcattgtttattctctagtatgatgtgccttacacaatatatctaagaatgtgtacatcacaaaaaatattttttttacccatctgatcatagaaagttgaagtaaatgtgaagaagagtggaaaataaatctattatctttcccagaatgagtaatggccaaagagtgagccttattatgagtgatatcccgaacgtaggtgctttatcaaaatcactgcactttctcccaagcaatgtcatctttattctcagaggtttatgcatgctacttttaagtcaatgggaacaactgaaaagaggtcattagctggaagaaaccacacaaaaagaaaaagccaacagcccctgccctgagggaaaacagaattcagggtactaccatgtgttctgtgacagcagcatggtgacaaaagctgttcccagaataagaatactttggatagcaatgaagtcttaaaatgacattttaatccatatattaatgcttcaaagggatccacttcaactagaatgccttaactcttctttttgcccaataatgctcctggcaaagaagggccacagaaaccatgaacaggagtggatgctgcttgatccattttctgcaaaatgagatttggggactggatggcttctaagctgaccctcaatgctaatggcccatggtcccaggtatcagatggtgttgttgtaaagacaagcattaggccaccttgttaaaacatggtgattgtggattttcatgaggaaattaattttagagccattaaaaataaaataccataaatgttttttaactcagcaaatatcttttaaaaagcagtgaaatatttggcttgacatgttcttttcttcatctctctctgtttttaaaactaacttatggtgccttgacaattttatgaagaatttcagttggcatctgtggagatctttataattaagccattacatttttctgaaacgtttcatgttttaagcttgtcttctttccactttgtgctatacagacacacccacctcttatcactgagacatttctctgcattctttctacccatttaccacagcatgtcatggttttgacagccatcttaagaggaggaaggcagacataggttagatttcaggagattttgggggtttttttttttttttttttttgagacagagtctcgctctgtcacccaggctggagtgcagtggtgcgatcttggctcactgcaagctccacctcccgagttcatgccattctcctgcctcagcctcccgagtagctggaactacaggcacccgccaccacacccacctaattttttgtatttttagtagagacgggttttcaccgtgttagccagggtgatttcgatctcctgaccttgcgatctgcccgccttggcctcccaaagtgctgagattacaggtgtgagccactgcgcctggccgagatttcagttttatacagagtagttaagacaatgaaggacaaggcattatgatactaggaaatagagaagtttgtctcctcttcatttgaaatttttagcactaaagagattagatcagaaaaatttaagaagaaatctgaggacttcaagtcaatggctgctctttgcaagccctttttgtccaaagtgtatcaaaataaaccttttcttggattgctgaaacacctgtgatcatgggatcagtacttttggagctatttctggttcaagagacattctcatgagagttcctttccaatcaaatctgtcaggggctgacttaaaaacctgtaagtgggccagacacggtggctcacgcctgtaatcccagcactttgggaggccgaggcgggcggatcacaaggtcaggagatcgagaccatcccggctaaaacggtgaaaccccgtctctactaaaaatacaaaaaattatccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaacctgtaattggctcagtgtaactcagactaagtagagatcaccaattaaaacccaggcatcctaaataatgcagtaggtacagaggagaaatagttcattgcataaaatatatcagaataaaactataaatttctctacttccttcagtatttcttcttaaacttaagctacctgttatttctagtgatctctaaatgcagaacagaatgaagacaagataaaaactacaaagatatcctatcaaatttgagctgatgctccattactaaggacaattggaattgatgcacacacatgttcttctccatcttttttatagcccaatagatctacagttaggctgtgtcatatacaagaagaagcctgaactaactaggccgtataactctggcctgattaacactttatctaatactttttctgaagtcttttaatctaagtcttgttttgacttcattgaaaataagcagtttgttggtaatcgccacacaagaaccctacacatacttaaagactgttatgagctcaattgtttatcccccaaattcatatggtgaagccttaacccctaagacctcagaatgtgatggtttctggaaacagagactttaaggaggtgattaagttaaaatgaggctgttacggtggatcctaatgcaatctgactggtgtccttataagaggaagactggacacacaaagagacacaagggatgcacaggcatagaggaaggactatgtgaaaacccagcaagaaggtggacatctgcaagcaaaggaaacaggcctcagaaggaatcaaacctgctgactacttgattttggacttccagcctccagaactgtgagagaataaatttctctcatttaagctaccactctgtggtattttgctatggcagtcctagcaaactaatacagagataatttaaacgtagtttgaaataatatattgttagtttattcacagatctttcatattaagatgtgatagtattttgctgccagttgctaaaatagtctaaaagcgagtactcatggatttgcacacagaataaagctctgtgttaatgtcaaaatcatgtccattttaattattaattttagttaaaatgtattttgtcctgttctggttttgctgcaaattgtaatattctacattacagtcctggtaattagtacagttaccaaataaactctatccatgtacattttttgcatgactaaaactataaaataatattattttcatcatgaaatatacatgattatatgtagttccattaatgtatatagaacaacttttccaaaaggaactacttaacctctcataccattaaatgaattttcttgaagaaaacaaagtattttctactaccattttcttcactttgtggctccttataacttccctccttgtaacacctgctacgcggatgactgcagcactattaaaaatttactgtcagtgttagctttccaagttatggaaaaagtctcagtgcaaaacaaacaataaaagcaactctgcataagacaaatccttacttatgttaatgattacatgcggtgacattgtcttatttaaatatgcttatattttcttcaatttggaaactactgtgagatcccaaaagatacactgtgtccacttcaaaaactctaaaattctaagtaccaaaggacaagcacatatttattcacactaatttttatccttaggaactgcctaagaaatttaaaaaaaaaaaaagaaaaagtgattttgagagattataattagttttgtgaggcttgctaaatagtcatggcaaaaaaaaaaataaaacagcaactttcactgttaatttggaatgtttatcttctactcaaaactgaacgaatgtcttacattgttgtgctttttctttggtgcttatcactgaagaagaatgccaattccaagcccaacttggacatatacctcagtaaagctgccctgcagcagggctgaccacctccactgaaaatgcctaggcacagtgaaggcccagcaagtggatgacggcatcagctggtcctaaaacaaaaagacttgagtactatatggatgtaatgacctcaagatcccctatatttcctaagaaattagacatagcttcatcattttcacctatgaagacaaacttcaaaatatttttggcctgctttttacttaaaaaaatgcttatgaaaagggagtggacaaactttgtctatgcctttgtcttctgctctcttttgatgttcctggagcctatacccttaggaagaacttgatcttgaattacaatatcagtgtccttcaaattccacttcccgtgttatagtaagcaatgcctggactgtcatgtcacctagcttagctccagacatttgcagacatttattctggcccctttagactattccctgcactttagccagaaaaattatttgaaatcatgtgttatctgcaacagactatgtgttccaagggggtagtgaccattcctgcactccatgctgtatccctagcataagtccagacacatagccggtcttaaataaatatttctgaataaattactgaattcactgggattacctctcctcagtctcttctgtcttccactatcctttgttctaacatggcttatcaatcataattaacctctagaatacttatcaggcctcactcatgcttccagtttcttttccatgatccagacttactgaatttgccttctattcctttcaaatcctgctttttgctggcgaaaataggtagtcacagtagtgctcactttttttaatgcagtagaaaaagagaagcaatttgacattaatatttagatatggagttaacttccttcttgaaacttgacataatgactctctgctaatcatttgtagagatagtcaacaattctagtttaggtaggaaaattgagaataaaaaaaaagcataggcctgttaatctctttttaggaagagtttgagcattctgattagaaacagatgtcatataagctcttacacataaatgagtgcactattagtttgatattttatcgagaaagaagcaacatgaagaaaaataggcatattttatagcaacttggtacttaatagagtttatgccaaaggaggtcagtgcaatgcattttcttttttagtttttgtttgcacattttttaaggcctggaaagtatgagggtatgagtaggatcccagctgtgccaattaatgacacatataaccatagatgctttatttggctagtctttaaaataaacaaaaaaattataggttgccagattttttgaggaagaaattttctttgatgactgagctaagggaccccaacacagtatattatcaagagtacatcatttttaaaacattttatattatcactataatttaggtaaaattatagtatattagcactagatgatgtattcttcatcaaaaatgaaaagtttccttttagtagccatagaaggaagagttcccaatttaaatctcacgaaatcttgctttcttaaatatgtaaaatataacacaagatttatggaaaaaggtagtcaagtctatttgatttttatggaggctagaacattccagattcaaatatcatgaataaactcataaacaagttactatatcttctgtaaaatggggataatttatgaggttacttttaagaataatatgtaatgtctgtaaagttgctgggaacagtttctggcacatatatatgatggctactattgtttttatagattacatagaatcacagatccttagaaataaaaacaacttgagctagaatctggtgtaattcccatccaatgcaggatgatttgataatcttgacaaattggtctcttgagctctatagaattagaacagagtctaaaagttaccatagcccaggaagagttgaagtacattatcttataaaactactcttgttcatgctatttcctttctaaagtaaatgtaaaaagtatggaaagagcatcatcacaaattgtgaatacaatggagcttctcattttggtttgttttggtttggctatacatgaaataccttaattccattcagtcattatgcttagtttatcaagttagtggccttctggcatattcaatacatacaacggtaaagttcacagtgtgaaacttaaatgacaatacaatgaaaacacaaacagatctaatcctagatttcctattgcaagggcaagaaattgagaacactgtagtcaggaaaatgtatatcaggaaaatgagatttacaaacaatttatatgtatagaaacaaaacaattaaaatctgaaacagactccaaaatgtaaaatatctgacctcacagaaggactttgaaccctattatacacctttcttcatccatgcaaattctatttattctattagtctactttgacgagtcactgaagaattgagaggcaggaaaatatatgatgaaagcaattttaaaaagataaacatcttggctgcacaccagatggattaaaataatggagactggggaggaatatttattgtttatagctgataacaggaaaagaggcccaattgtgtaaaaagccttagatcattaaaataatgtcagcccaagaataaatgcctcaacaggaataaactgaacaccttatcataatcactaacttagactgagtctagtttctccaggtaaaattcaggcagtagtctcagctctaccagtaggcactgcatattacaggaggtgacaaatgttccagattgcctcaaatatcttggtttgttcctattatataggagtaactatcaatagtgcttctttttttatcagaattgtgtctgtttgaatgataatttttatgatcttctaattatcgaatgccactgtggaaatttaaaaaagaaaactttcctggattgttatagcttaagcaaaaggcttgggcaatcccaacgtgcttggtgacaaaggaaaaaaaaaacagctctactttcaggaaatctggctatgtacatgcacatgacttggagacccaagcacagactgtatttcagcctcgactcatcccctccgctgggactctggggcagcacccgagctgtctaactctacacagtgccctgtccaccagctagcatggtttctctaatgttcatttaccaaatttcaaatgaattccttagcacccagcccacattttactcttctgtgatatcagccttgattactgaacaccattctgttttctaaaattgtacagaacatatattttgtgccactcatttgaactatgtctttcttagtaatgtcttcatagtgttttgcttggagtgggtttggggacagaagcggtactgcacttaatgtctgccagggtcaggaggaacaatcttaagtttttggaaaggtttgtctccatttatgtgaactgaagtctgacagccaagagaaaataaatttgttcccagaaagaaatacaaactaatacggggaggttagtgactattgcagttgcaggattgcaaaactaaactattttgactaataatatagtggaattaacttttactcagcacttactacttaccaggtttttaccaatttctaactgttttgaaattaataactcatttaaacatcaaacaaccttatgaggtaagtactgtcattgtccccactttttagattaggaaaatgagattaaagaacttggcaaaaaatttcacatctcatcaatgtttgaactaggatttgaacccatgcagtctggcttttgaatgttccctctgaaccttcatgctaacctgcacacttaacttgcattaagtttgtagcatatgtctggtttgatcatttgatgtgtggtatatattcctacagcaattttagtcattaagaggagtattcaagttagacttggcactcacttctccatctagacaaagaataaccagcagacaggaagaacactattatgagaatgcttctaatcacaaaggacccctaaacagcccttacagatctgaatagaagaagtaataaccagtggtatcacaaccttagcacaacaaaggtctgagcatcatctgacctggtgaggaccaacaataacattttatgaattattttttaggggaattaagaattatttattaggcagcattgcataatcctacaaagcactggagtaggctttagaacctatggtgttggcaagtaaatgaatctccctgtgtttgctcatttatcacaaggagatactgtaagctgtcttataaagattctgtgagtgttaatgcaataatgtttgtaaataaggtatgtaaaataattagcatattgccccatatagagtgcccactacagactgcatgtctaacttattgtttcggatactagctcttacaaataggcaggaatttcaaaaggttctatgaatgtttggaattttggatgagttctgttacctcttcaccccaatgctggcgcaacatgaatttcctttattgaatcaatttgacagatttaacattctatttgaactccatttccataaagcacaggcctcatctaattatccccaggtctgccttctactgtgattgtgctcattctgcctttctttttttactaaagcaaatcttttcatttaaaaaagcttccttttgcttgtttcgcctctaaccacaaaatgcactctcgtccaagtcctctgccaacctgagcaataaaaataataaatgagacaactgaagactctacttggacctttaaaatgctccagcgaaggtgaccctgaaaaattattatggcatgttatcaattaggtgacactatcaagaaaaatgaaaccaaaatattcctttattctgcctgattttatatctcataaatcctgctaaaatacttcattggaaatgcatatggtaatatctagacaggcttatgttagatatattctttttggattctcagtggacattttacatattagggccaccaatatagataatatgcccaagatgacaaattacttcaataatacttaacatgaggaaagtctgtctcaactttgcggggaggggtaaacacagctgctttttaacacagttaaattcataaagctaaaaacaaaacagactttaaaatgtttaaaagtctgtctttgagaaatattctacccatgaggctaaatttgacacaaaatattcatcatcataatttaaattttaatatatggcctatttaaaggcttcatacttcaaaaggtttttacatttattttgtcattctgtcttaattaagaaccaactccagtattagattaagttacacctttggattgttagaaaaattaggttgctattcttctggaataaatctacttttccaataaacacatgaacatgtcaaaattttttttaacaacaaatgcatttgacttacaattacacaaaggcattatgtttaattatttttttctgaaatgttatatagaattgagtaaaaggtatttttaggtggaaaccatttctaaactcttatttcaaaaaaaaaaatcttatagaatgagagttccaaatacctttcattcagctttcctcctgttaataattaaataaccattaggcagttatcaaaaccaagaaagtaacactgataataaactgttgactaaagtatacactttattttgttttaccagttttcaactaatgtcctttttctattgcaggatctaacccagctcccacattgcattaaactgccatgtttcctttgtcccttcagatgtgtctttttttgtaattcgtgtagttaacacttttgaagaatactggccattttgtaaaatgtccctcaattttggtttgtcgtagttagatggaacttatggatttttgttgagaatatgaataccaaagaagtgaagagcctttcttagcatgaaggttcatgaagtcaatattttttattactggtgacatttaacttgatcacttaaggtgatctgctgagtttttctgaagaaagttactacttttacttggaggaaatatttttagactacataaattactaatttctactgaaaactttttcgcacttattttggtatctattagggaatcccgacttcaacaatttttacattgggattctaacgatgaattcctatttccatcatccttctacattattaattgtaatttttctgtatgggtgagctgtctctgcttccctatttatctatctgtatatctttctttctatctgttcagttacttgtttatatctctatgggttcatagatgtttattttactcttttggttataatcaaatgacatatctattagttttgttgctcaatttgatctagttctggcccttggaagttttttcggattagctcttacgctcctttgtcatgcttctctctcaggggtcaataaagtatgccctacaggtaaaatgtgtccactactatctatctaatattgtaaataaagatttattggatcacagccacacccattcattttcctattagctattgttgcttttgagctataatggcagaattgagtaattgtgaccatgtggttctcaaagccaaagatatttaatatttggccttctatgatgaaaatttcttgatctttgctctaggcgaattttctttttttaaattatgaactttgaatagtgcccaaaatgtatttaattgttatatctgaggtactttagaattcagactcttgaatgtatatttttcctatattctcctaacttcattagttgtaataattttgatgctagacatttattattttgtttgaagaaaacaaaatggattatcagtattctattgagtttaaaatactaaatcatacagaataagaaaataatggtgagacaaagttgaaaaattatctagtaagaggagcgaaagagaaaaattgtcctcttgcatgatatgttttaaagtttcctaaatacatgcaaaggcctttattaacttcttcccataataatgaacggtaatatggtagtctcctcttattctacagtttcagttacccacagtcgaatgcagtctgaaaatattaaatggaaaattttagaaataagcaattcatgccatttcagtaaatggcatgcaatttaaataataaagttttaaattgcatgccattctgagtagcaagataaaatctctggccatcccactctgtccctcatgacacatgaatcatcccgttttctagtgtatccacgttatatagtcggttagtcacttataagtagccacctgggttatcaaatcaacagatcacaagaagaagggtgagtatagtacaataagaaattttgggacaaggagagagagaggaagaggccacattcgcagaacttttattatggcatattgttacgattgttctattttattactagttattgtcactaatctcttatcatgtctaatttatacattaaattttatcatagggatatatgtatagggaaacacatagtatatataggttttggtactatctgtgatttctggcatccaatgagagtcttggaatgtattcctcaatggatacagggggattattgtactttccagagatgttatattgatagcaatttttatctttatgatattggacacagttatttcaccatcccacttcacaatcatgagatgattcactgagagacctttccaaatgaaactctgaaaccatgcattttggttttaaggatattcattatgtaatgccccaatgttataattatatcaagcatagtatcagtgcttaaaataaatttattagaaggataatggcattcttatgatcctattttggagaacaattgttttaaactggaagtacaaaagttggtcctattctgtgaaaaaaaaattatctgagctagtaaaggctacacccagagggctatgtcagtggttagaaggttattagcaggttagtaaagggcagccacatttcattggaagcatgtttaattaggggaggaggaggtttctcctcatatgttcattacacagactttattttttcctctaatatctcaatatcctcaaagatcacctagagcagaggttctgaattctaggtaaatgggcctaaggatgcaacccttaaacataacatacataattttgtatacaaatgtagatagatgtgtatttttctaaagatagaatgttctactttattggattcctatggaggcagagattcaaaggaagttaagaaaaactgatctagattaatgtctaaaactaaatacagttacctaagctttatactctacataggaccttgacaccagtgtatgatattttatcctttttgatactctgcctcctcttgacggcactttcatttgtttattagaagttaagtgacattaaaaccaacttattcctggccaggcgcagtggctcatgcctgtaatcccagcactttggggggctgaggcgggtggatcacgaggtcaagagatcgcgaccatcctggtcaacgtggtgaaaccccatccctactaaaatacaaaaattagctgggcatggtgttgtgaggctgaggcatgagaattgtttgaacccaggaagtggaggttgcagtgagccaaattcgggccactgcactccagcccggtgatagagcaagactctgcctcaaaaaacaaaacaaaacaacttattcttgagcttacaagatacgaaaagtgggtagacagtggacaaatataaatagcatgaaaatcatgagacttgttcatagttgacattcaaataatgacattaaagctgagaaggaacaaatcacatagtacagttttaaaaattgttcatcatacaccaaaatactagctattatgtattatcattataaaaatatataaataaatatgtctgtgctatttaataaaagctcctgaagatataagaactcagagtgtttgagaaagtattacgagaaaggcttgtcattgagttgggaatgtgacttcttcttccattaaagtcagctatttataaactataaactatatgataaaacaaagatacttttaggtaatagtcaaattataaaagcgactgttataaaatataaatattaaaatcaaccaaatacttgtaaataccatctgaagtttcctaaaaacctaatactctttaatatgtcattttttccggccttcagtgcttagctattcctataacttgtttccacctcatttcctaaaagctagatttctgcattgtagtgacaattaattttttatatctgacatgattaattcattttttgtaaccagtagttagattcattaacctgattacccgtatctttggtgaaaagtccttcaagacaatctcagccaatatctttagccacacttatttaaaatcatgataatgctattctctgtttaacgtgactacttttcaggagtgagaccagtataacccttcattatgataagaacttaaattgctaaacaaattgtatgttggaaacaataatggcagacaagaagttaaagggggaaattttatgaaattttatgaagggctgctatttgtatattacaacataagatatacttggcaaaagttcttaaacacagtaatgattaataaacatttctcaatttgatttgatgggttggtttctaagtaatttgttttcagaatctgagaacttttaaaagtaaaaagttcattaaaaactcgcaaaacagaataaatttttattgattaaatgtttcaaaatatatttaactcatttttaaataagcttaagtttagcttcaaatacgtaggaaactcatgagttgctatcctactttattgagctcttgttttctgatagtgataataaaggcacctatcctccccacacagttgcaaaaaggattaacttaagtgagagacaaaaaagtactaggagaaatcgggaaagaagaggtttgacttacatgtctctatgtcattcccaatagtatccaaatagcagatacccaacacgtatctgaagaaattaatttctcagattatttcaattttgtcagcaataaacatttaataatgcatttgttttgggggcaaaaaatcagcatattctgaaagcagaaaaaaagggcctgtttgggtttcactgagctttcagaattgcctggacaattatcaaattggccctgtgatactctgtatgttagcttctactacaagagaactttatgaaagtcactgataggtctcattgacaagtttcctgggatggaacaaagaacatttccataactacatagcaataatggaacaaaaatggcaacttacagacaaactacaagatttcaatttaaggaatgaagcagttaagcctagttgatataatatcctttacttctgttttaccacaactcttagaaaacatctgcattatctgtttgccaacctgtgtagtttaaatgatgccaaaacccatcaaaccatcagagaatcttgctctctcttttaacagaaaataaaaaaatgctaacatggttgtgtgtccagaattggtgggttcttggtctcactgacttcaagaatgaagcctcggaccctagcgctgagtgttatagttcttaaaggcagtgtggacccaaagagtgagcagcagcaagatttattgcaaacagcaaaagaacaaggcttccacaacacgcaagaggaccccagcaggtggccagggctggctcgggcagcctgcttttattctcttatctggccccacccacatcctgctgatcggtccattttacagagagccgattggtctgtttttcagagagctgactggtccgttttgagagggtgctgattggtacgtttacaatccctgagctagacacaaacgttctccacctccccactagataagctagatacagagtgctgattggtgtatttacaaaccctgagctagatacagagtgctgattggtgtattcacaatcccttaggtagacataaaggttctccaagtccgcaccagatcagctagacacagagcgcagattggtgcatttacaaaccttgagctagatagagtgccgattggtgtattcacaatcccttagctagacataaagattctccaagtccccaccagattagttagatacagagtgcagattggtgcatccacaaaccctgagctagacacaaggtgctgattgctgtgtttacaatcccttggctagacataaaggttctccaagtccccaccaaactcaggagcccagctggcttcacccagcgtatcccacacggggcggcagatggagctgcctgccagtccggcgccatgcccttgcgcggtggatgagactgggtgccgcggagcagggggccgcacaggagcccgtggcggggggacactggggaggggaggctcaggcatggcggactgcaggttccgagccctgccccgcagggaggcagctaaagcccagtgagaaatcgagcgcagtgccggtgggccggcactgatgggggaccctgcgcactctctgcatctgctggccctggtgctaagcccatcactgccggggcccacagggccggccggccgctgcaagtgcagggcccaccaagcccacgctcaccaggaactctaggtggcctgcaagcgccgcacgcagccccggttcccgcccgtgcctctccctccacaccccccgcaggctgagggaaccggctctggccttggccatcccaggaaggggctcccacagtgcagtggcaggctgaagggctcctcaagcgtggctgaatgggcgccgaggccgaggaggcaccgagagcgagggagggctgctagcacgctgtcaccttttagttgccttacagtaactgtaaaaattctgatatttaaaaaatccaagtcattgataaagtaagaacaagtgagaagtctgataatatatcatttctttccatctccttggacacaatttctcagaagctaagcttagaattttaggaagacacattcaatatactacttaataaaaaagttcattatgtttcatcatttggaataacctcaaattcccagcaaaattgaacactgtgaaaaaagataattaaacaggaaaagtcagagttttagacacttgtttaatttactcagctactgtatttgtggcttcagatttctcagagtaagatttattacagaaagttagtattagtaaacatttaatgatttccaatggaaaccaaacatttatatattgaaataaatattcatctatgcatgtaagtatattttggctaaaaaccaccagaaaaaaaatgctttgacctagaagtttaaggagggatgttgatttattcaacaactatttattaagcaccttctgtgtgtcacaccctgattattacgtcttttgttagactctactcaaaattggttatttaaacaataattcagatattccatatggtttatcagtttccacaagacttatattttcactattttacttttagaggaaggaaaaaaattagtcaaacatttcccatatctatacatttaatgagaacatgggcaagtcttcttttaacaaactttttctcccaaatgattcttaagtattctaatgttctaatggtccataataatttacttaatttgctaataaagtttctctagtaaagttagaaaataattagtgcttactaacgagtattattgattcaaaactttagtgaaaacaaaatatggttattataagataaattataatttatcatataaattataaattctatggttattataagaaaattttttttatgtgttactatgtttaaatacccataagatagtcttgtgtgtatatgtgtttgtgtgggtcagcagaaatagcagactgtgacatcgactgatacagttaggatcaatcatgtaagtaataacatttagttatgaagaataggctatgctatgtttaaagatgcatctaatgatctttgtatattttactttatgtttcccagactttataaaggaaggtgcatagcttgtagacagcagtccccaagtgtagtttttactctgccactaacgagcattgtgatcttgagcaaaccagttggtctcttcaaggttccattttgttgtttgataaatgaaggacgtggaatagaagaacgttgaagttccttccctccttcaaatgtaatgatcatgtaaggtagattgctttaattacatgatactttgaaaaattaaattaaacaaatattaaaaaatcattaaattaaccaacacttcagtaccaaccctgcaatctctaaataatagagtgacttaaataaataataaattactgatgacttgaattaaaaataaactaatcttagattaagctacactaaaggtttggaatttagggtaataatatgacttcctgagccctgaaatattttaccagatttcatggatgaaaacagagttaaggtttagatctaatactcataagctcttccagacaaattgcatgatcacgagaaaagatttacaccatctctatggagtcttagagcatttctctctttctctcagatcctcttatccctaaaggatctctttatcttaccactccagaccaccattttctattttccttaaacttaacagtaatcaaactcggcattttgaaagttaatacattttatctgacatgttcaggttttctggatcctccttatctcccaatcagactaatctgttggcaaacatgaataataatgtctttgacttctttgttccttcctacaactggtttccatttcattggtacctaatgctgtctggtgacacacagcagcattagaacattgaataattgctggttaaaagagagagagggggagaggcagagaagaatgagagagagagagagagagagagagagagcgagccgaaaatgcgggcatgtctctccttctattaagttgttcattagcttttacagtgtattttgcattcatcttgtttattttctcacattctactttagtactttatcttttgatacctggattggttagtagtttcctaaatagtttgtctgtctctatcatttcctgctaatccttcctaaatgaatgcatgcttgaaaagacctaaatctaatttgctactgatttcacaatcttactgcaccactcacttcaaaatggtctcttcttccttggaacgagttttccttttatatcttattcagaaattagccaaatatgatatgataactctagcactttctcacattttatatttctaatcttgaacttttttttgcctatctctgtaaccagactgtaaatttagtatgttacttttatgtagtatatatcctttaaatatttgttgatttaatatgttaacttgagtataaaacgaacatttgaccttgtgtagagtgtaaaagaaatcttttgacacactgtgataggaaaacaaattcaaaagtttattatcaaagataactgtgatttatctgaagcaatctttagtcagggtaagcaagatgatgttaggctttgtgaattaatgttatgagaaagaaagtctatttttgtggagagagaaaattttcccgcataactgtaattagggacaaatcagagattaatgatgcattatattctagagctttaactgataagcaccaagaaatggctttctcaactttaaatggtttgtaaaatattatctctgtactttgctctctatatagaaaataatggatactaggtcttctattcagaaaattcaatatttattctaaaatgtaaactgttgagttacaggaagatttcatatactcaaaaagagcataaaatctacctctactaattagtttctctatgaaagccttccaggcaattacagagcagtaccattggtcaatgctttggttgcttttcattaaaggtatagtgttgctaccagatgaattgcttcatataaaagcacttaccacaaagacctataatggaggttaagtgctatactaattactaatttcaatccttattacctatattttgcagtacaggcactttaaaggaaccatatatagtctgctggttcccgcttctctgagtataagacttggtggtaaaagctctaatttagctgttcttctaataaaaataaccccaaaaattaataaaaagagccataccacaaactgacataaaatacatatactagactttgctactgaactcgtatttacaatcaccgtgtcacaaaaactttaatcaaggtgacacactcttcaaaatttgtattcagccattatggcaccgttgcagatgaagttccaagagaaaaaggtatttgaaattttcatggcttatttcctacctcagcatcacactgaaatgaacacagagcagatgattaataaaacatctgatgacaatggtgactcccctgagttctttatatattgatcattaactttttatatgtatatattgaaattcttcatatgtgctttattttcttgagggccgactctgtgttttaccttgcgtatatccttcagaataattgcaactttgcccactcttggtttatttatattttctaaaatacatcttggtaaaagggcatttaaaatctctgattaaatgttgaaagttgtatctgaaataactatatgtaaagatttgcttcttattacgatactgctcatttctatttttaaacatcttttacattgtgtttcttattctgaacaattatttaattggcaaataaggtactatatgtgttaaacaaatattaatctagaaaaatatgtacaaatatttttttcaaataattaataagtactgcctcaatctcagctaccagattcaaattggacattagtctgctacaagaacacaggaaccatatcttttttgaactatattcagtacatggcatctggtatgtgcacagtcaaataaaatatagtaaaattggggcatatagacatttttgaaaacataaaatatttactaaaatgcaatgatgtttggctaatatatcctatatttattttctatcatctatgcttgggtaaagcatcctgtatttctcttttacagatacattatgcatattaataaagtccaagtatagatattttaacttagcttaacccagaatttcccaaactaatgggactttccctttctcaccataagtagtaataagctctaggtaaagataccagtttggaaattgctgattaagtgttaaaagttactaaataaagacattttcaagaattaactatgaacacaaaaccatgcctcaagaggcaaatgccacactgcaatagtaacaggatttatcattttgcacgttcaggtccactgttcacagctgacaacatcccatgagcaaagcctagaccttaccctactatatattttcatggcatccagtgtgatgactttctctcagcaaataggcagtgattaatccatattttaggaaaattaccaatacacctttctgttattttattaaggttttagctattacttttaaaagcacattttttaggctgggcatggtggctcatgcctgtaatcccagcactttgggaggccgaggcaggaagatcacttaaggtcaggtgttcaagaccagcctgagcaacatagcgagacccccatctctacaaaaaaattttaaaaattagccaggcatggtggtgtgcacctgtagtcctagctactagagaggccaaggaaggaggatcctgtgagcccaggagtttgaggttacagtgagctatgactgccactacatccagtctgggcaaaagagtgagaccttgcttcaaaaaaaaaaaaaaagttaaattgataaagaataaaaattgaaattgcacatttatactaggatttcagataatgcaataatctgggattagcaggggctatgtaacattgcatgcatattaagttacttggctttcaaatcttccattacttcaccttattgtatatggttcacataattgtagtgtaaaattgtggtaattcccaagacatcgattcagcaaatatttactgaatgcctactatttgccagtattataacaggcactggacatattaatttccttgcttcctaactttgtcatagagcagtttttttattacatttaattcagcaaatattggcagagtactaggcttgtggaataggtttgaactagggcttgaagatttagaattctataaaccagaaaaggtccagaagggtattatagacatttcattccacaattgtgagtcagtacttgggatatttgatatcaattgaatacattggttatgtcattaaattacttctttcaagaaccaaataagtgtgatagaagaatttaaatataaattttgattattatttttattgggtaaaatagaaatgtatttttatactttttctttatactgtgttataaattgtgtgctttgcaaaaaacatagttatatctaaaaggggaagagagaaatgagactgatgcttttagtaatagagacgataatgattgcagtaaaatatctttatacttttaatttatatattacttaaaaagcatatttgttttaaaattgaggatatatacaaccacaagtaacattgtttaaaatttctaatctaccacctttgtttcaataacataatattgataaaactcattcacaataaacaagataatttttattttatcaataacggcttgacatttattttatagacttaaaatgagtagtgctagtgtcaaagaatcctcatgaaactctatggttatatgaaagtgaaaacaaacttcttttatgtacatgttcttataactgctgatttatgctactattgttttctcactagttctctacttatctcacgggatccctacactttaatgtgtttcagctgtgcactaccatctgaggaagcgttaggtcttattttctctcagaaaaaaaaagtgttataatattctttcccttagttttaaattttaacttttttacttttgacaaagcctttcctttgtttaaatgcaaggatccagtaaaaagagctttgatatgttgtgctttttatgtgtgcatttttctgatttcattgatgtcctgaattttgaaaacgataatgtacaccttcacgttctcctataaaatggcatttgtacactgtagcaagaacagtttaggacagcattacattcacatgactctaaagtccaataaatagttgatggtttctcagaaaaccacaatttggtgaaacggatgcaaaacagtgctttttcttccagtttgtttttcataaaatcttcccccgatacatattcacttgcttacctgcagggtagcgctcgatcactggccagctgtccacctgcaacgtggcattgccaccactcctcgtgaaacgaactacatggtatttcccatcattaatgattgcattggattcttcaatggcgatgtcatctgtcccaacattaaacttaactccaatttttccctggtgctgtaagagaggaggggaaaaaagagttgaattaagttgactagtcaccatttaataaagattacatacaaggtattgttttaaaatgtgctttggacaacagctgctttcctccaattttacttctgaaaaactacatgtagtagaagcaagattcttgacatctgggtaaatttaagacatctctttcatggataattgatattccaaaaggcacactttcaagggaattgagccgccttcttcccagaggttgtcacagagaaggcgcacagctgcctgcacaaaggacatccttttgtgtactttaacacaacccctttaatccactctccccatttcacaagaaaaacggggctccaaattcttacttttaataactggtgaaatcagagcaatgatgtctgtttagagcccattgacaaatactcacaataggggaaatcattctaaagggtatggggcatttaatgagtgcagtcccttagtcagtattcacaaaaccatcaaatactaacagcttgaaagttattcaatgtttttattttattgatgatgaaacatcaacattttattgatgataacacaggaaggtacaagacttgttcaaggacacataatagagacgtacgaaaactaaaattcatttcccttattcttagattatatctaagctaagttgaagcaaagataccgttatccaaaatgaacgccctcttcacttcttcatatgcaaagcctcattatgaatcattctaactataaagttgttgctgttaactttagaatttcataatataaggtggcaaagagaaacatgtgctatgtcctctgcctctgagaagcattctttaacaggactgtcaactctaccatgaaatcagttgatttctaaagcatgtggatttgtccttaatcagttgcacagaatacctgtgctgtaggcccttgtcagaacacataacctcaaactgtctgtggttcacccttcttcaaacctcagttgagagaaatcacacggaggaagaagggtttaaagtacacacagtccatcctttcctgtagaagttttaaatcagaatgttagaaacctgaagatttgggccacattctcttgactctttgtggggttctcatcattatttgaactaggcagcaggagtatggaatcagcttacactaagaatccttacggaaaatctttttcaaaattgtattaatcaaaggaaaatatttgaggatgttattttgcagtattgctcattatctccttcatgtagagatcctaaaggtttctgttggttttcttccccctgggttcttattgtacataaagatctctttcttataagttagcatgcttacaattttttttggtttgattagctttaggcttgacggatggtttaacttttttaaaaaatcacattttaacactatatacatgtttgttaaataaagataacttattatgtctcttaaatgagattctttaaaatttttctgtagagttatatcacatgtgttaaaaatgtatgtactaaattaattactgaaaatgagcaaaaagtaattctgttaaaataagaaaataatgcatgcttacaaaaaggtctgagctaaaaaaaaatctttaaaaaaatctccataagtctttgaataacgtttgaattttcattggacttttgctgtttgtttattagctgagtcagtctacacaatactaaaatgccttacaatgacatgtatttaaaagtaagggtcatgagaaatatggtggaaaataataagtccaggggaaaatatatactaaagtctctgcagctattaaaattacccagccagaagtgatggcacacatgtataatcccagcagtttgggaggccaaggtgaagaggattgttcaagcccaggagttggagaccagcctgggaaacatagcaagatctcgtctttactattaaaaaaaaagaaaaagaaaaaaaaaagaaaatctgggcatggtggcacacacctgtattcccaactactcaggaggctgaggtgggaagatcacttgagccccggaggctgaggctgcagtgagccatgactgtgcactgaactcctgcctggttgacagcgtaagaccctgtctcaaaataaataaatattttaaaaattaccctatctacatggaccctgagtttcctaacaaccaaacacatacgtagggctctatacattttataaatactaactctggtattcttcataacagttccatgagggagatgctattttatcttcattttacagatgagaaaattaaggcacagggtgattaagcaatttggctaaggtcgcacagctggaaagagaaaagctatggttcagatccacacagttaggctccagagtctggtccttaatcattacaccaggctgagtttaggactgttgtgccatcctatagctgtagctagcagatttggtaaatctagctgtttttactacctgttttatctctcctgctagaatagcatcactaaggggccttgtattgttctttgaagttagtagacatgtatcaatcaatgtatgtttaaaataattttggaataaattgtaagcaactgatatgtggatataatagaatattaaaatgattctttttgtttcagtttcagctgagatgttaacatgataacataataagtcaaaaacacattactgtttccatcttacaaaatgaagcataaagttacttaagccagtcttgcaaaggagaacactgagaactgcttttagggtcctgaattaattacctacttctagtccatcaaaatgcagaaaaaggcaagaggagactgacaattagaagaggatttttggagacagttgagatgtgatgtgatttccacatactgcagggtggaagtctgcttttccctatctcaagtgcaggagaaagggacattagtggaacatctaagaaaatttgatatgtgtcttctgggacttggtgggtggcagcggtcaaggtagtgagcaaactagtatttgactataactgagaaatcttcaagggaagagactgtggcttgctgatgcccagtggccaagcaaagagatattgatgtaccaggagccacttgtgcattagggtttgttaggacaaaggacacttgtggaccctaggttagagtctgtgtagaattgtattgtatcctgtttagcagggttactaaagggattgggctgagtggtgaagaaaactgagaaaagaaaagaaaaaaaaaaaaagaacttggaattgcagtgatagatgaccagatggtgaggtgggaatcctaaatgaccatctgaaggaagtgcatttactacctcaatggaattgcaggtaaattctaataatggggttaaggtctgtaaagaaccaaatgcttccgaaaagtgcctccttaagaactttaagtataggctaagctcaactagatggctacaataatactagccaagtaaggtcatttctgccctttatgtcttctttcttctgcttcatccctggaggaataagagagggagaggaatagtgaaagccatggaaacaatcgtgctcctcccagtgcaagtgggggctccactgtggctgaagcagggataatgaagaggctttaactgacttctgctattacagaggagtaagctgattttactttttatgtctaaaagtgaacggatgacctttttactatccaagagggagcaaagcactgttgagactccctgtggacttccctggtggttagaaagaaatatttttacagaacaagtttaattcctgttacaccttgggaagtactttcaacacaacaagtacaggaagatatctgttactctagggttgcccattgttttagggtctcgtctattatagacctggttcttatccaggatacactggaaaaaattcttgcagtttcctacttattatgaaacttattatggaagtaggccataagagcctattttcatcagagtattaattattaagaaggtctagattcagtgaatagaagcattgcaatgttaaaggtgaaaaatgcactaaactctgaaataagtccctttaacttaaccttaaaactttctgcaatatgaaatgcaaaatgctcattttctaggtgcagaaatctccagatttcataggatttggtttttttgcaacacaataaaataaacaatttagaaacaatgagcatccgtgatgcttggagaacatccgactttttttttttttaattttatatatatatttttttattatactttaatttctagggtacatgtgcacaacgtgcaggtttgttacatatgtatacatgtgccatgttggtgtgctgcacccattaactcgtcattgacattaggtgtatctcctaacgctatccctcccccctccccccaccccacaacaggccccggtgtgtgatgttccccttcctgtgtccaagtgttctcatatcatttgacttttaaatgacgcccatctcttcttggagatgttcagttgttgcctcaacttcaaatgtctttgacatctcatggatttaaactctagagttagctagaatggaactgaaggctatcaaaataagggttcaaacaacaggcccgaccctaattcagacattatctacttcaccccaagttgcatcaggctttgaaaaacagtttaattataaatgatcgccaaagagttttccctgaaaacaataaatttaaaatacacataaagcacaaaatactaataacaagcatatttataagaccggtatttactatttaattcagaaactatagatattcttacaacacaaccatctcatgtttataggatagcaagtcatttaaattatataagcaataaaacgtgctaaactttcttgccaatgcgtaattacaatttaaaagaattcatttcaaactcttattctctgggattaaatatgattgtcttggcaaattctcatgaatattgcattagcaaaaccagaagtcatttcactggacatgtctttatctccctgtacatgtcttgatctccctgtactgtatattccttgaaatagataactggctcaaatcataatttcaaaaatctcttataagaatatcagtaacgaggcatttataatttaatgaagactttccatggattcattaaataaacagtgacaatggtaattattgatttttttacaaaagctcatttctgaataaagattatattattaaaccaagttaaagggaaacatcatgaaatatgacactgggaaggtccctgaaatttctagcaagtggcaccatagtttaatgcactgtctaattccatatgaaataacatatgcacttgtaagttttatgttttaactaagattaagatttaatggtgtaatcaatatcttgggtatacttcaagcaagatgtctgcatgttacagatgcatatataatatgtgcctatgaaatggataaagcagaatacacgtaagtaaagatttcggtctacatgtggcatacagacatgttacataagattttagtgcactgtttcccctcaccccattcttggattgttatatagaaatgtttggctcaactatgctcaggaacagagaccagtaacaaataaaaatgtctctctctgtgtctgtttactatactcctagagagaaggaccaaacattgtgagcaagtgtgcaactcaggagggcatgtagattagcagggagccctgtttacgttctgtaaacttctgtcatgcaccatagtacagtccagtactccagggccccactttggacagaactcaacaatgtctttaaatgctctctctatgcttgtactcatttcagaatacagaaagactcccatagtccaaatctacattgttgattgaaaccagagttgggtgaatggaatgttttgcttctccagagactaatcctcaccagggagcaaaggttttaaggcatgaaggggagtctggagcctatagtcacagttgttggactatgcaacactgcagacagtatcagagagccatctgttatctcacctaaaaacaaacacactcagataattgctaatttagcccaaacacttttttttttttttgagatggagtttcactcttattgcccaggctggagtgcaatggcacgatctcagctctctgcaacctttgcttcctttgttcaagtgattctcctgcctcagcctccgaagtagctgggattacaggtgcatgccaccacgcccagctaataatgtatttttggtagaggcagggtttttccatgttggtcaggctggtctcgaaatcctgacctcaggtgatctgcccaccttggcctctcagactgctgggattacacgtgtgagccactgcccccagccacccaaatacatttctaagtgaattacttagaggccctcttggctggtagagactctgtttaccaatttagatggcctataatggtaagaagtggttttaatctagttgttttaacctggcactgagatatacatgccatcctctaacccccaaaaagcaacaccaccacatcaaaaacaagaagttcctgctgccctgtctcctattttctccattaaatagcgtctgtttaaaattcattcaggtaactaataaaaagtatgtaatatgcacccagcattttcctactactgggaggagaataaaaacaggtaaagtctgttttctgctcctgggaaaactttcaatcaaattgggaaggtaaatcgtgcatgcaaatactcatacccacaaaagagttgagggagtggtggggaaaagcacaggtgcattgggggaagcatctgaaggatctctggaagcctcaaactgccatgggagcaaaccagcatttggacagctctaacactaccagcaggttctaatgcaactcccagggacatagaagttatgttctgtctaccttctatctctcctttcaggccccacataccagactactcactatgtgccaggtattgagctctatacaatgtatctcatctaaaactcccagcagacctgaaaggtaagtgccattgtctctatctccttggaaactttaatcttgctgaaatcacacagccaataattatgggtactgaaatatgaccaatttggtggggcattctaaaactgaataatgtcagttgtgtcagtgttccaggaaaatgtcttgaaactaaggcacccttagaggatgagtcaagaggagggttactacagggtgcatggttttgtttttggttttagttttttttttttttttttttttttttttttttttttttttttttttttttttggctagttacattttgtagcactacacaataaggaatcagaagtgggcaagatatgtgggcaataccacctcagaaacatctcatttaggagtaatacatttttaaaaaacagccttttcatttccccatcaaatcttcattaaggatagtgtatcttttctaatatgtctccatcctacaggatgctgtagctccttcaatgagactatattctggcagcgatattaacttcctggaggcttaaattcatctcttggtcctaagaatgtctaataaaattttctaagcctgtgccagtcctcctccacacactgccttaggtgttagtttttatatgcccatttcaacccctcaaacctattaaaaacaactttagggtaggaaaaaagcctggtgtattcctcattgtatccttcaccacacttcccagaatacctttctttacttttgcaaatttccaatattctttcacatcaattttcttttttttaattgagatataattcacatatcataacatttgcccttttaaagtatatggttcagtggttttagtatattcacaaggttgtgcaaccatcaccattatttaatttcagaacatttgcatcatgctccaattttcttttgatgagataatgcatacaaaattcttagcacatttaatggctacatagttcctgttagctattagcattattattattattgctacaattattgttgttattcatcactttgaaaaacaatgtttagcttcaccgtagtttgatggaagttaattaaaatattgcttcaattatatagacatttcggttttgctagaggatacatttttaatgattacaacttgtgaagcagggtatctattttgtaaatgggaaagctaaagctcagaaaggctgagacttggccaaagtcagagcatctatctatgacttggatcaagagaggatattctaaaatctacctgtgctcaactgtaagataagtggttctcccgttgattatgctgaggcagagcatgcttgattagacaacatccatgtcccctcccatctcaatattatggttctagggaaatcctaaatgtaaggcaaagcagttctcacggaaaaaatttagatattactagttgagttttttgaaacacattgaaggtgcctaagtttgaatttgagtctctcttagatttccttcaaaatttaaaaaaatagaaaaactctaagattttattgtgtttttaaatcagagattctccaatttaggaggagaaagaggactttgcattaggttgaagtatcagtaatctgtgaagccttttgtgaaccatgtatgtttcttcccaagaaagtataatctctgatggaagcgcttgccattattgggaagagcccctgccttgtcaggtatgtaggatttagtggtcgtaaagtgagaaaaaggatggacagatcttgagctccagtgataacatcaaaacacttcagtgcttctatttcctcattgtctctccttagatgaaattaaataaaaaatcaaaacaatgtcaagatgaatttagtccactaagtgactggctgctggatctttgaatggggtaataatcttgatatcggtattttaagatattctcaattttgtttcactaataaagccaatactggattattctttacacagtatttgagaagacattctcaaaccattatgaagttctccagtgtggccatgggtacagacatatcatcaagccttttcgtgatacttcccccttccaaatagcatacgtttgcagatatcacgatagctgtagaataaaataaagctaccttagcctcttgtgaatcagagtcatctcattgagataattaattctgtatctccatccactgagacaacaactactatgaagttgaaatagttgcctttaaatgtgtccttatgtgtaaagaatgtcttttattatttttctccctgaataatcaatgagcagaaatcaaatagaacaagaaagaggcattgacttggtggcctatggaaccttcttaatttttcacaggtaatactttccatttggatagttagcctagtggtctggcatcataacaaatactttaggttgctgtatgaaaatctcagcgtcacactgaattaagttaagccttttccaaagtgtaatgagctgatcagatgtgtattacttgtttttgttcatttttttatatttaaaaattattgttgctttaaagacccttgttggaatgttaaattactttttcttgtacagtcacattgtacagtaattcaggaaactatgggcaatacattgtgtttcaggtgctgattaaaaccacaatctttgtttattctgcatctgcctgaatccttgtctttggaccattgcactctttgatattacctccaccaggaactgaacaggaaaggggcattctatcaattctgctaattgttgacattttttatgtaaaaaggttttcctataaaagagctttgggattatttgtggatttcatttacttgttatatcccaggatcatcattttccaggagacctgactatataattacaatctaactctaatgttccaaatttccatagcacaaagcccaacatttttcagacaaatagacagaacatccttggattgtaattttagtcctctgcatggcaaatgtaaccttagtaactcggttataggtaaaacaaaatgaaccttcgtattttagaaaatccttaaaagacgtgaaaacatatcaagagattaatgtaattattttcagtgcttccattgatataagccataagctacatacagtaaactgggaatggaaagatcagtttggaaggagcactatttttttaaattctatttgtgaatcatgacttgcaacctaaaaacaagagtgaggaaatgttttcaagtgtgtttgatggactgacttcctaatgatgctatgttagttttcacaagcctcaagaagagccctaccttgaaatgcatcccaagagaaaagctgacagtgctaacttttttcttttcgttttctctttcttattgacttctagtccaggactagctgtccgacatccttaggaaaaaaatgtgtgtatatgggcatagaaatgcatttaccaatgaatattttctaaagaatcagcaaaactctgttatccctgaagtggtaagtaataattcctacagccatcaaaaataaatctatgttcatgtgtgtgattgtggcacaacagaggagaatatggaatctctaaggcagaaattcctaatgattataacttttttcatcttcacaaaacagtaatacctccacaaaaatgaagtaatgcagaaaaatatttatcaagtgccttttagctgcagtgaattttgtaaaacaccataccactcatcccatgactcaaaactgataaaatgtgtgttgctggttatatttatatacatttattttcctcaattgcatggttttctggcataaatgacactaaaattttggaactaccataacacatgaagttcagtattcaccaatatttatgtacttattcaaaaaccacagactttttactatactcctggcactctgttaagttctggataaatatggttaacaaaccagatggtgctgctgtcattatgaagcttaagtctcacattattcgttacacattaaaacttactgtagcatatacagcatgctaagtttcaagaaggcaaagagtaaggatagcatgagaggaactgaataatttaagcaaagtctccttgagaagctgaagatgagaagaaatcaataatgaacatttagcattttccaggcagagaaaacagcatgtgcacatagcccagggagggattgtacaaagacagatccttttatgaacaaatgcagacacagatataaatatgtggactctttatagctattaagatgtgcaaattatatgtgaacatgtacaggtattcaaaatatttgtataagatataaaactaggttatggaataatgcgtaacaaaagtaaaatatattatttgcacaaatagagcaattgaaaaatagatggtgaagcacatttaaaaaattttccaatcagagaacagaaaattgttgaatatatgtagaacctaacagtatgcaacctgacattcatctaattgtttattcctaagtgtcattcatcaatgtgcattatgaaatgcaatttataaaagacttcctgaatcaacagggactcacatctttttcaaaagtcacttacttctacaatgtcaaaaaagattcatcattctacgctcatatttctaaactaatgtaacatgtttagtttctttgtgtggtggaatgtcttgttaacttatttatccagagagcccttttatctcaagatgtagtaaagagttatccataaaatttctgccttaagatttatgtctgaaatcacttgactggtttttcaagtaccctccttaaattggtagaagaatgcaaagttttcacccttgaccctttcaccttcctgttcactcagaagagcagatgaacagggtttaatgcctgtgtcccaaaatgcagtcttccaggcagtcaaccaatcacttcaaatgagacgaaggattctctatccaattctacttccagaaaaattttaaataaatgaagttaaatgagcatttgccctgaaatttggccaggaatcgtgaagccaaaaacacgcgaagtgctcaaattcaagtaactcatggacgttttgaacttgagataaaagttcacttgtaacttctccagagcagtaaccactggaggctctttgaggtcatcccttcccattgtttgcctggaaaagcaagagaatattttgaagacagttgtggacgtttagctcagtaaagacagccgaaggaataaatacctggagcaatgtcaacttagcagccattgaccaaacaaacaaacaaacaaacacactttctctcttactgctccatcacactagcttttcatttccataaatgtctcatgttctgacccatctcaggcccattgctcttccttctgcctggttagctgtttccttgccttccccatcccaaaataattgataccctatattgtttggagataattttgagaacttaaggatagatttgggcattgaatctgctgaataagggatagtgtttgtgaaatatcatttcgtgaagcaaaaactcattagtggtcatctactggagtacaaaagacatctacttaaaagtctgggctgacaatagttgaaaagcaagagacatactgggaggccatttctcttctgattagcagaattatttggtggactctgactatttctgataaatctttaagtactaaatatcatagcaagaaatatactgttgtgatcttgcattccatttatacacttcccctgccaaacatgtccactgttttaaaataaacatgaacaaaacctaatagagaaggtaaaaatgcactgagagattaatcagaaacatcattctaaggccaagtggaaaccatatgtaacttattcagtgtttggtaataccagtgtcagagctctgaaatgagtgtggatattccagaagggcaggatttggcagcagatgcgtgatgatgataatgatgatgatagccatccttcttgccatgtgtcagacactccttctaagcactttacaggcaataatacgtatgaatatatatgattattttcatttaaatgatgaggaagctgagcctcaaaagcttgtcctaaatcacatggctaataagtatcagagctgtgatttttcaagcagtccaattccagattttgtgtgctaaactataccattgctcctctgaggaagtccaacatgcttacaagaggttgcagcttgtttagctgtggtattaataaggctctttgaaaaagagagacactaacatcctcattattgtatatatcaagtaaaacatcaagtacttttcagacctccactcctttaattctcacaataactcattttgccagcctaccaatctccatgttgaggatgtttaaaactcaaagcaaggaggtacttttctgaagtcacgcagctaaaacatcaatctagttacattcaatccaggtctatctggttccaaactaagagctttcaaccacatcatgctactccttctgcagagtcttcatgatcccctagaagtagtaggggccagatgagagtatcctagagctctagacgcttaccattttaggaggtttgtatactgataagttttccaagatgggggtggacagacgcagcaattcctctttcatgagcattaaattagtccagttgtttagaactgctagtaagtgaaatattaatctccattagggccagagcagactttgtcatacttcaagagccagaaatggaagtactatcttttaggtttaattgagattctggagtgtcagcctattttcagagtctgtaagagaggaacactcagagaaatagccagtgtctttcctctacccaaccccttcccacctagtttacatccagtttttctctagtatgttttttgtttatagccaacagatttatttaaatcatatttatcattgcttgctattttgaaagatgtgcctcaagcttccaatcaaatccaaaagaatacataatcatcaaaacaaggttagtcatggagttttctactaaataacatttgtgactgaaataggcaaggaaatgagagatttagttgtagtttcccaaaggtaataaacctaatatttaaaaagaaatagtaataacttaccagcagctcaggtgttccatgtgtcatgatcaataaccaagtaaatatagatctgaattttgtagccactttggttgtatcaaaaaagccactgcatggtactattacatacatagtttatatggtttagaagaaccatataaaccaccattaactattccttttatcataataataaaaataataggtggagttgctgatatataaaatatgaattgatccattagaagtaattttctattataatttttcaactttcttagtcaatttcagattatgattagaaatgttaatgttaatcttgtttctctaccatttaacccctctcttaaaaacataatgaccacttcttagacccttttctactctccttccatgtatatttcaagttttctacttataatttgtaattatttaaattgttttatttttatcttagttgtttgaaatcaacctctacattattaccatcttttctttctccccaagcttataagcattggtctagcatttaatgataacttttaatttgggatgattatatccaagatgctgccccagaatgagagttttatgaatgcttaatgcaaggaatcataaagcttataccagtgctgccctgaaaaattaaccaaagaaaaccccaaaactctttctccttaatcaaagaatatgctttgatgtgaacaaaagagagaagaatatttaatatcagctttggttgcactgcaattagcaattaacaagtaataacctatgattagttcacaaactccaacaaatacacttaatgacaggtgactaagagatgtgggaaacatttaagttagggccaagatgaacaaatgtgaacctagcacaatttggtttggtaacattaagcttttgataaactttcctagtcaaaattaaattattccatattactttgaagtaattataatacaattttctactttaatcagctgtctcaaactttgtgatcacaagttattttatgcaaaaaaaaccctaaaagaaattatgaaagatttttcaagaaagatttataaacttaatctttcaaagtatctcataaatgtaaatgcatgcttagcatttttaatggattatttactcatcatttagcttaaacatcataatgtttccaatctatgttacaagagctaagccatttcaatgctttttgaacaagttactctgttgacattggcacagaccaccaaaatgcactgattatggaagatatacggttaatgcatacagtatctgagcattgatagagcatcaaggcaaaagcaggcaatacttaagttctccaaataaatacacaaaaaagagagcttgatgaccacctaaaataacttttcaacatggaaaggtgagccttgcggcattccacatacagattagctgagcctttcaaaggtattgttgaatttatctatttctgagcatatcttacttttaacccaacttaattctttggaaggacatgcattacttctgatacattaaaaaaaaaaaaaaaaagacccttttcatgctcttgcttgctaaaactctactagaactttcaatgacaccatattgcctctcagactattcaactggaaattgtatcaggtaaactctcattcattattgcactacccatcttttaaatttttaaagagattattaggggctgtttaaaattattactattcttccacttcttactttttttaggtttactctcccatcacaattattgtcacatgctacattccagactacatatatatatatatatatattttttttttttacccaagtactacaatagaaatgtgatacatcaatggattgtaagaaaaaaaaactacccagctatgtacctggttatattcacacattgttacagagctgaaacggattaattaggcagttaataaaactattacaacaataattgcagaaattactaacgtaaaagtatcttggcctagatagtttatgtctcagttaataataatgttgatagtaatactaataagttctaattatcaatgaccatttgctatgttcccaatttagtcttttaaatatacctctgaacagtatttggctcataatggtcacaaaacaagtgtttgctaaatattgactaaattcttatattaactctgtgtgagacagatgccattattaccttcacttaataggtaaggaaactgagtcataaaaatgtcacttgctcacagtcactccactaacatttgaaggatcaggatttgaatccagatctgtctatctccaaagtaggtgttcttaaccactactgttttatgttgcctttggaaaaatatccaagaactagataattaccagtgatgaaatctgtttcagaatatagaaaagtataactcccctctaactccataaaattaaaacaaaattacaatccctcctaaatgtataaaattagaacttccttatacaaaagccaattaaatgtagcacacacacacaaatccattgaccaatgtatattttaatcataactcactataataaagatggctgctgcatatattgccatttaccatgagtcagtccttttgtggtgcttatataataaccgattttagctttacaactctgaggtaaccattattaagatcattttacagagaaaaagaagtggcacaaatttgcacagtcactgtgttaacctaaggactcaaacttggtccttttttacttcaaatgctacataaagccagataaagtgtatgtcaaaaactctgagatatttcaaaattgagaaatctattaacatgcatcattaggacaaatgagaaaaaagcaaaatactaagataaattctataaaggtatttgttaagttcactatgcatttttgagatatttttaaaaatcacttggtaaactagaacaatccgttgcatgataaaactatttctacctcaaaccaactgccaacatcatgcttaacactaaaagcgttcccaatgaagtaaaacagttttacattgtcaccaataggtcttagcgttggtttaaacatgtcaatcaatgcaatatgacaggaaataaaaataacagtttaaattattgatagagaagaaaacaaaaacacactacttgctgtaaaccgaaaccacactgttggatgcaaatatagccatttaaaataaaatgagagagctagccttcagaaaaccattctaaaaataagataaacataaatgcatacattctcataaggagtggcaaagatattgagcaaaatgttttggaataaagaattaaaatgtgagtttaatgaaactatataattttttggcaagtgtttctaaatatagactctgtgtgatggatacattaaaaattattatgttattttctttgtgttagaaaatgtccataatggaaagaatgaacaatggcagtctgcgaaacaagagtactgcaatttttgtctctaactatatttgtaatcttgaacaaattacataactcctctctcttgctttactttcctcatttagttcatctttttctagatcatcctttctggttctgtaattctattttattttcagttgccttctcaattttctatattgcaatatattttaattcataatggttcaatttgtgataatcactgctcagccacaaattgaaaatttagccaaaaaaaccccacagaaatggcattgctttgactttaaaatagcatactcttcctgtcttttttgagatctaaaattgtttatcagtttgcggggttctcttgggtttattgtactattagacactgacacgttttaaaggatccttaaaaaaaaaaagaaacaaatgaaaagaaaaagaaaacaaccaaatctggcttgttctgggatgctgagatgtcttgacagcaattactgcagtagagactggtgaataccctattttcacagctgatgttttccttcaaaattgcagctaccttcactttggttgaggccagggtactatatttagatagtataaatgtatccagagagcaatctttcacgtttatttgtagagtgggtttatttttatttattgatgtcacacaaaatgatgtttcctcggtttctgctgtatataacataccaaaaaataaagacggtctagaacacaaagtaagaatatattctgtgtgattatattgacaatggtttcgatttttatgcaattatactcccataatgttgaaattgttaacacaagtctatgtttactatgtaagaggaaactttattatgcataatgaagatggcatgggaataagggagtctcttatccttcctgtcaacctaaggccaatgtgtaatgcaagaaacaagtaggacacagggaaaagcaatagccataaccaagagaacatcagctatccctccctcctcacttagaaataaagaatgttggccgggcgcggtggctcaggcctgtaatcccagcactttgggaggctgaggtgggcagatcacgaggtcaggaaatcgagaccatcctgtctaacacggtgaaaccgcgtctctactaaaaatacaaaaaaaaatagccgggtgtcgtggcaggtgcctgtagtcccagctgctcgggaggctgaggcaagagaatggcgtgaagccgggaggcggagcttgcagtgagctgagatcgcgccaccgcactccagcctgggcgacagagtgagactctgtctcaaaaaaaaaaaaaaaaaaaaagaaagaaagaatgttgagaaagcaaagcattagtttatacaaccttcaaaataaaaaataatttcaagtcaaattctttttccaactttatatgtggggtgtgtgtgcgtatgtgcgtgcaaattaataagtcctagacaataaaaaattgatagcacataaatggaggggccaattctagcacttctttttgtcttttttctccattattggataatagtggttaccaaatagaattcaacaacagaactgattaaatattttccccctaggttttaatttagactacacaacatgtatttcagtacttcacattattagttataaaatttttctattgttcccctattgaaagtttaagagaatgcccataaactgagtttccttttagaaaaaaatcaaataatgtcaacatcctttgcatctcatttcttctctttcagacttatgacttaatcctcattagttataatactttattttcatcttttttatttgattatttaaaactttaaggtgcaaatgggttcattttggagacgataaacaggaaattttaagatttctcttggcccgttattttagattgtcccgtgatacactgggggcaactagcgaaagaaatgataatttgccaatgactcttaaaatactgaatagtaaaataacaaaattcttagaattgggaagtgatcttaggcccaaactctcatgtgataacagaagcccttctaaaaatatctctgacaaagggtcacttaagttcaacttgaaacatgccagtgatgttattagttctcaaagcagcctattcattattaaaatccttttgaattgaaagttactctcatgcggcatggtggtcactcccgtaatcccagcacttttggaggttgaggcgggcagatcacttgaggtcaggagtgagaccgcctggccaacacggtgaaaccccttctctactaaaaatacaaaaattagcagggcctggtggtatgcacctgtaattccagctactctggggactgaagcaggagaatagctatagcctgtgaggcagaggttgcagtgagccaagatcgccccactgaattccagcctgggtgacagagtgacactctgtctcaaaaaaaagaaaaaaaaaagttactctcatgggtctgcactatggatcattttagtgtaatctgcaccctcttgccaaatcacagccctttgaatatttaaaaacagttattaggccacattttccccacagtcagcccaggttttctgctggaaaaatcaccttccattctttaactatcaatccttaaagtttttataaccattcacctttcagctatctagtttgttaataagcttagatgctaatggaccttagcacaatacactaacttcaatgcaacgtgtaagatgggtaccaaaccgtaagatataaaatgggtactcaacagtgtaatatgtttcttaattagggcaccacttttccatcaaaattgtctgagtttttttttttcctttaatagctgcactcactagttgatgatctcagcttttagcaaactaaaattctcagacctttgcacattatgtattagctagatatctccctgtacttattcttgtggatttgaaaatgcaattataggactttaaccaccccctccagatctcccatctgtgttgcctttgcttaaacctttttcttcatccaaaatactcctacctctgctgtgcaaaacactttatcttgggcttaaactcccttgggtccttattacccctgctactgtatcactatgcttaatggagaagatgaaatttacataggaggcaaacaatccaggtttctctcttcatctgtcattacaccatcttactgaagctggtcccttcgttgttcagccttctccggtagacagagacaaatccgtgttacacaagtctgcttattccgactttagtcttgatgagtccacatttactggctcagtgcattctcgctctctctcactcaaattatttttggttttgcaggcatcctttgaaatacacttttaaaatattttgagttgtgaacttttagatggagataggattccatgagggtgcaagggctgtttcatggctttggtatgcagtgtaagactcagagtcaaatgtgtctgggggtgtgtcccaggcccatgtggggcaagccactgtttcctttactaaaatgcagcataaaattcatacctgcctcagaggtcaaggaagaattacataagattaaaaaaataaaatgtttaaaataatatctttatcaaattaagtactcaataaatataatctattaatatattaattatactattctagatataaaatgatcatcaaaagaaatcagaaaatgacaaactctttgctttttggaacacaagacatctggtgcctatgccatttctgttgccaacatttggaatgtgcctcccctctcattgctcattatctccaaatatccaaaccctaccttccctttgatgccaagtcaaaatgtgacctcttcttctgaagccctcattacccctagatttgattcctgctcagtgacgatcttgaaggtatggcatttttgcaacacatccttcaatccctatcatctggcataaacctggatcacagtaggtacttaataaatgtctgttatatgaatcaatgactacctttcccgcagccatcattaatttcttcctctcctgattttgtatatccttattgcacataaatatttaccatgcatcataattatttgtgcatgtgtctcttctgccttgcaggactataaagctttttgagcactccatgtcaaattgacctctggctaccttgcaattccttaatacatactagacactgaaaaatacttttgaatgaattaatatctgcttttctctattgctacagtattttttgtccatggaagttctgtaatctgtaccaggaaaataattaaccataactcacctttgtaggaaaaggattaaccataaactgcctttttctgagacatctgttccataatctaatgaccaacgctatttatacagttgatctatctacaaccccttcaactgtaaaaagcatatggaaaatgtatgttcaattctagaggaggaatattttggctatccttttgtgactccctttatctttgatgctcacgtataatccaccttaaaaggctgtgagtgaggcagaaggaggatcacatcacttagatgagatcttgcctgacaccactagatttgggccttcctatgaaactcccaagtttcagttattattatatcgaaatgacttctattgaacactaatcattcaatggtcagttaatttttattgagtatctctatgtacacaggagactatgtgggatgctatagaagatacaaaacaaactaagggtctgttccctgtttggaaggtaagatctatatatacaagtatatacacaccagtgaaaagtaatatacaaactgaaccctaaaattacagatgtaaaaaaatatataccacagactgggagaaactatttgcaaaagatatatctgataaagggctgtgatccagaatagttgtgagatccacacaaagaactcttgaaactcaacaaaaagaaaacaagatagatttaaaaatgggcaaaatatctgaaattaccaaaatgagatatacaaatggcaaatacatacatgaaagatacatagcatcatatatcattaaggaattgcaagttaaaactacagtgatacaccactataaacctagtagaatggccaaaacctgggacactgacaacaccaaaggctggtgagaatgtagagcaacaggaactcattcattgtcagtggaaatgcaaagcaatacagttactttggaagacattgtagtagtttcttactaaatcaaacatactcttactacatgattcagcaactgaactccttggtatttaaccagaagagctgagaatttatgtccacacaataatctgtacatggatgtttatagcagctttattcaaaattgccaaaacttataggcaaccaagatgtccttcagtaggtgaatgaataaataaactgtggtacatccaagcaatggaatatcattcagtgctaaaagaaatgggctatcaagccatgaaaaaacatggggaagtcttaaatgcatattattatactaagctaaagaaactaatctgagaagcctacacactgtatgatttcaactgtgtgacattctggaaaaggataaactatagagacataaaagaacacattggttgccaggatctagtggggagagagggatgaataggtagagtacagaggatttttagggcaatgaatgtactccgtgtgatattataatggttagtactagtcattatacatttgccaaaacccacagaatgaacaccaggagtaaaccctaacgtaaactatggactttgtgtgataatgatgcaccaatgtaggttcatcgattataacaaattaccactctagtgagggatgttgatggtggggagactgtgcatgtgtaggagcagagagtatttggaaaatctttgtaatttcgctcaattttttttttttgtgaacctaaaactactctaaagaataaaacttacaaaaaaacatatatatgttatgtgtatatatatatatatatatatatacacacacacacatatatataataatacatattttatataccaaagaaagctgattaaaactttgtttagaagtacagtaggaccacagaagaaacaaatttctgggggtactcaggagtttacccgagattacgtaataccaacaggaatcaatgtttcttcagcacaaactgattttggaatgatcgaaacaatgtatatgtactttctcatttaatatccacaacaaactaataaaggaaatactattattatctctattttgtaaatggcttgaaacttattatggtgaataacttcctcaaggtcacagaaccagtgaggggtataagtgagatacgaacccagtcctgtccaactgcacagctgaggttcaccaatatcctatacttccagtcttgggaaaagaaaaaaaataaaaattcagttggacaaaagcaacagaaagagaagtccaggtgggagaagtctgattaacttctggaaactttgcaatctatgacagttttatgattcacttatttttatttaatatttcttcaacactactagtctatctccaatgtgaacagaggcaacagtctttctgttacataagaatcatgtacatatgtatgtttatattcaatttataagcagtctgtctttttaagaagacttattaaggagaagtaatttttcataggatcagtcttggggctaagcaattatatttgctatctttttaatactagtagtcatatttcttccctaattgattattgaacctttctaaatatgtctgaagacatagattgaaattatcctaaggctcgacctctttttttaattgtgactaacaaattttaatacaaggcaaacagcaaaacatggcaggctgaaggagtaatttcttgcacctatagccggagtttttttaaagagctacgcaatttttgttgatcttccactggcttatctacagcaattgaagtttatcagaaagatttatgacatggtattgcaggccctaataaatgactttgggaagctgggaaaactcactaaagttaaagttattatctgaacctcatagggctaattagagatacaacctgaagtgttgagtcagcagtaagaaacacaacacgttatcaattaaagcctccatctaggcttggagaagaggtggggaaaagaaaagatttgcaatgaaaatgaatcatatgtttaaacaccagagccaaaaattagtcctcaaaagcatttcctgaactctctggaaatgtcgatggggtcagctctctgcttaaaaagggacccttccaaggcattctcaaagtaagttaccaaagttgctttgcatatgtataacaggaagatctgaacatatacagatgtgggggttccagaaagcaagaaaaaactctacctcttccccacatctcttcttctgaggaataggcaaaatcttccttccccaacacagctctgtgacactgtcaatttaaaacattttcatgcaaatcaagttaacatttaaaaaacaaacaaacaaaacttgcactatgaatgacgtaaccccttctcaaatactggactttaactactgccattgaaaacagggtggtttttcttaagcatttctgacttgatgctgctgttttcctgagatgcgaccaactaaaaatgacttaaaaatccctgcaccttcctggtattaatggaaagaggtagtggggtgttacagggagctaacttttttcatggttttcttaactgagttacaaaaataacagaaaattgcctctgtgcacatgtgtttaatgtgtctatgcatgaaaagccttggggataaagggagaagtagatattttcagaatgtttgattatgattgtttgtatcagaatctgtttagacaagaaaatcagaactgaaagtagacatatgttaaaacattttcagcccatatccttctgctttcatgttgaaaattgagggccataaaataataaacatgtattagatttattgagttcctttaagtcggcaagatccccagagtgttgtgcaaaataacagcaacttttgaattacaaaattattacatgttcccatgaagattatttaacccagagatgaataaggagaatgggtaataaagagacctgagagggattttccacacccttctcctcaatccataatttaaatacagtcataaactgtgagtaagcaatataagcatttgtgtgcagcatatatttgagcctgaaaggtagaaggcagtgtttaaaaatatgtttttaataaagcctataatacagaatagacaaacaccaaggtaaagatggattagaagaacaagtattaaatgaatacaccttctagcaaaaatcatttcttgttatgtgcctcaaaaaagaacaatcttctttagatagtattttaagcaactgactagtgtgtatgtctttacacagccatagaagagtttcaatgagtacttctcaccgattcagtgagccaaatcataaagcctcaggctgtcagaaaaaaaaaaaaacaaccaactgtaaattttgacaagaatgtgacaaaaatatataagatagattcactagcatttctagagtgaaaaattactagaattggcccacggcctctattgctgaaaaatttaatgtaattactttttttatgatattgtctagactctccagcattggcagaatttttgttctatgtctatgctggaaataaattaaataaagacctaggttttcttccttctattgtaagaactatgtcctcttcaagatgaatgtgattatggtttagcaaatgaatgtgaaggtaaaggtgtttaggagaaaatacaaaagtaagatcttaacgttgtacttaacagaatgtgtccgttagtaagaatactaaaaagcaggattgtaaggaagaaattctccaatgtaaaacagcttgcatgtcttctgggaatcttgtaaaaatatagaatctgattcagtagatctggagtgggcctaagagtctgcattcctcacaagctcccaggtgatgctgatgccgccagtctgcaggttaacaccttaagtagcaaggttataatgtatggggaagattcgtggatagggtcagtcttttaaaaatctttaaataatttgaatgtaaattatatgaaatttctctgtctcctggtttcataagtgttttcttttttttttctttagacaaaattggaatagcagtttgactatgacattctaattggtgtgtgtttcagctagaggaagattataacaaaagagtatttctccaaaataaagttttcctttattttgcttttgtaagtagctcaacaaaaaagagagtgtggctctgtgtttgattttacttcctttaaattcaaaagcaggcactaaaaatacctttgaaaactatagtaatgaactactgtggtactaggctcaagaaatctggggcgttcctatggacttagtggcaattgaagcagtcagattttcagatttagctgccatcagctgtggattggacagtgacatagtctaggacagatgtcaattttagccttcttctaacataagtctggaatacattttaattcaccagcaggaaggattttgttgcatgtaagttagagtttaaagccaggtttatttttgtttgggaaaaattctgtgcatctcaaaaggcacaatacctgtgtgttaacctgtctttttttttttttcggttggtattacagaattgctgataaagctttacatttacattggccagtagactagaacagattcctcacgtctctgtaagagctttgtgctgctcacttgatccaagttaaaatctctccacatcttaagttgaaaattaacatacgggaatttaatcctgacatagccactgcatcaacttttgtctagtttacgctttgccagaatgtcttaccattatgtgtctttatcttttggaaggctaggtatattgaaaatcttttaaaaataattttaagaaaagaatgtaaacaatagaaatttattcactttcttatgggacacatttcctgccaaatgctccccacaaagtaaacaccttagggtcttttttatttggaaaatgtaaggagatacgtaagtgtggatatagattcttctaaaatgtcctaaaagaaataaaattgcaagttttcctttgtctttcatcagagctttctttgtcatgtctaaagccccgcggcagggattagggagatgcaaaaccttactgtaaacagggaagggttgaaagaaaaggttcattaaaaaagaaaaaaaaaaaaactatcatttgaatgtaatatgtgaaaaatgtttcttccaggttgagtgaaaaatatactaaaaaagtgtaatcctagcttaagagattttgttttaaaatcctaattctgctaacaaggcaaaaggaacttaagatacggatgtatataaagcctcccggttcacccatcagtctttgaaactgccacacctaaactatctgttttagtgccattctcctatatttactccagtcatttttatatttcagttttgctcttaattttttttcccaacagtattcaagaagaaggataccaaaaaaagcattcccataagtattgtaaaaagtctctctcatgggtttgtttttagaaaaatgttaagccatgtttttggttcagtggaagaaggagcctgtgatagttttaacacgtgtacccaattagttgttctggacttcagcaaatgttctgcttggagcagctgttaacagattcttgctctattgttaatcaaaaagccaataataaaaaggcaaattaaaaggcaatttaatattatacttgtaattattcactttgtttctcatataagtgcaatctcatttcaatgcaatgctttcaaagaaaacatatataaggtagaggaaaatatcaatataaaattaaaattttaaaaaatggtactatatacacctttataaaatatgactagggaactccaaaaaaatgttcaaggactaagttccaaatacatacgtatgcacacacaccaacatgcacacatgcacacacacataaatgaatgcatatattctcaggcaaaaagtagaccttaggcccagaaacaagatatttgcaaagtattgatcagaatactatttatagtttatttttagggataaacacattaatgtaacttcatcttcaaaactttttaaaaataattacttttcaaaataggcaatgtgctatgcaatggagacgcatctatctacaacaggaaatgaaagtacaaacatccattcccacagtcttagattgttgtttaaatatagatatatatttcattaaagtataaaaattaagtcattgacctttactgatttgataatagtacttagtctctatttattaaatattgtcatctttctggaatttactataatacataccggttaagttattaaaatttaatcttttcacatattattaaacaaaacctctcacttattctgtccttactgtggcaacaactgatgccacaaaagttatatttccactaaagcattttaagggaattttgagtaagttacttactgatcatttgatgagatctgttgactaaatgtggctttaattgctgatacttgaacttagagtgcgatactaacaggatttattattcactaagcacttacaatatgccagacaatgttttaagcactttagttatctcgtctgtttttttgtttattttttgagaccgactcctactctgtcactgaggctggagtgcagtggcacgatgtcagctgactgcaacctctgcctccgggttcaagcgattctcctgcctcagcctcccaagtagctgggattagaggtgtgccaccaaacctagctaattttttgtatttttagtggagaccgggtttcgccatgttggccaggctggtctcgaactcctgaccttaagatccgcctgcctcagcctcccaaagtgctgggattataggcatgagccactgcccactgcgcccagccttatttcacctcatttaatccttacaattactttaaaaagtaggtagaataataaactccattttacatatgatgaaactaaggcacaaagaacaatgatcacacagctagtcagtggtagaactctgtaatctgtgggttccacatctgccagaggatgtatgtaagtgatgtgcaaacactactccattttatataagggacttaaatatcaacactatggattttgttgtgtgtctgtgtgcaggggaatgtttctggaaccaatccttggaggaacaactgtaccttatacactacattgaaggctcacaataaaagtctttcaaccaggagaacatagagtaagatacaaaactgtgggatatagactatgactcttttgattagtatggaagaaaacatcctagtattttgttattggaagaaaacatcctagtactttgttattaaggattagcgagattgaatcattgatgtacttacagcaaatctaaagtaaaccatacaaaatagaactttcctcaagatgactagaggtcaataaagctatgggttatttacagtgtaatatgaaacagcatacaaccgcaagggagaaggacatactaaataaacaaaacctgcaaaggcaattttcttcagagaatctcctcatgtacaaaaatatatttcaagagaaagtagtatagttactgcgttttcataaaaagtctgtttggtgataacatatgctgaatacaactaaaggcagttcttcaagtctaggcagacaagctgcagtacagcagatacacttgctgtttaaatatcccttcaaaaaaaaaattccatttgtttaccaaaatctattcacacttgttgaaaagcatctttcttcacttatctgaatgtgacaatgaatcaaaagtaccttctcttctgttaccagaggtgataagggagaaactgagatcctcaccagaggctgaaagatgtcttttcagtgctcttgaaagcaaaggctaatttttccaaacaaaaatttctccctaaggagctgtattaatgaggtccaaagtaatgcttaacccttgactactctaattaactcaagctgactggccagaagccctctttcctgtggcctatatgggagagatcacaaaagtgcatggtaaccctatccccacttgctgttttcacaaaacatggggctttgttctttgtttggcggttgtgaagacatttcagtctcatctgacatcacctcctcacatggaagaagtgtgcatagaaacacctagcagcaggctgcttgtctcagtgtgttccataacccttgctagcacaaagactcatttccagctcccagaggtagcatccattaacacatgttccttgagaaatctgacttttcttttcaaaaatgggaacgagtgtattcttgctatacttttttccaaatgctccaaatacacaataaattatcaagtaatcaggcctagttatgcgattcccagctttcaatacaggtatattagaggaattcatttattcactcatttgtctagcacatctattgaaaaccttctacatggtagatacaaggctaatttggtttcattgaatctttcctaagcaattaagcccagaaaaatttgtcttctctctgtttgctagagcgatagatactaaagtatctataatactcaatttattagtagtaaatttaaaatgtaattacatttatttcaacttacatttaccaatgagtacctttgatatgccaggcacttttctaaatgccagggatacagtagtgaaacaaacagacaaaaacctctgccctcctgtagctttaattctacaatggaggaacagaaaataacttcaataagtgaatgaaatatataatgtgagagagaggtaaaagaagtgagcaggtggcactgaaagagtggacagagaaagcctcactagaaaggtgaacttgtaaagatgaaaggaggtaacgaaccatgttaatgtctgggaaaaaagcattcagggcaaggaaagactacatagaaaggcttggaggtgaaagcaaacatggtatttggttggagcaaatgggtcatgtggttggaggaaagtaaataagggttaaagtgtgtgaggggtgcagtcaatggtaaacttttggattttactctggggaagataggtactcattagaaggttttgaacagataattgacacagtctgatttagggttttaaaaagctcattctcagagtctttgggaataggttgaaaagcatctaaaacacaagttcagagaacaattagcagactattgaaatactatgaagtgattaaactttattgaattttaattataatcaagcacattatggtagaggcaatgagatttactgatagattggatgtgagatgcaggatgaaggaactgcaccttgaactcaagatgatttcaaggtttttggaaaaggcaacaggcagtatgaattgctatcccttcagatggatattgtggaaggagtaaattttgaaaggaatatcagattaattgttgacaaccaaaatttgtataaaatcaggtaataaaaaggggatgtgagtttagaatataaaagtaaaatgtggacgtatcacatacagatggtattaaaagccgtgagagagaatgggatatccaggggagtggctataaatagaaaaaggaagaggcccagacctgagctctcagggtattgaggaagaaccagagaaggagaccaaggagaaagaacaggaaaaacagaagaaaacccaggaaagtgtatagctctagaagtcaagtgaacaagtgttttgctgaggagggaatgatcaacgatataaaatgctgcttgtagtccatgaatatgaagactgagaattgacattgatggttactgttcaccttaataagaatattgaatacattatttacctaattaaattctagactcctggtagtcaggacttgtcttaagcagggaattgagactgagtcaaatttgaaagttattttatacttaagttgtctagaactctgaacatcatttttcatatcacatacgatatttcattatagattctagtgacttctcaagaaagcctactttttcccattgttaatacgtagaaccagaccaaaataatagaaccataaaatgttaaagtatccagtttggtgattattacaaatgcatacagttgtattcaccatagcagcaacatataaaatatttccatcacccccaaaacttccattgtgccctgctgtgctcagttcccttcctccaccccaacccctgacaatcattcatcagacttacctccctgcaattttgacttttctagaatgccttagaagtaaaatcatttaagaatttaacttttacactattatttaaaaataatttcatcagtaaatatataccaaccataacttaaatgtttaaaatatatcttttcttctcactaccacatctttagtcttaaaatggtcctcagagatcccagttcctcctgctgtgaccttagcttctagaagttctttagcccctttgagtttataaatacattgatttataattcatcatacatttattaataattatttcaaggaatagtcagaactcatttgcatatatatacaaacatagatatgtatgtaagtaatatgtatacaaacatatacatgtacgtacatgagtaacaacagaaaatgagttctgactactccttgaaatagtaaattattaatttattgttttggaactgtctctaatcctttatattctgaacactgagcacaataacagtaactgtaatggtcctataatcaattattgatatgtagaaaatgttgcagctacattacctatgaaatcacaatgttacttctcagtagtcctaaatttcagaagtagcatttgaatgtaaaaattggcacatttgaatacaatctatataatctttgtcgttgttgctgttgttgttgttttaattcagtctcttagtaacacagaaatgtatttccagagttttccctcttatgtgcctttaagcatataagattacacatctggctttgtaccaaaaacagggcccaacaggatatgaaatcctggggataacagcaacctagctatttctttttcaagaatttttttcaaactgagccagaaactgaaaagacagatgaaaatggcacaacccggtgacaagagagcaaagataaatcacgtttccttccataaaaacattaagatcttggctttaatattaatatttttggttacagttaagctttaaagttaatgaaattctcatttgtatgctgatcttgggacatgaataccaagttgtagatgggatagagattagcaataaagaaaattaaggaaaagaaaatgaaaaattcccatagagtttaacatgcatacacatatgcccacactcatatgtgggtaatatgagagaacctgcatattttttggaggttgcctttttgcaggagttgaaactattcatcattttgctgcactttcctgtggtataacctaactaagatttttgagcaaaagatagtttttgtttttggaaaattatgagtaacttatacgtgacctgtttactccattaggaaatatgctgttttattcaatggatcataggaacagaacgaagcagaacaatagcaggaaagaaaaaattacagtcttagaaataaaaacgtatttcatccattttggcaccaggactgaattaaaatgctgccactaggcaggattttaaacatacacccttttcggcatacaattttaatacagaaattgagatattaggcatgcagcgcatattagaacattgctctttctgctgcaggtgtgtttgactgaccctgaataaatgtcaagaaaaacacctttcctatcttttttttctggctataattcaccttctcttaatatttaactattgctccatcattataacaggcactctgtttaagtcgtgggtacaggtaaaattcagcagataaaaaataatcatattggaacatactaaatgtaatggagatttttggttgagaaaaataattggtactgctaatataactgatatagtcatcatatttcctatggatttacaaaaaaaaatttaaaaaagcaagtaagatataatagaagcaaaaataggaggtgaataattttctgtctttggaatcagtgtactttattattacacattcattctaagcctacgtcagaaaatacttgaagcaaataaatagagaacagttttcttttcttttttcgtcccttttcttcaagagaacatctcattaacattaacagaaactgtgcccagaaaaagccattaacattaatggaaactatgcatagaaaaacccctagattagtttttggtcttttaaggagcttatgcattgctgcctgtcccaaaaagacaggatgggaagatagtaatcacatttttgccccatctttttaaattatatatttcattaaattatatttaataaatcctgagttggaaacagcacaaggaaactcaagctgcaataatatttactctcccaataaacctggagctttcacaaaccatgtgtcttactgagagtcactgaacaagttatacgaccatgattctcatgaacatcctctttgtgcttgcaattaggctgcctgccaggagttgaaatgattagcagtaaatataaatttaatagctttgctttgcagttccccagtcactcttggtgcctccattcactagggagataatgtgaatcagaccctatcaactaaacatacgacaatagttgaatctgaattaaatatgagggaatcttaaaagggcaaggtaaaataaaaagaaaaattaaaatatgttctctatttaatagccactttacatttacaccaaaacactgcgctattttttataaatatcagccaaactcaaagtattagtacataaatcatatataatctaaaatttttaaaaacctgataaaaagaatgcttgaaaaagtataggttttcttttttttgtcacttgaaatagaattgtgaaaaatatttacatttcaaatatcattttgcttagctgttagagttccttagagttcggttttctgaaatttaccaatactttctcatcctctttcacatcatcatcagggctccacaggaaactgtcaataggtatcaatttaatgtgccttctttactaggtgccttactatatgtcttatcacttatctctcaatttaggagacacaaaactagaagacagcaatgaccaggaagtcttgtggctatgctgtagaatgatgatgacgtatataaaatatggaaagtctttatgctttgcttttgttctcatcagaaatagtccctaagtcttaaattgtgataaaatactccttcacattttctttcaggtacaataaaggtcagataaataagaagcaaaagaaaaagagtcagggaagagaagaacagttttcggcttagcctgatggcaaagggcttttaaacactcctcaaggaacattaagcaaaaatgagcctactgaaaacaactttccttgattttactccccagttactttcgttcttctctataacttcccttatcctttcatcatagatgtcttccttcatcactattcaatatttaaaacagctgaaagattggttactgggtaagaaaaaaagatacgatagctaccaggttgagcagagatatctttgagctctaccatgatagctgagatgtttgtcctgctcagcactgcctggcacatggtaggagctataggtgaaaagatatctctgagaagatatgagtttgttggtactagggcaaagcatggaggaaaaaagaaaaaagagatagagaaagaccatgagtcataatgacatctttcgtcccttcgaaccaacttttcttgagtccatagtattatatgctccgatgctttagccaattaagttaaatccatccttatgcattttaaagtattcgaactaaaataatatcatcaggaaacatgtgagtaaaagaagggccacctcattaccttttggcaataaaaggcagagtttaaattataaatatttacagaaatatatacaccaatggatttccaagaaaatgtgaatgatatgccacttaggaaaataaaacgatctcccagtataaaattaatctcactggaattgctgaatacacatctgatgctcaaaaagaatactccaagaaaatataaattgtttaaatataagtcttaataagcaggatgttaaaaactaaataaagtgacaggggatgcggtggctcaagcctgcaattccagctctttgggggagctgaggggggtggatcgcctgagatcaggagtttgagaccagcctggccaacatggcgaaaccacatctctattaaaactacaaaaattaaccgggcatggtggcgggcgcctgtaatcccagctactcagagggccaaggcaggagaatcacttgaacctgggaggtgcaggttgcagtgagccgagatcacaccactgcactccatcatgagcgacaagagtgagactccatctcaataaataaataaataaataaataaataaataaataaagttatgatgaataacaaatcaaacggaagcaaactgatcctcaaggtggtaaaactcaagaaaaaccctatgattttgctgatctcttagctgatgccacagaaagccaaacacaaacaaacaagagaaattatcctatctgaatacatcagttttatgatatttatgtaactactaaagcatttttttttaagtataactgatgcaaaactggaggaacgcaaagtcagctttctttgatcaaagctcctataacttctgattaaaataataattggatatagttcggactactccacatacattctttcactgaaattggacataatttagtgaagcaagatgctgagaagtctactgccttggcagatttccactgaaatatgtttaaaagcatagtttttctccacatggaaaataaattgtagaaaattaaatgtgagtttatataggattactttttttaataaaataattatcagatatccaaaaagggaagagaattagcaagttaaagaaattttattttgcttgaacaacaactaagtttcataaaccatgctccatgtgtcctaatataaaaacaaaactattaattttaatgtacagggctatgaaatggaatttggaaattatgttgctagaccaatttggttcctttaaaaaaggcaatctttatagatgcccagcaaaaagaaaggagggcctatttagagccatgttagaatcatgtactgtccaggtattaagaaagccactttggccactccaaaaaacaacaataaaattatttactttaaggcaaggcagaaagtctccacattaaatttttgaatttttacttgaattgactccaaaacaaatcaaactgaattacagttgaaagttaagtgaagctaaatataatttatattttctatatcctattccaaaacaaatattttctatgtaatactccaaactataaacgccagacactatgatcagcacatgttatctcattttttcttccataactaatatataagcaggttattattcccgttttacagataagaaaacctagagactgtaattaagttttcaaaggcctctcacagttttgtcgcttctttccactgatgtcctccctagtcttgttctgatgtgtgcaggagtaaagatttctatttttccatctggaggaatttcttagtggcacactccctttaatctgtgtagagagctcaaaatttccctcaattctcttgatccactccaaaataaggatgttctgaagatggtcacagacaaacaagcagggggcagcttttggtagaaggagcaataatgtccttcttaggcatcctcttctcagaaggaatcaacatgtagcccataaaaaacagaacccccatctccatggctgcttcccagagctcagagaaccaatccacctcctcaagtacaagagcagcaaaagaattggggttaaaatcttaactagaaattaaggaggtatcttctacttaagcagatttcaaaccgtgctccaaggaatgctgttacataatatattctatattctgcctctattggaaagaaaaacatgcaaacaaacaaacaacatcccaagtatccaaaaccaaaacaaagtactctgcatgtgagcaagtttggaaactctagattaaataaagttcagcttttatactgttttcattattaaccatttatatgttaatcagcattatgacctccgaaaaggctttaagttcatttatcatctgctgaagtagttcggaaatcctgcttcatatatcctccaggtgaagacttgaaaagagcagctgcagcccaaggcatttggttgaggattcagggacttggaaggccaattcttttccggatgtaacgactaataatatttaatatacaattttgaccaaaaatatttttgcatgaacatggcctaatgtattttacttaagtatatctttattggtaccatattaagaaaagcttattccttcttgaaaccatgtttaggcatcagttgagcacctctgaaactcattttaattttgcaggactctcagattattaggaagcaaatattcaatggggtcaacttagacaagatttccaaaaatgtgttcctcagcttgggttgaaagctgtaaacatgttcattattaatcttcaagagaataatatttatgcggcccttttccacttaattaatcattaacacctttgtcccagagcatcttaaaaggctagtgtttcaaggactatccatctgtttgaataccattgataaaaccttactgtttaagtttattcaattatcatgaataatgaattagagttttctttggtcagtttatctcttcaagatatcactaagctcagtcttgtaaaccctaacaaggtccagttttgaactagttacaatttaggaggtttaactgtcattaagatgcgaatgactcttccagaggacatggaccttgtcttgtacatctctgtgatctccaaagagctgtgcacagaattgacactaagttcaataaatgtttcttcaatatacgaagaaatgctctgttgccacttaaagtgcagagcagttttcatcttcaaagcactttattcacattaattcagctatttacattttgctgatgggtaaacggctggagaggctaaatgggctgttttaaaggctagagagagaaaatcctgcctgtcaggaataaaaatttgcaattactgattaccagtcatatgtccctggacttttgtaggaaaaaaacagagggacaaacaaaggccacctaggtagtggttatcctactgtcaggacaagtcaatagcaggtaaagaaacaagtacactagacggtccaacagctctattgaacaagtatgggggaaaaaaagttatttttgttgtggttttcagtgagtgtgtgcgtgtgtatgtgtgtgtgagcagtgttgatacacactgtgatgcagaattacctttttccatttgcaattctaaaacaacttccaggtgccatgtgctgtttacaaaggaattgaaatacatttgacctcaagcgtattttgctctggcaaagtgtgctaattgtatagatctaaaggcagcagcaacatcatcatttcaaaatagacattaagacaattaaaaaccccatgtaactctactgcaaagtaaagttctcatggagactgtgaggtgtgtacagatatgctgtgtcatacgtttctttatgcgatagtttatgtcccaaaactctttttttttttttttttaagatggagtcttgctctgtcgcccaggctggagtgcagtggcacaatcttggctcactgcaacctccgcctcctgtgttcacgccattctcctgcctcagccttccgagtatctgggactacaagggcccgccaccacacctggctaattttttatatttttagtagagacagggtttcatcgtgttagccaggatggtcttgatctcttgactttgtgatcttcccgcctcggcctcccaaagcgctgagattacaggcatgagccaccgcgaccggcccagctcttatctttttaaaatgacttttttgatgtgaattgggggaggacagagacaagacttcttggccatgtattgcttcagttctcagttgtgtttctctctattccttggaaaccttgactttcttccagtagcttcctggaaggaaaatttgaggaaacgtctaatgtacatagatactgtgtgtatagagaatagtccagttaggaaagtactctatgtaagttctgaaagtctggatttagggtcttttttttttttttttaccttgccatctacttctttccaccctgctaaaatcttagtaattaagtcataagagacatcttccttttatacccaaaaaaacacttgatgagatagaaaggagctgcgtaacattatacttcgtttgggtgtatcttaggaagagatcctgttcccttaggaagtgcaagggaggtggtgaggacataggcaatcaggaccaaaagtgtaggtgctattctaaaagcagtaatttagtagtcaggtgtcagatgaagacagcaaaaaatgcagttttgagtaactggagatggcaaatccccatgtagctggcttaggcttgaactggcaggtacctgacattcaatgcttgaagatgtagggaaagtggctgaggcagagtgctgggtaagggcaggactgagttggttggaaatgggcgtaagtacagcctccagtgtggaggttgctgacaactcagcaatctggtttcagaggaggtctgaagaaaacttaatgcaagatagtttgttagatcagaacaaccactgaaaattctccagaggaaataattgtgcttataacataggtggagtagatatgccacacccatttgacacccaaatcttcatcagcttggatagtaccagacagactcttctttaggtccacagggatttttttaatttctgacaatttctagattctaatccaaggtgacaactcaagaaaaaaattagtaaactagttgtgttctggaaaagaaaaataaattaaagccacagacaagggagaagaaaaacttctatgcttggccaggtaaaggcaagctttctctaggaagtacttatagtcacataaatactcaagaaatcatagacttctggagcaagaagggtcttggttatcatctggactaacagttgctattaacagattaaaaaactaaagccatgaggaattattttatgaaatcatacatctaactgacaaaatgaagactaggatacatttatttgcttgtgtctaatactcctcttcaatttggaaacctccagtgaagcagaacacctaataaaagttaattaggaacaggtactgctgagaccttctctaaaccccaggagcagatgcatctctttcactcgcctggttacctgaatgtaactaaacatgccatctgattgaacaaacaaacctattcttgtatttcctgggaagatgagcccctggatatgaaaatctcacacttttaaggcaaaggacttcaaagtagtccaagggtaagtcaatcagtaaaggaatataactatagacatgcactgtgtgatctggtgttaatctagaactatgacattttttgaaaagcaacaaaaagggtgttgaggtatagctgccaaaaccaattaaaagtaaccagaaaaaaaaaaaaaaaaaaagagaacactaagcaaacaggttttccctcaccatatttctaacagaaatgcatggccatcattaaggatattctgcagaacctattcaagaaagactgcacgtggtggataaccaaataaaatttccttgtacagtcaatgtcttggcatgcaatgggtcccgaggcataaatgcaaaccattaacaaagctttattaagaaagccttcaccatgctttgggaagatgtttgatacaattcaggttaagtgctgatcaataacctggaaatcaaaagaaccgatcacagaagcaaaaaaagcagatttaggcagattcccagccccatcccaaatgtgagatactgacaccaagcataagaaatcatcgctttttctctcccctccttcccccatcacacataccaatgccttttcctcttaagtcccctagctgcaaatatttcttagtgaagtctattttaccccttttacactcacaaactgagtcgcaggttgtacattttgtgataccatcattgatgaaattgatgaaagcctctaatggcattagaaaatcctgaaatagcacggctgatatatacctggcaggtaattgcttaaaactccagcagagatggatgtctaatctattcttaaaaatatgagcagacagatagcagttcacccctccactgcctctttcttgttctcccccaacaattctgctagttcatttgagtgtttcagacaagaaagcaagaatattatgcaccagaatataatgtggcctttcttgcacagcttctctttgcaatcccaaagctgccatttgcagcttcaagcaacagaaaagcatgcttactgttacttaagattaaattcttgataataagcagatttattgactcatgttttgaatacatatttattgaggcactctactagatgctgggcaaagtgataaccagaaatagccagccagaaacactttccacaagtcattaccagagatttaagccacagtaaaaaggtggaggagaatagacgaaaggttttagggggaaccccatactcaaactctccctcagaaaaacaattattaagtcttttcttacaaactgtagagtaaaagaagctgcccaatcgcggtggctcacgcctgtaatcccagcactttgggaggctgaggtaggtggatcacgaggtcaggagatccagaccatcctggctaacacagtgaaacccatctctactaaaaatacaaaaaattagccaggcatggtggcgggcgcctgtagacccagctactcaggaggctgaggcgggagactggcgtgaacctgggagtcagagcttgcagtgagctgagattgcaccattgcactccagcctgggcgacagagcaagactccatctcaaaaaacaaaaaacgaaaaacaaaacaaaacaaaacaaaaaaagaagctgcccaataatgtctgagcaaaatggaggccatgattattttggctgtagtgttttagactttcatgtaggagagaaggattcgctaattggttttcagtcaaataattctactgaggaaaaagaagtattcctgaaagaaaattgagacataacatggataatgtaaagcctatatttaatcttggtcaattccattgtctcattttcatgtagatgtcaaacataccagcaaggagaaaatggttcaaaaatgcaacccagggaattgccctacttttcctacttgcccagtcttcaatacaatagatctttattctgttctcattttctctaacaaaatctccttgttcggaagagtcaaaggaataaatggttggaaggttaatctcctaattactttctcccttcataaaataatttatttaattgtggaaattattatgcagctgtagagggagagcatattcattttttttcaggaagtagttgagcaagcctgacttacgccaagagaaaaaataaaaattcctgagaaaaataacaaattgttcaaaatgagctgggttaagtatccaaaccaaggaacaagttcatttaaatggttactcaggaaatcttgacggtgatctaaattcaaagttgcttttgtttttctaggaggcctggcttacagaaagaacatgataggttcctaggatatatcttaattttgtacttcatttaatattgttaaaataattttgtctctaatatcacagcttgtaatatctcaaacaacactgattactgattggtaatgcaccatactctaacagatatttaatctctatcctctccttccctagaaaaggtgtcatggaccccgggatgtattatacattgcttatagcattttgctgcaactttaaggcaaaaagaaaaaaaggtctctgtcctaatcaggcataacagccatgaaatcctatgtgcaaattgaatatcaaactaatactgtttttactaaccaaaatccattatctaaaagtttgaacaagtgaaaaataatttatttatttgttatggtcccaattaataagatgagaaacttaacagaataaacatatgactatccatttgtacacatctaggaatggaaaaatgacccactttaagtacaaaaaaatgagaataatctataaaaactaatgaatcagtccctttaactttgtttattggaattacaatatcaaagcatttctaatttgggttaagtaaaacatacaccaaagaatctatagacagtacttacaacactgtcagttgagtatttggctttgatatagctttgaaaggtaaaagacaaaccaagtagatttttttttacttggggaagaatgtgagaatgtgttaagtagctcagagtaatcattccataatgtgaacagataccaaaacatcacaatctaccccataaacatataatatataaaaatattatttgtcaattataaaaagcctatgttaattaaactcagctgaaccctgatatatacaaaccagtgatgcaaatggtgttcaccaagcgcatactcttagttggtgagcatctgtaaacatgctcgttctcagcctacagctactaccgtttggagatcacggtcagtaatgatgaccagtctagggaaagttcatggatagattaagtcactgggctagtatggatttgcactgaaattccaagcaaagcctctttcatttagtccaaatcttgttctacttgactgcaactagatttcccaatagggtctgtcaatcaaaattaaaaagaagaaatgtaataactttaatttctttctaaatctagagtcaggacaaaacttctaagtcattattaactggtactctaccaagaatatagctctcaattattcatttcagttcttaattattccctgtttcaaaaaatagcctgcctgccgctcataaaatcattagctggagagaaaagtgggttcaattttgattggaagtaaaagatatggtaggatgtttgtgaaataatgcttgaaaagtaatgttttaaaaagaaaaaaataaaaactttgttttgttgtacttcttgtttatagctttcatgtaaaacaaactatggttgtttcaagatggagcctcacgttcttagatttggtatgtacaaacaatttctcctttgacggaaaatgagacattttactttgccagttactttggtttacttgactggacttgtataattttaatgcaagctaagccaattgttttctaacaaaagctgtcataaaaaaatttatgcagccttggaaatgtaaacgtaaaaaagaaatgtaaaaaagtaaaacgtattcatcattttcctgcaaattgaagctaattacacttagaattacttgcccttccacatatttcatttacaacccatatgatcttctcagagtctcatacttaagttaataaattcagttggaatttttaaacacatttataagtatgtatatattggaaatagcaccacatgtaaggcatctctgaattttgatgagttgggggttaggtggggacattacacaattattctggtttctaagattaaaaaaacaatcttcctacaagaaaataatgcaaactgaagagagagagattctctaccactcttgaagaaaactttgggccttggggctgagaaggaaaagtaactcaatgagccatttgtaacacattaacactaattcttaaatgctatttgtggttaaaaagagatgaaatagacaaataacctggaaaaatctgtgacaatagaattcaaatgtaaattatcatgtctcactgccccgttagctatccaaaggcaaaactccattatttcattccccttctcacatctattacttattttcctttctcaattagttttaattaattgtttcttaaagtgtacttacacatttaacagtggttactgtgggctgtgccgccctctgattattagtcttgaagccatcttatgttattgttccattcctcacactcaaaaggtccccaaagaacaacctcctgaagttaggaccaatggtccctttagtttgtcataaaaccaaagtgatacatgtgtttaataacacagaatgtgtgccataaaaccctgatttgaatagttcttggaaatgtaggccaaagacgtcagatgaaacgtgccaagttgagaggtgcagataaaaggtaaaggtttattttgtaaatgtgtaatattttgatagtcaccagggaagaaataatgttactgcatgtggacgggcaaggtggctcatacctgtaatcccagcactttgggaggccaaggtgggcagatcacctgaggtcaggcatttgagactagcctaaccaacatggtgaaacgccatctctactaaaaatacaaaaattagccgggcgtggtggcgtgtgccagtaatcccagctacttgggaggccgagacaggagagttgcttgatcctgggaggcagaggttgcagtgatctgagattgtgccactgcactccagccaggcaacagagcgagacttggtatcaaaaaaaaaaaaaaaaaaaaaaggtactgcatgggccatcatgtgaacctgaactaatgttattccatcacgtaggatgatggcagtcacatcattaatctaaaatattcactagtttcttgcaaggacattaagtagacagattcaacaattacttttgctagataaagttagggcaaaagtatgacggacagctgaaaagttccattcttttcaatgtcccagcagataaattagtagcttaccagtaacatcaagcattttaaaaagagaggaaaaaacaaaacaaaacaaaacaaaacaccaccagtaatgatccagtttaataacctcatatatttggcttggggtaaatatcaagtggtgctgatcagtggaattacagatgtaattggaaatgttaaattttcttcttactcgactagtcacatagactattctatctatactaaggaaacatttataagattttttgcaaatcgacagaaaagagtcatcaaggaaaaaatatgataatttataattctgtttgttttaatgaggaataatatatgtgggagctgaaaatgttaaaatatatcaaatatttcaaatataacaaaatatttaatcaaagcaaaaattagttttttttaaagactgatacattctttcacctccatttcaatatatattaactctcctaaagcaaattagttaatacacagagcatttttaaatgaattataaggatagccattcaagaattgtttatcctggaaaaatatcagtcacaaattaaatgtaaaatagtgagcaaatggattaaaatatatacagcatgaaagattgctttgtctcttaggacttcacactttaaaatgattattattaacattgaaatgatttatatcagtgaaggcagacatacacctgacttcagggaccaatacaatagagagtatttttgaaaaatgtatattctctagacttgctgatttaaacctcagcttgtgaccaagaattttcatttttcagaacctgaccatgttactcttcttatcaccgaaatctgataaccactgcagtaccaacttcaggatgttcctagatacctttggatatgttaaaggaatcctaagatggttgagggcactccacatttatctaagcctttagaacaacaatcacaaagtccagtgactacagaggccagactttaaaaaggaatagggagaaataaagtattgccgacaggagagagccttccctgtttcaaggcagtagcaactattcacttccattcgatactctcctacagaaatgtagaccactttgttcgatattctgagcttttttctctctcttttttttttttaatagtagagatgttgatgtttatgtgaaacattctgattttcaaatgttggcaaccagtttcgaatattttcagtgtgcaaccaagcactatgcttgcaaataaaacacaggtatgggaaggctctgactgaaggacaattaatttacaatatctgattgtggtaaactatctgaaagatatagaatattatgttctgcatatatatgtgttcgtgtgtgtgtgtatatatatatataaaacaactacaaaaaattatattcatatgtatatacgtataattttcttctttctgtgtttacatatataaagcacagattgacaagctggcttattaatactaggtgtagatattttgaaagagataaacaaatagtattgaacgtatctaaacagacagccaaatcaacaagttgaatggcaacaagtaagacgtacactctatgacagtgactaaattaaccaagagttacagataagagagtgattagcatgcgataagaacattatagaggactacctagagaaggcaaggtttaaattgggccatgtgctgggaaacctggatatctatatgcagaagaattacattagatccctatctctcatcatatacaaaattcaactctaaaaacaataaagatttaaaggcaagacctgaaaatatgaaactactagaaaaaaacatagggaaaacactctaagacattggtctaggcaaagattttacggctaagtcctcagaaacacagggaacaaaaacaaaaagagataactgggactgtattaaactaaaagcttctgtataccaaaggaaaaaatcaatagaatgaagagacaacctgctgaatggaagaaaatatttgcaaactattcatccaagggactaatatccagaataaacaaggagctgaaacaattcaatagcaaaaagccaaataaacacgttaaagagtggacaaagaatctgaaaagacatttacttaaagaagacatacaaacagccaacaggtatatgaaaaagtgttcaatataactaatcatcagggaaatatgaaaatccaaacctccatcagatatccttacccccgttagaatgtctaccatctaaaagacaaaacagatgctggtgaggatgtggagaaaaggcaattcttacacattgttggtggggatgtaaattagtacagccattatggaaaacaatacgtagatttctcaaacactaaaaagagagctattacatgattcagcaatcccactactgggtatttatccaaaggaaaggaaatcagttcaaaggaatacctgtccccctatcaccatgtttgttgcagtaatattcacaatagcaaagacatggaatcaatcaaagtatccgtcaacaggtaaatggataaagaagtggtggtatatgtacacagtggaatactcttgggtcataaaaaagaatcaaaacctgtcttttgcagcaacatgaatgaaactgaagggcattatgttaggtgaaataagctaggcacagatagacaaatatcacatgttctcacacatatgtgggagctaaaaaagttgatcttatggaggtggagagtataatgatagataccagaggctgagaagggtgttcatgtgtagaaagggggtgaagagaggtaggacagggggtataaacatacagttagatggaagaaatatgttctaatgtttgatagcacagtagggtgactatagttaataaaattgcattttatatttcaaaatagctagaagagaggatttgaaacattcccaacacataaaaatgataaaagctcaaggtgatgaatatcataaatccccctgacttgatcgttacacattctatacatataacaaaatatcacatgtacccagtaaatatgtataaaaatgtatatcaattaaaaaaatcaaaccatgaaagctaattaagtttaaaaaatgatttcatataactttagtaagaaatactttaaaattccttaatgctaaaaaatttatcagaccagttaatatataaattttagttatataagcatttaaaaatttagaaatattaaaaactggaaataattaaaaatcaagataggttggacttaagaggtgtggcattaagggagatcagatacaacagactgagcaaaagcaagaaggtgagaataaagcgaaacccaggcatagaacctacaaagaatacagtaagaagtcaccagaaatgtcaagcagactgtttgccagtctgaactatcaccctatccccgtaacagaattccatgaaaaactaagaaaaaataatatgacaaaatatatgttttatttccttctttatgagcctgtttggttaacattttataccatgcaatgttaggttgagaactaaaccaagaaatatgaacacaggaatggaaaatagaaagaaggaaagaaggaaaggagaggaagagaaaggtagtaaggagggaaggaaggaatgaagaaagaaaaataaaagagaatgaggaaataaagaagaaaaatgtaatgcaccatgaaaaggagatacatatacaaatatgcaaagggacatgcagaaaagaaacattgaccaattaatctcattaatgggtacagctcgaaaactaatgtgcttaagtacagagggaacaatttaggataaataatatgaaagaactttatagttatgtaagaacactcaggcaatggatcatgctatcgagggaatttagagacactcttggctggaagacactaatttattatgcgctgatttaagtataattaaaatcaacctagatattaaacaagggaaacgatatgtaacttttagatatccatttattacctaaggacagagagagcagcaaatgtgcaaatgttctacagccagattaatcttcctttaaaaagctcccattcataatatcactcccttttgaaaatactttaattgactctacatgatccatccaaattcataagtggagtattcaatatccatagtctggctttaccctactgtttcaatcatgcctcccacttcttctagatgctggccatctacactcattaggttgatctactccccatactttagggtgcacaatgtttgcccagcgtaattgctcagtgattttttaatggatttactgattaagcttcaaaggcatttccaactccacagaatgtatgctaattctaacgttacccgtatagaatactaaaaaaaaattttaacattctccaaaactatggctatatttttctcctcttccattttcatccttaggatggttttccaaagtaaaacactggcctgtgaaagctactgaaataatcttggtttcttcagtaagaaataaattattcactatcatccccactccaatgcaatcatagcagaattatctttcaaattatagccacatggtttctgaagactaatgaagaggctcagcccaggagacagttttgggatccaaaaaatacctttcagtttctgctctttctaattcggacagtagcaatgaggccacactgattcaactggtaagcttccttcatatttttcattgttgttttttcccttagtttcaagccctacctgagccttgcccacgctaccaccactctgtctgaatttttgcacctttatttcatccaggttgatactcacagcccctgagttttcctgactgtctaagacaacagtctaaaagtgaaaccagaaagctaggggggagaaacagtgtcacacaaaaattctggcagatactgccacctacagggattataaggtcatccccaactcaatctcctaaaaaatcactcatttataatagagggggaaactgggcatatttgaactacacggataaagaagaagccaatttcatcaaatgataacctttgatttagtgtatggaataattatatatgtatatatgtatgtatgtatatgcatatgtaaatcaatcattaaacagggccaataaaaacagggctgtaagaaagaaaattaaaggagaaatatcaggttgtgccagtcgataatttctgttactagaaattattaaaaatcatattggacgagttgattacctatttttggttctatatgctcttgaaaagtttatgtaacactgtatacaacatgatagaatatttacctataaccaaggtgtctaggggttgacatttttatcctataatatttgaaacttaaaattatattttagttattcacaaataattcattaaaattcataaactaaatgataaactatatcattcctgaaataactaatataaatgtagctatttaaaatatgagatgctggctatttctgtgatgatttaatgccatgttaacaaatatagagaagaaaatagtataaaagcatatttttagtatttactgtttaaaaaacctttagatctatgatttttaaaaactgcatttgaaaataattacaaacatatagaaaaggtgcaaaaaaagcacaaaacatccctttacccaagttcacctattactaaaatttaacactaggatttttctcaatttatttaatttttttctctctctgtccacacaaatacacacacacacacagaaattgttttttttcctgaaccatttgatggtgaattacatacatcatggcgctttacctcttaaatattgtgtatttcctaataataatatcgtcttacataatcataatgttaccaaccaaataatctaatctaaaaagtagattatttgatctcatctacaatctatttccccatttcctgtcaattgatccagaaatatcttcacgctatctccccctccagaacaagacccagtctaggaaagctataatctttgaatctgcttttttaggggagaagaaggaagagattccttattttttagctgcgtaggctcttagctgtgtcaccattgcaaccaaatggcttgagtgtgacaactcccattcatctttttggtctaccttttcctttaatacatcttggagtcagaagatggataataaattattttggaattatagatgggtaatatttaatgcccaatataagaaggactgaagacttctaaggtttgagggcagatgattttttttgcatgcatttgacagctcaattgatttttacttcttcataagttacctaagtgctatggataggtgatatggtactactttaggtgttgataactgaattatgtcagtagtctagggatgacaaatagccagaaaaaaaaaattcattagtttccccaaattggtaaacagtttttgggaaattggaagaataatatgagtgtcatggagacactatcggctaaattgacaatcagtaagaattaggtaactgaaaacctagctctttaagtgtgtatgagaggagagaaggcgggttaaactggcagttataattaccatgattcattcaaaagtatgaactgcagtagttactatgcatttccaagtagattttcaaaactcctaaattggtgggagtctaaattcgttcaaccattgtggaagagagtgtggtgattcctcaaggatctagaactagaaataccatttgacccagcaatcccattactgggtatatacccaaaggattacaaatcatccttctataaagacacatgcacatggatgtttactgcagcactattcacaatagcaaagacttggaaccaatccaattgcccatcaatgatagactggataaagaaaatatggcacacatttgttagattatatagagtaatgctaaatatttaaatcagcaaatcatctgttccattatagttttttaaatgattattttgccactacccaaggatgctgtgaaaataaatgataagatattctatcaacaaacaatgaggctttcaattaaagctgattataacttacttttaatgtatattgctattatacttaggctaaaaaaccagtttacgttaacatagtttttatgttaggctaaacatcaatatacacaggccaagttttctttgaataatcttcttttgttaatgaatggtccaaatctttaccccacctaaaattcctttctttgtgttttttacccattgaaattctgtatcgtcatacttaggtcagtcttctgggaagtcttttctgaaggtttcaatttattcctcttaagaatttattttgcatttatgcattctaacactcattttcacattaccacttcatgttgtaaaattttcaagtaattttagaccctacataaataattccctaagaataattttgttaattttatcctattttgtttcccctgtaacactcagtacaaatgctctctgattggtgggtcctctataatagttggctatttcagatgaatggtaaaagacccctctcacatctgggatcatcaggaggtcagagtttcagcaagcattgcagttatgcaaatttctatttgttactattacaataattgctagcagctagaagaagctagagtaatgatgtattttttcaaataagtgccttagaagattcctaggaaaagctaattgcaaacacctaggagagaaggcatatgcattatctttatctgtatagccagagtcctactagttacagagtggcaaagaagcagcatccaaataacttgtcttaggtatttgtgaataactaaaaatttagataattgcatttgaaaataccatattttagtgcattctatatgtggggtccacctctgaacacttgcatccctagagttaaagagagctagaaaggacaaatggacaacagacagcgtctctgcagacgaggtgattctttgagatgttattaaaatgagtgctgttcaactacgtgattgactgtaatatgaagtcacgtgtggaaaaaacaaaactacaccctgcattataaacaccattctagtgataagacatcctctaacccacttgtaaaattaagaagataaaaaccacttagttagatttggcttaaccatagttaaaacaagtttctaacatgaagtaaaccttaaccacaggcttcttctttcagaaaagcaaatacaaaacagttatagctagaaatcccatggtgtcttttaaagtactgaaagttttcagactatattgctgaagcctgttgcatgtagcctatgcatgtagctgcttgtctcctgtaggaatcctagcttacaaagtctagatgtgaaataggtcctgggttgagtggggcatctataagttaaaaatattttcaactgtgtagagttctacaggttctccagtcttatgattgggagaatggtgcttgctgactgtcagatgcttctattctcacatccatcttaataatatattcacacaagcatatgctgttaaataaacaaaagcagtactgatgatgatctggtatctgtgagtgtgaaactaatttttttttaagttgtaagtcatttgcaacctagacacttacagagattattggggtaaaattgtggactctagaggcaacagctccaccatttattgattacatgactagcaagttacttaacctctgtttatgtcagtttcctcatttataaatccaaagctaatattagcttctacttcatgaagtctctataaggagtatgctttttactcaagcagagcacttgctacattgctcaaacaatattagcttgtcttaataccattacacaaatacatgaagggcaaaaaaaaacaaagtctaatttctccaataaacaaattgctcatgtcatcaatctaatcaccatttgattgagtttagttgtttttcttttcctgaacacaggtccattgctagacatgcacttgcttatccagagggccaatcagatttctgaaaaagttccaagttttggcatattcctctctttctctttgactgactgacccatgattcagaattgcaatcacaaagtgcccctgatgctactgttcacactgtcagaggatagaaacacacaaagtttaatcagattctcagtagcaatgtgatgtcaatcgggatgattaaataccagccattctaagcctgccttgcaattgttgtctgagaattcacctgagtcctaaggaatgtgataatcctaggtctgcagagtacactgacccagagaaagaccactgacaacatctacatctacctttcttttggtatgggggtgccagagagggttaaatttacagtgtgtataatcatctctgggttgaaagtctatttgccaggttcatattaacaatatgttttctctaagagcatagcataaagtagtgaaaatagaggtctttcagcaatgcatggcttttgcctacagcagcagagagggaaggtggaaagtcattgctatgaaagaggctatttgttgtttataaagcataatttttaaagataaattgctggaaacatcgatgccatgaacataagtagacattgttcactttatggaatccattttatatccatttgcgctgcctgcttatgaaaggaataaagggagaatttcagaaatggctaagcaaaaaagacaaagggtggccattttgttaaagttttaccatccaagaaagtgctggcaaagaagtggagatatatccacaccaaattgtcaccactactgataaataactcagagaactgatctatataggtgacaaatcaaaatggatatttgcatacaaagagaagcaaatgatatggaataccatatcatatcctcatgacctagtgtcaatgtgactatgatggaagccataagtgacaccctcagcaaaataattcgaattcattctagtgctcctgggctcccatagcaccttgtatatacctctttgataaaacttactatgttttactcttcctccttacccagctagcttttacactaaactgtgagctatttgggaatagagattttactttccttatctttatatatacatagatttatctcagtgccaagcacataataaacaccaaaaatgttgaatattgattggattctgtgctttcatctttggtgactagtttaattgaaaaaaaaagcagtagttctgactcaagagaagacttgagcccccagaaataggcttgttttcattattatctgtaagtattccagtatgttaaccatgccatttaactcactgcctgtatgtagccatatgcatatcagctgaactattgatgccaaatgaaagtgggattatataattcaaaccaccccttgggtttaaatttggtccaagacttgcactctttatatttcttattttttttccttctattagtgaatttctccattactcctggggaaatagataattctcctttaagtagattcaattactgtaaagaaatcacacttgatcactttgaggagatctaagctttgctcaaactacaattcaatgagctgacctagagttaatcaccttttactcattcatttatcaaagagacaagcacaacaatggatggattttggcatgcagtcttcatgcatgcaccacattaattaattcctattaaggaggttttaccagcacttgcaatgaacactaacacttataaagacagcacagtccacattcttgctgttctgtctacacttagacatcagaactagcaaaggatgtattgtctatttttttctacataaaataaagcttactactttgtgcaaaccacttacctactgataagtccacactctgctagtttcagtgttctcctaaagaagcaaaagtatattactgctaaatgttcctgtaaggactaatttccagtgaggtgtatctgtcattttgtacatctttacaatttctgaactgcagaaagataacaggttttgtagaataaagaagaatcatttaggaattaggtgttagatacctatctatatttttttgtttctactcagtatcacatttatcttctgcgatttataaaactatacctccttttacaggaacatgatgcttcccatatcacatccaaatggagcccatagggattgctatgttcttacatgaccatacacccctggccagagttggtagattgaggagtaggctcaaactgggccaaacacagtaccttacctccctgaacacatttgattggtccaggagtgggtacctcacttagcccactgcatctagagccaagtgtctattcccatctttatcctgggatatttggattttagatggtatcttcaaaaaactcagatttgtttcccacaggggctaaagatttatgcaataaaacttaagagttctcagaaactaagtttttcacctcaaggaaaagcctagtctgcagtgaaaccaaatgaagctgacaagctgagagaggcaaagaggaaaaccagattgatttctgacagtgcctgaatcccgagggctggacttcaccactcttctttcctcagctttgttatttaaggtttctttccattctgggagccaataaatctccccctttgcttaaatacttcaggctgcctttctgacagttacaaaccaaacaattctaatcatattcattaatagtgcacactaaaacacactgtcaaagacagttacatttcagactcttcaaaaaaaaatcaatgaaagtgacagaagtttaaaataggatatcagtatgcaccagtatagcattcttatttccccatgtttcttctctaatcaccctactagattttcatagagtgtttaatatgagggaaacaggggaggttaggcctcaggcttctagtttctaatgtatttatagggaaagaaacaattgtaaactagtaccaaaagctccaaagctttaaaacaagcaaataaaaaaaaatcaataaataatatgggatagaaacagaaagtagattagtggctgcctgggactgggtgtgggaactgagaatgactaaaaatgggtatgaggtttctttttgcctgatggatacattctaaagttggattgtggcaatggttgcaattacttagtaagtttactaaaaattagataactgtatactttaaaaattagtgagttttatggtatgaaaactatacttcaatgcagctgtaaaataggcaaataaagcaaacaaaaatagaaataaagagtatgagcaattctacagattttaagcagctagagaaaatgattaccaataataatctttaggaattaaaattaacaccaatagaagcagcatgctgtaaatgtaaatatagttcaatatttcatttttaattttttcttattgtggtataatatacataacataaaatatactgtcttaaccattttaagtatacagttcagtggtactaagtgcactcatattgttgtacaacggtcaccaccatgcatctcaataactctttctatctggcaaaactctattcccactaaacaataactacccatttcctctctctccagcctctggcaatcatcattctaccttctgtttctataattttcactactctaggtacattatataagtagaatcatacagtatttgtcttttcatgactagattattttacttatgacaatgttctcaaggttcatccatgaaccctgcatatgtcagaatttctttccttttaaaggctgaataatgttccattgtatgtatacagtagtccctccttaaccacagggaatatgttccaaggcccccagtgcacacctgaaataaggcatagtaacaaaccctacttacactatgtttcccgcagcttttatttatctgggaatatcttaatttctccttcactttcaaagaacagttttgccagatataggattcttggttcacagttttgttttgctttatttttttattttggcactttgaatatatcagcccattgccttctggccttcaaagtttctgaagagaaatcttagctaatcttattaaggatgacatgtatgaatgacttgcttctctctcactacttttaagatcctctctttgtcttttgacggtttgattctaatatgactcagtggtttccctttgaattcatcctactttacatgttttgaatttcttggagttttatatttatgttttcattgaacttgggaaattttcaggtattatttttttcaaataatctctgtccctttctccttctcttctccctctgagacttccaaaatgtgtgtgttcatttgtttgatggtgttctataggttccttaggcactatttacttttctccaatcattttttactttctgttcctcagactcagtaatttcaataggtaaaaatcttgacctatcttcaagctcagtagttcttcctcctgtctgctcagttctgtattttattccctctagtaaatttttcatgttagttattttatttttcagctctagaacttgtttgcaatttttaagattttctacgtctttgttgctatttccattttgttcattcatagtttttttcttaatttcttcctttattcttagagcatttttaagacaattgttttaaagtctttgtctagtaagtttgccatctggtttttctctggcacagtttctatttttttttcctttaaatgagtcatactttttcccaattctttatatgtaattttttttttgttgaaaaatggacatttgaatttaatgatatggcaactctggaaatcagattacctcccttcctaaggattgctgttttttggtttgacttttcatttttgttcttttgggttcttctgattgttgcaggctgtctttgagccagggatcagcctgagctataaatttgaggtcttctcaagtttattctgggctcatgcctttccctgagtatgcacaccgactttctaatttcctctgcatatgcagttgcttttgaatgtctaaatctttattttctggctccaaaaaaagaaagaagaaaagaaaagaagaaaaataaagtgtgtgtgggaaagttaccaggcctttaaatcctcctcttagctggagggaagaagggtttgcaacaatgaggagagggtgaaatgatgagtccccacctctgtatctgcacctacatggtcagagacagtagtcagaaatcaaaacacaggtctctggtatttgacactttgagtcttatttgtccatcatggcttctacaagctgcatgcaagcctaacacagtatggggagtagagaagatagatagttgctgctaaactaaaactgactaaaattaaccataatttatcatccaagtcttcccttagaagttatacacctttaatagactccagagattaaaaatagttacttcagacagattgtatcagtgcaattattgtctatataaaaagacagattcctggtgcttcctttttttagatcttcccagactcctctttgaagattattttttatcctaatctacatatagtttcttcagataaagatctgaataaaaaaaagactacgcattgagtacaatgtatactgctcgggtgatgagtgcaccaaaatctcagaaatcatcactaaatcattattaagaacttattcatgtaaccaaataccacctgctccctaaaaacctattaaaattaaacaaaaaaaacagtgtggaaaaaattaagaagcatgggaattgtaaataatcaaggatgtataatatctatgaattttataagatacaatgagataaatagaaaaccttagacagctttctatccggtaaaaacaaatggaattgaccatctattgttaaaaaaaggacagttctaaagatcagaggtcaactgtgagtgatgtgagaatataattagccacagaatattatagtacttcaataaagaaaggctcctatagttaaaaacatacaagtcagacaaaggaagaacaatacatctatgatccataaagaattaataaagcagaacaaaaaggtattctgcagatataatttgcctggatgttttgcaaaaacttttatgaagaatttttcaaaagaaagtcatggaaaataaagaccaaggaggattttgaatacaaattaaaatttcattgtttgagatcaaagagtatacctctaataagcattaagaaaaaaaagcatttaaatgtaagcattttaatgtattaaaattattaagatcactgttgcccaatagattatattaaacaaccttaacttaaaatgaaaaaattgaataaaagtataaaatcattcaaaattgtatctatagtggaatttcatcaaagctgtaaaataactctaattaccaaaattatatctattttttaaacctgttttcctatttaagttgattactccgtgaggtaatttttactgccccagtaatgcgattcaagttttttacatctttccacagattcttttattatggaaagaagacactaaaatactatccagttgaaaatgtaattcctttcttaatatatcccaggttatttttgttagtaagtgaagtattcagggaaaatatctctagcatccccaagtctatagagtagtgtgggtaatgaccaataaggaactattttggggtacattcatttattattttgcttggggccctcaggcatacatatacacttccctatccctaaaatacaaaatctgctacccaagaacaattaagaaaaaaaaaaagaagaaaggagggacgaattatgataatttaattacaatgctgacaaatgtatacatgaagttcaaaggttattctcatatgctccttctaagagtacaaattgttatataatttggtaagatccttctctagaataaaaaacaatacaagtttaaagctttaagattggatagtatttttgatcctgtttttttccaccctgacatttattttaataaatacatgatgcatatgtagaatattttatctaaaaagatgttagccacctttttccttataacagtgaaaaacggaaacctctgcctataagtaagagatgcataaaataagtatggtgtattcatataaactatatgcaactaataaaaatgatggccaaagttttcacagtagactgagcaaaaaactatgagacagtacacacatttctactgtttaaaaaaaagtagacatttgtaaatttgtacaaaaagtagaatgttcttaaaaaagtagaaatttatttgcatatttaagttgacaaatttgttaacttaaaaatctaagttaattcacatgcaaataaatacatctagaattatatatatatcaatatgtttttagcatttatctctggatggtgagattataaattattttactttgttctttgcttctctttgtattctataaagttcctacaataaatacatattacttttggaataaaaaaggaataaaggttatttctaaagttaaagtaaaaaaattaacagtcatataatgtaaaatgaatgtgaagataccctgaaaatacagagtaaagggatctctctctaggtagtaaaaccaagggctaagtctttttagaggccccattaaataagtaggatagcaagtaatacagtgtatgagaaagggcaaaggtctcagcactagcgtgcctgtgttttaggttaggttttaccatttagtggttaaagactttgggtaatcattgtttgacttttcttactttattttttgtccacctataaaaaattacgtaaatggttccttgccttttatcttacgggttacctcaatgttcaaacatgtgcatgaatgtggacacattttataactataaagcaataatgtaagtttattaaaaagttgttaaaataacattaaggagaaaagcagacaaccaaataatagcacaattcagtgaaaaaagaaaaaaataaaccaatacaatgtaaagtttcacacgccatgttttaatccttatctagttccttcattgaaaggaaattatatgagtatgtaagataactatcaaatcctacccttttcctaaaacatcccctttcaagtcagttgcaagtaaactcttaacaacaaccacagtactgctattggtttgaattacctgcaacatgtaaagcatatatgcgattcacaaaccactaaagtgctataagaaaatgtccttttggttgtctcttatgtaccacacaaatgctaaaagaacaataacaactaatattttcattgaaagtctattatgtccctggggctgtactaagtgctttgtatgtattatcttagttaaaccatttaaccatcttcttaagtaggtgttattaagtagccaattcaaagacacatagaggtacacaggtggggcaggcattaaagcctatgtgcttaatcactacataaaatgccttctgttttgcaatatgaatggatattgtggtgaataagatatgggctctgtctctaaggctactgacatttaacagtggaggtaagatatgcatgcattcccaaacaaaattcaagttgagatcatttggacttctctctaagagtagttggcattgtatctgcgtcttaactttaagcgttttcaccagtcattcaggcacagaaagttatatatgtaaagacagaatataaaaaagataagcataggcgtttataatatttacatatgaaattatgtatgcaatatacacattacatattattccaggaatacgtattttattcatgagccaacattatgctacttgagggcagaatgtgaccaattcttattacaagactttcacataatataggacttacacactcagaggcagatgctgaataaatgccctgagctgtgtttttaagaatatttgtttcaaggtacgaacatgacagatttggccatagggaaggtgaagcaggggaaaggctagtaagatagacgaaatgttgtccagcagcagaaatggaggcagtaagaatggagaggaagaaacaatgcaaataaagtccaccagcgttgggcagtctgtagtgagaaaagtttaaagatctcttttaaagtggcactctggatttccaaggaaaacactctattgtcaagtaaagtgaatgtgttgcttggtaggatgatcttctgaacacattgaatttgaggtattgaggggccatttcatgactgggattagagctggggatatggatttaggagtaatcccccgagagtggatagatgaaaccttgggagtagctagtaggggagagaaacaaggagggcaattataaaaaaaaagaaatgaagctgctggagaaagatccttcaggaatatttataagaagttgagtgtgtgtgtgtgtgtgtgtgtgtgtgtgtgtgtgtgtgtgtgtagggggagtcaaattagaggaaggaattaaagggtcacaagaatctatccattttccaccacatctgatccataatttctaaaagcttaaatagaatccacatcattgatagatttgtctttctataagtctgtggagcgttcatcagagcccacaggatgcaaaagtagtacaaaatgcccatcaaaatattctccagcttcaatccatttaacataatttaactaaggtaacataccttagttaagacaatcatcactatttgctgacattcatagacagtacattttcttacaagcatttacttcataaaacaccaagagaaattaaactatgttggaacagagtgatgtctaacacaactggaaaaggaaaaaaagggttctggacattgttatcccaatgttaatgtcctaatcttgatttttcttacaaagcaactggttttctttgaaatgtctaattgatgaatacaattaaaaactaaagttctttgtgaaggaaaaaaaacattatcttcagaaaccaggaagctgagtgttaagccattgctttgtttcaaatgcagctgtatcttgttgcatgatagcatttatggcatcaccagtggaatattgtttttaataagtgcaaaactggtgaagacattggtctcctttagaaagaaaaagttaataatttcttctccaccacatattggctaccctgtttattaaaagatagacatttttgacatttggaaagcaataattgattctacaatattattaggagtccatatagatagtgaacctttcctgtcaggatacgacaaaaaacgcgtaagatagggacatccaaggatcacctaccattcatcacacgcaaggtaactgctttcccctaagttcactcaagcagaaaatgaacagttgccaatgatgatcagagagatagaaaatgctgcttccaggaatgaaagtctctttgttgttgttgttgttgttgttgttttaaagttaaaccaatattctatatacttttgctgaaatagcaagagggccagatttgataagatcacagtcctggaactgatcagttgctccttgatgtgtttacagaattttacaatcatataaccaacagatgctcaaaagtagcctcaaaaccaacaaagacaaacattctgttttcaatctttggtgaattattttgaagtttcaaagcatattgctcagaatggaattttacaaagataatctttagatcttagttatttggaggattataaactataccaatttactgttctatcattggaagaactgcaagtattttttgctccccacaaaactaaatctcctctgaaaatagaaacctatttcaataattcaatttgtattgcaatcaatacaaattgattgggtgcaataaaaagtacagctaattcttagaaataagcatgcttatgtcattaaggctaaaactgctagcatgagaagctcaagtgaaataaataaagtgtattcttataataagcattgccaagccattggtagttgaagacactattcaaagatgcaaccttgtctttcattggtgttctctgtctgcatagaaagggctgtgaaaggagagatgcaaaagaggcaaagaaataggaaaaatgtcttgggagaaggaaggatgttccaatgatatggaataacaacaaaaaagttaacttgggacaagttattatttaataatactggagacaattccaaaaatattttgaatcacataattatgctgtggaagaaaaaaaaattattcaacgtccaagactttgtgtttgtgaaaaaactgtcctctttattttatagcccatatattctaaatgtttacaaagataaacaacattgtttttgtgaccattaaaatatgatatgtgaggaagtatgcagggcttgggacttgaagattctgcatcaaattcagaataaataacctgtgatttagctacaattcgggccaaaccttcatggctttttgacatcaagaactagtacatagtgagggatcaaaggatgcaaaattgagtgtaatcaaggatatatgattttttcttctatcaggtaaggtacaactgctagtattgatgaaatgacaacttaaaaaaaggctttctgggccagacgcagttgctaacgtctgtaatcccagcactttgggaggtcgaggtgggcagatcaccttaggtcaggagttcgaaaccagcctgaccaacatggtgaaaacccgtctctactaaaaatacaaaaattagctgggcatggtgatgcatgcctgtaatcccagctactcaggaggctgaggcaggaaaattgcttgaacccaggaggtggaagttgcagtgagctgagattgcgccattgcactccagtctgggcaacaagagcgaaatttcgtctccaaaaaaaaaaatggctttctgttacaaaaatgacaggtcagtaatctgttacagaaaaatttataataagaaaatgtgagtaggtaaacacacctaaatataccttaaagattgctcaaaaaaagactcaagtggattaaggacttcccaaagtattcttagtggtgcttgtcaaacactatccagaaagccctcggtcaggtttgtaatcttttcggtagtgttcatttgttgcaataaaataagtcagcagttttaacaaagaaaaaaattctataatgtttactgtttaatactaaacacaacagtgtgagattatttcctgggcttttaaaaattatacatatcttttttttagaaacctttacaaggaatagtagcatcctatgaaaagttggcttaatatttgattatatatggtgtgtatgattatctccataatttgagacattaggctattggtcagaaatgtgatctccactgtaacagcattttaggggaacaattatatttgatatttctgttttcaatttatagtgtctattctagaaatataatctgccataatctgtcaaaactgccaagactgtttgtagtacttcaatggtactttacagctaatatcaccaccacccaacacccatctgcataatgcatttaaccttacaaagaatacttttatctattatattacttcattttcaaaatggtcttataaaacaggtagagcagggattttaactgaatttccattatgaggaaaataaggtaacaacccattcctggcaaaatctggactagaattcaaatcatttggctccaaactaacacatgcttctccaaaaagcagcccagtatttccagcgacttaatttaatgaacagattcaagacatgggttaaaaatgttgaggatgtcaggctgactgtcactgagtatacttcttgggtaaggggcatccttactcctgttaagatgatcttactaacagctaaagcagactgggagaattttgacaggagaactactattcttttcagacacagatagttcccttttggtgaaacttgttgcaatgttccacaaagtgttaccgcatctggaaagtccataataattttgatttatctgcactgacagtcagcagtatgttatattcactgttgcataatattattatctgttgatcttcccagtagataatatattcctcaaaggaagaatcttgcttattttttaactctgtttagtgccagccatgttgaagttgctcagtaaaatttgtgggaggaatgaaggcaggaaggcaggcaggcaggaaggaaaggaaagaagggaggggatgacgaagttttggaattttcttttgcaaaacactctgctaattgaatttatgacacaaaagagttcagggacaacaacaagaaaaatgtttgaagtcattgtagcgaaagagtatctcaaaaacaagtaagagaatgacttaatccaaccacttgatatgaaaattaccagtaattagcctgtgttaaagagatcaacttttttacacaactcagcagcaaattggttaacttaaccaaagttatgcccaaattgctccttatccaaactgatttctatgttttggtttcatgaaactgatctatcattcaggacaataaactaaataagaactaggcgttttatatagtgttaaggaaaaaacatcattactggcactagtatcaaataatattgctttctttggcaagcaactcaaactaggaaaatgaatttattaaaactcttcatggaccttatatcaagtctgcaatctcctaaatgtaaaactctgcctataaacattgtcagggtaaaattttgccttaaaacagagtaattgcttctatttcctgtgatgtttacacagcaactccttcagaattactcttaaaaagaaatagaaaagaaaatcaatagcaacagtgcactatgaaataaactttgtggcagaaatggaaccagaagattaagataaaaccataaaagtatgaaataataaaaagggcaccaaattcactccataaaaaagactaaacatgatttcaaatgtatattacacacacacacaatggaatatagacattttgtatttcacaagaacatttttataaaaaataatttgcaaaaattaatccagtagcaattaatactattctgcctaacctcatggtattgacaaaccttaatcagatattatttgtaaaaatatactttacagcattattacaaatgtttcattttccaaataaattatctttgaaatatttttactttgtataaaatttttaaaattcaagaatcatatactctctcttgttaaaaatgtcaactactaattacacaacttactataactgcttttactatttgtatgcaacattcttcttcattatttgtgttctactttgcttgttttccaaagtctctggagatattcttgtaagacaaatttaaaacatttatcaatttttatcttaaatattaatttgagttgaaaattagacatgtttaccttaaatactgagcaaaaataatttcaactatatataacagttatagatctatcaatccaaaatgtatatatatatatatatatataaaacaatactaaatgtagtatcttaagtaattttgaaactaacatgaatttccaaatgcttctttagcctagcagacgtccaatgatacacggttgaaggtaactgcttcaatggcaatcaatcattaaccatcaaatccactcaagactagaatcaaactttcttctattaaattacccgcgcaaaacaactgagttttcccatccaaaccattggcctctgcaacttgtaagagtagagggaaaacagacagatctacttgataatcaatttaaaggttatcaaggctttctttacttttgctaacacagtttctattttgagccttcttggccaatgtgcttctgcctaagtgtcacaatctgttttaggtcttagctaagaaaatgtcttatatggtttttacagttaaggattgacaactgccttttgcttttgttggtaagcactcctctaaagttctcttgcctgatcaaacctcacaaaaatagaaattggtccttattctgaatgtttaaaagtccagtaagcatttactttttcttgacgtgtgttaacatatacacgttttgatctactcttgaagtaattaatttaggaaagtgaattaccaatactgtacaaacacatgatgccatatggattttcagggctgaaccaagttcataagcaagatggcaatgaggagacatctatactttatcttattgcaactaccactttgagctaagtacacagagcttgaaggagaaatcattacttgcttctttggaaaccaaatccatcctctcaaaccctatggttttcccttccctttgttaggccatactgatttacattgtatttcagtattgaaatttacatcagaccaatttcacattgtttagtaacttgtgatttatgtagtattaagattaattccattatgaccaatatcctgtcatatcatttaattacattgacatttattgtaattacatctaataaattagatacatttaaatacattccagctaagaatttaaacaaatgagagccacctggcacaatgagagaaactgtttcagtacagagacggcaaagacactctctgctccccaagttaaaatgatttagtttgacacaacctggaggaatttattctgtgatcacgatattttctcttttgcataagatacacaaagtttgagatggaatttggtggtaattagaaggcagagaagaccataagaaatatgggaggtcatgcttttctcttttcattaaaaagttatctaaaatgatagcataatccttgatagtcatttttaattggcaattattgagtacacacagtgcagccagaattgaactgaagtgtcacattgtcaaatgtgacttttcctgttgcatttgctttggcagcttgaacataactattaggaccaagaagaaataaatacttcacattctaaagaatatggggccagatcctctttccagagctatgatcaatagcaacccccaccgcctaatcctccttccctaacacactttctaatctacataaggtgatctgaggatcagaaaagagaaagagacaacgcattcttaatggagaatacagaggttgtgttctccgttctccgtcaaaacacccaatttaagtgcgattgaactccaaaataaataaagacagggacactggcatgtcacttccagggctctgtacttactgtcagtggagtgaagcaaagaacttttaactcaatttaatacatgatccctgtggcttgaggctatacatgaggagagagaggtgtctactcctcacctggaggtttctgaaagcaagagactctccaaacaatctatcctagggtgaaagaacctaaaaagccaaggagaaaagccctctctgatcctcacaaccccctgaggttgctgaagaagacctcaatgggtaactgacctcagtgggtaactgagcttcatgtggagaagtatgaagtagaaggtggaagaagaacgacaaggtggtctagataacagtcatattaacggatcctcatggaggagtgagggacattagctgcttatagaaagtacggtagcaggagcaacagcatgttgtgtttacacactttgacatcatatatttctggatgaagcctcagcactatttttttttctttttctttagacacagtctcactctgtcacccaggctggagtgcagtggcgcaatctcagctcaccgcaacctccgcctgccgagttcaagcgattctcttgcctcagcctcccgactaggtgggattataggtatgcaccaccacgtctggctaacttttgtatttttagtagaaacgaggtttcagcatgttggccaggctggtctccaactcctgacctcaggtgatacacccacctcagcctcccgaagtgctgggattacaggcgtgagccacccaccgcgcccagccagcactgtcaactcatttaaggtctctgagccttactttcctcctctgcaaaatgagaacaatgtgctctacctcacagggcttttatgatgaacaaatcggacaatacttttagaaatgatgtcaaatgattacactatgcaaacaatgatattattacttaacctatatattacattcaacttcactgcttgctcatattatcttactatattatatatattcttaggacagctggagtcttgtactactttatgtcttgtgtattctccaggtgtgctatatttagcataatctaagaatgatttgcaatgacccttatctttgtataattctcttccctttgagtgtgtgtgtaacctgtaaatatgacaatatatctcaccaatgatacaggctgagcaagccaaatctaaaaatttgaaatccaaaatgctccataatctgaaactttgcagccaatatgacactcaaaagaaatgctcattgaaacattttggattttggattttcagatttgggatgctcaacttggtaagtgcaatgcaaatatttcaaaatctgaagaaaatccaaaatctgaaacatttctggtcctaggcattttggataggagtactcaacgtatgtgtgtgtgtgtgtgtgtgtgtgtgtgtgtgtgtgtgtgtgtgtttgtgtgtgtgtgtgtgttcaagaatggaaaagccactaagaatgccctccagctgacaaccagcaagaaactgggacctcagtcctacagcctcacagaactgaatactggtaacattctgaagaagcttggaagcagtttcatcttcaaatcctcaagataaagagcccagtcaactggctccttaatattagccttcttgagaccctaagcagagaagcaagttgagctcccacagacatgtgatctacagaaatgtaagctaaaaaaatatatgtgttttttggctactaactttgtagtaatctattatttagtgattgaaaactgatacagatgctaaaacctatttattaaatgcatactatttattaaatgaaagccattgattgaatgttcatgaagcaattaatatataatatctgagaacatttcatgtgaggtcttgtctgaaaattcttctgaagaattttgaatccttattagaatctgaaaaaaaatctcagaggctaatcacaactaggattaattggaagacatgaataagcacccctggtgatgtttaaaacatttgttgagggtagagtggtagagtttagcaaaacctgtagtcaagtaggatggaggctcggcaccaatataatttggccaaaaacttccatggtttactcataggctgatggcatgtagattacatacaatgaaatgataatttttatgttaaggagagaattctcaaaatatttgtaaaaatgggcagtttgggatggctttatggaaaagtggggttcatgttaagtctcaacaccgagtactaatgactaaagtaaaagaacactgatgaggaactaaaagaaaactacagagataatcaaatctgctcccctgcctcaccccttatgcattataatatgtcatcattccctgccaaaaatagaattccttttattttagtatatctctagggaataagatcgaagaacactctcctaggaatttaattatccttcgttggaggaaatcctctcgctcaacatgaaggcaaaaagtaaaggccatttcatcttgtcctgcctcccccccgcctgttaattttaaaacacatgtttagatactagaatattttaagaaaacagctaccatactggcatctggtgctattggcaaccagtgcaaggataagctccagtgagaatttaaaaatgccttttcctaaggagaaactgttaaaaaaaaaaaacaacctgattatcaattgttccccaattcatgaggaaaaagaacaagtattatcaaagagctaatttataaatacctggatttacaactcttttccactaagtatttccaaaataattgttctcaaagttaactgtacactagagttaactagggacctttaacaaattttgatgcctagtttctatgcctttaaaaattctgaactaattggtctggagttcagtttgtttattgtgataatttcaagagctcccaggtaattctaatttatggcctctgagctatggtccaggattacatgcatagtagacttctgaagaaagacaaccatgagttcagtttatttctccactagaaggactggattttagagatctctgaagtaaaatatccatgcatatttgctctgaaataaaaatgttacagaacaatgcttttatttcaaggtttgcatttttccaaaggttttttttttcaattcctctgtttgcaatgcagcaatatcttgtttgaatgcaaattaaatcttcctcttaataagaaggatgtgtctctgcctcaggaccatgtacaaacagtctggtgatggcaggcagtgacccagggatgttcatgatggactgagagagacatggcaaacattacaagcatgcattgcaaatactggactgtggaaaattaatagttttaacccttaagccaacttcacctggcacagtagcatattttagcaataatttacctacattttacactaacttgggggaattacagacacaaagttggaaataaaccatactgaagatagcattatactttaccttggctgaaacttgggaagcaacacaatttggcctttatatttaaaaatcacggttcatttgacgtcacataaatgtagagagaagagtggaaatttgagtgagaaaagctattaggaagtatatttactagagaaggaatagaattaacagaacttagtttttttcatcttacattttcttttgttgataacgaatcaattggaacatttttgaggttgccagaatcttctgattctggagcctaaataaggttttttactggcaggttgaccgaataatagaaatttcatggccagaggccaaccaacactttataaaagccctctggaccaggtggttgacaagcccaggacttacatgaatgcaaccccagaagaaaaacttgcaagtgcctcttcaatagccatccaagactcttgcttgaaattcaaggcagctgatggtgatttcgtcttccatttacaacttctttattcttataaaaagaatgctgtatccttttctttcctccccaacaccaacagttcactcgttcaaaaactctaaggcattcagttaaaagtagatgaaaatattgtttgccagaaacatcttcaaacagaatatgagttttcacacacggaatgctcattagaagcagaagcaaacgtatcactgtaacataataatagctcatattgagcaagtactctgggctgtgtgcctaacatacaatagctcatttaattaaccataatgttgggtggaagctattattttcatttcacaaattaggaatctcagacacatagaacttaaatcacttgctgaaagccgtacagaaagcagtaaaagatccagtattcaaaagtaggtaatttggccaaaagtgtccactcttaattataccactctattgtagctattgtgtaaagtggcccatgagaacaagcaatgggtaccttgccccagtggaaaaagataaattcagggaagtttcttgggtaagtttatttctgcactaagtgaaaatgttaaataaaaaaatatatggatgaggtaggcagggcccagtggctcatgctagtaatcccagcactttgggaggccaaggagggcggattacgaggtcaggagttcgagaccagtctggccaacacagtgaaaccccatctctactaaaaatacgaaaattagctggtcatggtagtgggcacctgtaatcccagctactcgggaggctgaggaaggagaattgcttgaacccaggagcggaggttgcagtgagcggagaatgcgccactgcactccaggctgggcaacagagcaagcttccatctcaaaaaaaaaaaaaaaaagaaagaaagaaattatatggatgaggtagatggaggacgggggatggaattcctggcataggggatagcataactgaaatcaaaaaggttgaaacaaagcaaaacaaaaaaacaaacttacattgtgtgttgggcagtttggtacagtaaagagataatataaaaatcaaggagatggcactggagaggtgaactaggagaagatcatggcagtcttagtatcacaccaagaactttgactttgttctacaggtcagaaaatctcaaatatttctgatcatgacccacagaaaaaaatatattttacttggtgacaaatacttttttaagcatgtattttacttctatataataaaagtttatatatctttattatacatgttatttataatacgtcatattatagataatatcacacacacacacacacacacacatatgtacactcaaactggttgagcaccctaaatccaaaaatttgaagtttgaaatgctccaaaatccaaaattttttgaacaccagaatgatgctcaaggaaatactcattagaacattttgttttgttttgttttgttttgttttttttgagacagtctcactctattgcccagtctggagtgcagtggcacgatctcagctcactgcaacctccgcctcctggattcaagcaattctcctacctcagcatcctgagtagctgggactacaggtgtgcaccaccacatccagataattttttgcagttttactagagacagggtttcacgatgttgaccatgctggtctcatactcctgtcctcaagtgattcgcccaccttggcctcccaaaattctgggattacaggagtaagacacgatgcacagccatcattagagctgggctctaatcatcattcatattttatattttcatatttgggatgctcaaatagtgcaaatattccacaaacaaaaaaaccctgaaatctgaaacacttccggttcaagcattttggataagggacattgagtctctctctgtctgtcgtgtgtgtgtgtgtgtgtgtgtgtgtgtgtgtgtgtgtatgcatctgtatagttggcccttgaacaatgtgggggttggggtacccatacactctcagttgaaaatctgtgcataacttttggcacccccaaattttaacaaccagtagcctactgttgaccagaagccttactaataacaataagcagttgataacacatattttgtgtgttatatgtagtatatactgcattcttacaataaagtaagctagacaaaagaaaatgttatttagaaaatcataaagaaaatacattgacttcattaggtggaaattaatcatcataacagtttcatccttgtcaacttcacattcagtaggctgaggaagagaaggaagaggaggggctgatcttgctgtctcatgggtggcagaggcagaagaaactctatgtataagtggacctgtacagttcaatcctgtattgttcaagactcaagtgtgtgtgtgtgtgtgtttgtgtgtgtaagagagagcattttatatatatatatatttgcaattgaatgaaaattttcaagaaaattaatgaatcttactattcaaatattcatattttctattctatttcatatcagttctagactatttaggaaatgagtaggcctctcaattcatttttaggccccattaatgagctataatactgtttaaataacactgttatgggtgttggaaatatatgcgctatcatcaaaggattttgattacaggagacatagtttagagtgttacttcaactgggtcactctgatagcagtcattagctgtctgaagatgattttgagtcatttgccaagctcaggcaaaagagaaaaggggagacaaaatcaagtctacttagatgccacaaaaaataaattgaataacttagagtctccactaaaattataattctttattagaagaatgttaaagaaatgatccgaggaccactattcttgaatatccttaaaagtgcaatacaaagccagttagattagcagggttactgacatacccgcctgaaggaaaggaaacaaacaggcgaccactggtgccctccagctctagatttatttccctggtcactgactatctgaaaactaattttggttgcctgagaataaaaagtcaaaagtacatgagattgctctgaagaggagtctacagaaatgtattagaaacagatgaatagtcatgaccctctttactcaatccactcttacacaaatgtctatgcaactacagaagagaattcagtacctatttatcaataaaagaatatgagaatgtttctgcaggctcctaaaaaaaacctttcctatgaacagaagataatggggttattatagacaaggcaacagcgccttctgaaatattgcaaactaattaagaataattattaataacatttttggtggtattgtcttatgcttgactaatttgtaaatattctggtatatttgaactttcactattttagcctgtaccctattttttagcacagattttaattagaaaaatagaagtaataacaagggaaatcacatgttaactaatgaactgagcctaacaacaaaaaagacacagggaggcccttgaaggactctctagcttgatgttcttcttggaatctagggcagggcaaaagtcctaacatcactctatggacaacagagatgaaccacatgagccaggtgctagaactgtgatatttatctctgtttccctgtgtgtaccaccaccccacaactccaaaaaagaaaaaaattataaacacatccactaaaattggcaattctagagaaactggatggcctgttaacatctggctttcccaaaactcaatttttctgtaactcattcattttttagcctttgattctgaagaaattacttgcctcctggccagccacagaggctgacgcctgcaatcccagcactttatggggcaaggcaggtggataacctgaggtcaggagttcgagaccagcctaataaatatagtgaaaccccgtctctactaaaaatacaaaaattagccaggcgtggtagtgggcgcctgtagtcccagccacttgggaggctgagacaggagaattgcttgaacttgggaggtggaggttacagtgagctgagattgtgccactgcactccagcctgggcaacagagggagactccgtctcaaaaaaataaataaataaaaataaatgaaattacttgcctccttccaggcttgctatagataaataaacatatacgcgcaatctatatttctccattacactgcaatcatttccttgtcactagaattgtatcttgtagtccaagaggtaagtaatcggaactgtcaggacaaactcttgggactgtaaatgtgctatctggagcataactatcctaagaataaaatccaaaagcaaaaactcatcagaaaagatttgaaactcatttcagacaagatgcagactataaacaaataaatacacaatatgaaagcaacttaagtctcatgatggaaagattttgatccaactgattattattgttcctagttcaaaatattttaggccttatcaatggcaatgcataacaggaatgactaaggttagcttttcagtgaatcatcagagtagtgattaaactgatgacatacaagactcctaactggattttgaagattgagtacagtatccaaaactagcactggaacaagacaacaacgttcattcagcccacaagaaaaccagtttaaaactctgaaacaatgacaccatgagtatatttgtgataattatttgccatgccaattatattaaatcatgaggaggtagtacacatctacatgcataacgagcccatttttatgttagcatatctccaaggactttcctgctgtgtattttatactgctactgccttatattttatgttagcattaatgttttaattttcatatacatatccttaggccattttacgaagggcgtggctttaaaaattcagttgatatattaaattaatgttaaaaaaaggtcatgtaacaagtagtcctaaatcagttctttgtgttccctctgtacattcaaaccttctaatatggtttatttattatgggtaatacagaagtaagatctgggctctaaactctgaccatctgtcaggttaacatgcatatgcactaagtgtctttcttcagatgatggatcctaccacaagtcctccctaaaacaatatatcaatccccttccccacaaaaataaaaaaaattgatttatatcaaaataaatacataaaatagagcttctctctaaattggccttctgattagaatactacttcatcacctcagaaaacctgtcttaatattatacaggtagaataatttaccaaggtgtaaagaattttttaaaaaatacaaaaaagagacaaaatagtgtagtgattaggaataaaagttctagaacaagacgatctctatcagacccagttcggccattgactgtcttgtgagtctggtccagttatttcaccttttagagctttagttttctcaattcaaataagagtattcaccacaaggtttatttaaaaaaataaaagatccatgtaaagcatttgtatcaaattcaacatatttattaatattactattgttactaatacacagatgacttcaaaagctgctattaaaaaccaagtaaggatgtgggtggcatgctgtattttagattcagattcaacagccactatactagttacattcatatgacattcatatcacattaacgtcatagcacagcacagcaattaagaataagggtctgtctggttttaaaccttagttctatcacttattagctgtatttaattcagtaatcttcttaacagttctataaaacagataatagtattacataccttataatgttgttggaaggattaaataaattactatatgtcaagctcttagaaaaaaaaatttgctgttgtaattatggattttatttcagaacggaaaatgtccaaatatttaaaaagccagaagaacaacagaaccagtcttgtagtcactgaagtaatgataatttaaaaaatcataataataaccattaaaacagtaacatgctatacttagctcaagcgtagcatgctatcatttgcctacaatttcactatattacccacatgacctctcaacaagcctgtaatgtgggtaggctatagattattgccttcaaattatatttcatgaacttgaggttcagaaatcagtgacttgctaagccacataatagtaggtgttcgagccagtgctagcatctaagcatgggcctcatgatccaatgccctttccacttcactccttcacaatggccgaagaaccaaattcaaggcaaggccatccaacaggccatcctgataagaacccctcctgaaataagacaacacggtcacacaaatcaagtgcacatgctttctaactcaatggttataaagaagttataggtaacaactgatacatctgcacaaaccataaggccattaacacaaagatgcattttaaagctaaccagttccagcagattatattcatgtaaagagaatttggttttcctttccttctgacacttcattttccctttgtctcccaaatctgttaataactatttttaggcagatggagcatttcatgaatgggtcactcttaaaaatctcatttggtttccaatttttcttcaagcattaagacttactacttttagattttttggttattatacacaaaagaatatatgtggatagaatatacacacatttatgcaaatatatatatatatatagcatgcatatatatgcacatgcatgtctatctatacatatacatttacaacaaagaaaaactgcttaattttatgtataagagattcagagaactagaccaggtaacactcagaatatacacattattaaggagaaagcaaaaaataaaagagaaatcagtaaacacacaaatcttcccattgacaaggttccctttctgagcttcctttcactttacttctgattttcttctcatattatgtgcttcaggtaattctgcacattttcttctcctgaagagaagccatcaccagaagaaaaagccatgaggtctttttagagagaagaaattcacaaatactgttaggcagggaggcagtcaacaagcacttactgaatccctagccccctaagcactgtactaggtgcttagaactgagtccctcctgctattcagttagaaggatggaaaagctatgacttctagtattagcactgacctagttaagccatgaataaagaattaaaaggttttcatcttccaccatacaagttaagaaaacaaaaccagaaaccttgatatatgtttttcagcccaatgcattatggtttcacatatgtttcagctcttattgaaattttttagctcaatttcttttggtctagaaagttaaaaaatgtccaagtcaacaactcagtaagaaatttagaaagtttccaaacaactcagttttggaaactttttagttcagcatttcccaaactctttgctattgacattttaggctagaaaattctttcttggaaggagcaggggcctttcctgtgaattttagagtgtttaatggcatgcctggcctcgactcattagatgcctgttatcacctctccaaccgagtggtgacaaccaaaaatgtcttcagacattgtcaaatataccctgggagcaacataattcctgagtgaaaactatctaggccaaaacttcacctaacacataactctattagatggatagcatgaaaggatggcatataaaggtctggaaatagaatgacattaaacttaaaataatcagcctttttcctaaaggtatttttattcaccttgtacataacattgagaaaacatcacttgtccaatatcaaaaattggggaccttaaagcaatacacccctggtcttcccaaatcactgctctggcttgctttagtttgtaacattaaggctctgtttcctagaaagtccagagctaagacatacaggttgctttcagttcttcagaggcaaggaaactaagaaaggtggtaatcataagaacaccacacataaaaagaaagggaagagtaaaccgagtttctgttcttaaaagaaacagtgggaaaaaagagaagacatacattatcatttcaaagcaatttatcttaacaataattgggcaaaagacattgtttttagttgtgttcttgcagaagtaatgtcaaatttacttgaaagttagagttttagaaaattttagatgcagggagtacatgtgcttgttacatggatattacttgtgtaatagcggggattgggtttcttgtgcacccatcacccaaatgttgaacattatacccaataggtaatttttcaactctcattcccctcccaccatcctcccttttggagtttccagtgtctgtcatctccagaaaatcagataacttaaaaggtttcatgcacgttaaatagttaatagttgttttattacaccaaaggaaaaatgaaaaactgtttttcccaaaacagcataaatgtttattttctgtatgtttactttgctgtcccatttctataatatagaaaagtatattatttgaatagctaaatgtatttatcataaatatattacttttatataaatatagtaaatatatcttttactttgggatgtaaacagagctaaaatattatattctcaaaagccccaaaatagtccttaaaaatcattgaattaatgtggttatttaatcttgctcagcaatttgatgcaaacgcctaaatacaaaaagtggtttagtaggtactacaaaggaaggaagaaggaaggaaaagacttaatactctagaatgtttcctgaaaatcagaaaacaagtagcattcaattgtagctaaactaactaactaactctctctctctctctctctctctctctctctctctcctcctctccctccctccctccctctctgtcacacacaaaaacacacaccacaaccctgattaaatacctgttggaagaaaggaaggaagcatatgaggcagcatggaagagagaaagagagtgacaacctcaagagacatcattgacttgagttctagtcctatgatggatttcagaaagtggtcataatctctttaggcctcagtttctcatatgtaaaatttgagggtttactagaagatacatgtattctcttcaatttaaacagtccctgattcatagtgtgtttcagattagggtagtaggaggaagattctgagtttcagaatctaagaaaaattaaatgatctaagttacattctaaaatcgatatgagctgcaattctgagaacaacttggccagctagcccgaatatttttggcaatgccagcaacagattggctggatggcactgcacaagagaatctttttaacacagtctgctcaatctggtctatccaatgttctgcttgggataactttaaatttgggttgacttagaacttgtccttggtatctcactggctgttaagaggacagtccatgataaatgtcttcttcattaaaagtcaattcttgccaactttttcatgctactttttttctacaataccacatataatttgagacatactgcccacaaaacagaacctacagaaggttggaaacaatattctattctctctttcagagacatgtaacattaaacagggttcaaagggaatgcattagaagtttacagaggaatttggattacaaatggttcacaggaacagtaagtacttttttttggcttaccagctagaagtgggacataaggtaaacaagctatgagtagatttctatagaggtaaaacacctcatgttacatatcaccacacccctgctgtataatacataccataaagtattattacaagatttaaatatttacatcaaggtttgccaatgaaaagagctttgagaaccatgttagcttgtagctgccaaagacacaagtaacagcagtagttgaaatcaggcagtagtctggggaaaatggggaatccaagaacaaagccatgtatgaatttctccctgtcttccatttcaaagtgctctttgtaaagagaaatacctaacaatgcttgagaacagtttatatttataattgtaataaaaaagaaaatactgaagactgtatttttaggtgtcttagttcaaaggagcaaaacactttgtcatcctaatcagaaaagacatttaagataacaactggagaaaagtagctttagaaataagtaggaaacatgtcctaagatattttaataatgtcaagcagctatttgcacaaaaatatggagctgctccacatttcactacatcttccagggagacggtagtagatatgagtaggtaaacatccctaacctgtctagtcacatcagcatattagccacagagaaacaagatacataaattctgggaccacctaaagtgatttgttgatcagctctgtgcataattactgcttttgtttaattacttttaattacctgtttttcttttgtccttatgccctgaggtgagtttttcatcagtaatgggcatgattttatgaatatcacatgcaaacaagcaaattagacccactgaacttgggaaaccatttttccccatcccttctctaaaggttagctgctattttctgaaaatgatattgattctatggtaacatgcacaaaggcactaatcaggagaacaggagcttttgtgaattcagtaaagcttataaaatacctcattataacatgctaccaatctatgaccccaataatagcagtcccaaaattataaataaattagatgtttaaattgttacccttttttatactacatagtgtaacacacattataatttccagaagagctcttaaagaaaaaaaatgtggagaatgaaaattgaaaagcagcagctgcttaggagtgcttaacctagagctagacgtccaggcagatcgaaactgcctgctgctcctccttcccttttcctatactgcctacaaataatcggtttgatttttcataccacgattttgattaagcactgtgtcattatttctgggtaataaacagtttttattattttcagtttaaagcaattattgccaaaaggaatttttaattttaatattaatttatttagagacaggctctcactctgttgtccaggctggctggagtgcagtggttcaatcagacctcactgtagccttgaactcctgggctcaagcaatcctcctgcctcagcctcctgagtagctaagaatacagggcggtgcccccacatctggctaatttaaaaaaaaaaatttgtagagacacggtcttgctgtgctgcccaggctggtcttgaactcctgacttcaaggaattctcctgcctcagcctcccaaagttctgggattacaggggtgagccactgtgccaggctcaatttttgtttttaatgataatagctaattctgatgagaatccttgaagcaaaactctcacaccttgctagtgttccagcatgtataatcccctgttatagcctgaatgtgtcccccagaatatgtgtgttggatacttaatccccagtgtaacagtgttgggagatggtgtctaatgggaggtgtttagataatgagagctctaccctcaaaaatggattaacactgcaatataaagagctttggggagaagggttctgcccctctgctcttctgccttatgaggaaaaggattccttccctctgggggatacagcactcgaggccccatcctaaagcagagaccaaacccttaccatcagacaccagatgctggagctttggtcttgaacttcccagcctctagacccatgaggaaaataattctattctttataaactacctggttttaggtattctgttatagcagcaaaaatggactagagacatctccttttaaaagtcttgcatgcactgataattgttgatgtggtaaattgaattaaataaaagaatctaaaatgactgtcttaatttttttaaaaacagttttccattgacaggtgttcaaaacagcattatttttaacttttgggtttgtgtagtaaattaattaggggttttcttttatatttgtgttttccaatttttctttaaggaggatttagtatttataattacaataatttttagaaaaacattctcatttaaccatgaaaagagttttaaggtattcacaataacgtattagagctcagtagctttaacacatttctttctacaggtacatgacataagtgcatgatgatatttactaaaggatagaaagagaagtcttaactatcttgaaaacatgaaacaatttaatggtgagtttaaaaaaaacctatgtattgcaattaattgacaaataaaatattgagacatgggctttaggttcctctgaggcaaaaaaaaaataccctgtttattaattttttgtccccttctccttgctgttgtagaatatatgaacatggtcttataataggttcagaaccatggatagcagatccatgcttttaggtagatgcggcattatcttaagagacaaagtatctgctgatcttcagtctgctttgtagtggcctcgttatgagggcaaatcagttaccttctctgggcctcctttgcctcactggtaaagcaattcattgccttgcctttccaataggggaaaattagactaaataaattttggccatttacagctgaggactaggacttttttttaatcgttctgatacacaaataaatatgctctgacattattccacggatgagttttactttttttgtttacttgaatgagaataatggataagaaaaacattttcaataaggttaatttatcaatatatctacttccctattgtcttcagtccatagttctagtaatgagcgcaccacaaaattgataattccatcagattatcatggaaaacgagcattgttgtatgaacgtttttgtgactactgcaaaggtcaggaacaggtctgctttgaaaacttcagataaagatagtttttaaaaagttccttaacacacagtcctaggagtacgctattaatttttcaacttaaaaaactaaggtttccatatcttttttggtagcttcaagggaaaggaaaaaaaaaatgccttcacattcctaattattttgaaatatttttcattggttactacttcttaaaaattcattatccttttttttttttttacttttagattttatcaaaaccatatagctatttcctctctgattgacaaataaagccactatcggtttggcacaaaatctagaatatggtagactctcaataaatgttagatcctctttttcttctctcctattctttcctatttctataaggtacatttcataagattttacatgtggcattcatcttctagatcaaaaaatgtatcatttaatggaaaagaataaagtttaaaatcctagattagtgtctgcgggtgttggtaaagctgaatggctcccacgttttggataatctcattcaatttttcttccatatttttccttgaatttgccactttctttctttcaaaagccaaggctctcaatatgtttggattctctgttaagttatgctgtttattcaatggaggcatgaattcaaatttgtccacataaatttgacctcctaatgctacacgttgttattggatttctgttgtttctcttttaagtggccctggttgtcttaaaacctgctcattccttcttcgagctgtcgccatcctctacaatgctggaaattcacaatcatgaatattatacagggagatacaataaaaatctatgtctttataatagagtcaacaggtataaaaagaaagttatttcaaataaaaagtttaatattctacatttcataattattgggaagctttgagagtcgatcccaggaatgctcttatcacattattcattgtggagaaaaagttcagtaaagtaaatatagtaattagagctcatgcaagaccatcagatggtaaaatatctaaattatctcactagaaggctgtttatagcaagggaaactaaaatatcattctaacaatgtatacataccatagagagaatgatattgagtctaaacctccaattaagtataggcattaaggatgcacatcattagaaatatgctgtgacttttgtttcagccaattatagaaggaagttagagctaagaatttcttgaaaggtgattttagatgtgagtgaagaggaaaagacaggaaataaagctatcatttattttttgtcttaggacaacactgaatatttgtcagaagcatctgctccttaaataacacaattgaataaaaattggcatctgaggtttgaaagttaatttcaaaggtttattataccacagggttcatatttagcagctgtcaatttgttatcgacaagtgtaataaaattcagcaaaacttgaaatcttcccttgccaaagagacagctgtttctgaatgttggagatttggggagtttttttttaaaccaacctctatttgaaaaagaccttacttttatttatcaaaaaagtcatttgatgataaaatattgatattctttaactgtgtttgtaaaaaaaatatatatttttaaatgtgggattttgttgttcttgctgattcaatatttgtagacagtgtttcaacctgggtaatgtggaccctccatgggatatctggcaatatctaaaagtgtttctgtttgtcacaactagatactattggcatctagtgtgcaaagaccagggatgctgctaaacattcaataaaatgcaggacagctcccacaacaaaggattatttggctcaacatgtaaattgtaacaaccttgagaaaatttgttttaaggaaactgatacaatggatttagattaaagattagtttgcatttacagactttctaaaccatggttttcacctggtggggagctgcaggcaggcaccggttgtgctttaagtaagtgttatttgaacaacagagtaaaactccttagctcgaaattatagcaagtacattcgcactgatgtaattaagtttgtgtcagttacactgaatatatttctatgtacaacattttgtaactgtgctataaaaataaatctgtaaaaagttcgacaggaagtttctttaggtagtaattgttttctacagatgcattagctaatattctacacagactccataattcatattaaacaaaaaacttgaatattgttttagtcctaccttttaccccattattttctcaacttgacaatactaataagcaaatctatattttcaaacaatatctctagatcacacattccttaaataattattttaagtatgctacataaccaaaacagacattttcagggccgaaataaggaccagggatccacattttgttgaatgtctactcagtcattgagaaaagtactttttatttaatatcaatttacttcaataaaaatgtcacctaacatgtaaaaatacttaaagagagagtactatttaacccatgaaaaataaaagaacagaatgagacagctgcaaaatcaaatgtatttaggtgttttagctaaaagtatacattattccaataaaattaccttttgcaaataatattactaagaagaaatttaaagaaaacatactccactatcataatggtgattttcatttaaattagaaacacatttcaaaattcatgaccttggaaactctcatttcatttgagcctccagagtagtgtgctgtctctctctgtctctctgtctctctcaatcttttaatttaacaaatacttatatagcatttacaatatacttgataattgtagaaatattttacaagtattaactcctgatgaccctataatgtaggcacacatattatcgacattttgctaacagtggaaccgagtcatgcagggattaagtaattggccaaggtcccatagctagtaagtgacagaggtaggatttgaattaaggaagtctggttccaaaagccttcctctttagcgccacgtaggtggcctcccctcttcattacatagtattacaccttttatttatctcaaacttgcccaggtagtgtgaccttggaggagacatatgtgaaaggtttcaagtcaagtcaaagcctgtgggaaagtgatggggagaatgagagaaactgaatgatctcaccagctaatccatccatggagatgctttgttcagaaatctcttagaattagaagtacaaacatagttagatctgagttgaatgcatctgatctataacttccatttgtttatggcacacattttatatcactgacaatttcttttttctctacaaggagaggcagtatagaatggtgtttaagagcacaaactcaggagttaaatctcctgggttccgtttccagatttaacttgctattaccatatttgtattgtatctcttgaatggtgaacagagaaaatatgatgtagtcaagaagttctctccttcctgagcacactgtcagattacacttccccacttcttcctaagtggggccatgtcattagttttcaccaataatgtaagagtagaaataaatgcatgatacctgaagcctcagatgcattgagagccagtgtactttgtctttgctcttgttcctgccttgtctagcatctggatgcagaagatctggatgcagtgaaagactcaaaggcctaaatgatggtggagtcacaatatgggaggagtctgcatccttgaatcatcacagggattaaagcctccaccctgatactgaactatatttgactgtacaataaacatttataataactcactgaaattttgcattatttcttacaacaactagcttttattatactactatgactgcacatcattcatgtgagcaaaatggtcactcttttaaacttcaaattaccttggtttaaaatagttttactcagtgtgtgttcctcttcaaaagagctttgataagcctcattacctataaatatttttctgtatagttccaaatgttaaaataacttagtagagatgcagatatttatagcagttaaatactgatttataaaaccacacaatactagtacaattgatggaaaaactcataaactaagtaaaatatattgaaactatctgccagaaaacctgcattttccatgatttgaatgggccacttcaatgaacagaacaaataaaatggctcttgtggccataactctcacaaagaaaattatttctgataacaataccatccttttctgtaaatgtatactacgctcaactaacaagggaatctttactttgctacatcattaccaaattggtaaataaatctaagtcttcatgtcaacatttcaagaagggctccctaaagcttgtaaattgtcaaagatatcagattttaaaggatatgaacctcttaaaaagtacttggatgaaatgttatgttcagaatctcaaatatgaattcattgtgttcttgtcagaagttacatcatcagggtcctgagctggtgctggttcagtcccaaggaaaagaggaaacttgtgtattactcagccctggcagatgagtagattcttctataaccttttcatcaccaaatgtctcaacgaatttaaaaactaaagattatttcttgatttggccaggttccttgtaatcttgacagtaagaagctcagaaaaatttcctttgctgtgcatcatgtatgctttactcaaaggccgaaaagacatagaatgcttcttctgaactttcatttaaccagcggaatttgtgagggtataatattcatatattttattgaggagatataagcaatatctcttaacatgtagtttttaattgactattaagatacacaatcttttaaaaatttcaaaatgactcaacccaaattatttagaatatgatttatttcaaaacatttttaaaattccttccttccacaattgtttattttgtctatccagttttgtaataaatgctatatatataaagatggttcctggcattaaacaacatctgcaaaacagtgagcaagaacaagatatttctagaggtaagtaaggtccactaaaacaacataaaatcatagttaataacatcataaagtcaatggctgattctatgttttaaaatcagacaaacaaaccaataaagatcacacctaaaacatgtgcaactgtatagcataaaggagttcagaatgagactcaaccaaattattgcgatcatgaatattacacatcctgagaaacaggaactgtcatagcagtcttgaccacatgttcacatactcaagttggataaaaggaaaagtccaaaatcttggcacaccaaggtaaaaaggtggatatatatttaattaacatttaaaacaaattttcccatttctccacaaagagctcattttttaaatcttaaggtttagtgaagaagagatttcaagcccactgcaaaatgaataacattcttttattatgctgttgatctccaaatatgcaaatgcctttttctttaaaaaaaatagtggtagtttgaaatcaggtagcatgatgcctccagctttgttctttttgtttagggttgtcttggctataaggagctcttttttggatccatataaaatttaaagcagagtttttttctaattctgtgaagaaagtcaatggtagcttcatggggatggcattgaatctatacattaccttgggcagtatggccattttcgcaatattgattcttcttatccatgagcatggttccatttgtgtcctctcttatttccttgagcagtggtttgtagttttccttgaagaggtccttcacatcccttgtaagttggattcctaggtattttattctctttgtggcaattgtgaatgggagttcactcatgatttggcactttgtttgtctattgctggtgtattagaatgcttgtgatttttgcacattgattttgtatcctgagactttgctgaagttgcttattaaggagattttgagctgagatgatggggttttctaaatatacaaacatgtcatctgcaaacagagaaaatttgacttcctctcttcctatttgaataccctatgtttctttctcttgcctgactgccctggccagaagttccaacactatattgaataagagtacaaggctacagtaacaaaaccagcttgatactgataccaaaacagatatatagaccaatggaacagaatggaggcctcagaaataacaccgcacatctacaaccatttgatctttgacaaacctgacaaaaacaagcaacggggaaaggattccctatttagtaaatggtgttgggaaaactggctagccatatgcagaaaactgaaactggatcccttccttataccttatacaaaaattaactcaagatggattaaagactgaaatgtaagacctaaaaccataaaaaccctacaagaaaacctaggcaacaccattcaggacataagcatgggcaaaaacttcataactaaaacactaaaagcaatggcaacaaatgccaaaattgacaaatgggatctaattaaactaaacagcttctgcatagcaaaataaactatcattagagtgaataggtaacctacagaatgggagaaaatttttgcaagctatccagctgacaaatagctaatatccagaatctacaaggaacttaaacaaatttacaagaaaaaaaaaacatcaaaaagtggatgaagaatatgaacagacacttctcaaaagaaggtatttatgtggccaacaaacatattttaaaaagctcatcatcactggtcattagaaaaatgcaaatcaacaccacaatgagataccatctcatgccagtcagaacagagatcattgaaaagtcagcaaacaacagatgctggagaggatgtggagaaataggatcgctcttaaactgtttttgggagtgtaaattagttcaaccattgtggaagacagtgtggcgattcctcaaggatctagagccagaaatatcatttgacccagcaatcccattactgggtatatacccaaaggattataaatcattctactataaagacacatgcacacgtatgtttattgcagcactgttcacaatagcaaagacttggaaccaacccaaatgatcatcaatgatagagtggataaagaaaatgtggcacatatacacaatggaatactatgaagtcataaaaagaattacttcatgtcctttccagggacatggatggagctggaaaccatcattctcaggaaactaacacagggacagaaaaccaaacactccgtgttctcactcataagtgggagttgaacaatgagaacacatggacacagggaggggaatatcacacacctgagcctgctgggggttggggggtaggggagggatagcattaggaaaaatacctaatgtagatgacaggttaatgggtgcagcaaaccaccatggcacacgtatacttatgtaacaaacctgcatgttctgcacatgtatccaagaacttaaagtataataattaaaaaagtggtaaaataaaatgaaaatcaaagtatttcttagctagtatatttcatattatgtgtaaggccatagcaaaataaatcagtatatcttggtggcaaatgatcaattgacaaagccttctagaatgagtcatctcaaaactggtaagaaggaagtcactcagtataagcagaaagggaatatggatttgacagagtattcaaactacaccgaagcttaaacaccactttactgttcattttatatacaatagatctgaactctaagaggcctgcaatcatttaaagttattgaattagtttatcaatagattttaagcattaatttggttgagtctcattctgaactccttcatgctatacagtttgcacatggatgatactcagatgaagtattctgattgacttttctacatttcacaaatcaaactcaaacaatatacaatcatcttgaatgaagtggtatgagattagtagcaaaaggctgaaagaatcagaaatgagttctaatactatgtcattgataaacaatggacattttaacttcaggatactaattttgaaaatggagacactacattctgttcaactattgggactataaagaaactagagtaagatcatgaaaatggtaaatatcataagttattatctccaattatcacaggaaagtttgcaattaaataccattttccttaaaagagtaagaatatatttcaactatgaaaagtttttttctatatatgtatttttttcttaaagtggaggtacaattacactacataaattagttgagaatgccacaccaaatattgtatatgcttttctcagggatgcataaaagtttattcttgggtgtgttctaacttcaaagagaattttgtctgaaatatatgggacatttttacatctcaagcatataggcaatcatcataaaaaagttatttagtttctagtattaactaaggctttatttgatagcttaatgatctttaaaataaaaacaaaacattgccattttctgttgatttagcctctcttctatgaaagtctccaagccccattatcacaccttctaactttttttttcttttttttttttttttgagacagagtttcactcttgttgcctaggctggagtgcaatggcgtgatcttggctcatggcaacctccacctcccaagttcaagcgattctcctgcctcagccttctgagtagctgggattacaggcatgcgccaccatggccggctaattttgtatttttagtagagacggggttttttccatgttggtcaggctggtctcaaactcccgactgcaggtgatccacctgccttggcctcacaaagtgctgggattacaggcatgagccaccacacccggcctacacctcctaacattttaaagtgttaacacaattcttttatttacaaaccttttattttgaaatacagaatcacagaaagttgtgaaaatgtaccagaaattcttgtgtgtccttcactcagtttctttctttgagacggagtctcactctgtggcccaggctggagtgcactggcgtgatctcagctcactataacctccgcctcccaggttcaagcttttctcctacctcagcctcctaggtagctgggattacaggcacatgccatcatgctcagctaattgttttttgttttttttttttttagtagagacggggtttcactatgttggccaggctgatctctaactcctgacctcaaatgatccacctgcctcagcctcccaaagttttgggaacacaggtgtgagccaccatgaccggcaatttcttacaatgataatatcctgtctagctatagtacaatatctaaattaggaaattgactttggtctagagattattccgacttcactggttttatatgtactcatttgtgtgtttgtatagttataggtagttttatcatatgtgtagatatatgtggccaccaccacagttaaaatacagaactgattccatcatcataaggatccctcttgctacctctctttggcttacacaacccctctccccactccatccttgagacttgtcaaatcaataatctattctccatctctataattttgccatttcaagaatgtcttctaactggaatcatatttatgtaacttcttctgttggactttttcattcagcatagttcccctgagatccatctaagttgttgtgtgtatcaatagtttattcctttttattgttgcatagtattccatggcataccatgtaatatgttatacactgtgcataacacattttaatacatgtattaacttaatacagtgttattaactctggaaacaaatttttgtttgtgtttcttcaaacatacagcttctaaaactgaaaatattggctaggaagacatatctaaattataaagaaccaattgttcatatgctatataaaaatgtttggagtaagagggcatactttcataaagtttttttttaagtcctaaaaagaggattttatctaaaatagaatgcagcttctaagttctaaaaatattatatatcctattgagtagctcagtttgtagctggaagaattgtgcctgtatcccagaaggtcttataaataatttattcaatttcagtatttaatttaattcatttacaaatgagatgaggttagattattcagtgtaataagaaatctgttagagaaaatagtatttttcatagttgattattatagtatcattttctttaaagcatgaaatgcatcttttaaaatattgattagagactataatgtaactttgctgtaattacaatacttgtcttccagatacgtcctgaaaatagttggattaaacaaattagtgaacatccattcaataaaatactatgtagcaatttataatgatgataaagatatacaatttaatgacatggggatatattccttagatgttagtaatttgcatagcaggttacaaaatagtttacataatataattatatttttgtaaaatgatacctatatatccacacaggcatacaaatcggaagaatatatacttttttttggggggggcggtgggggacagagtcctgccctgtcacccaggctagagtgtagtggtgcaatctctgctcactgcaacctcctcctcccaggttcaaatgattcttgtgcctcagcctcctgagtagctgggattacagacatgcaccaccactcccggctaatttttttgtattttttagtagagacaaggtttcgccatgttggccagactggtctcaaaatcttggcctcaagtcatccgctcccatcggcaggctgggattagaggtgctgggattacaggcgtgagccacccgccccacaggaagaatacgtaataattgtgtagtaaaatacatatttttaaaggggcattctgggctactgttgtgtatattactctttaaaccctttaaaatagtcttgaactcaatctgacaagattactgttctcatgtaagaacaatattttccttttactacagggtcaatattcttgcacaatagtattgcattcctttacttattcagctgtacctaattagttaacaagttcactttaattattttcataaaaataattccatttttgatgatccttccatatcctcatcatcaataaaagcagcagtcacatagcactgattaaagaaattacttcaaaattaaaactacaaaaataaaggcttcaatatcatagtttctctaaatgtatcaaattcagctgttaaatatatttagagcctacgagtgttctggtattgtcccactcacatcttatgatttctttttcctttactttttaccaaacaaagctgctgtgttatcatttaggcatttataatttattcctgcttcttattttacaacaactttcagtgatatttataaactgtggcatattagtgattgatattatgtataaccttgggtagacttctggcagggcttctcttctgctctctctcctgtcactactggcagcatatacaaattgttaaattgccctgagtaaagctttattgtgccactaatatctaattttcttttgaattaaaaactacctttcatatattaagcatcaggattagtacttcaaagatacccattataaaatttctcaattaataagatactcatagaaaaatggggtcaattattggcataattatattcttttaatattttatatccattaccattctgtggtcacaaaactatctcaaggacatactgtcttttaatttggaaaaaaaaaagttgagcaatttgaaagtggttgtatgaactacttacagaaaacaaacgtgaatcctacactgttgataatgactattacactactattactccttacagtaacagctaatgcttgtgtagtagtaattaccatcaattaccatctatctgttatgtaatttaactccttttgtcttaactacaaccctatgagttaagtgacttgcccaccaatttactggcttaccctttggtcatcagataggggaactacaactcagacccaggtggtctggttctgattacataatggtaaaatggttattacagaaatttatctgaatatggactactttgtgactaatattcacttgaattttgtgtccccaatgcttccttcatattcaatcttacccgtgcctatactaatcatcaacagtttagcttgagagctgcagcagttgactagttttccaacagctaaacagaagattctggctatttatatgagcattctcttaatgctttactatattatgaactgaccctaagggctaaatattatttacaaatccaagaatacaaattcataaattctagctatttttatgccaacgtggactgccaatttgctttgaattatattaaaagttcaaaaactttaaagttctttacccccccgattccccaacttcaaaacgtattagctgttacaattcatacatggactagcattctaaagatgtgacagttccctttgaaagataatgtttggaagtctcaagacttgaattccagtgtcatctttgctctatgatgctggataagttacttaaactctctgggttttatttaattcctctggaaatttaaacataatttttatgagaatggacttttctaagatatttttacaagaatctaagatgaattagagattcacttaatgatgactgtctgaaggaacatgcatgaactggtctaatttaaagagatttctttgagtgatctgtcatttttctctcctctttgttcaaattaaagaacaacaacagataacgttaagtatttttatacttcctaaaaacaactttaactgacagagtgaaaggtataaaacttcaccctgtaataaatttgaggccatctttagacagaacaaaattaatacggccctgtagatgaaagatttacacagatcgattttctgtgcccattgacagagcaactggataatctgtggtagtcttttacacttgagcagttaaaacctcagatatatcctggactgaagattggtcagcagttcttttctggtccatgaataattaaaatcattcttattctgtattctataaatatgcagagaatgcaagatttgaaccatatacattccgctggagaagctgcttgggtccaagcgaacctcatcagcgatcacttcaaagatcaattcttcatgtccacagcatcatgtttaaatgattgtgtgtgatccagctgcttcttgtctccttgttgcttcatgcatgatctttactcatgatctcacaaactatagtgcttcagtagtaattctgcattttgtgctaaattttaacagtgattgccattttataggctaataggctgttgttgtgcatatttattataacacttttttcttttcctatcaataacagtgctttgcttagataatgagaagcaataatctctttaaaatatttacaagtctattcatcatgggaaaaaataatcttacaaagacagccttctccactggcattgcttttgattgtcactctcctccctcttcccaagacaggcatttccataattgcatcttatctttttgtatagactgagaaactggcaataactatgcctgggcaactgttttttgaggaaacacacaaatactacctgataatgtgattatatgcaatgatctaacttgctcttacttttaggactattaataatattaatgattttaaaatataatattatcatagtttcttattctgattgtagagtgagaagaaagaaatgtaaaggtagaatataataatagtaatattgtctgtacttaattccttggatggcctttcttttttggtttgttttattttttattttttaattttattttaagttctggggtacatgcacaggatgtgcaggtttgttacatatgtaaacgtgtgccatggtgatttgctgcacctatcaacctatcaactaggtattaggcccaacatgcataaactatttttcctgatggtctccctacccctgaccacccccacaggtctcagggtgtgttgttccactccctatgtccatctgctgtcattgttcagctcccacttataagtgcatgttcttagatatactctcttactaatctgtgtagggtagattcactccctgaagtcactcatggggttctaatttctatagctgagaaatgccttttagatgcccttgttctatcatacaaaaacactgttacttattagaattccagaaaagtttcctaaacaccatcaaaaattgtatggcaaagaacatgtttgtacctcatcaaattttatttatgttttgattatctaatgtgctagtcatgtttgtgactttccacacgaaatgatttcccatgttttctttctaccatgcaccatccttatcattaaggaacacaaatacatttaatatcaatgcaatcagtgtagaagtgaggcaatatgacacagtataaaacaggcagatatacagttatatatttatcaacatgtcccatagataacatatatctatattccttcaactaaaaagatttgtttaatattgccatttattatcccatatttctattttaaaatgttttgcagccataaaaacaaatgagatcatgtcttttgcaggaatatggatggagctagaggccatttttctcagcaaactaatgcaggaacagaaaaccaaatactgcatgttctcacttattagtgggagctaaatgatgagaacttacgaacacaaagaaggaaacaacagacactgagatctatttgagggtggagggtgggaggaaggagtggagaaaaaagacaactgtcgggtactgggcttaacagcttggtgattaaatgatctgtccaagaaacccccatggcttgagcttacctatgtaacaaatcttcacatgtacccccaaacctaaaataaaagtttaaaaatatatcaaatgttgggataatatggacagagtctcctagcaaactttttttcagaaaattatagtccactttttgatgacggtgatttcaaaggaaactatacttgagttcagctgccaaatctttgtttttttttagatgcataacagttcaagtaccattctctcttattttgtcacctgggaaagaggtcaaaagcacagtgggacactttacggggaacctgagagtctaagaaccattcttacatgccattagcatatcaattgatcatgaacatttaaatttggtagttttaggaacttagtttccttttcctaaaatgaagactttggattagtctctgaagcaactttctgctcgaaatgttgatgaatccgaatcaccttttcattcacttgaaatgtaatgacgtttttgatgtctacgttacagagattgaagtaacgcatctttccccttttacactattatattttgtgatgttttgctttaaaaagttttattttttattaatcttcaaatttcatatttttatccttgataacttccttctagagatgaggccagtgataagcagtatcttaattctcttctgtaagtattttttccttttgcatatgttctcccattcagtacagatatcaatttagctatttctttattccagacacaattctcctctgagattttcatcaataaataaagagacatgctaatatcacagctacttgacacctaccaaaaccctcattaactagtggactacaacataagagaatgaacatattttttaaaggccttattgcaagtcaagtcacaaagttaatacttccacatgtatttgccactcttttccttcaacagaaaaagaaattccagttggttgtaaagtcaaatctcttgtcttttcagtttaaccagctgcactctaagtctcaagacaactccctccttattctatgtttaattgactaccttccctatgccattatccatctgcatctttatgaacataatcaaacctccaacccttcagatcatctgtggggcattgctatcaccaaatagcaatttaatgctgagctttatctttcctggggattttataaagccttgaaagaataaagaatctagcagttggcacactcacttgcatgcaaacttagattgttaggaaaagaaaaaaacatttagataattaaataggatcatttaatagttcactcatttcataggatgagtgaggcaccaggggaaaagtggattgtttgagataacacagctagccatgatcccatgtaggagaataagactgctctaatatttcactctagcaccatccctattacatcacacaacttcccacacttccttcgtattttcccatgataaattataccttctgatttttccccaacctctcgaatgcccataatgtaactgaagaaatatagttccttaaaagtagctatggtttctaaaggcaactcaatgatttttaaaatacaatacaaattgttttttaagtgtttgttttgctttccagcttcaagcagaaccatcgatgtgacaaccgaagacaccaaagaagcagtcctttattattcaagatgtcattaaagtgcagggatcctaaaaccccattctagattatcccttagtatggatcaggctaaaatatttgcttcatgtgaggccctaggtcttgaatattgcatggtttcttgtactctgcaaatttcttctgaagaacccccttgggtgagtgactgttgtcagtatttatattaatgaacttttggagcacaggtatatctccaaagaggaaaggcctaattttgtccccagagctacaaaggtgtatggcatggctgacactccccagtagctgcccaaggatagcatggtggcagatgcattatcagaacaaaaagccaagagtgcccagagctgaggacctgatcaagtgaaacaatcagtcctctctgtgctactttgcaaatggttcatatacttttcaattagcacctgtcatctggatgcaccaattttcgcagaaatattttgaaaggacaattttatttcacgttagctggatgaaaataaaaccaaattccttctagtcagaaatatgtttggaaagattgaatccaaaggttcatatatccatcattggctccagatttcattataatgactgcaggtcaaggattcctgcaaagattttttaaaaaaatagtattttagaaatcatattttgaaaccaggtttgcttctgtttagttaactcccagagaaatatactgtttttggaactcccaaccccaccccaccaaaatataatttgcttttaagaatgtaaaaggattatggtttacacaagaaactaaaacaaatataagaagaaagtgcatgtatgccaaagtaatcgctctctctcttactcattctctctttcttatacacacacacacacacacacacacacacacatgcacactgacattaataagtcagtaatgagtatattagtgtctctatttaagttttctggtggaaaccaaactcttaatgctattttaatgaaggatttgtcagtgaattgtttccaagagtggtaagggagcatgcaatcacatttttataatgtttggcatcattttggggtgtaggaacaagcagattaactaactgaatgatacaaaatggtccactcctcttttcttaaaaagacacattgctccctgcaaggctgcatgaaatacaatttattctttttggacaatttcataaaacaaaagtggaaaattcatcctagaaaatcagatatatagaacactacaattttattactatttctggacaaattttcctaacatccttgcagccttctattatgattcacaatgtctgcaatgagagattagatgacagagtaacctattaaggaacagttactatgctgctggatgcagctaataattcctttatttttcatttttattactttatagtttatgaatgtacaatctactcattacctattataaatattttgattcagcaatggaaatatacaccagtaaacaaaacctacttgaagctttatgtattacatacccacccataaatgtatatcatagcatttgctgcctactagacttatttcttgagaatctagatgaactcttaatcttagctgtaataactacctgcaaacttagtatcatctctgctgctttcactgttttatctactgtctggagtcataattaattggcctcattactgtttctactatgaaatacagtcttctaagacattaatattttatcagagatactagtcttgacctaaaacagagaagaataaaaacataattgtgagttggaaatttttttaacaataacataaaataatcgatgttttggcaagaattatgacaaggctgcagatagcgacacacagctcactgagtgtaaatggagagaactaaacaggctctcattggtgtaacccttctaaaactctctagctaacattcatgccaaaacatccaatatatcaaagactttgtagcaatctggaataaaatcatttggtttcctctagactgtttctgcaagaagtaaatataacccagatacaatgaatgaaatgaaattttagtgcactgagttatggttttcaaaagtaagagcaactttagaacactaaatttaaagtcattcctaagaaccttctggaacctatgaaaattgtattaggttggcaaaaccttctctcgtcttcctatttctttttttcatttttcttgttctttttatcagtcaatactaaataagaatgtgctgcccaaaaagtgaagctataaatcgacttctgaaaagcttccctttttctccatgggtctctatttcattaggtcttcttttattttacttctgttgcccactgtttaatttctgaggccagtattttaatatcctttcaagtattgttttcaagatgtattgtgtagcagatcagtaaacaaatagttatttgcctcttactctatccaaggcaccgtactaaatgctatgcagaggtgaaaagtatgcttactgctatgcaataaattacaatctaatgaggagcataaaaaacacaataataataaaatagttcaagtgattttcaaccttggttgaacgacggaatcacacatagagttctaaaaagacttgacactaagaccttacctcaaaatccattaaactagaaactactgttgtcaatgtttaaaaactgaatgatagggacaatagtatggttaggatccagtggaagatgttctaaatgagtactcgttgtaaatagcacatcaagtgtccctcaagggcaaggatccagtggagctttaaatctacgtaacatgagggaaagtaatgcattagtactgttctaaagttattcatggaattctctcttctgatagcttattatcttctgagttcatagtagatattccatatctcaatgaactggttttattaggaaaagaaggtgtactggttatctgttgctgaataataaattaccacaaaactaaatggcttaaaacaaccatacacacgcattatcctcactgtttttaagagttagtaattcaggggtacttaactaagcagttcaagctcatggtctcatgtgattgtcaccaagtttctgaccctggctatagacagccaaaggcttgagtagggctggaacattagcttccaaggtagtgcacttacagagctagcatcacattgttcttagtccattggttttgtatttctccttttccttacctgtatttaaaagttttccttaagttctattttccccactgtgatacctaggactatcaagtctacttttattcaatacattgttactgagtatctctcctaatcaagacattatgccttctgtctttccaagcttgaatacatcacaagttaaagggggaaacacatttgttcacatgcagctactatgcctactgtactgttttaatttaccataatggacaccacaaacaaagggctacagcaaacgaaaggaggaatgattagttacacaggagtggtgtataggaagaattaaaaaagtaagctggggctgggcgcggtggctcacgcctgtaatcccgccacttttggaggcagaggcaggaggatcacaaggtcaggagatcgaggccaccctggctaacacggtgaaaccccgtctctactaaaaatacaaaaaattagccgggtgtggtgctgggcacctgtagtcccagctactcgggagactaaggcaggagaattgcttgaacatgggaggtggagcttgcagtgagctgagatcatgctactacattccagcctgggcaacagagtgagaatccatctcacaaaaacaaaacaaaacaaaaaaaaaggaggcaatggacttgagcagtaatgataaatttgagttttgagaggcaagaaaaggaactattgacttaagcctcttttctgggaccactggtactttgttatcctgcctgacacttatagcaaaattaacatatgtctaggctaaataaacatattaaggaggagatgatatatgaatataaagtatattaggggaggcagaccaaatagcttcaacatttatagtaaaacaaaatacaacatcattggtagcaagtgagagaggagggtttgaaaattcttaagatgtgaaaatgcatgaattttacttggaactgatccacatttttttttgtttagacttttaaaataactctatagcaacattcaataacttgggattgtactggaaaaagtaaacagtgaaagggacacagaccagaaaattaaaaatggctagatgtcaatgggagaagaaattgaaggtcccagagagggcagcctggaaaacggtaaaaaagatctcctgaagtctgagagggtataatgaatggcaaaactgtgaagagcctggagaatcaaggtcgtactgcaggtgaagagctagcaaacctattgccaggtcttctgataactgaattaaagtcataattcagttcttggggtcaaagattgaaaactcagtatctttttagcctgaagtcaaagaggaatagctattttcctcaagttttacaaagctaacaacagcaaggtacattggtctaactttttcttaacaacctagtgtaggaaacaaactctgaaaaaccaacagtcaaatgagctctacagtttgtgacatgggtctttacattcttgaatgtgtttctgttattgctgaaccttatttttgtacaagggtccatgtttgaagcatttgaaagatttgaaatgttggaattccatttttagctgacttttttatatactgagttttctaggcattactttggacaacaggttaatgcttgccttgctctctttggatgctgtctactccacacaggtataatcatacatacatttctatctagacatcatgaagattccacttctgattcacaagagctatcacaatgttgtacaagtccatattcttaggataaaaaggttaactctgtgtctcagctttgtgggcagaagaaaagagaagacatatgccctattatttgtgttatattacatgcattatattttcgaaatggcatttcaaagaaatagctacaaaatcaatagttcttttcttcttcatttttttcttagagctgaaaactgttcaacagctttatcgtattaaattaggctttcttaatcttaagcagtgactgggtgagttttcctggggaaaaacaattctgaattccacagtgtttaggaaataatacaatccaaatctgagagaaaaatttaacgccaatactgtgtaaatatttcacaaaatatttgttctcaaatattcaactttctatgtatacattatacagttttgactcaaagatcactaaaatgaacctaaaataaacccaccatggaatagtaacttccaataatcagtctttcgccttaagtgaataaggatcacaataacataaaatgcagaggctataaagtaaaaagcagcactcaaattgtagagctgggataatacaactaggtgaagttaaaatttgaaagaaataaatgggttggttttgagtgatggtactgcccatgattttttactttaaattttttgtcactattaacaaaaaataaagttatttgaaataaaaatataagaaataccgtgtgtgtgtgtgtgtgtgtgtgtgtgtgtgtatgtttgtatgtaagacatagaggaaaagacctaaaagatacaaaatgctaccttccaattcaactgtagctattggctctgtcagttttagccttccaagttgtttatttccatgagctcagacaaattataccactgactcatgtgctgctccctgggtgcagtgagaatattaacctttagaaggggccttaaaaatgagaagtgttatatgaattgatattttagttgtgtgttgtgtataaacttttctggatatggcttgccatttggttgggtgcttatttttggccactcaatgtgcataccaatgtgtgtgacttcatatatgggaataaatgttggcatttggattatttttggccaaagagtgggtgagaaattagacacactcaggagccaaaaataaccaaatggcaagccaattacataaatgttttctggcataccaaaaaaaatctggattagttatcataaaacaagagttttagttccagttattattactattactactactattacttctggtgttattcctactaaagccactaatctctattagacacttatgcttgttaaatttataaagtttaacatgaatcattccatttacaccaaacactaatcctatatatgaagtgaatatcagtactataaatacatggatatcagtcccacacaaagacaagaaaaattatgcttagaaaggttaagcatcttagtagagtcacacacaaataagtgacagagttgatgagaacccagacatactgaaattaagaatcagacaattcatctgcatggaaattctgctactaatatatcatgtggccttgagcactcatgaaaaactttgcattttagttttatcatctgaaaaatgaaaatgagtatatgtgctgtagaacatgagtgtaagtgctataaaagtagaaactgatggaatgtgtaaagtggatgattactgaaatattttccctttcctataaacctaatagatcatttattcttgcatctgagaaaaaaatactaatgatcaacagaagactacatgaaggcagtaactctaatattttcacggtattcttcaaagtttgaatatacattatagttcatttgaattctttcaagaatgccaagaaataggaccttcaaagtgcaacatacggaatatatgttataaaattctatgttgtataagtcacacagatgtggagaatggaagaaaactggacatcaagcagctaagcactttccacacaaaatcttgtacatgattgcttataatagcattactcatgattaccaaaaggtggaaataacccaaatatccatgaattgatgaatggataaataattgcagtatattcatacaatggaatattattcagtatttaaaataaatgaaatactgatacatgttacaacatggatgaaccttgaaaacactatacaaatgaaaaaagcctagtcacaaaagatcacgtattatattattctatttatatgacatgtccagaattagcaaaggaatatggagaaaaagtagtagttgtctagggcttgggagaaggagagagaagggatgtctttcagggggttccaaatttgattatggtgatggttgcacaactccgtgaatatactaaaaatcattaaattgtacacattgagtaaatcacattgtgtatgaattatatcctcataaaacaaatgaaaagttcaccaccacctcccaaagaaatactagaaaacttatttatttgcaaaattttcaactgcaaaaattatatgtgtgaattcattaaacacttatacagtacaataagttatacatgcatacacacaaatacacacacacacacacacacacacacacacacacaacaatttttttcctaactagacattttgaaaaccagttttaggacaggttgttgtaaacaaaagtattcacgaggtggtcagaccaatttgaaattatccaattggcattttcaccatgtctcatgcaaatgtatgtcagaagataataagatctcagaggacatttttttctttctagtcagctgcatctacccaggcttaatttcaatctattgctcctcattatatccctttggagagcctaattccattccccacttgatggccataccctctgtctaaacctgagcatcagtataccacatcctctgcagtaatcacacctcgggacagcacattaaaaattacctggaactcccaaggagctgacattatggaccctcaggttgacaatctgaaacaatgtctggaaggttttgttttgttttgttttcagctttgctctactattgaagtaatgtttgaaaacgtcatttgttaaaatgttaacaaagcaaagttatatataacatatatagtatatatttaattacatatgcaaatgtaatatatattttatttattatgaattacacaaacaatgtgtgtgtatatacacacacacacagaaatgggcagtacacacacacacacacacacacatacatatacacacacatacaaacccagtgaatccgaatctgagtactgcccattttaatatcatgtcataatattgaaattaatatactaagtgtacattaggttaaaaacagctgctcttctagcactcttcttcaagaaaaaatacatagaagaaattcataaaagtatgttagatgctaaaatctaaaattcagcagggacttaccgatggggtataaacaagattaatcaatacgatgtgctagatttcaggagaggtaagacacattcaccaaactatcttcacattttatctacctgatttaaaatacaaaatctttccatgttagaacaggtgtatgaatttactaagagtataagtagaaactgctattaaattgctgtggaaatacttttcatatttacctaccttgtcacaagatgaattttttaaaagaatacctctgtaactcacctcttgaataatcccttgtggtcacaatggaaaaaatatttttttattttgatacttactgatacatgttatgccttattatagtaacttaatatatacaattaagaaatatatatttatatatcttccccttaatcttcttaaaggaatttggtattattaatctactcttaccaataaggaaacagaaggttgcagatgttagataatttgcttatgattccgtagctactatgtgacggaacttgactttgaatcaaatattatacttcaaaggccatctatgttctttcaagcatagcagttgcctccacaaaagcattctgatcattgaagagtctaaactcaagaaacaaaatatgatcggctttagttcttctaataattgttctaatccatactattctgaatcagctatcatttgggaaagttctcttaatatcttggcccaaagtttacagctttttggccatttcaaatctcttccctgctattcagtaccacaagttagggcctttgttgtttccatgtagagtaggagggacacaagcctaggttggtatatggtttgaagacctgcttttcccctttcttctaggcccagcctcttcttagcccttgggtgaagaagaggagaaaaaggcaaaccttcccttcctggacttggtgagctgctgtgctccactagttagttgtggctggcttacagcctgcaacggttggcaggagaacccactgtctggtgtccaaatgatggtgttctgaaatgcactgctcatttccctccagtggaagactgaatttccactcaaccacttttgcaccttctcagccagtaactcacactaccagggtaccctcatccagtgggcagacctcttatgtactagcacaatgaactcatgcccagcaactttctgagatgtccaatgtatcaatgagagatacagacatcttcatctcacaaacagtgagtgtacaggttactgcaatgctgctacccttttgtcagccctttactgaccaagcaggtatcaaatgaaggaaatacagttccggtctccctcctctgaccattcttgcaaatctttgtaaatctttctcacagggtatccctttccagttttgaaaaggggatatagcttttcttccagcatatgacattcactaaaatgctatttgctccatttctcggattattttgatttagagaggaggtggtggtggagggtcttggctcctgtccatgagcctgcaggggctgtactccaccctgcttcccagaagctcttagaaaatgcaggtcctgaatatccactgtcctcagtttggggtctgagctaacattcagggacaacaagcaaaagctcatcccatttaattacacttgaaaataacacgagtcctttaagttgtagcccaaattttaaaaaatcaagctatctttcaaaacgtgctaacattcttgcgttaacacatttgatgttaaaacatttgggtcttgttcattgtctctttgaataagctttaatagatatttctcacacaaactacatataatatagagactgtatgtaatttccatttcatatttgcagcaaatgtgacattttcctttattgcacacctcttatttcttcattctcaactctttgaactctgaaagcccaagccttaagtcaaaaaagtatgagaatccatgtccacactttaaaaaggaccaagaacacaaggttgtgaactactctaaacactgaaagaacaatttaagtatttctatagccttcacccctggagtactccacttctttgataaagtgactatttttgcaaaaagtctagtgaagttcatgagtttcacttctctcaggttgagagaatgagttaacttggactctagcgttcattataaacactagagatttaatatatggccaaatgccagagagtctaattcaaggcattaacataaaataataacagttaccatttatgcaatacttgtggtgcactagcactatgctaggcccttcacaggcctagtttcaggattacagtctaactccatgacgtgggtagtattggagccttcattttacaaacgagaagactgaggttgaggaattaagtagcccaaaactgtaaaggtggaaataattggggccaaaattcaagtttatcagttcaaaatagtttttgaaaatctaccatatccatggcataggtacttaaataaaacaaacaaaattataccctttgagaatttctatttggttctgtcacaacacagtgcctacattcttacaactaaagtatgtatgtaaataagacatgtttcaataaaaacatggaaaacatttaacagatatctgatttattttcattaaacaaataatagatataacttggtgttttcaaattatttacacttgttgcaataaaaaataaaatgagaaatgtcatagatttaaatctcagttgtacttaaagcctctgcaataattcactttgtaaccactgtatatatttattaatgaagtattaaaaaataattgtgctatactatatatgtactgttctatgtattaacgataatgctgtattagtgatcttattaatgctgtttatctctcaactctctaacagtatattttccattcaaaaccaaaattataattacttgggtaaatattatcatttacaggcaaataataagaatttgaagaaaatcaaaacagaattggtccagtcaagcccaggcaatgagacccaatcacaaattcgtgcataaacttttgcctaaagaatagccttgttttgttttctccttgtatccaatcttaaaagtgttttaatgaagatttgaatattaagaattcattataaaaataacaactcatcatcgcactgtgtttggtttattcaaaaaactctaaagttattaatttcagcttcctaattagaataatccaattttaatctactggcatttttggagatgaatggattggtggtgcattattctaaaagttaaatctcattaatatttaattgcacccacattcacaggtattaattagaagtgttttatgagtcatagctattattggaaaatcaggtacaattttataattagcataaaatgaactgtaattttgaataatcactgatagtgatcatttagtagaccttgtgagattattaaacttgttgatccatataataatttatatgtagactgcatatcaccattatagtgatacttttgagacaattaaaaataacattccctttcagccaagcaggaacacatatttcattgttgttttgactatgaataaaaaccctttctgctgaatacattttaaagcagtagtagaaaatagataatgtactagttatgaaattgaataaagcacaatcaaaactataattttattgatatttatatattattatatgtttatatcaagatctttcaaataaaagatatatttagcttttaaaaaataaaattactttcacatacataagacttgcactttgctcaaacacacactatttaagtggtttaatcaagtctaaataatggatagttactagaaattcccaaacaacaaaatgacacagtgatatataagttaagttctattaaagagaaagcttttgaataatctctatccatttttctggctttcataataaaatgtggacataccaaactgacttgaaaaaaatttaaaagtggccactagattcaagggaaactttattttaggagaaaacttgttgagggaagttcctcttataccttatgtaagaaagcccaatataagaattaaccataggaactgctgaaaaacctccccttaaatgggtagatgggttcagtgaaaaacacacatgcacacatacatatacacatatacatatgttatatttatatcattttgatatcatgcttagagtatctgtatcctaaatttaatagaacattgaaaataagaatccaaaatagtacttaataatcaactatttcttcttaagatgaaaatattcatagtccctaaaagatgattaaattcctatatcaacagactattaatttgaattataaaccttgtaattttcatattaaatgataataagacaaatataatatgcctgtgatttccattataacagcaaaagaaatgtgacgattcaataatcaaatattttcatatatactggagtctataaagcatttcatataggtaaacttgaatgaaacctaatattatatactaaatactaaggaaatatcgtcataatgaaggttaaagtttagagataactaaaaacaacagtatagtatattctgtaggcaaatgtttaatgtatcaattatacatattacactcttggttataaatactaaatatctcttagtcaaccagactccatttgatgtgtaataattttgcctcatcaagaagaagacagggtaaaaaaagaacaggaaatacgtgttcttcgttcatttaatacatataattgacaatttcaggaatatgctgtaatgtactctacacaaatcttgcatttcctttggctcattcatgggagcaaatcaatatgaattcctaatacatcttaagagctacactagacagaaaatttttgcttattggcaaactaaatccactatatattcactattaaagtttcctgtccttaaaactgtcccctcaggatttaatttaaaagcatgggattcactgaatatgaagtatatttttccaaatttataattgaaaaacaaagtttgtgagtcatcttttttcagttttaaattctactaacttctttataaatgtcacagaaactctcagaagtagaaaatcaacaagataagcagtttcatggtagtgaaaaaaatatgctttgaatttgcaaaaaaaaaaaaaaaatgggtttgcctagaaaagatatcaacactttaattccacagattatttcacccattaagttagcattccctcttcacctatatggctaatattaaaggcctgtgtgtgaccctacaacttaagtcttgtaagagcatcgatttgagtctggttttttttttctctcttctatacacagcctccaggaaagtccccaaacttagaagtttttgataaataactgttaactgaataaatggcaaagtttgtcatttatatgtttatttaaatctgtagcctcaaaattggtaaaagaagttgaaggtggtttgggacattacagttcctttatctgagtgaacgaggcagaggaggagcattcttaggaaacaaataaaccaaaaatattactcaggtcagcttgaaagaaaaaccaagggaaaggaataagatgcctttgtcaatcacacacagcccctttaacctttcacagtttgcttgcattatatgaaacttcaaggttaaatgcaagacaaatgtgaactgatatttctgcaagggtcaggtaggtaccagttgcaagtcattatgattgcaaagtggttcttcatcatgagaatttccaaactgcaagaatatgcctgcaggctttagtatgggaaacactcattaaagtagtaataaaaatatcacctttgaaattgtttcccagtttctaattcccctaagatgtgttctgtctttataattgctcatagaaattaacattggtaccatggcagacaggagctggttgttgtctttgacattaggagggtgctgcacattctggagatcccaagagctttaatttgagaaacagtggtcaagtgaacgaggtgagataatatctttattcattcaacaaatataaaatgaacatttacaataagctaggcacggttttaggtgctggatatacagaagtgaaccagacagacataataagttcctcacttatacagtttgcattctaatgatactttaaatattgaatacattttatagaatgaaggaataaaagctatgtgactaaggatataagaaaagacaggaaagaaaaaattgggatgaatatattgtttgtaaaaacaatggcactatggattgtatgtgaacttcagcttgtgaatttctgctataattgattttcctatacaacataatagaatgataagactgtataatggatctggaagtttcgttagtccaggcagccctctgatgcttaatctttccacactctacacaaaggaacttgtaatactcatgacctcttgaggtagcccattccatttctaacccaccgaaatttttaggtatttctagtcaattaattatcatgcctcctcgagtcattagctagtggttcaaagaatcttgtttggactcctaaccaagaattctaatcacttttaatttctttgatgattttataatttaacttggtttcaacttttttcatcaacttcttgttcaactctgaaggtattccatttaaaaagtgtgacaagcagagcactccacaaaccccagcagagtcaccactgcagctaagaggaattcaccacatccatctttctaaatattaatgcatcctaaaattgattagttttacttggcaacttcgtaaaactattgacttacattaagtttatgctgattactaaattgtaacagtttatttagttgttgtttattttgtgctttacttaaatgtgtccctcagttttagagttgtcagtcttatgttcttggatttgatacttcattctagcttgggatactcatattagtcataactttgattttcagcttatctacatactgagtaacaatatcttcttttattttaattcaagatattggataattttcatcaggccagggcaaggataaagccctgtaggaagaactagcaatctcactctgtgatcacaattcctgaacatatccagtaattgtccctaaatgggaaagtctttagcatacgtctttctctttttcaagtagattgcataaaatatgtatcagcaaatctctaatgctaaatattttcggttccttctaatccaatcagcaactctatattccatactttcagcatttaatgagtaaattaccaaataatttgggtcatttttgtccaggtagagactgatgtcaacattagtatgactaatgtaagcaacagaaacaatattaattccagcaggcacagaaaaaaatctactgcctagttataaaacagaattttaagataattcaaatatagtctgtattctagctactttcaactcttaaatagagagcttgacttctgatttttctaaggagtttactgataatttctctctagatttcatgcagaagtcataacatatcctacattttattttttaagtgactataagataatgaaactgctttcttgtatgatttttggaaaccacatagctctgtattgcaccatgatgacttcaatgtttcaaagtacattcacatcctgtttcattcgatcttcagaataattctataaggtggataggaaagtattattatctcgactttataaactgatgcagggtaaaataaaatatgtagcatctctaggactcagctcactttaatatagctaggtccctgatttgcagccacattattacctgaattgtacatatcacagaaatgagacagatggcggcaaccctcacaaaattcattttagataatatgttatttatctaattaccttcctattcctctgagagttgaattattttatctgatacagacttcctttacgttttcttataatggcattaatgcccctttacattccacctccattctaatcctactcccattctcctgattaatgtgctcctgtctttcttgtattgcattaaaagaaaaaggttattataaggctctgaaggtaaagaatgttacatccttattacacccctggggcacattttaaaataaaggcctattataaataaatactatatgttatgtgtcagtgcgattcttaaagctcaacaaatgaatccaattcatattaacatgacctgctaccaagtataaatattacagcttcctgtgtctaacattgtctcaatcaaatattactgggtgaaaacatttaatttataaataaaaatacagtaaaaaagtaatgagattgaaatcagaaaacctaaactctgatcattgcttatccttttattagtcatgccatttatccacaggccttaattttcttattcatgaaatatgcacagtaaaaagaatttctgtaccttttgaagttgttttaaaaagattatgtgtataatgctattaactttaaaacaatatttaaaataagacatcatgatattaataataatattaaaaaatcaggacaatctaaattaaggaattattgttaaatagtcaaacttctgcagagcaggcaattatttttatccattcttcagctcaacaacatgtatctcatgctttgcccaaccatatagccttatgcaaagtgaattctccaaagaaaatttaagcaagtacataattggcatttttcagctgatttcacaactgaatgtggttaaacctcatattcagttggtgacattggttaaatatttcaaggaactaaatatgcttataagtagataaagaatggagggagtgaagcaaagaaaagatggtgtcagaaaagttatttttaaaatactttgggcctgatacagtggctcatgtctgtaatcctaacacttagggaggctgaggcaggaagaatgctggatgccaggagtttgaggctgcagtgagctatgatcccaccacggcaccccagcctgggtgacagagcagaactccatctcaaaaataaataattaaattaaattaaatacttcagtgtcaaatgagttaattatctcaaatgtttataaacatcttaatgtttataattttaagatacttgttattgttttttcaaacttaatgctctactttgaaagagcaacacagtatgagaagaagggttcaatttaagatatttgattttgaagttgaatgaggatactgtatttaaaggcattgagccatacctctgaagtatttaccaatcggattttgaaaacagaattattacttcctttgaaccacttttaattttcattacaccaaatgaagagattctacaagatctacatttttcaaataatggaagtgagcagagactgagacatgccaacagatagagttttttctttcttatttttctgttttcaagccattatttaaaaaaaaaatcagagtgctttattgagcttagaaagacacagccttagggaacaaaatgactacactaattttctgcatatgctagttgggtggaaagttcaacacaagttttaatgatcaatgatgccacgttagcacactttcaaaaagtggatttcagatttgggtgtgattccaaacatgcacctgccatcctcaaagcagagaattcaggtccagaataatcacaagttctaaattatacacagtgtgttgtgaaatatcattattatttttagaaagtgaaaaaatatctgtgatagaacctatttaatgttttgtcagcctccacagatgtggctaaaaacagcttcccagtaatactttcaagggtcaaaagcaatgaccttgtcatgtttctgtgatcgtggtaaaacacctgggtcaagacactagtgaagattaataaggtaattataaaggaatcagaaatgttattgtagcaaagcagatgtagcaaaaacagcacctcctaatactattggtattgtcctcaacttttttcccaatccttgattatgaggaccaaaataaatatgttttacataataaaatttgctattattaagaataacaaagactatttaaaaagcagtagacttattctcaatcacatctttaaaaatcacctttgaacaggatgttcaacatgcatatcagagctgtgggagaatataaagcatgaccccatataccattgttattgctgtatctgtgcccattgacagttgagaaactaagtgattagaaaagacaaagcttaaaaaaacgtaaacttattggaccttcttttatctggctggatctataattacatgctttaaaactctctaggtatgtagttttttttaaaccctataagtaggggttcaactttcaatttagatcatgtttcagaaatgcctaaagagatggacagaccgaattataacaggggacctaaagaaacagtcctaggaaagcgtgcattctgtgggtctgtggagcaagtctgtcaacagaacgcctggttgaaggtcatctttccaacccagagtcctatgcagaaagaaacttaacagcaaagctttagactcttacttgaagtctctctgcagtatgacatcacttgcatacttattaaaatatttttgccacttctcttttcatctaacttattgttattgaaaaactagataagatatttcccatttagccattcatccagaaaacatttactgatgcctagtaatggctatgttaaaaggcacataattagccagacacaccatgttgtatctcaatttagctcattatttctgatggcctcctttgttttcttctgtttggcacactcctctcccatacatacctgaactacctcctctgcaaaggtgctcctgaggcatcaaggcaaaattcactcttctttcttatatgctactattataaatttcagtgcttccattattgtctttacatcattttattaaaattatttcttcaaaagtcttaatggagagttttcactattcaagtttattgaagcatatgcaatatctcatccacatttctatcccaagaagctaacaaggttctgttcactttaaagccctcaagaagtgattcatgaatgaacgaaaaactttccaccttcagtgggaattgggtgacagttagctcccagacacgtttttgaagagatctaccagctcttagtatgaataccatcctttctgacaaatggtgatgattctctcaaaatggaagaatatctctcacattctactggagatttgaatgtgttctccttaaagttagcaccttctttttttttttttttttctttctcagaatctaaacgtctttggtaaacttcatatttagccacagtgattatagccccctccccaccacatacccacggttttggagaaaaataagtttgtttatcttggagtctaagacagaatctaaactttcagcaaggccatagcttatataacagcattactcatttacttttttaaattagagtatctttagtctttgattaggggttggaatacaagtgagcctctaagggaaataactgcctttccaggtcctgaaacttatctgagatagaaaaacttcaactttgtacccagtgacattttagttaaatataatttaagattctatggattcctgttatacatatgcaaaacaaagtaaaggtgtcctttccaaaaatattcacttttattccatattgtttaaatagttttcaagagagatattccaatagcctttatttttttttcttctctattgccaatggatttaaatgtttgcttcattgtggcattccaaacacacaaaactccagtggctatgggttttattcctttgagtgaatagttatcgtacttcaaagactgctttggattttaagttagggtgacctgttttcattatattcaaacaggctttgatccatttctcaattaggtattgcagatgacaaacaggtacgtctagctttcctgccatctaaattaccctagaattctatgaagatgataatttgttctgtgagtacactacttctatgtgttatccacacaaatttcattatttcaagtattgtctttttatgtatctcttttgtggggagactaatattccaatacaaaactgtgttctgttttggggaaaaaaaaaaaaagagctcttagacagtcagaacatgagaagtttaccaaaaataatttgtcctcaagtctagttgataaaaaggccctatgaggttagatttatacaattttattggcaatgacaaaatctagaataaaatatataattattgaggtacttacatttttagtataaactggaataacaaacacatcaactttacaaacctctcatactagtgtctcactttaaagatattcttaggtcaaatacagtggctcactcctgtagctgcaacattttgggaggccaaggcaggaggatcgcttgagcccaggagttagagaccaacctgggcaacatggtgagaccccatctctacaaaaaattcaaaaaattagttgggcatggtggcacatgcctgcagtcccagatacttgagaggctaaggcgagaagattgcttgagcctcgggagtgtcgaggcttcagtgagctataaccacactactgtactctaatgagaccttgtgactatatatacatatatatacacacacatatatatataaaatctctctctatattatatatattatatattatatatataatatatatattatatatatataatatatatattatatataatatatattatataatatattatatatatatataaagaaaatattcctaaataagtggctctcatatgagccacaatttaaggaatattttcttaaaggcagacttagagagaaatatgagtcacactaacacaaagcataatcagcctaactcctcagtcaaacaccctgaggttcacattaccaaagagagaggtttgaacatgagggaaacatattattttcactatactgtgatggaaggaaattaattctggttgtgcaaacctagagcatttctctgaattctctgaactagggtggattgttaagaccaagacagagtgtgcataataaccttgatgttgggaaaagactatgccgtgagtcttaaaacagatcctagttgatgattatgccaaccctgctgaagaaattctgaaaagatgcagaatgccttgaaatacaaatgctttttctggcccagataattgatattgcattagaacattccatgggatttgaaccagcctctttcacactttagatttcaggctagtataattccctcaccacacaaggcagaaccgaaatccctgaagttcaacaggacgtatccaatttcaacaactttacaattttcaatatctgtacaggatttttgcaaaaacccatttcaaatatcccattatcagttccacgtctttttgtgaataccaaaatatattagctagaccgtcatcttattttagctttagaatgtatatcagattttttttccagacacaagcaattaaaggattggaaaatagctcatggaaagctccaaagaattgatcctcagagagcaaatcttgtaacaccaaacaaccacaattcccctaagccactctgctgacaaaagttattgctagttatgcaaggtaactagaagatatgcacacaaatcattgcaattaaatatcctgcccaccatataactgatacttgccgagcagatggttggcagaattttcttgctaatctcgtgttatcaatgtccatattgcagagcatccttgaaggtgctcctctgtttgttttgtattggatacacctatttgtattgttgtatagttatctgtgctgtgtgtcttacccagtctcacccagttattttactttagaatctcatgggctgtgtatcgtgaagacaaacaacctgttggaaataaacaacaaagaactgaatccctcttatctgttcgctgcctaacaaatcaaaacacactgaaatctgggattattagagaagttttggggatatagaaataaaataaaaaccagcttgtcaaatggggctgcctgctgctcagtaccatgtgttaccacagcaagttgcatctgttcagctattaaacctgttagtgaatataatatagacagccacggcattaacaaatattcttaatgcctattaaactctacagctacacattttaatttttacattgtattagtaaaattcaagactatagcacctttaggacaatttaaaagtgcaatgaaaaaactataattttggttatatctcacatgcttaaattatatttagccatcattttaagaattggccatttaaaaaaaagttctttaatttttaaatgtggttctcactgctaactgtaatttagctcactatagatgcaataggactgaagtaattaatcacatgtagaatttgaaaaactcaactaggtacatcttttttccactactgaacatcttacttcctttcgatttaatattggctattagcaaatgccacagaacatatgagttactcccttgatataatccaccctctgagctcaggctcaggaacttcgtcatttaaattggctatcaacagctaggacatgtatgttttactaaacactttatagcagaatacatctgttgctactctgtttgttatattaagattaagcacaatgatgttgacagtattaatacatttaaaagcctgtcacgttccatggtgttcacgagtcctggggactgcaggattgaaataaaaagtgactagaggcaaaattaagaattatggaatgtgtagaaggtgaagaacacagaggtagactctgaaatgagtactgctacccaggaggatattaacctcttgcctgcctggcttttcccataatattgtgaagccacattttactgaaaagagccgcatgcttcatgaaatagttatccaacctccttggcctactgctgcttcatgaatgctgccagaataggggaaagtttgtgactgaagttaaaggggggttggtttcaccgctatactagtgtaattattaaaatgcgaacacactcaaattaaatacaccagaaagaaaatcattctatggagctcagtttcctaagaaataatgagaccaatttgcttttatatgaaaacactccagtttgtgatatcttcatacactgctggtgggagtgttcaacagtacaatgttcttagaggacaactcagcaatatatacattggttcggcttgtatgaatttgtacataaaaatatgcttttacacatgtgaaacgatatttttacaagattttaaaatgttatccatttgtaatacttaaaatgctgaaaaaattaaaatacccatcattagggtctgctaccctcataacatgtagcagatgcatgttatgaggtaaatatgagatcatatgctctaaaatgaaaagatgtacaaaatatattaaataaaaatactcaagttgcagaatagtatgcacatgataatatttcatctttttaaagaatgttcaggtatgttagcatatatacaaatccttgtacctatactatacacaaaaaagaaattgaatgtatatgcataagattaaagattagagttttagacaccacagtaaaaaagtgggtatattatatgctgtttttactttttactcccatcattgttgtattatttaaatttttcaatacaaatttttatgatttaaaaattaaattgatttaaaatatgggctttcctgaaaagtaaatactttcatccgtaggcaacaaataaaattcaattccttctgaacagcctgtcataaaatattattggccttcaagaccctacagtatgcctcactagtctattgaatctagtttatgtctggatgcttagaagaataccaaaaaattagtaagttaaaaaaaaagttaaataatataaatacagtctactgagaaggacaaagttaaggaaaaactagttaaatatggagttgatggttatagcatgttcctcacataacaattaacaatatctacatagcactctcaaattccagaaacatccccagccactgcatttatccaacacccttctcaataaccagttacaaataatcaaataaccatcggtcttgatttaggtatttggaggcggagctagaatttacaactttttcttcccaccttatgaaatatctttgcaatacctgttttttaaagatcaaatgaacacagttctggagcctagacgagtagctgtctaaccttactctgcgtaatagggctaaaatttcaactctatttctctgctgatgctctatgggatttggagcccccaaagcctgattttattcctaattaacagtaatgaacagatgacatacttttcctttgaacacctctgtcgggaaaatgtccaatcagcaagagctacaagcaatagacaaattccctttctctgacctcatttacatgcttaagtacacagagactccccctgcctttagtttggggtgcggggggaaagaagtaggtcaagacattgaggctttatgcattacctttagaatgtggtgaaggctgaaagtcatggctccaaccagagtttccagagcaatgtgggttactttcatattcatcacacataaggccaataccctcctagcagtattagtttagttctacatttaggcacaactcacaaagcagcaaagatacctataattgtacccattaagagacttataatagaaaatactatgtgctatgtcatcacactttgttgttatttagtgcattcaccttgagggtcacagaatctctggaattccatgtttaaggaatatcataaaataatacactacaaagactcactggtttcacatcagtagttgggattttataatcatttgcaaaataagctgggccagcctgaaattttcctttgtacaaagaaaaatgaagctttgaagtcatatacaactggttcaaagacaggcagttatttactatctgtatgattttggtcaatttatttataatgcagtctgctcattggtaaaactgagataaaattcatacctcaatgaattattgtgaatatttaataaaatctaattttatgcaaaatgtttagatcagtgtgtgttccacagtaagcaatcagtacactctaaagagtattgtttagttaccgttcttctgactaagccaaataatagggtaagcatgatttcagagggggaatttaaccctacttcagatgattcactgatagtacttccaaacatttaatatatattaattaaaataatttttacaactcaacaaatggagaaccaattttacctccctcagctaagccaagtgttagaggttggcacagcagaagattaaagagagagagagagggagaaagagagagagagagagagagagagagagagagagagagagaatggttaaattgccagggtagtggagattgatcatctctacattcctaatcaattagggaggattactacaggacagttttttgtttgttttcattctcctagtggattcttctcttctcatcaagtcaggatgcagggaaatatatcacataagtttttgtgtagatattagaaataaaaatgatacagagaacagacaagaagcatacctagactcagagaaatgatcacctgtgtgtagtatttgaatctgaaggtggagctagccattaacaaaagaaaagtcttcctttcataagaaaataacacaggaaaaatgaatccatttcatgacaggcctcagtcctcaggcctctgacttttgtttgcctcaggaggttgtaaatgggaagtcccaggagaacatcacgtgctttcacgattatcctttggtactgtacctcatactatgctccaaggagagcacttctggagtgagcgcctgcatgacaatggaaaactaccagcaggagggcaagagaggccacagtcaaaagtaaagcagcaagagttcacttatttctccattcactcaggtatgcattgcttcctctgtaaaccattactatgcatctactaagcaccatgctagagtatgaaaatacggacatgtaaagatacatagtattatacattgtcagtgaccctgaagagtttacaatttaatgggctacaaggacatataaagacatagttataactacagtaagtaacacaataggattaagaacaaagtattatgattgtaccaagaagggcataattagtcttgccctaggggacaaaggaaggtttcacaaatacataaaatatataatccaggcctcaaagatgaataaaaaagcaccagactaggaaaaagagaaggacaggtaggaataagaggaagtaggagtactttaaagaaaggaacagatatgaacagcggcactctggaggtctctttttgctgactctcattattggtacatttttttaaactgtgtttctcggtctttaaaattatttatgccccaaacttacaaatcaaactagttgcaaatgctagctagctaaccacaaaatctttggggtaactggccagtcagataacttcctatgtatttatttaactagagaaaatgctttatgtagcagatatctgaaatgctccataatttatgtgatatgtggtatactaaagggtagggttgtttgacttcataaaacttcattacacagaccaaaaggcagagttatctcgttcagcctgatgagggattgtctcctgaactctcacctgcatcacagaaggcacagtggttaagcacatggatttaggagtcagactgactgagttcaacactggttttgcagctcactagttgtgtgactttcatttcttcattaactacctgagtatatattttttccttttgaagttttaatgcatattagatggacttacatatgtaaacttagaacagttatgagactgttgattgcttttataaaagccacacttgtagactgcttcatagtttaaaaacttttaagtgtgcttttacagtgtgaggatttgaaatatcagcctattttctgtggctaatgtgccagtagaataatgattatgtagtaaattataaggtacttgaggtcagaagccatgccacatctgactgtatttctagtgctttggaaagtgcttagcacttagaagaaaaggaggtagaagagaaagaagaagaaggaggagaggagaagcacaaggaggagggggagaaaattttgttaagaacatgtattaaagagtgaatgtgtgtgaggtagaatgtggagtagctgaagatgaggctggaaaataagtctagattgtgcatacatcagaggtccagctaaggaagttggcctttgaagtatttgcagtagaccactggttctctatcagaactagaatcttgcttcaagataccaatctataaataggtaacacataaactggaaacatgctgatagttagctcagatttgtatctctaacccccccaaaacacatttaatataaactggcttctgatattgcctttaacctgagcagcaccgacctattgccattgaacattttcagaacacacatagtttaagttggtagaacttccagaatgcaaagattatttcaacaaatactgattgctcacttgctaaattctaggctcatgctgggctctaggaatactaaagtgcacgaaatagataaaattccctgctttcatgacacttgctgctcggcatcatgctgttcagtatggatgaagatttgccatcagagtttaaatactttaacctaattccaaattttgtctgcttcataaaattgccaacaaaaaatgcaagagtacacaaagacgggaaaaaaaaaaaaaaggaagtttgttgttgttattttgccaattttttccagacgtttgactttgctttgtcctggagaagtaaattactaagtgtccgtgtctataattttaataaataaaaattagtttctcttcatatgctattaaatacacattgggaaaaatacttaaagaatactatgagggggcttcaaattgacaactgaacagggagcccatgcccatctctgaccagccttgctaccaggtgagaggtggaaacacacccttgcagagcagtgggagaaaatgggtgaaaggactgatagagtaccaggatttgtgctttttttccactgatgagcagctcataagtgagcaaaattactgctgaaagtgggtgaacattatcagccaggtatgtcttgaactaaaagaggttgagacccactgtaactgaacatttgaagccagaggttgaaacaccacaattttattttataacaatcattctggtagcagtgcagaggatggattagaaagggaagatgctggaggcagagagattagttagaaggctattgcaacagttcaagaagaggtcattaaactaaggcaataatagtggaataaaaagcaagcagataccttctaaaaattgctgttcagtaggcaagccagtagccatatgttgagcatttgagatatggctaatgtgaccaaggagctgaattttaaaatgtatttaattttaattaagtttgttgtaagtttaaaagatactcaaacttttaagtatgtttagaataacttgagtatgtgaatctacttttacaactgtagatataacaaaatataaaatgcttctgatggaaaatttagattctgaaatgagaggtgttgttaagtgtacaagaagttccttgttttgacagcttggcataagaaacagggtttgctaaatgttaagtgtaaaacacacattggatttgaaaagcttattatgaaaagataatagaaaacattaataatttatatcatttatatattaaaatgataatattctgggcatattgagttaaaatatattctcaaagttaattgtatttagtaaaactaattccatctttttttccttttatatgagtagtagaaaattaaaacttacaaacatggctcatatatttctcttggatggtataggttgagagacatggtagcaattcggtgacaaactgattagattgtaaaggcaagcacggagtaaaagatgtcaaagatgtagcctgtgatcgtgtagatgagtgggtgattgggagatgatgagttcagttgttaatgtggtaagtttcagtcgcctgtgagacacccaggtagagatgctgagtaagcagttggaaatattagtatggtagtgacagaagtctgggatggagatgtgtctttgggagtgagcagccggcacttatttgatagctaaaattcagagtaaaattttaagtatatgaagataccctttttcataggccaaaagccttactaatcaattaaatttgatctttcaccaaacttttttgtctgtcaatcacgaatttccattctttattgggcaggaaggatttaagggctaaaattccaggaagagcccaccattaaagcatttacttagaagcctagttgcagtgtgatcttccagggcagttgagcgtcccccattcagggctgtgctctgttggcaaaaaggttagacagttttccagtttgttttgaggaggagagaggcctcctctgtgttgtcgatataagaatccctagttctggtctagcacaccatctcctaaagtaactcctagagacatcacaaattgttttcatcagaagaattttctcagaccccataaaaattatgtctagtcctccgattctaatttataatttggattatttatgtctactattaacttgagtaccccctatctatgcacctagattatttccttccattgtttaaataaacttgcccatgtctagagtgggccagcatcagcattaataggattctaatgctgtagaatcaccatcatcatcttgttttctggtctttggctgacatatttacaatgctgtttctattttgtaaccgctactgccatgcattttgcttatggctttcagcgcatttttttttgtgtgtgtgtgtgtaataaaagtaattttcctgatcattgtgcaaatgacccatattcagtatgtattccccaaactggttcttaaccctcaagcaatgtctttgtttctttttttcttccatcaatctatattgtgtttagagttctgcaaagcctccttaataacgtgcttgcatatagtttaaattattgctcatcatttcttcccgagacacacagactctgtctggatcataagggtaaacatattggatatgttctaaatacaggagttcttaaccattacttcttctaaaaattccagaataactaagatgctcctggattcctaagtcagtgtaagattataaatgtttgctcttttaagcttctaaattatggaaaaattggttacacaggaactaatcacacacattataaattgcattataggtgatcaaaaataatgtgtttattttgcctaaaatgtttcttaaaggtacgcttttgaaaaatagttagtagctatagaagaaattgtggtatagtcagtagtcagaaagaattcaacaagaagttccttgttttgacagcttggcataagaaacagggtttcctaaagccactcatcactggctaacttaagaatagatttgaagccattctataaaatagcttggggcccaccacaaagcagtgggtcaaaaggagtagtgatcacaggatggagcagaatcaatggacatgattttctccagctaggtaatgtcctaggaattgtttctgcaactcttccaaagagattccggagacctaacttctttctgctagcttaggaggtgaaaagatccaggaccaaccctgaaaacactcactatttgaaaaaactgttcaatgactgagtcaaatctatatagtgagagagaatgggaagaaatcttttgaacaggaattagaaatagagagatgacaagaagctcattttttaaaaaaagttaatatgtttcactggagttgaaagataagtagaaaaatgggaaaaatggacacgaaaagggaaagagatcaaaatgctgaagacattaaattttaggtacagaatttgcctttacccatatataattgcagcggcatcaatgtgttttaacaaaggaataatatgatcaaagaaccagattagcaaattaacctgccataagtatataaaatggatagaaaagtactcagaatggagacagaaggatagctgagaaagtgaggcagcagtacaagcctctaagtggtaagtatgtgaaccgagaagaagctagaaatagctgttttgttctcatttcttaaatttcacagcaatagaatttcagatgaggaaataactctagaattctagaaaccaaaaacatagagattaaatgacacactaaagatgatgaccagtaatttagaagttgagaaattgaattaacttccaagggaaaaggatgaaggtaggaatctgtattgattcatttacctctcctacctcccacataataaactatttagcacttaagccaatagaaatgtgaccatcatttctcacattttccccaaaaatgacttttacacctcagaagtttggacagtaattttacaatacatggtgaaaaggcattatttaacccatcttttgaaattgtagtaaaataggccacatgttctctaattcatataagaattaggaaagctacctcgtgatacggcaatagaaaaaataaataaatgaatgtaaaagaactaggaaagcaaaaccaagcaatatatatacaacatatgatttacaggactgaatctgaatactatatggcaaagttaaacctctataaaatcagtgcatctgttgattagaaagagtatttcaaatggaacataatttctattcaaggaaaaccctgaggggaaataactgggtttatcttgttgatataggtgtgcatctatgtataattactgactttaaaaaggtatttctgaatcaaatcttaatagaccagcaagataaataatgtataatggagagaagcagagaaagatgagaaagacttgacacgtcaccaatattggtgttattttgggacatgtaatatttactataaatacactgtttctagtctacactaaaaccaatgatcaaaaggcatatttctaaatcaaaatcaattaagagcttggtttcaaaataaggcttccggcccagcaaagtacaaagaagcaacacttaaggcaaaaatgtgcaacaattcactcatcaaatttgcaatgctcttttatgctcccaagatgaaaggatttcaaaacacactcttcactcatcccctcctccaccctcagtgacatttcctctggtcagaaccaatgcacatgttaatatttgtggtagtgaatgcatccagatttatagtgactttcttctgtcagagaggcattaagtaatttccaaatgacatcactaaactgctatatgagcgcttttctctagaagtgacaacattggtaaaatttctagatatatcttatataatataaaaacttgagctaaatttttcttattgcttctaagaaattatttaagtcattatcagttaaataatcctcaacacatcgtaacttaaacatgtcttgtgtaacacttcacagtttgcaagttatttctttatattctttatcttaaaaatctattatttgttaactgtccacacaaatactatacaagtaagaaagttaaaactgtaaggaagagagatgaagaaatatcaagacagaaaaataccaagaaataccagtcatttggggacaaaatgtttgctataaatcatataagttaactggatctcagctagcttgttcattcattcatccaacaaatatttattgaggtggttactaaacaaccagctcatttatttttgtatccacagagcctaacataggcctgggtcatattaggtgctaaataaatatttctggagaggcttctaggatgtactgaagtaaatgatgaaaagtcacattactgtattatttttctttcttttcttttcttttttttttttttttttgagacggagtgtcactctgttgccaggctggagtacagtggcacgatctcggctcactgcaacctccaccttctgggttcaaacgattctcctgccccagactcccaagtagctgggactacaggcatgtgtcaccacacccagctaatttttgtatttttagtagagatggggtttcaccttgttggctagcatagtctccatctcttgaccttgtgatctgccagccttggcctcccaaagtgctaggattacaggcgtgagccactgagcccggctatttttcttattaatcatcaccattattataaatcatgttctctgccatcagaaagtttatttctatttgtaaataatggacagatataaaataactagagaataattcatgataaaagtgaattacaataaataaggcaattattaacaaaaaataaacattcatccaactaaaatttcaccatagactttctttaaaccaccaatcaccataaccaattcttagttgaagatttctgaaaactacctttaagatttgaagcttctcaataatatggctgcttatatcaagttctatacttttctgtattgtaatcaggaacctggaggactttctcagagttatatagaaattaaaatgtctgtcactttacttgactgttaaataattgaagatctacactcatcctaagccacagtattttcaatgtataatttattaaatctattaaattctttcagaaaatatttattgagcactcatattctaggtactatactaattaattgctcttcacttcatgtcttaccttctcctcaccccttcataaaaccttaacaatttcaatagtaatattatatgactttgaggttaacagtggtagcatcaatattaatatgacaaaaaaatccatctatcaaaactgggccacctgactcaaaaaccattttattccaagttgttatgtttttaagagtacagttaatcaaaatttttaaaaatccaacatttttattctgaaaaattggatgacaaaccatgtcaaatattcaaatcttcattaaaattatatgccaatcagattttttaaattatctaatttaaatagcagtatatatttcagcaatgatggagcatctcttaatgcaatcaactttctaatttattggcttactctatcaaataaggatgaaaatattaaatctgatcagtacatagtatacttcactgactttgaaagcttacacaaattttccttgaagtttaatggataatgaataagtctaacttttacagataaaaatgtatcattgatagcatagcaccaattaggttaatttttaagtcagttatattcacaaacctaaatcataagcaataatctagaatttataaatcttatttttccttttaaatttcaataatgaaagaagtagaacaatttattgggcaaaccaaaatggactcaaagatacctaaataatttgataaaacagcctttcaatattctcaaatctaaatattaagaacagttctgcttctatcacccccaggcattatcttgtgttgctttgcactttctttgttcctttcttccctccctttctttctttcttctttccttccttcctttcttcttggcttcctgtctggttttcattttttcttttaatttctaattcctctttcttttattattccatgcacccaacattttgggaaagtgctggaggtaaacttaggtagtaaaaagaaaaccactggccttgtgttaatttttattatatgcttaaaacatggaaaaaggccgggcacggtggctcatgcctgtaatcccagtactttgggaggcagaagcagttggatcacctgaggtcagaagttcaagaccagcctggtcaacgtagtgaaaacccgtctctaccgcatatacaaaaattagctgggcgtggtggtgggcacctgtaatcctagatatttgggaggctgaggcaggagaatagcttgaacccaggaggcaaaggttgcagtgaactgagattgcatcattgcactccagcctgggcaacaagagcgaaactttgtctcaacaacgacaacaacaacaacaacatggaaagaaatgacttatctccacatcaaagacttgttgagtctgtaatgtctaatcacctcttctaggcaatgggagaaagaaaatttaatttgaccagatttgaactcagactgagtcccattagttgataaggagtgggtagggctgacaataaacagtatttgagaagcccaggaggacacggtttacgagcaagggagattttgaagatatcaagtccaagagaaagggtgtgtagagacatgcactgaatccaaagagaacgaccaggcaagaccaagatcggagattcagaaagaagaaggccttcacagtgcagctatcagaaatccatggctcgtaaaggagatatggagggtattacgctagaatggacgccgagaaagtcaattctttacttatgacaggaccctaagaccacatttgaccagaattggaaagaaatacctattcttgcagtctaaaactctttgaccataaaataaacaacagtggtttgagtaattcaataacacagccccttgtgatttgagagtgatcattgtagaaccttttctcagagtaaaagtgtaattggttatggatcaataagtaatttattttagaaggaaaaggcccttgttttcatttttatttatttattttttgaagtagcaaagctcttaaatcagaacggagcaaatacattttgaaagttgagcttactctaaacagcaagattccttactgtactagtaaaatttatcttaactgatcatttatttatgatgccataaaaatccagatgttcttaattttgattgttagaaatttgctaaaaggcacctgaaattacttttccagagttcccctcttgagaactacattttaaattgaaattttactatggttcaataatggctgtgctgaggggttttgttgtgtttttcaagcttatcaatgaattcagcccttgtggtcagtgtaaactcctacacagcttattggaaattccagaattctaaggcaaaattaagattaagaaaatagtttaataaaaacagagaattaaaaacttgtaaaagtttgtgctaatgtactttggtgtttcatgtttttcttaattattttagaactggtacccgatgaccactttctaacaggaaagaacatgatgacctaatcaaatgtcctttggagagtgagcactgatagaaggagaacttatagggaaagacaaaacaaaatagaacaaacttccatggtcgcttaatgcatgggaaataaacagaacctcaaggataaaaaagaggatggggagacttacctgtttcttctgaaatcttccaaaagatagactttagaccaagaactatgataataagaaccctttagaaaagtttttgaatatgtgacacactacgattttttggatatatcaataaaatattcatatctcttaataaaagacactgtgcttctttacaaataatgcaagaaaatgaagatttaaagagttgcaaacatactcattaataatttttaaaatgcagagaaataagtgcccctgaaccctaaagttaattatggcaactttcaaaggaaaatgaagtttttcattcatgactattctttgctatctattatatgctgagtaaattactgtgggaggcttacaactttagagaaaagagaatgggcccaggatgtaagtggtaattatgaattaaaatgtattttcctgacacgtatcaaaatgagtacaaaatggcacagaaacaatctttttgccatcttgtttcacatccccaagtatccttaaagtatactttcgttccttttatttcatgtagcttcagataagtactttctctagtgagcaaagaaataaagacagaatccagatctttggatgtcaccagtattacaacctcctgcttccagccagatggtgtggtatctactaggcaataacttattttattcatttggcaagtctgcctaaagacactaaaatcactccaaaatttttttaaaaattattttgaacacagaattaagaggaattcacactccaaaaaaaaaaaaaaaaagtttgcattgtaaagaacgcgattaactacagcaataggtatatggtcttatttcctctagattgtattcatatttcctataacaaagtactggtttctgggggaaggaagcatccaagaagcaaaattataaattctttacaaaaagttaacagtaaaaagtaaaagctgaatcttatgcaaaaagtacttactatatgcagttctaggtagtcacccaagcctgaagaactgtccactcgcaccaatacggcttctttctgaacagtgctaaaacctatggccagtctgtctgctcgtgtactgggtcggtcattaggaggccacttatacgtgatttgtccaccacctttgctaaagatatatgtcgtcccagctggaaaacaaaaaccaaaaccaattagtccaaatacatcaagtctgcacattagcaaggcatgttatattgatatatcagtaaagtatcaactctacacacaaaactatggcaaagtaaatcatagatttcaatcaaatgtgctcaagaaagtggaccaagttgttttaaaagaaatggagaggtagctcagtttttaatacactgattcaatttaccagtaggtgtttcagaacaaatagtaggttattgtgttttccattgagttggacaagaacggaatgtaatgaggcattatctcttcctgccagtttttaagaaatagtttagtagaaaacattgactggatgcttccaaaaagcaacagcagcacacatcaacttggtattgaaataggagctgcatgcagatgtgacagggtcatacagcacagtggagaaagtcgcaacaaatgtgctaggaatgtaacttttatggaaaaaggatctacttacatgtgacagataactaatggatgaatagccacaagccccagtagccatgtcaagaaaatacagataatagatgtcatccctagaagtcaggttttgtttaacaagcaacatctagtagctgtcaaactattcagaatcataaaaagacccacatcctctgccaccccaaggtgaatacaagccttatagcactgagaataatgtcacggactcattctgtgagtgttcaaattttaccttatggttgtctggtcagtaaattatccagcttaaatgaaaagagtctttttcaaacaaatttattcagcatttgatatggtttggctctgtgtccccactcaaatctcatctgaaatggtaaaccccataaaccccatatgttgagggcagggcctggtggaaggtgatgggatcatggagtggctttgcccatgctgttctcatgatagtgagttctaacaagatctgatggttttataagtgtttgacatttcctcctacacacacttctgtctctcctgctgccttgtgaagaaggtgcctgcttccccttctaccatgactgtaagtttcctgaggcctcctcagccacacagaactgtgagtcaattaaacctcttttctttatcaattacccagtctcagggaagttctttatagcagtgtgaaaatggactaatagagcatttggtgcactagtcttacctcaatgcatcattcattggccacccattttggttctattattttgaggtcctgaatagaaccaaaaaagaaagaaaaaagattggattttccctctgtcttcttctgactgcttaaaatgggacattgttgttttcctgcctttgcagcttcttgttctcatgccttcaaacctggactaaaatctacatcgttgtttctccagttgtcagtcccataatcgatacccctagcttttctggttctctaacttgcagacagcagatcatatatgatttgatcatatatacatgattatacataataagagaaaatatgaaaacttaggccacaaaacttcttgtatttatagaaaaatagcttgtaccaagagtaacatttatgtgtaaaagttgtgtgtacagcagtatgttttgaagaaaactatacattgaattgccatgattaccaagtttaccagttaaatggagttgacctactatcacatttgtgtacatttaattaaacagctgacaatattgattttgtggccatttttggaagcaactcttctttgttttctgttacagacatttccacaggcctttgagaaattccaaagacctctgcaatatgcctattgtacctgatgcttaaataggacttggtatatagacctcttccaagaaacatgttaggagaaaattgaatgcaaaagtgataaacatgaatactgttaaaatgcaaagctatagaggctgtacccttctctattaattttgcagataccaatgcatgaaaacagtttatctctttcaagagagaaaaggcaagccatatttcaaaagcaccagtcagtgcacaaagaaaattcagaatatacagagtgtagatcagaaatcccagggctttcctgagccacttatgttctacatcctcagaagcttgttcatcataatctttataggcaaacactatttgagaaatatttttctgcctggtaatttttgcaaatgattaagtattaacttttctagtgaagcccattgttgataaaaataggacaagaacataaaaaagtggagatggctttaaaaggaggatgtagtggttatctctgagtgctgatacttaataattaatttttttccttttttaaattggctttgttctctaatgactatatacattatgtgaaataagaaaaatattcaaaactagagatgctatttaatgatataaaacaacacatatctaagaattcagatggtttaagaattatataagtgtgaggtaagcattataaaacaacattgcatattaatttttaactttaaacatcactttcacaattaaaaaaaatcttatctacttattatggaacatagggcagacattacttccatgctatatctgaggaaatttagtcataaagattaacgtgctatctaaagttgcaaacttggttaattggcagagttggtataaaacccatatcctgatacctattccagtatatatatatatatatatatatatatatatatatatatatatatatatatatttatgacagaaatatttctgttatcataaccaggcagtcaagaaaaagttaattggatgtcagtctgaatttatcaaggccaactgttatcatattctaatgtcttatatccataaagtgacatttgctcttcattatcatatactttcttctcacctcacaatacttttaaaaagagaaaaataacatctaaatgtaaaatgacagaacatttaatatatgtagattaacatttagttggggtacacttcccaaacctatggaactatgaaagtttctagcacaattatagaacttgtgggtaataatttgaagttttacactttcagtaagataagtgtcacaatacaaataccattactcaagatttgatttcttctcagattttaacctttttcaatgaatctaaaacttgatgactagaatgagattagctaatctgtcttgtttagaatgactttacagttttttaggtttcaccaaaacaaagcaaaaaaatcgcaactactgtttgtcaaacattgccattatttctagtttccttttttcccaccagatatatcctgagagcagtctttcttagtttttcttctgtatgcacagtagtgcattgtattgtactcatcagcacaattttataataagcgagacaattagatatccagtccttcctcagctctcttctacatacttctataagcactctggattttttttaaaaaattaactttgcatcaaactttacaaaatctcctatattcttaaagccctcttttcactgagctagaaaattactctcataatcaaatatagtgggttagatggcttaaagtttcaaaatctacctcctttaacacacatctttctgaaccaaggacatgatgtacttactgaagcagaatagcttagagattaagaatgtaaactctagactcagagagatctgggttcaaattccaactgtgtcatttactagctatgtgaccttggtagccatttattctgtattgggattcctatttgaaaaaagatggggatagcaacactatcttatagagctctatcagaattacatgagatattacaaagtaacatttagtccatttcctagtatgtgataaatgcctaataaattttagagagaataggtgtcatgtgtgagggcagttgtgtgtgctgtaaaaatataaaataatgaacactgtaacattgttttattttaatatgaaagccttcagaaaagttggacatatttcaaagttatgtccaaatcaagtgactttcaaaaatgacattcctacctcgtaatttttattaatattttcaatattttgtagcacagattaggacttttatgtaaactcattatatcattatttatgttcagtaatagttgacaatggaaggaatattaaattgtatcacatgggagctttcatgagaaaaagaatattagctcatcaccataaaacatctagcatagtaagatttatagcataatgcaaaaaaaaaaatcacttgaccattaaataaagaccaaacttaccaaaaaaccctgccagctagctttttaaaaattttatctttacagaaacatgttttattttactatataagtgagttaaatatgcagtggcagtacatcttaatcacagttccaatatagagaggaacatagaggaatgtgtcacctttattatttatgcatgtttctatatggcaagcactaccacatcagtaccatgactactaatggatttactgcaaattaaccttgacatccatcagatcgctgaatgtatgaatgactgaaatttaaagtggttttcagcaatctccacatttaagctgtgcagcaagcctctattactcactctaaattcattaacaaagctggctctatcagacacaaatttagcaatgtcaacatactttacactccaataaatgtttgtaaaaaatatacatgggctcccgtatctcttgtttaaactgcctgtgatgttataatcagggaatatttttagatcttattgaacatgctatttacatatagggctctctcccttcttgttctttcttgccaactgtcccttgcctaagtgtgcccacttcagcctcacgtcaattctgcaaaggctaacatattcccttacatagattgaaactttctgaaaaagaaaaccaatcagcatgtacaggtctgctcaattattggttgctctggatccttgctacatgaacaataatataattaacttcggagtagattagcttctaactcataacataagtatatgaataaaaggttactttttgaaagcctataattcttcaaatgtcatcttgtagccaacacgaaacattcaggcaattatgtttctattaataaatgtaacaggaatataacacttccttcagtgaaagtttacagtgaaagccaggtacccagatgaatattaaaagtaaagcatttgtaagtaaggggaacctttattctttctacaaccttttccagatgctgttgttaatttgaaattttctggagaatttctacctatatggaggaattctttggcttaaggttcataaaaagcaaaagcacagagaagaccacattgtatgcaaaaagagttttagatcagggcaacatttctaaactgatgaaacagaatcttaacaatcactaaaacaataacaagtaaatacactttattttccttctgaattattgtaagttctttgtagaatcataaggaattatttcatgaagctgagcactataggttcctaattactaaaatttcatataggcatattaaaaattcagaaaaagtgaacatcttaggagaagttaatggaatcaagtaatgagtttctacctataatatgtaaccacttctagatttaaaaattaattacaataattactaatattgagaagtaaggcacagccctcaatgttacatatgcatgtaagggtgcaaagacaaagatgccaggaaaagaaaaagaaaatatggactatatatcataaattaagacttctggtgggaggggcagacaacagaattggcaaatgtgttataactagctaaagagattggagaattagacagatttttaatcacatctttgagaaagagaatgcatatgctctttataaatgaaagaaggcaagaaacatgacatgtcacagaaatggtttaggcacaggtcccatattctcaatcaggtcgaaacaaaaaatgtccagaagaatttagataattcccaaataatgaaagctttatggaaatagttaaggatgatattcaagacagcaacataggtcaacagatacaaagttacggttagataggaagaatgagttctggtgttctgttgcacagtagggtgactatggttaatattattatattgtaaatttcaaaatagctaggagagaggatctgaatgatctaacaacaaagaaatgataaatatatgagatgatgaatatgctaaacataccgatttgatttttacacaacatatatatgtattaaaacatcactataagtgtgtacaattataacatgtcaataaaaacaaaacacaataaataaatttgaaaaaagagaacaatgggaagtttgtcatatatagcaaattgtatgttctgtcaaaactctaggctaaagcattttttaattattaattttttattaaataaaattaagttattaaattttaaaaaatacgttgttgactacttattaagtcaaatgcaaactgagcaagacagggagactcaaacttgtgagcacactattttcttgcattggaatttcatgaaagtgatactgtctaggatcactgtccacacactattccaccaaacaccaatcataaatttggttcaagttaatccaaaagattcttgaactcttgcaaatcagacactgtcatacctccagtatccaggaggactcattaggtgttaacaattaaggttttccaaatttttaaggggatcagaggagggtgaaccagctagactccacggtagacattggaagtctgaaagcagaagagtattcctcttcaataagccagcccatctgagattaggctctagcccagccaagataccatttaaaaaaaaattgtgtgtgtttactcaacaagaaattttaatcaaaataaaacaattgagaaaatgaaataactaaaagttactgtgattccaatgaggtcaagaatcatttctctcaaatataatttcaatagtaattatgcgcttcaataaaaaatgaatttacctctacctattggcccaaaacttttctctaataaaaatgtttttctaataaatgttctacattttctatattctctaataaaattgctatatcttagaaagaattatatattcataaatacattttatcacattttgatgtttataaaaagagtatggtacatgaaaataaagtattcattcttctaaaaacaagtgtataccactctaataagtgaaataattatttaaaatgtaaatagatccatggctgacctatcttgtcaatatcctagacattcattcagaaacaccaccaatagcagcaaagactgcacactggacaatcaaatatgcaccattcatatagaatgagatgttaatgatgttcattggtgtcgtataaaactatgactctacataatcaatgatcaatgattgatagagattgtgctgatttgaataagttattctcttttttttctgacattataagggcattaactaacatagaaaacatttctaagccttcctatctcttgatttgctgataagtgccaactgtgtgaaaggagctaagaatataaattcagaaacagccttttctcttcagcagataggatctgttcattaaaggtaaatattagggcaaaatagtttgtgtgagatgtcagaaaaatggtggtgttctgttgcacagtagggttactatggttaatattattgtattgtaaatttcaaaatggctagaagagaggatttgaattttctaaccataaagaaatgacaaatgtatgaatatttgtcaaatatttgacaaatatatgttattcaaccatgttatcatctattttggatttttaaactgctttttaagaaggtgataatattaaaagcactgattaatgaaaacctaagattatcagaaaaaaatgataagaaaaatctatgtgtgtatatgtattttcttttaggtcaaagtcatgtaaatagttgagtagtttgaaataatgttcaacccaatgaacactacttttaaaaatgtatgcaataagtggtccacttagtggtatctttgcaatatattttcttttacaatctacttattattttcctggcaaatgtgtcatttagaagtatcccctccaggaacagttgagttcaatagtttgagctgcccagagagacaaacttgttttgagatcaaattcaaagtcctgggaactgcttaaaaggctcttggtccaggttacctggctgagtagaaaaacaggtaagtagtagaacttttgccaatcagatcagaaaaaattccataaagacagcaaagtgatctagaattaaaaataaaacaaagcaaagtaatcccacaaccaataatcctaagaacatcaaatgcttatgtcttcccttctgaaactaggctccctccagcagtaggtgaactttattaaaaagtctctggcaagtaactcagtaatcaatttgtattaaagctataggcagcagggataggaagaaaaagaatcacatcatcaggaactttaagaaaaatctattttgaagagcataacctaagtgtgcatgttcccagtaaactcttaaaattattagctggtcggtagaagttgtagttgcctagcaatgtcctttaacttacttatttcaaaggttaattgtgaaaatggctttcattaggattcaagagtcaagaattttctttactataattatggtctaaaaaatgtccagtttaaaaaaaaaaatgacataaacatagaacttactgccgaaatactcttggagaaaagtgagtaaattttccaatttacaaataacaaaactgaggcacagagaaaccaagtgtcttctcaatgtcaaacagatgggtgcaggcttgtacttaactctattcttagtgattttttttttctatacaacaaaaagctaagctcaaatgactaattcttatttagaaaaataaattataattcacaaatcaaggtctcatttcaatcattttagagtttttctaatgatgcttccctagtctgatttggggaaagtttctataatgacacttaacagaaatgattcactcacattctgacatttttagagtctatcctgaatctttaaaaggtgtgaggtatctgcaatgctttattgtaaacatcctctctaagcagccatccaagcctttggcttattctgaagcttctaaattgtggaccaaagctacagaagacaaattttccttatttttaccacagtcacttttactctataccagaaaggctttatgactttttggcagtgacacttctttttgtccttagcaatggaattaaatccttaatacaaaagaataggtatttattttgaattatttgcatcgcatagttaaatagaagggaccatgcaaacaataaaatttgtagtaattttaggctaaaaccagaaccttaacttttgtttatttcctaatgttagttctactcatttatcttcttcctgcctatctgctatacttaagtcattctttacctgactaggccctcgtcaaaaccatttactaattattttggactggaacagaagggaatattagtttttgactcagaaattatctcagactaagctctaactggatttacctaggcattcacaaatgcaatacacattctcctctcaaagtcacttttacttctgctggtttaggcttctctgctgcaccttgatttcttttgtcatgctttccacattcattccagccaaggttaattctcgcctttcaacatccactaacttatttttaatttttgaactattataatatatgagaattgtcttttattgaaatatccattttaaaaagtatgcatcctgaagaaagggatcttgctttaattctaggtatccttataaaaaattatgtgcttttattcacttactaattattaataatgactaatacactcctcaagctaagtcaggaccactgattcaatgatgaataccataagactcctgattctgaaacaagcataggaaagatttatttatgtgatccatcccatgcctacatccatcagcatgatggagtatctgcagctatataagaaattggaatgatttcacctaatacaacaatctcagataaggacacagattgcctaaattattctgataagaaaaaacatggtcgacttagttatacctgggtaagaaataagtattatgaagagacatgggactcctcaacctggtaatggtgatcacatgaaaaggagcaccagatctcacagttcacttgaatagcatagccaaaaattctgcatattttacagggaaaagctggatataccttgctagtcctcaggctttaatgatttattaatactcagagaaatctgacagatagcaccttaaccaggtgatcaaagctagcatcaccagtaatgagacatatcaaattcaggttctccaaatatggtacactgaggacactgcaacattctgtgctatttttggcaaaaattcacagtctcagttttagttttccaaaaatgcatagtctcaatctaatcataagaaaacatctaacaaacccaaattgaaggacattctagaaaataactggcagcactcatcaagagtcgagggcaggaaacagagaaagactaaggaactgtcctagattagagaaaactaagaagatatgacaacttgatgaaatgcaagatcctggctttgatagtggaccacagaagagggcattagtgggacaactggcaaggtttgattaaggtctgactcttacttaataatactacattaatgttaatttcctggttttaatcattgtactctggatatatgagatgttaacatttgtgggagctaagtgaagacacaagaaggctcttttaattttttataacttttttgtaaatctaaaatttcaaaataatttttaaagataaatatattagtcatgaagagcaatttagaatctctctcttttttattgagacagagtctcattctgtcacataggctggagttcagtggctcaaacatagctgatttgcagcctcaaacacctgggctcaagcaatcctcccatctcagcctcctgagtagctggggcttcaggcacatggccaccatacttggcgaattttttaatattttcttagagataaggtctcactatgtttcccaggttggtttcaaacttctggcctcaatagatctttctgccttggcctctgaagtgctgggattctgggtgtgagctatagtgtacaatttagaatcctgaataagattcttggccatgggaatttatgcaagagaggtagcttgagaaacacctacctcttgaaatgaagtagagtttgagattttgtttggctataaaaacaggagagcatttagaggtgggcagaagacatttaacttttgttctacctaataaatttgcttaacgcagagctctttgtaaataaatcattattaagtctttaaaatgaacatattctaaaaatgcaagttaaaatagaaattgcctaagtagagtagtcaactctgggatcagttcacccaaaaagacagacaacttattcattcatttaattcttttatcataatgtcattgtaaatatcattgaaattcttatgaaatgttttccagtcttaaaaccatgtagatacatagttttaagtcagaatacatttttcctgtcttgtaattagaacttcttcacattagtgtgagctaattccttccctaagtttggaatctaagagggaaactagtgtaaacaaatacttgtatgtgtagaaattggcatacgttttgggctgggtatggtgactcacacctgtaatcccagcactttgggaggccaaggcagaaggattccttgaggccaggagtttgagactagcctgggcaacatagcaagatcctgtctttacaaacttttttttttttttttttaattagctgggtgtggtggcacacatctgtagtcctagctacttgggaggctgaagttggaggatcacttgagcccaggagtttaaggctgcagtgagttgtgatcacatcactgcattccaccctggacaacaaagtgagaccctttcttaaaaaaaaaaaaagaatgaaatattgtggttatgatgaaaaagatgattcaaaaggcaggggatggtgataattatagaggaaggactcatatctcttctaataaaacaagacaaaaaaatcctatgagagatcacttttagatttcttgaaagtttaaaaaccagatggcttagagaggtggcagggaaaaactctaactcaaattaatgagtggggcattttgacacaaacaaacaaatcaacaaaaaacaatgcggagacaacagcagaaatatattgctggagacagaatacaaaggcaataaaatagtataatttaagaataaaaacatctgtatactcaataaatactaattaagcatttactatgtataaagcaccatgctagatcctgatgatgataaaaaggtgtgacatagctctgaaatccagctttttctcaactatcatgacccatccaaacacatgtcatttctttcctttctttttttttttttgagatggcgtcgcactctgttgtcaaggctggagtgcaatggtgtgatctcagctcactgcaaactctgcctcccgggttcaagctattctcctgcctcagcctcccaagtagctgggatcatagatacgcgccactatggctgtcaaatttttatatttttagtagagatggggtttcaccatgttggccaggcttgtctcaaactcctgacctcaggtgatccgcccgtcttggccacccaaagtgttgggattacaggcgtgagccaccgtgcctggcccagatttcatttttgaatttctctttcatatttccattcttaataccatccgcatcaagttaaaaataaataaataacttttctaataaatactttactgactgacttgctttactgacctgctaccttcttacctcttaatttaaatctcttttataaattaacatcagtttattttttgaaatagtattgctaattgcttctctattcaaagaccttcaatgattaagtgactgtctcccaaattaagaatttatggtaacttggactaccttatgtacaaaccaaccctgtacttcaagcaaactggagaatttgcttgtctcccaaatactcccaaattattttcatagaagataaaatttaatatggctctgaaaagataagagcaaattttattggcaggattttgatgaggaaaggcaaaaaggcacaaaatttggttttcaggagtaggttgtagatccacttatataaatggaaagtcactttttaatattttttttttttagcggaagctgatgcatttttaaataccactatgtcttatctctttgtctcttgaattaaatctccagataaatacagagcacaaatcacatagtagaaattaggactattcaaggtcagtgttaaaaagagattagataagttctagtatcttagtttattaaaaattctatgaaatgcaaatttcctttaacaaggagtcacataaattcacaaaagtagaaaaatgtaatattaatgtcataagaaagactgcacttagtaagtgtcttggtgatattttgctatttatcataaattgtgtcattctatctttatgagaaataaaatcatttctcattttttcaaaatttaaatttaagtaccgggatacatgtgcagtacgtgcaggtttattacataggtacatgtgtgccatttacctatgtaatagatattgtattacatatgtaattgtatatttattacacattgcatatgtaataaatttattacatatggcatatgtaataaatttattacacattgcatatgtaataaatttattacacattgcatatgtgtaatattacatattgtatatgtaataaatttattacatgttgtatatgtattacatatgtaattgtatattgtattacatatgtaatacaatatgtaatagatgcatctattagcccatcacctaggtattgagccccacatgtgttagcattcatcctgatgctctctctccccctggctccctgacaggcaccactgtggtgagctccccttcctgtgtccatgtgttctcattgttcagctcccacttataactgagaacgtgcactgtttggttttctgttcctgcattagtttgctgaggataatggcttccagctccatccatgtctctgcagaagacacgatctcagtcctttttatggctacatagtattccatagtgtaatgtatcacattttctttatccggtctatcattgatgggcatttggagtggttccatgtctttgctgttgtgaatagtgctgcaattaacgttaagtgtacgtgtatctttataatagaatgatttattgttctttgggtatatacccagtagtaggattgctgggtcaaatggtatttctggttctaggtctttgaggaattggcacactgtcttccacactggttgaactaatttacattcccaccaacagtgtaaaagcattcctctttctccagagcctggccagcatctgctgtttcttgactctttaataatcaccattctgactgctgtgcgatagtatacgattgtggttttggttcacatttctctaatgatcagtgatgttgaacgttttttcatatgattgttggcagcataaatgttttcttttgacaaatgtctgttaatgccctttgcccagtttttaatgtttttttgtttgtttgtttttgtaaatttgcccaggttccttgtagattctggatattagacctttgtcagatggatagattgcaaaagttttctcctattctgcaggttgtctgttcactctgatgatagtttcttttgctgtgcagaagctctttagtttaattagatcccatttgtcaatgtttgctattgttgccatttctttttatgtttttgtcatgaaatctttacctatgcctatgtcctgaatggtattgcttagattttcttctagggtttttacagttttgggttttacatttaagtcttttttttttttaacttttttaaaattttatattttaaatacattttgtccttttttttttttcttttttcttttctttttttttttttttttttgagacagagtatccctctatcacccaggctggaatgcagtgcgtgatcttggctcactgcaacctctgtctcttgggttcaagtgattctcctgcctcagcctcccaagaaactgggaatacaggcatgtgccaccacactcagctaatttttgtacttttagtagagacagggttttgccatgttagccaggctggtctcaaactcctgacctcaggtgatccacccacctctgcctcccaaagtgctgagattacaggtgtgagccactgcgtccagcacatttatatctttaatccatcttgagttaatttttgtataaggtgtaagtacggggtccagtttccattttctgtatatggctagccagttttcccaacaccatttattaattagggaatcctttccccattgcatctttttgtcaggtttgtcgaagatcaggtggttgtagatgtgcagtcttatttctgagatctctaaactgttccattagtctatgtgtctgtgtgtgccatgctgtttggttactgtagccttgtagtatagtttaaagtcaggtaacgtgatgcctccaggtttattctcttcatttaggattgtcttagctatacagattcttttttggttccatatgaattttaaaatggttttttctaattctgtaaagaatgtcaatggtagtttaatgggaatagtatttaaactataaattgctttgggcagtatggccattttcatgatattgattcttcctatccatgagcatggaatgctttttcatttgtttgtgtcctttcttgttttcttgagcaatggtttgtagttccccttgaagaggtccttcacttccctctttagctgtattcctaggtattttattgtttttgtagtaattgtgaatgggagttcattcacgatttgactctctccttgtctattggtggtgtataggaatgtttctgatttctgcacattgattttgtatcttgagactttgctgaagttgtttatcagcttaagaagattttgggctgagacatgggggttttctaaatataggatcatgtcgtctgcaaacagagacagtttaacttcctttcttcctatttgaataccccttatttctttctcttgctcgtttgcactgaccagaaattccaatacaatgttgattggaagttgtgagagagggcatctttgtcttgtgtcagttttcaagaagaattcttccagctttttcccattctgtataagatttgctgtgcatttatcataaatggctcttatgattttgagatatgttacattaacacctagtttattgagagtttttaacgtaaagggatgctgaattttatcaaaagctttttctgcgtctattgagataatcacatagtttttgtctttagttctttttatgtgatgaattacatttattgatttgtgtatgttgatttcaccttgcatcccagggataaagccgacttgatcctggtggataagctttttgatgtgctgctgcctttggtttgccagtattttattgaggatttttgcatcagtgttcatccaggatattgacctgaagttttctttttttttgttgtatctctggtaggttttgatgtcaggataatgctggccccataaaatgagttagggagaagtccctccttttcaattgtttggaatcatttcagaagaaatggtaccagctcccctctgtatctctaggagaattcagctgtaattccatctggtcctgggcttcttttggttggtaggctatttattactgccttactttcagaacctgtttttggtctatttgggaattcaacttcttcctggtttagtcttgggagggtgtatgtgtccaggaatttatccatattctctagattttctagtttgtttgcatagaggtgtttatagtatactctgatggttggttgtatttctgtggggtcagtgatgatatcccctttatcattttttattgtgtcaatttgattattttctctttttttttattagtctagctatcagtctatctgtcttattattttttttcaaaagaccagctcctggattcattgattttttgaagagtttttttgtgtctttagctccttcagttctgctttgatcttggttatttcttgtcttctgctaccttttgggtttgttggctcttggttctttagttcttctagttgtgatgttagggtgtcaatttgagctcttcctagcatttttatatgagtatttagtgctctaaatttccctcttaacaatgctttagctgcatcccaaagattctggtacattgtctctttgttcatttctcaattttttaagtggtggttttatgcttagtagaaacagtaacagcaaaagaaataaaaaaatataactttggtttgtttgtttactcattccttatctcaagcctactccaacagcctatgaagatggcagtaagagtaaagttcagccatttctgtgatttatctatccacatttattttttttgtagacactgtcatgctctgctgctctgtcacccatgcttgaaagcagtggtgttatcgtggttcactgcaggctcgacctcctgaactcaagagatcctcccacctcagcctcccagatagctgggtctacaggcgcacactaccacacttggctaatttttgtatttttttgttgagatgtggttttgccatgttacctaggctagtcttgaattcctgggctcaagcgatccacccaccttggcctacgaaagtgctggtattacaggtataagtcaccattcctggcttatccacatatgtttataataacggttataaaaaacaaacaaacaaaaaaaactggaaagttaggtcacttacattgacaagaaattgtgggtatctgtaagatttataactcaacgatataagattttttaacccatgaagttctttggccaattaaatttaacaaaggaaatggattttcaagtgaaaaagaaaagaaagaggttctctatggagaattttacattttaccacccatgtgaagattataactatgtatgagagtcatttttgaagttgaaataattgaaacacaagagcacggattaaagtaccaaatcagacatggggcaggtaagtgtcaaatcttttttcttttgtatttggttcaaaaaattctatctttctagactaaaattacaaggtggttccaatttgcacatcagatccttgaacactcaggtccccaatctcaaaataacctcacatttgaaacatacgtccttaagctctgaagtgaaaatggtggagaaaaacctataaaacagaaaggatagaacactcagaggtgaagcaggcttccaacttaaaaattcccagttctagggtcattttaaaaattttaattcattttaaatgggttattgtattcaaataaagtttgcatgccatctgttttcaaagtcatttaaattaagttttatgactcatgaggaagagaggccatttttaacacattatagtctgcttattactatcattaactaattaaaattaattattaagagtgattccttttgctctcaaatcttctagatcatttatcaaagaatgacatgactttctcttccttccttggaatactgaagtcacagtcatatgacttttgggtagatgctattgaaatgatgattttagtcagatgtttaacagtaacgctgtctaaaagctacatttaaccaagagagcagtatttttgaaacagcaggcagtataaaactgctttgtgaatattaacatattctagcaaattagtttgcactcattatcataagcaattgcttactgtttagatgcagcttgtattaaattggcaagcaatttgcaagaattaaaacataacatggagagctttctgaaaactcagcaatatcctgggagaaatgatgctactaggttcacagaccatgtaccaaacgtttttacccattaaacatatttagcattagaacaatagttggttggctacataggtttttaatgtaagatcattttctaaccgctgtttggacaccatcaacagaattttatatatcagacatttaaagactttgttttaaaaagcctgaggagaaagtaggaaggctttgttttctaaaaatgaactagctatcaatttgactaaattttgatacttcaataacctattgcattgtcttgagttactttatgctacccaatttgtccctttcacaaagtttctgttgtcttgatcattctttccatttattcctgagttggattctgctgatgtttacccctatccactttactttctttaataacagaacttttgagtgtcagctgagcagatagataactgcgtagagcctacatttcccattctcttttacagcttgaagggtctattgactaacttctggccaatgagagatgagcaaaaatgatgtgtgtttattctagttcagatcctgaaatgtgtctgcattctcctgcccatttccctctttcttgcctagtgatgacaaaattgaatcagctgcttcagacttcgagatggaagccaaaggttgagaactgtacaatcctatcctaggacgactgaaatgtgactattatgtgagaaaaaagaatcttatactgtgttgagagatgagtatttctgggtctcatattgacagcaaagggtgtttatccaggctttgaaaaaaatgacctaacatttccatgtatttttttaaccttatgaggcaagtaaatttgatagagaagctattattatctccattttatggatttaaaagagattaatattcaaagagctaaaattatttgtccatggtcacaaagtaatgtaaaactttttctgtcaaaaccttccacaggaggctaccgataatctattacctttttaatagtaaactgaggttacctaccctgaataattctatgggaggtcacatgtatttatggatttccccattctgcaattctttgctccttaagaaaacaaaatttgcaaaacacagtaaaggatattgcttgtaatatgaaacaaagttaaaataactgacccacacaagcccctcagcttgaatagacagcatttactttagaaaacttttaaatactttctccaccttttgagatttaaatcttctcccagctttttgccagatttacggcttgaaaatgtctttctcaagggcctaggagtcatctatttgaaatgtaatcatcaaggaagacagtgctctgtctaccagtatctgaaagggtaagagcctaacctctggaagtgccaacgagtaattttttctgtactatacatataataaaggactaattaatgggaagttggataataaagaaaagtgtaatgtattaaaatctgtacatcagcaaagaaagataatttaaagagtatcgttaaagtgctacggagtactgagaaaagagactatccaaaaacaaatctagtagctagttttatggtttttcaaatgataaaattaaaatataaaacaaaaaatttaaattttttattgataaagtatctgcacaattttttttttggtttcccagtgcatataaaggttgtttatactataatgtagtctatttaagtatgcaacagcattatgtctgaaacaaacaatgtatataacttaattaaaaaatactttattgctaaatcatctgagcctttagcaagctgtaatatttttgatggtggaggatcttgcttcattgttgatgggtgcttactgattagggtggtggctgctgaaggttgaggtggctgtggcaatttcttaaaacaagacaacagtgcagtttgctgcatcaaatgactctacacaaaagttttctccatagcatacaatgctgtttgatagcattttaaccacaatagacttctttcaaaatttgagtcaatcctctcaaaccctgctgctgctttttcaactaagtttatgtaatattctacatccattgttgtcatttcaacaatgttcacagcatcttcatcaggagtacatttcatctcatgaaaccacatttttcattcatccataagaagcaacttctcatttgttcaagttttatcatgagattgcagcaattcagtcacatgtccaggcttcactcctagttttagttctcttgctatttctaccacatctgtagttacctcctccactgaagtcttgagcctgtcaaagtcatctatgaaggttgaaatcaatttcttccaaattcctattagcactgatatttttaccgtcttccctgagtcacagatgttcttaatggcatctagaatggtaaatcctttccagaaggttttcaatgtactttgtctagatacatcataggaatcactatctatggcagttataactttataaaatgtatttcttaaataaggcttgaaagttgaaattactccttccttgggttataaaatagaagtgttatcaaggataaaattatattaatccccatgtatatctccatcattgggtgacaggtgcattgtcaatgagcagtaataatttgaaaagaatctctatttctaagcagtaggtctcaatattgggctcaaagtgttcagtaaatcatgctgtaaacagcatgtcattcactctttgctgtttcatttatagagcacaggcaaagcacatttagcataattattaaggaccctaggatttttagaatggttaataagcattggcttcaacttaaattcaccagctgcattagcccctaaaagagagtcagcctgtcttttgcacctctgaaaacaggcattgacttttctccttttcagctgtgaaagaagaagatacctacatggcatcttcttcaaaaactatataaagctgttttgtctacactgaaaatctattgagtatagtcaactttatcaaattttagctaaatttttttttataacttgctgcagcttctacatcaggactgttgcttcaactgacctggaaggggagtagaagatgtgccattcactcagataggaaacatcagagaagaaacatgatgcttaagtaatataaggggtttgttatgttagaatttagctaccttcctccaggtaagcataccacatcatctctacattcctacttagcatactgaagtgtacatggaagacttttttttagtatcctgctaattaatcaagtaaataattaagaagacatcttcaaatgaaaactctgccctcttttgtagatttttgccaaactcaaagttataaacacaattaactcctcatctcttttaaaatattctccaaatgtaatatttagctttcaataatacctttccatgaaacacacatgaattggctttatctgaatatttgcagtgttccccttttttccaaaaatgttaagaaatcattttatgaaacaggtttcactatactatattgtcccaggatgtcatttgcatgtttactatttggttttctaaatacatttatcggtacaagttattgtacttagttgatctgcttcctctactcatcaaggtggtttatcatttgtggtgcataggtgagcaataggatctagtgtaacgcgggcttaggttcaaacccctgcatgtacagatgaaattgggttatctgcacttcttgtacctttcaatagtgggaggagagaaggaaatccatcactactggaaaatatgctctgtactctatcaactctgttgaccctcagcataaaatattttaaagcatttccctaacaaacaactctagttagacaatctgtatcataaccactacttttatctatgagacccctctgtctcttagaacatagtggtcatgggtactggtagcccatatgatgcctttaggaaaatagaaaaaaagcaaatctccaaaaccctctacttctgcctattgaaaattttcatgatttttgtcagaacaagacatttgcttgatatttcctagaaaattgtcatattaaatatgcaactccattgtgaaaacagtataaatggtgccaccttaacaagtgtacaacttgcacaaacatccatggcatccttttagtaagatgtaggaaatgattaggttttgggttaagacggagactcaacacatttggaccctgttgttctattggaatacaaccacactcctcagagggagaaaatgcaagagacacacaaaagaaccataattcctattcaatcactttttttaatgcaaagcaaacaccgatgacaaaagaagttcaagctttttttttttccgttttttttttttttttttttgaaagaagccgtcttacagagttgaaataagattagtcacagacctaacctgtagaaatgaaatttctgaaaaggaagacagtatcagagcagtgttaatccaagatgtatgaagaactaaaccatagcagcttaagccatatatttgaagcacagatttcagcaagacaaaactgtgacttgaaaaacgagacactcaaaatcctcaggagatcagtctcttctcctgttcctctacggctcctccaaagtacagattcaattttgagtcaggttaaattgggggctgaagtgggaatatatggttaatgaattttgtacagtcttccttcttttcaattgaaaaagaacagagaaaaaaaatccctcaaaaagacttcatgggttttactaagtctttccaacatttccccccagattgatttcagatcatgtagagacaaccagactgctaattaaactattaactctttcttctaaattgcaaatctttgagcatttacactgtagaagccacctcactaactctgaagccccgaggaatatagactttccatagattgggagggaagtaacatacacattaccctaggccaaatttgaccctgaaaatgaagtcatatgcactaactctcaaaatatttaattatttttcccagactttgcttaacaagtgtatataacaaggaaagcctctaaggtacgctcagagagattcattttctcctggagttaaattgaaaggtgacacaatgaaagctctgttatgattcttttgaaagcagcaagattatgttctcagccaatgtaatgtatagctgacacagaataaagtgttggccaaaacagaggaaatgtgctgaagtccaaagcctccatagacttaagtcacaagacataaatatacttatggaactctaatgccctaggttattgtataaaagtgatatgtgtgttaaatttttaaataaaccaaccaaaacagtgtagcaaattcagctccaaaatagattcctttaattttgaaagatatgttaacaatatagaaatatgtaaaaatactatttcttttatataaagtgaattctttacctcttccatcagagcagtgtctacactctaaattcattaataaattctccttgtcctatgtgaaaatgagtaaaaaataagattgcaaatgtggaagttctcaaccttgaatcaggaaactatagatctagtcctaattccttgctttgtgactttgccaaagttattgaaactatacaataatcctcattttcttcttctgaaaataaaggagtttttccaggtaatttatatgggcatctccagctctattctgagtttaaaatgtcactccaccaaagccggcgttaaccttgaacttgattccagagtacactgagcatgaagtagaaagttaaatttatcagtgaggcaattcagcagacaacatgcaatgacttctttggtttatatttatttcattcttatttgactttcaacaaaattgcacagaatgttttctgtattttatggctgtgaaacaacacagtagaggacattttattttgcctagcaattctttctatgattaaaattaagacataaatacagaagaattgaatagtgtatgggataagcactgctagcagttaactttttaattttctaaaatcatataccctacatggctgttctagcaactccacccaaaatcaatataatacaaaatccatagaaatagtagtctaaaaccagttccaggtttattagaacctagttatgtaattactgaggtcttctctttttaaatctataattactactgttatactaaaaaggttgggttaaatgttattaggcaaaaccaccctggctgatttgttttgtgaatacatgttaagataattcctacttagaagaacagaatcattccaagctgaaattcttatgagccttagtaggttctattgtcataaatatgactcagatccagaaagggattcattaccctattctagcagtcaattttagttgtgaaaatataaggaaaagtcaaagcatattctctacagatgtagctgcagtggtgtcattttcctccatgcttctggttgagaaaaaccaggcatcgcctcaatggtccacagattattaattcccattgtaagataatcctgccaatgttcaccaaaattatagccatttcttcttttgcatgtgttcttatgtgttggagtttttggcaaagaatttaaagtccttcatagatacccagttaaataatcctattactcattccctggtagattaataccttttgaaatgcccttagacctttcacatcatggaatagaaactcatgttttcttctgagttacatgacagtactccacacactggctgaattttgtctatcatctcactttttctttaaagcactaattggagactacatggcaaggtgatgatcatttttaccaagaggaaaacacacatacacacacacacacacacacacacacacacacacacatacacaaacagcaaatgacctgttcagtgtcataaagttggtgagcaggaggaacacataggtgttccttctgttatttattcctcagatttgaaagttctgcccttcatataactgtcccatactgaagcagtagaaccaatgtacttatggtaaggtggcactgtgtgtactctcaacaaatgttaattaaatggacttagggcaatctcccctctcacctatttgagaggtccaaatgacacaaattattatttttatataggtagctattaggtcttcaaacacatatgaacaattctgattgggatcattcatatgttatatataacaaataggcttaattacagttggtcattaaataatatatctactgcagaaactgtggaaagtacaaaattaaaaacatagggacttaaaacaggtgagaaaatttttaagtgatttgaccactgaaggtgaaggaaaataaataaagagaagaataaaaacaataagaacaataacattggttcaagaaatcagagtatgcatccttttagaggtctccaagctgtctgtgccttccatcttaacacctagttcaataacacgcctgtttagagggtggcagctacattcaaaggagtcaacataactttgtatcactctattgattggctatttggcttgggaccagcatagaccagaattggtctagaggttgctctcttgctttggagatcatttagcaagtgacatcgtgtgaaatcaatggcctgttactgctttcatcattctcaagttcagtatcataagggtccttaagatttaatgaacctagtctgttgagtgaagctttcaacctgctatatttcttctaacataccaaaatggcttgtatgggaaatgattactatcttatgcagtaggactgtgcaatctaagacttatcaattaaggataatacggcagtaagataaacatttaaattagtttttcaataagatgtgtatttatatattttccttaaagaaaaacagtgaaacagctctctactggctaaaaaaaaagaaacaaagaaaatcagtcacaattgaacgcacacatacgcacatagaaacagaatagataacattgtagaacagtcgctaggtctctggagattcattaacatttcatatccaaggagactagccattcattccttctaaaacagaaagcattttcaaagcaatatccatgtacaggtaaacgacaaagcaatcattttgaaagaaggtaaattacggtcagatgggtagagaaacaaggaggaaatgtcagacattctcatcagcagaaagaggcaacaaacagcaaaatatatatcatatatatgttaaatatatgtattatatatctatgtataataaatcaatgcaagaggtgaatgagaagtaggctgtcatgttctccagcacaaggatgatctccctaagtggtacaatgaaatgaagaaactcccccagaatattataacacagttatatgtcaattttcttaacagatttttgagtgttctgtacacacggcaggaagaacattgtggaaacatttcagtaaagagttataatctaggcctctgtctcttggagacaagaagtgggaacaagaccatgagtctcatatcaagaccacacatctattttctttggaataatgtcatcactaggaccagcagaagcttgactaatcacatgtgaaattaagtcaggggtcctagattttttcaagaaaacaacaataacaaaataggagtttaaaataattgatgggtatagcgcccaaagcattaattacatgtagaaaggttttttaaagaaaacctttaaaatttccagatgccagaaaattctttttttccaaaaacatttgatatgggagtttaatagtatcatatgaagaagtatagaaacttctccatttctgggggacttttcatagagataggccaactcaccaattctaggtttcctcatggtgggaatatatttgcttactggtaaaaaagtcttgggcaaggacaacaaacaccgaaaaaaaatgtgtactctgatctgatcttgaattcccagaaacaagcaacttcctgttaattaatcctagcaaggccagagactcaggaaagggcagctcttttctacgtgagattaaaactctctctacatatattataggtgcaccatcagaagagactggtctaagggcttatcataaagaggggagagtaactgcactgctaatctctccaacaaaagtgctactgtgattacatcatgacactataaagacctggataagtgttactgtattaccacatgagttactagttcctggacagaatgcccaagactgtttctgattcatttttgtgaaactacttccaatagcaacgaacaaagaagaaaaatacagaaaccaaaagcaagacatagcacaattcttcaggtaccaatttactttatcaagttttcaccttataaaaacagaggtgatatttggacacaagaccagaaaaagtcatcttccgagcatatgtcctcctcaccacactcattcacacttaagcaaatacatttcacccagggttcttggaagccagcattccacatttagaaataatttctttggcttaaagattggctattcttacatcttcaaatgcaagagaggagcaagttaaagctagaaaaacggtcacacaaagatagaggtttgaggaccaattttttattttatttatttctttgttattattattattattattattattattattatttattttttttttttttgagatagagtctcactctgttgcccaggctggagtgcagtggcacgatcttggctcactgcaacttctgcctcctgggttcaaccgactcccctgcctcagcctcccgagtagctgggattacaggcatgcaccacaacgcccaggtaatttttgtagttttagtagagacagggtttcaccatgttggccgggttggtcttgaacgcctgacctaaggtgatccacctgccttggcctcccaaaatgctgggattacaggtgtgagccaccactcctggctgaggatcaattttgagatcacttgactccagtttttccaagaaccaccctgaaatggacagtgtgaattcaacataactaaatatatattatatactataaatgtatatataatgtttataaatttttatatatgcattatattttattataattatatattatgatataactctataatatatataatttttatatatttagttacatataaaatatatttatatatgtatataaatacacacacacacacacacacacacacacacacacacatattttctttctagaagaactaaggtaaagttgcgtttgaaaatggtaataagagtgtgtggccagaaagaaggaagcagcaagttagttgtcaataacactggccaaggcaaactctgaccctgtctactttccagcttttgtctttcctcgatactgctttgcctaacagactcttccctggcattaatgactccgctgtgaagaaggatggtttctagtttagtgacacaaaaagatacgtttggtatttaagaaagcataaagggagcataactccattcacctatgtcaaaattacttggataaacaagtatagaaaacattagttattcttctttattatagaaaatggataaaactaaaactcaacttcatctctgtgtacagatagcatagctacctagggaattaattatttaatttgtgcacaccttatgatcatgcctcagaaaagaactgccagagcaatcccttgtataggctactgtgattctgtttttctgaggctaatgtgctctgtgaggttgtcagaaaagaaataataatcagttatttctttgtttaactggagaggcagatgaataaagcatataagaaaggtacaaggaaaagcagcttaaatataaatacaagctagtcccatttctgactttgtgtctacctttgaccaatggtgaatgaatttccttgtcactgtttctgcattttgaagaaagtaagctgtattcatattttttctcagaaatactatgttaaatgtattagtgtatgtccttgataaacaaaatgtaaaactcagaagaagaataatgtttatggtacatatatttcttcaaagtaagaaagaactattcatttcaataatgccacaattgaaaattgagccataaacatcctgaagggccccaaagttgaaaacaaaaatgaataagactaccaactttttaactttttcagaaggatgaagctgcttgcattctttggggagcaaatgttaggcttttttcctatttaaattaccacaacattgtcacgatctgacattcgatttataacaactaatcaagaaatatttacctaatgcccatagcatatgaggtattatagggaacgaaaatcttacacactggatatttaagacccctattgagggtaagccaaattagaagtaaccgttgtataaataatgctcacattttaaaagcactttatgattttcaaaatatgtttcacattggtcacttcatttaacagacattatcttatttgaagtccaagaagagagagatccagaggtggaagtgattaaaaaaaaaaatctgtgaatttaaggccaggcacagcggctcacacctgtaatcctagcaatttgggaggcagaggcaggtggattgcctgagctcaggagtttgcgaccagcctgggtaacatggcgaaacctcgtctctaccaaaatacaaaaaatcagctgggtgtggtaacgtgcacttgtaaacccagctacttgggaggctgaggcacaagatttgcttgaacccggaaggcagaggttgcagtgagcagagattgtgccacttcacttcagcatgggtgacagtgagactctgactcaaaataataaaataaaaataaaataaaattctgtgaatttaaacctgagctggcatttgaaagaagagttgggcttgaataagaaagagaagaagccaattatgactgaaaattgctttgttctttaattttcataaacacataatttactagttccttaagtacacaaatatatgctttcttattatcctacttaggcttagtactacacccaacagtgacctggggagcacatactgaattaaccaatagggaggatttgtccttctgtatctattttgatcattaacaggacactttacaaagtagctggggagttcagagtatagctcatggctatggaatataattgagctcacagactcagggagtcaatcccttcacttaaggttcattagcctgggttccaaggatcccagggggcgattccttccttttctgaatccccatagcacacatcacccagacaatgtctgtaggacaactttagcacttcaaatgaaatattgtctgtgagatctttgcttttcaattgattcgtgttatctttgtcttacctcccaattaatctccagagctccttgtagataggaactatgtcatccagattctttatctaggccacatagcttctagccaattacttgacaaagcataggtgcataaccaatgtcttctttgtgcctctgagttgcaaacgcagttgtatatctacgttaatgaaacgatgcttcatgcctgtattttaaaaactgatgcctagacaggtgagtaatgccaagcagactatgcaagctcttgtggtttctgattatcagataagagtcgcttaatttggtaattgtgacattgtagatatggaaagtatagtaaaagccaactagtgcagaaccctcattttttacatggggaaacagacttagacagggaaagtgccttgcctaagatcacaactaatattgtgcaagaatctgttgtgggctcagcatatggtaggcaattatttcaatgaataaagaagtaccagatgtgggtcacatggtcccctggcactccagccgagaaggcaacttggtgttatttctatgagtccttgcaggtgtggaatactgtatactcttccctttgctgtattgtttctgccaaaataattgtattttgtagctgtattttcacttaaatataaaagcagctaaaagatagtatgcactgtatttcccaactttgtatttaagtccatgattacgtctacgtatttacacagattccttttcaaaatacttacaaggcatgcaccaaaataataacagattatatctggccaatggaattcttggtgactttaatctgactttttaaacatgtcaacatatctccaatattgtcatgaatatataaacaaacattaattttatagctagaagttaagtccagtaaaaatatgtttttaaaaagaaagacactacttctacacctgccaaaagcctgccgttttgcaaactagtcgagttttctcatgatatataaattagcgcaattttgaaaatgtaaatatcaattattgtgttacaaaaaaacaacttttaggatgtgggaagcagaggttctgctaacatagagtttaacattgagccttaaagaggcggaaaggtctaatttgggaaaagactcgttccttaaattttactctagtttttctttctatttccctccataaggaatttataaactcagactttaaattccattatttggacttacaaaaagcacattctgttaaaacaaaattaaattaaattaaattaaattattagattaaattaaaaagccctatctgcatgataactatcccctccgtttctgaccaaagtctcacagaacttcccccattatgtgttgaaggaaatttgtatttcaaggtacaaatgagaatgactcaaaaccatgtgggagaatcccagatgcattatatagattaagtgggtgtggtgataaaaaagattaggggttaaataaaatggttgctggtcaccatgagcctcttattttgtattactaaaattcaacctaccatcatttgtaacatgagcgtggggaaagtaaattgtgaattgcagactattttgtatacatatgaaactttaataattatagatccactagctagactgagaaacactaagtacttctagaaaatattgagcgttgtgagaatttgcttaccttaagtagtattactatttgtatttggagtcctctaaactatgcaaaaggatttaaaattggagatctttactaattaaattgtttattcatcctttctccagaaaaataaaaggtatgtctcagctcaatatatttcagaactatcagaattttgaattctaaaacagatttttcccattatacacacagtttatcgacaccgtgaaagtataacgtacaagcaaattatatatttatatgtaaaatgcatatagatatagtttttttttttttttgaaacagagtctcatttgttgcccaggctggagtgcagtggtgcgatctcagctcactgcaacctccacctcccgggttcaagcaattctcctgcctcagcttaccaagtagctgcggctacaccacacctggctaattgttgtatttttagtagagacgggttttcaccacgttggccaggctggtggcgaactcctaacctcaaatgattcacctgctttggcctcccaaagtgctgggattacaggcatgagccactatgcccggccatatacagatataggtttttgaataattgtctttcaaatactcatgccatttatgggtatgtatgcaattatatgcacaactgcatagttacaatgatataacataaatgaaaacaattcagaatactaaaaagtgttactcataagtaatatagtaaagtagtgtgaacactactggacaatattgatacaaaacacaaaaatgcagtatttcacattagcttttaggctacctgattgaaatgaccttttaaaactcttgtggagtctgataattgaacttagctaccaataatggaaagtatcatgatttaaagaggacagaatgttgtattttgtctacaagaaaaaatatattttctgtctacagaggagtataattaagatttagtagaggaaaaaccagtgataattgtcatattcctctctttcactctcagcatccaaatgatcactcaaaatggtcattttttaaattggtgcagtgcaactaagagctattttaggaatggttatttccataaaattctattctattttcttcagtcttactgaaaatggtgctttctgtctaaaccatcaaggtgttaaaacatattaggacaggttgaaacccaatgagagcaagtgacacattttaacaagattttataggtcactgtcttgcaaaaatgtaactcaaagtacatttatgggcacacaggaaaattttaacaactgagaaacctattcataaatcttgtacttattttaaattaatttattagattatatacatgactggcattgctaaaaaatgtaaacttgcctattttggtgaataacagtacaataatggtactttccttttccttcataaacaaaattttttaaaaagacaagagaaaaaaaatcaaataaaactaaagaacagccaatctatgaagaagtatttcctatggactgcactgaaacttggacctaggtaaaggacgaagcactaggtcaaaagccacccgagaggtaatggactatgcagtctgagttcctccaagggggggtcacacaatcccaaggatagacttaatatttatttacagaactcaaagtgcttggaattggggaaatgggtgtgaggacaaattgcaggagggtccctgaccttggggagcaggtctgactcagagaacacacaggctggctgttttgcatgaaatagatgatgatttagcaatgtggcggagaaaacgtagaaaacaagaagttctgtaactctccattttggtcaaccaaagagaagtacattctatcaccacaggtcagacctatgacaccagttcactatagacctaccatctgcaagtggagacagccacaggaaaaggtgttttggtaagggtggagaaagagacagtaggagaaacgtagctgactgcttctttagtttaccactactatattagcattcaataaaacttgatactgaaaacaacagctcccattgaacaactggaggtagaaaaaagtggcaaacagaaaataaataccaaaaatttttccaagatttagccagaaaatattgagaatctagtttcaatgaagtcaaaagaaaacacagattctctgaaacaagagtctgaagaagagatgaagaaagtaaaagtagactaaaagcaggaaaaaatggaagagtaaataaaactatggcataaataaaatccactccaacagttaattcttcctctttcaatagaggctcaatagatacagcataaagtgataatctccccaaaagggaacttaaatatacaaattacaagaaataaaaggaaggatcataaattttccagatttagaataaaactgcaaaaacacacagattgccacataaacacattctaaaaatgcatgctacttattaaaagagaaatttaaaaagaaacccttaatgaaaaaaaatgaatttgtaatacataaagaatttttacaaccaataagataaaacccaaaaattcaattaaaaactgggcaagtctgcataggaagttcatgaatttaagaaattgaagaaacatcttaaaaaacacataaaaattttaaaagaagtggctctaaacatacaaaaacatgtccaaccacctagtaaagaaagatcaatgaaaacgacattgaggtaccattggcaaatattgaaaagattgacagagagcgttgggcaactctcaacactgttcaaaggaagggaagtttggattcaaatacattggaggaaaatttggcaatctaccaaaatgaaaactgcacaacattttccccccaataattacatttttaggactttatcatacaaatgaactgaaacctgtttatataaatagccagtttaattaggccaagcctgcattaaagttagttctcaaatgagttaaacagtttccattttccactttcttttatttgtctatgtcttaacccaaaactcatgcaaaattttccagcatgatctctccccaaaatgtgagtagatgaaagatctggatggtttgtgttttcgagtgctattggtaaatcagaaattttttaactttaatgtgcaaatctcatttttacagtcccttattaaatttaaatttggtataaattgaaggagctcactatatttaaaataacaatagaattgaaaacctgacataggaagggcctgatacatcttaagaaaaatttagtcaagtataaccttaatatttatatacacaacccaaagtccatgttaattccacttggtattactatataaaagagattattatttatgcagccaaaaaacatatgaaaaaaagctcatcatcactgcttattagagaaatgcaaatcaaaaccacaatgacataccatctcatgtcagttagaatggcgatcattaaaaagtcaggaaacaacagatgctggagaggatgtgtagaaatgggaaggcttttatactgttggtgggagtgtaaattagttcagccattgtggaagacagtgtggctattcctcaaggatctagatctagaaataccatttgacccagcaatcccattactgggtatatacccaaaggattataaatcattctactatgaggacacatgcacatgtatgtttattgcgacactatttacaatagcaaagacttggcaccaaccgaaatgtccatcaatgacagactggataaagaagatgtggcacatatacaccatggaatactatgcagccataaaaaaagatgagttcatgcccttcacagggacatggatgaagctggaaaccatcattctcagctaactaacatcattctcagctaactaacacaggaacaggaaaccaaacactgcatgttctcactcttaagtgggattgaacaatgagaacacatggacacagggaggggaacatcatccaccagggcctgctgggggttggggggctacgggagggatagcattaggagaagtacctaatgcatgccgggcttaaaacctagatgatgggttgatgcgtgcagcaaatcaccatggcacgtgtatacctatgtaacaaatctgcacattctgcacatgtatcccagaacttagagtataatttaaaaaaagagactattgcggagactgaaaaagagatagaaggaagaaaaataaactaaaatctgtaaaaatagacatcacttttcaatataaaatgtatctcaaactttctgaagatattgcctccattttttaatctctaaaatgagcataggctggctgccaaagtccacaatgtaaatgttaacaaattatagtcaaaaatgcctttcaactacttaaaaaaaaacccataaaaatgtagttagtagtcgatgttgcctaaatagagtctcgaagcctacaatctgtaggctgtagaagtgaaccaagtcaaaatttaaaaacaggcttctgtacaacagattttctctgtatacttaactcacattagaagtgtggcatgtgttacaaaattgatgtcagatagcttagaagacttcatatgttttgaatgacaaggtattgaccatggtttctgcaaaagaaactaagcatcataaaaacagatactttaaacaccaagaatatcatcactccatttgttctgctcctttagaggtcctgtgtaattggaagtgaggctactggactacaatgttatcttttacaatgaactaccaaatttagatgtcagagtgacagttgaagaaaattgcttgaatgggaaataaatgaacagtcacagaataaaccaagtctacttgcccaggccttgtgttattaactagagggatgattactgcagcaagaagtgatagcttataaaaattctatgaaaatcaatatagatttgcagattgtaacttcaacaaagatttgatttgtcaaatattagtctaacttgctttattcagcacatgcatttctaaaattattaaagacaaatattcatgattgaaatctaaatgcaatattttttagaactcttgtttttaaatatttaaagtttcagacagaaaaaaaaaaatctattcatgggtagttgtcttcacttactatagtcccagaacataattgttgccccttgacttttattcgaagatttggcttccccacacaaaatttgtctttgtctaacacagtaacactttatgatgtcaattaataattattgattcattgagtcccttctaattcacttacattaccaatcagtagttcattttggtagaattcattccttatgtttaggtaaatgtggaaactttcttccaaatacagctccttcaaatttaaaagaaaagtgcctaatctttgtctcctggatttttggcacgtagttatcaatagaacatagtaaacatagcagtgaattgctgtataactatagtgtcaaaagccatgtttgtttaatgtgcctgcattctgccaaataaattaaattgttcaatcactgtttttgatgataataattatcatattattacccattcctaccttgcaaaaaaaaaaaaaaagcccagtctgcaattttgctggttaatttaaaccagaaactaaactgcaaaatggaaatatttaaaggaaagtagcctttgtattcaagcagggcttactcaaccatagaaacgtgagaaactcaagaacaaccacaacaaaaaaaggcttcttgatgcttcttttgattctaagggggaggtttctttagcttaattttttatattattgcagggaatccttcaccttatcaaaaccacacagctgttaaaaaataataaaaaataagaataaaaagcctaacactcattgtgcttgctgtctctttggaccaataaaaagcggaaagtatgagatgaacatgatacaagtatgtttatataacgggaagaacattaaaaggtagagtttctgcaaaaatgaaaatacctcaaacaattaagtttgttgctttaaagcaagattatagtgtagggcttgagataggaattcattagatatttaaaatgcagcaattattaagtctgtgctaggatcaagttttgcaatgggaatacttacccttggatctcagaggagaaagaaatacatccttctccattagagacctcagctacatgatagtaacttttatttaaaattttaaaaagaagagtgaccaaggtgttatacttattgtcaaaggcactttgcttccctagcgaaaacttgacaacattgtaatctttctctaacagacatgttgcaaagctgcttgccatcttgtagtcctatatgatttccttgcatttccagttctttaggaaatcccctgttttaatgatctttaagaggggaaaagacccttcaatagagaacttgctatttatgccaaatttgaaaaagtagccaaataaaaatgggctataaatgaggtctctttggccatttcaatccaatatagtcttacttctagcccccctgctttgactagggctctcatttcatgtaagcatcatggatttgatatttacctgtatgacaaacagttctacagaaggatagccttaccttttaattaacacagttagctacactatgaaagtagaaatattcgttcagaatgtaagaatgtttttaaaatattataactctctctgtataaataaatggagtttaaaacaacaacaacaaaaaaagcctaacatttgtatttagaagatacaaataactcaggagccacaaaacaacagtcgcctgttaagaatcctattaagaattctgactttttctttactttaaataagtaaataaataaatgttaaaaaatggagtataacactctactctgctgcttgctggctttcctaacaatgtgagcagttgacattgcttggccaagaggaactcaaaaaggtccgtccttccttccttccttcctccctccttcccttccttccttcctccctcccttcctccttccctctctccctcccttccttccttcccttctttttccttcctttcttcccttctttttccttccttccttcctttttccttccttcctttctcttcttctctctccctctttctctttctttctttcttagccaggagattttaaggagtcagtgtctagaccatctttgttttgatcaccaagctcagtagtcaatccatagatgaactattttagaaaaatattttcatgtcagtttgtagctggactgctttggtagcacacccattaaagcacaaactcctttaaattcacagtgctttgtgtctgtttatacaattcccaaagcataaaaatttcaggattggagctgaagggtgcacccatctttatttttctgcttttgatgcacccttcaaattgcttcacacccttctatacaatctaccttgatcagaaatatgtatttatcatactattaggggaaaaaagaaacatatgttctgagtggcaattaagttaccagcactgttaaggtcctggttattttatgtaatctaccatataactcaaaacatccaacaatattggccaaagacattgaccatagatagtgctttcttatcttttcctttctctctctctttttttttttttttttttgagatgaagtctcactctgttacccaggctggagggcagtggcaggatcttggctcaccacctgccaggtttaagtgatcttcccaagtcagcatcccaagtagctgggatcacagacaccacccaccaccacacctggcttttatatatatataatatatatatatattatatatattatatatgtattatatatataatacatatataatatatattttatatatatattatatatatatatatttagtagagatggggtttcaccatgttagccaggctggtgaacacctgacctcaagtgctccgccccccttggcctcccaaagtgctgggattacagatgtgagacactgtgcctggccattgatcatagatagtacctttaaaaacgtatctcaatctaccacttctaatctgagtgaaaccgtttgaattgggtccaaaggttaatcaagggcccctgtattttgttaatatgaactctctaaagggctttatatttacgatttgttttaagctgcttactaaagcatggtggaacatattttacctgctaaaaaatattctacaaaagcatcaaaactgaaagatgaaaattaggccttactgagaaaagaacccctttatgtccaaaacggtccaggataggctggaattcaattatagtatggcaaaatattgtgaacaggctgagataagcaacagctcgaagacttcttgggttgattctagtaaaaaattatttaaactacaaaataacttaatgatgtgtcactggcctgacaaaccattaaaataatctagaagtagagatttaattacaaataaagcacctcttaaaatattaattcctaaaataaaaatgacatgcttatccaattatatcacaatccactcatttcctcttcccaccaggctgaagtttctctttttatattttaaggcttaaaataacatgggtttaaacattttgatatctgtggcatcatttgtcagggactatcctattttgtgggaaccactcttcaaatcattggcctgtacaaaatacaaataatggtgttagtgttactacttgtaccttttccaccaaatgacccaccagttgcttatcagctgatacagttatctataaaacagccctaaggtactggtcatcatcaaatttataataatatcactgtcaacattttctgttaaagaggaaaatagatcaatctaaataataacagcttaaaagttacaaaatgcatcactataatgtgtatcttaataatgattagaatttcacataacatgctagcaaaatacttttgacatgaggaaaaaatgtttaaaactgaataagaatgtcctaaaatactgtatgcatttggcctcctttttcaccaaaatttaacttttttggttgtctgccccaggatcataatgaccatgatgattatcctagtttaggtaatttattaataaggtaatgactcattaattacaatgtttacataaataacatatcaaacaactctgatgaagctttataagtaaatcaaactgaaaatgtgctctgtgattttactaaagacagccacaaagctttaaatagtgcttgtttatagaccactttgaaagaaaaaaaattcacttcgtatctcttgttgacaaaatgccaagaatcattttcaaattagtagcgataaaatattaagtgattcataaatcataatggaaaacagaaaagttgaagtaaatataggcttgaaaatattatctcagaggggtacaaaataatttcaaatggcagtaacactaagccacttacttgaattttaaatgtgaatttgtcttgaaattgtagttcaggtttccctccaattaagaaaaagtattctattaaaaagctaagcagggcttgcataacagatatattaacgcctgtaatcccagcaatttgggaggtcgaggcgggtggatcacgaggtcaagaaatcgagaccaccctggctaacacggtgagccctcgtctctactaaaaatacaaaaaagtagcagggcgtggtggcgggcgcctgtagtcccagctacttgggaatctgaggcaggagaatggcgtgaacacgggaggcggagcttgcagtgagccgagatcacaccactgcactccagcctgggtcacagagcaagaatcagtctcaaaaaaaaaaaaaaaaacagatatattagaagtcaactattcactttaaaaatgcattattaatttatgaaatgattattaataagattgttttaaataaatgggatttcaagttgaaaatctcctgagattttctgaggttaccccatatcagaagcacacccccatatagccatgtggcatggatcctgatgaacctcagtctttggagtttaacaggctggggttggaatcccagctctgtcacttgttggccaaatattgtatttcatctattggaagctcagcctcctcatctgtaaagcgggagtaacaaaggcctaccttaaaaacgctttgaggatagcctgagacaactatggcacatcataggtagttaagtggtgattacattggttaacattaaatcagagaaaatactatgattcaggctctgacggcgctctaattgatagcttgggatctccctcccaatattctcccaagtccaaagtggacataggatgctcctattgagcctttcctgagggaagaatatgattaatgaaagggaggttttcctgtttttgtttggtttggttgttgttgttttgtttgtttgtttctgttttaaagtactggagatttgtaatttattttgaacaatgtttcaaaagggtgaaaaaatatacatttcagggaccatgttaaatggaggccaaggaaaactgtatttttattattttttattaaaaaatccataataggccgggcgcggtggctcatgcctgtaatcccagcactttgggaggccgaggcgggcagatcacgaggtcagaagatcgagaccatcctggctaacacggtgaaaccccgtctctactaaaaatacaaaaaaaaaaaaaaaaaaaattagctgggcatggtggcggcgcctgtggtcccagctactcgggaggctgaggcaggagaatggcatgaacccgggaggcggagcttgcagtgagccgagatcgcgccgctgcactccagcctcggtgacagagcaagactccgtctcaaaaacaataataataataataatccataatagtagaacaatggcaacatcacaactttgttctgtcctttttgtttgaaacatgaatgtgctatggagagccttagtgagtgaacaaaaccctctgcttggattcaaattctacctttccataactataataaagtcgcttaactttttttttgtgggattgttgaggctcaaatgagaaaacacattagaaaatatctggtgacttgacaaacatataaatatgagatactgttattattaatgataaagatgtgttcctggtccctgcactaaggaaggaagtgaggaggtccccttccacaaaccaagagctcaaagatgataaactgttcccaattaattcacaaattcagataagtaaggatcgcaaaaatgagacccagtcatctcagatttatttgttggtgcaaaatcttttagaatctgaatctgtactatgatcttgaagtttcagtgctcaagaacaaaagcaaaagtggtttctattagcagtagaaaacttgaactccttcccaaacatctttaaagactcatcatccttaaaataaacatatcaataagacagagttttaaactctatatatttggtcttgagaaaaaattttattaatattgagaaattaattccattgttaccataaaattagtcatttcccaaaagcaaagccctacttcatgcctgcagtatgaggcattgatacatttaatcaaaatgtcttacagttattgctttttagttttatggtctttgctgtgtgtgttatataacaacagttttggagcactacgtcagaagtaggaagcagaagatgtggctggaaagataggtagagcctgtatcataaagagctttatatgccatgctaaggattttgaaatttaccacttaagtgatgaggatctaccaaacagttttaagccaaggagagatgtagttctatttaattttaggcaggtcactcagtcagcaatgtagagtatttttaagacattaatcacagcctcaaactaagatattacagttgacccttgagcaatacaagttggaattgtgcaggtccacttaaatacaaatctttttcaaccaaattctgttggaaaatacaatattcacaggatataaaatctgagtgtatggagggaacacttctcgtatacctgggttccacgggaccaacagtgaaacttgaatatgcactgatttgggtatgatgatgaagaaagaggtcctagaactaatccccccaaaattctgagggactattataattaagtttgacataaatggtatagtttgggtcatactgttgacttcaagtatttctatttttatattatacttcctttcataatgggaaatcagatgaattctttgaaaatatgactcaattccaaagaaaatccaagttaaaatttttttccacaatttgttgactaattggagcagcaaaataattttgagtagtcgaggcaaacagatatccatgtgctttgagtgttggcaatatgtatcaattaacaatattatcaactctaatctcactttgaagtcaaagagtaatcaaattaaaatctttggcacaagttaagaacatagatctcttttaccatggatacttgcttaaactctttgagtcatgaataatttatctgtataatgggaacaataagatatttcacctatctccttttatttttgagacttgtaagctctgtgaaggaacactgtatgccttcttcattgttgattgtcaagctcccatgcctcctggcacacagtaggaatgaatcaagtgaatataaaaaagtattaccaaatgaaataagaatgtgaaattgttctgtaaaccttagaagtatcatacaagcattagtgctattgtttttgtttcacctattctgttattagcctccaactttttaagatgtactaaaaagacaataatctttcttcaacaaaatttaaaactaccatctctgaagatgcatttatgtgttaaaagtatttttatgcaaatgcttaagaaataatgaggagttctttaaaaattgaatctgctgcctttctaaatatctttcttgtttaaaacacaaaatacatatgccaaaatgaatcaataacttccttgtctggtacagaatgttaaggcttgaatttgaacaaagaagctgaacttagctttggatatctattataaaagatatccaaatgaagaacgcattgacacaatcgttaattagtattcattatactactcctcaaatagaacgatatcaggtctcctatatatcagtgattatttctcttagcttatccaagtttttccttttctactgcacataactgttacacatttgaatctgtaaccaggttttatgatttaatatatgctctgactgtaacacctatattttctgactaaatgcctcctgtatttcaatggacatctcctgtagcccctattaaaagtccctctccctatatccattcttctcagaaacaggctcatttcttctcaaggctagatttggagaactctaggtaaatgccaaaacaaaacaaaacaaaacgtaaaacatctttctctctctccttccctcattctctttccatgctatacttttcctaaccagagtaaagttccttgggagaagtgcttattttcttcaccttgccacatcagcaaaagcaaagtgatgcatcacaaatggtattacagattcctatgattctgagtcttcaatgcacattcatgattgagacactgctttctcttggaaattatggtgattctctgacataacactggtacagtgacctttgaggattctctgtcaacagtcattgatgaaagataacaataacatttcagttccttaaaagtggtatttctcttcatgtcttaatccaaggccgatactgtaccatctacttggaatctcttactcatcccttctcctccctttgcctaatgaacactgttcactcagcaaatgacagtccaaatgatgttcccctatggaggcctttgctggcctccctcactaggtcagggtttcccattatgtgacatcacagcatcctaattcttcttctatgacacttaggatggttttaaaattacaacaccttggggattcttttaataatggctgcctcccacaacgacatataatcttcatatggaaaaaggctatattttgctttccatcatccacgtaggggagtgtctaccacagaatatattgtagtcagtaaatgctttctcttctgtttatccttactcaccaaaccaattctagcctcctcccactcttatctacttaatgtagaaaaatcagtggggctaggcaagagattgttcttgatattttctgtttcttttcaaatttatttatttaaaaaattgtcatacaaaatttatatatttatcacatacaccacaatgttatgaagcatattcagtaacaccttgcttaacctcatggataaattactggaaactgcaactttcagcaaaaagatttataacaaaaccattttaccacaggctaattgattaaaaaaagagttaagttcctggtcacaaaaacatcaccaaacttctgtataaagactcaaaacacttctaatattaaacattgaattaaatgtgaaatatatatacatttaagaaagattaataaaaagataattatttatccaatttttggtgaatcaatgagtgatggcagttgtagttgtagtgggttaaatcaaggaataaatgtttgcaatgcaaaaattctaacgagcaccttctaaaacaaacaagaacaaacatggtgtgcccactgagtgctttcaaactgcattccttattgttgtgcatttgaaagattattgcaagctttatgaattttttattttacaataatttgtatttatttattcattcattcattttccaatccactcattctagttcagagtttgggatggttcaagcctatcccagcagctcagggtgcaaggtagaaaccaagcctggacaggaggccattccatagcagggcgcagtcacacacaaccccccacacacactcactcagactgggacagtttagacacaacaatgaacctaatgtgcacttgtttggaatgtgggaggagattggaatacccagagcaaacccctgcaaatatggggaaaacatgcaagctccacacagtggtcctgaccaagaatcattttttttccctcactaatgttataactaaaagactgagagaaacattattcaaggacctgttgtatagattgtaaaatggtcagatgagaagtatatattttttagatttttacttaaataaaaagacagcaggtagtaatttaaatgtttcagtatgcctacaatctttcagaaataacttcatgaaattcaactttacgaaatgatcttcaaaatacccatacagcacacctttcaataaacggagtttcatttgacagtgtataaaagagtttttttgaaaaacaaaaaaaaaacttgaaaaaatagcaatgcatgatggaataaggtattctcaactttcaactgttatagagaataatagaaaattttaacaaacagctacctaagaaaagatatatctctcaggtagatttttaaatatttttaaaattaacagataaaattgtatgtgtttaacacatacaacatattcttttgaagtatatatacattgcagaatgactaaatctagccaatttacatgttacctcacatagttatcatttttgtgatgaaaacacttcacatccactgtcttagcatttttcaagaacacaatgtattgttaactgcagtcaccatgtacaatagatctcttgaacttacttctcctatctaactgaaatttggtagtctttgaccaatatctcccaaactccaccaacaccacctcactcctaccccctagtaatcacaattctactctctacttctgagatcaacttttttcgaatcaacatatgagtgagatcatgtagtattcttctttttgtgcatagctatttcaattcacataatgtcccccagtttttccacattgttgcaattgacagaatttccatctttattatggctggatagtagtctgttgtgtatatatacctttttaaaaaatattcattcatccattgacaggtagaaaatttatgtaaagcagttaactagcaaaagcagttaacaataacatcttaatgtgccacagatattatgtgaagaggtagaatgataaaccaaaacaaacagccaattcatcaaatcaacaaaactagaaaaatctctgacatcctattattgatgtgagtacattaaaaaattgtgaggcaaagtgactgctacaaagttgaaaaaatacttcacataactcataaatatatagaaattcatattatcgcagaataagcattaagataaaattagaatttgcaattaagtgttcttttgataaatgggaaattatttttagctcctaagatacagcctggctttttgtaataataccattgctgctgcttcttcctcttcttcctgttatcattattttacaatatagacatgttgattttggcatttaagtgtaaattattgatgaatagaacttatattttgttgaaggtgctttgtaatttttaatattgtaaacatcatgatcatcaataagtacaggcttgcaaattacttccctacatgacttaactgagcttaatattttttcaacaagtatataaaaaataataatccagggaactatgtgctaaagctacttacgttcagtgctttacatgttttgtgtacctaggtctcacatttaatatcatttcctataatttcctggattgaaaattaatcagacagtgtcttctctttctacattcttcttctcaaaataataggacaaaaatgtttaatccttctttatggattttaacatgccattagtgctggaaagcatgaaaaatattacaggggaaggtaaccacaaatggataggagactaaaaattgacattgttgtcttccaaatgttcatataatttccattttaatgcttttgttttttagatatatttaaaggtatgttctcttctttacactgcccagagatcacattgtctgaatattagcaagtcttatttccctaagatggaaagtgcaacagagggaagatgactaaaaatagcacgtctctcaagatgtttgctttctatcacctgactctaggatgcagtcttcattagggtacaaatgtattataatggaatggtctgatttctgtttccatattttatgattctcatagtctaccacttgttaaatttaaaagtacattttaaacagatgaaaataagtgttagttgcttgctgataagaagatttaatttcccatatgttgcagcacgcttaattcatttaagaggtgatattcaaaaatattacttagtatgtattaaatttttatctttaataacctaggaagtttgctagcctattatttcctgatacatgaatttataaataatctggttatttgaatttggaatacaaagcaccctactgttgaggaaaggacctcgagggcatgtatagacacaacaaagagggaggtgaccaaaataaaagtatgtattattgatgcacaacctaaatacatctttgaggctttatccagtggaaaaaaaactcaaataaatttttctcttggatgttcaaacagcatgtaattatgttgtatcatatgaataactttccatcaaacatttactgaacaccaattttctaggagttttatttaacaatgaagctaaagcagtggttgtcaattggagaagattttacttccagggacatttgacgatgttgagagatagttttgattgccatgactaagaaagaagtgccactagcatctagtaggtaaaggccagggatgctgctaaccatcctacaatgcacaagacagcctacacagcaaagaattacccaccccaaaatgtcagtaatgccacagttgagaaactctcagataaagacataaggatgacttaaagggagataaaaatgaagaaagaataccttttgtattagtctattctcatgctgctaataaagacatacccaagatggggtaatttataaaggaaagaggtttaattgaatcacagttccacatggctggtgaggcctcacaatcatggcagaaggtgaatgaggagcaaaatcacatcttacatggtagcaggcaagagagaacatgcagggaactcccatttataaaaccatattatctcatgagacttattcactatcactaaaaatcacgggaaggacatgtccccatgattcaatcacctcccaccagtccttctcaggacacgtgggaattatgggatgtacacttcaagatgagatttgggtggggacaaagccaaaccatatctccttttaaagaggtgactgtactaaccctaactagaagagatagctccatgaattaaataatggttgaaatgagacgaaaagtcagatgcagagattgtagggaaagagcatagacaggatacaacaattgagcggctataagagaagctcgtaagaaaggtgaggaatctagggcaattcccgggtttctgcttttgatgacctagtagcaactcacagtatattgagatagggaacgtataaggagaaatagaactggatgggaagttagcttggtttgggaaatgacttagaggagaatgaataacatgtaaatggagccagttgcaaagaatataattatatatgggaatgtgtaaatctgtagagccccaaggttaatattaaaaagacaagaactagccatcaaataagttgaaattttacaccatagatattactattgactaaaagaggtagctgttaggtgcccttctcacaatgcaaatgaggagtgtggatctgggtagctgtgattacccccataatggtgaagttcccctctaagtcacttatgcaaattttagtagtaatgcttcccccatctaatattattctccacagaaatatccacttattcactgccttttcatatgaatgtgtggtataaagctggactgacagaaaaggtaccttaatagaaaccagaaactgatatatttgctaaagctctgtattatttggcttctttcctgctacatgaagtaaaggccatttcactgtattcctaaaggcaatttactattagctatgaattttcaggtaggcttaattaatcaaggtcttaaattaaattgaagtatttattacaagtatatgcatcacaaacatatttatataatttataaatagatttgtgtataatttacttgtctgcaaaacacacagtaccttactgctattgatttcaagtagaatcaagacacttggattcagtgcacaggaaggaaatatgatatctgtccattccataatcagctaacctttagcaaattcattaattttttaaaaggaaaaatataatatttagaattccaaacctcaagtggtaatcacatttcctgagacaacccagttattgttagcacttatatgctaagaaacaattagaaattaattttttagtgaaattagaatccaattaagcaagacagtaagttataatagtgagaaaatggctttcagatttgttcagaataaacgataccagacattttatctacttcagacacatgatgaaagtacaaactctgaaagttcacatttaaaaccaagaaaggagaaatcaacaggtgaagctcatttgcgcaaaataattaacgacaaatgagtagtatttctttcccataaaagaaaagattcatgtggcacttaattatttcatttacccaatacttcgcctgaaattgaagaagctctttttcaccagctgctaaacaaaagcaatttattcaattgggtttgctttgcatgagttgttctgtatataataagggaggaagaaaataaaaatgtgtaagtgccacacttccttccaaacatttttgaaagttatttgtggttccttgatacaagtcataggcataacaccaggcctgcactttattgtaatcattaaatttgtgtgatttgagtattctttcttattaataaactgagaaaataatgtctggaggaagagaaataagacagtgctagtttcctacgttctctagccagctaggcaacaagctctccatgaaggaggccaagccactggaaccacactcccactgtacagcagagaggactggagggggctgttctgtgggttcccaatcacctgttgctttggagttagaatgctggtttaggccaacatagaaatggaatttggttttaaagaaataaacaacagtggtaaaatgtccagatctcttctggacaaaacatggggccaagaaaggaatgtagctgttctagaaggcactctgctgcatgtggctgacagtctgactgaataatgagagctttcgtcaaatgcgactggcaaaggaaccctttccaaactgcattttttctcagggcctatttgcctgcagttgaggtgcaattacccgtcaaatgtggatgtaatgtagccacgtgacaccagcatatttctatttctagaaagatagcagagaaaaatcccctagtgtaatcatgttagtgtatgcttactgtcggaaggaaagggattttttattttgctcctggagttgaaccacagaagttgaaaaaaaaaaaaggctctgaattaaggggaaaaatctgatgttaggaaacattggctcacgtgcttcccactttcaggaactgaacagtttcaacaaataacctggtttatttttttcccagatgcatgcatctattaaagcatttctcttcctccaagtacataaatgaaatacgcataactattttaaaacgagttaagagtttaagcttaagattttatccttaactgcttaattgggcacccactctacactagatatcaaagggcatttgggccagatttgtaagaatatgttcaacaggcgatactttgccaggctgagaaatcaaggtggccagatgttcagcagtgcatttgcaacccatgaacccagctctagagaagcattcatccctggaactgagactccctgaaaaagccatcctcccatggatcacaagggaatttccccaataccagctagaaacaatttaacgaagcccgaagcctgccgaattttcaggagatgagtgtcctgctctctcagacatactgttctgctatttttccctaaggacaaagtccctaaataaatccaaactgacttttatttgaaaagagcaagtgtagattggtatgtccaggaacttaagtcacaggagcaataaattctagcaccctgtttcctctaaacaaaggggcctgcaaaggactattggtatttacgaggactgcagaggcttgagtaagcattttcacagcagccctgtaaggttctaatgcacagcagtactactctatagccagcttattaaaccttaatggcactcttttagtgttgtacaccaggacggtagataactcacccacagcgtggcttctggaagctgccacagcactgcaaccattctgcaggttaccacccttcaacttgaaattcctagatactggtttcttcattaaaatcaggagtcagcaaaccaaggtgcttggccaaatctgacccactgcctctttttgcattgctattagtaaaggaggttttttacattttaaaacagttgacaagaaatcaaaaaagaataatattttgtgacatatgacaactatataaaattgacatttcactgtccataattaagttatattggcaagccaccacacccattcatttaaatattgtctagggctgtttttgtagtataacaggtagttgaggggttatgacagagacttatcaccccaaatcctacttcctggctctttggagaaaaagtttgatccctgatttgaaagtactatcagtcattttcatcctttaacaggttctgaaatgcattactatcaacttaaaggaagactccatgtcagcctctttaaccactggtcaaaatgaatcatttcccaacagtcagatccattgtccccacttaagaaaagcatgcaagagctctgggtgggctaagcaaggatcaagactaaaatagtacctttagaaagctctggagttgctccagcaacatatagctgaaaagtagtatcactgatatttttttcaaactaacataatagaacttgttctcttcaaaggagtaactttgaaatttgttgcaaagaatctgccaatgttcaaaacatatttggagtgcacctttgatgctgcctttagaggctctttttaaattatcttttaaacaatctcaataatgccaaatcttgattcattatacttgagcttgattcatatttttaatcttaagtcattcagaactacaatcagtgaataaaagggagaagtacattgcctggaatagatggcgacctcaataaatattagtgaaacgaattgagctggttcgatataaagtgacactaatgcaacttaaaggaataaaaacctactgaagacatacatatccatccattatctgtgcccctaagcgtacataccccaagtctttctgattctacatttagttttcaaatattgctggctttctgggaatctgcatgattttatctgattctccactgccttcttccattcccaagcctgcctcattgtcctgcatagaactcgtctcagcccctgcttgacatctgactgctcgctctggacttcagttgtcacatctcttttccatctctcagaccacttctgatcaacatgcccatatagttatatacaccagtgatagttctcggcccaaagtgcctttcatattcacatacttctctgagggaagtagtcataggtttccacatgcatgatatggcaagccttacatcatgctaccctgtccatgatagactacacggatgcatatcgaaggtagccctgcatagggaagaagcgggggagacagggatctatgaagctatgtagcaaatgcctaaaagaacaaaattcaatactgcttcgtagatccctgtctcccctgttttcccacagcagggctacctttacatggaactcaagtagaacttttcttaggaagacatgatacactggtataagtaaaggagaaaggaaggagacataggaaatgagcggtctgtagaaatacacactgctattagaaagagcagtgcaccctcagaaatcagtcaagacagaaaggtgagccacagaatgatgccttcctggaggcagggggagatagtaaacttgcgagttcaatgaatttgctataatatcccaagtagtgtaaccatgttctagttctttaggatgcctggctgtgtgactgcaaggaaggtttcctgtgttttctcacattcctatttttcacagtaacctaaatgggtctcttcattgtaacctgaataaatctgtattcacagaaatgaaagtggttttctgttcacttactaacttggctatgacttcaggagcagagaattctaaaactgctttgagtaacatcagtgtctgtgcactaagtgtatataatcccagatgacttactaaaagaaccaaattccaatgaaacctttggtaaacttttccaaatagagcttcatgactttaaagctgcttctactggatgtgtcaatttatggagtaaaataaagtaagagcaaaaaattaatttacaatactttagggaatgataagacagcctaaattgccaggtagttatctgtatagcagtgtacattgtgtctaagtcttattttttaggaattgctcaatgtttctgctatgcttaaacaaaaataacaaattatttatttacagtatctgaaaacagtaacaacagagacatttatagatttatgatactttgtattctgttataaaaataaaataaatcagaaatagcaaatagtaatttattcatttatgtgtttattaaaaaagcatttactatatgctaagaactgaagacaggttgtataaaatgacttctctgttctggtgaagttcattgtgaaggagaatgacacctaaatcagcgatacaacaaagcatcaaggagggacacctgatccagcctggggtggagaggaggtagagtttaggaaagattttctggagaaggaatggtatttgatccaaccctgaaggatgaggtacatcctgccttgttgggacaggctgatccatgttgtttgatgagtaaaatatcagaacttgctggccaaaggtgcatcatcactcatcactgaagacacaggaataatggatctgttttatttccagagttactttattaaaatactaaactctcctgggaaagtttaaattacaagtctgtccaggtaaaaccttatccctatcagtcgatggaggaacagacgagacagaataaagagggaagaggaatggtttcttaggaattactgtttggtccagccctggctatggacatgtaagaatttgatttgggcaaactatattaactattggaaacactctgtttgcatgttaaatgcctagaaaggatgaatcatacatatttcctatgttccattttctgactctgttctttttcctgtttctgctttctatgccctggccttcctccctaccctccattgagggtacaatagcatgtggtatcaattaatgttaagttttgaaacttaagtttcagtaaactttgggtcagcactacaaagaacatctttatatctacatcttttaaattcaacctttgattataaggaaccaagagagtttggataggtcaatgaaaatctatcccaagtcctacaaatgtgacacaaggtaaattttttatgaaagatcattagacaatattgttcatgttttctatttttcttctactcaatattaaatgggaatatcacaaaatattgaggaagagtaaataattgtttaatattaccatctttagcaaaaaaaatcatttactactgtaatctctgaatagaaggaatatgagcaataaaataaatctgaatttacactccaatattgttgaattcaatcttgttcaatcttgttctataaaacatctttcacaaatgtgggctctgaattttattttatcctgtcattgcttaatttaccagattctgaaccagtcttttgggacatttgcagactgatttctaaggcaatctgacaaaaataacttgaaatttcaatgaggatgaagaattgctctttaaagaatgaggaagtcagtaggcataagggaatttctcacaaaaccgcaatgcagaccacttcacaaataactgggaaaattctaaatttttactgcactgaaagacaattgggagagaggacaaaccactacttacctgtaaaagcttcaccagtttattacagtaatttccctagaattcaccctaaagttttttgaatagagcagcacctttaaatctgtcttaattatcagcatatgcaaaatatagaatgattgctttacaaaagccattactccagatgtgcagactaggtgaatttcctctgtgggcacggcatttctaggcagacaatgttaatattcactatgactatataaagatgaatggaatgcttaggtttcacgcctacttgataagtaatcattttagataaattatagattgattacatttaattacagaactacaatgctcatacagtattctaagcctttgtcacttatccatctgactctctacacaaaggaatccctgaaaggataagtgagagaagcaaatgcttcaaaagctacagatttcatgcaattgccacaagagttgtgaacaacatcttttttgttctttcttttttaaaatacagatcatggggatacgagtgcagatttgttaaatggatatattgtataatggttgggcttctagcgtgcccatcacctgaatagttcccagtgtctgtcacttccctctgcatatccatgtgtacccattgcttagcttctattattattattattatcattattattattacttgaactcctgggttcacacaattttcccacctcagcttcttgagtagttggaacaacaggcatgcactactggctggctatttttaaaatacatttgtagagacagaatctcactatgttgcccaggctggtcttgaactcctggcttcaaatgattctcccacctcagactctgaaagtgctgggattacaggtattagccacgctgctcagccagctgccacttataagtgagaacatgcagtatgaattttctgtttctgagttacttagaatattggcctccacctccatctatgttgctgtaaaagacacagtttctttctttctttttttttttttttttttgagatggagtctcgctctttcatccaggctggagtgcagtggcacaaccctggctcactgcaacctccgtctcccgggttcaagcaattctactgcctcaggctcccaagtagctgggactacagatgagtgccaccacacccagctaattattttgtatttttattttttagtagagatgggtttcaccataatggtcaggctggtctcaaactcccgaccttgtgatgcacccgcctcagcctcccaaagtgctgggattacaggcgtgagccaccgcacccggctggtttgattctttttaatggctgtatagtattctgtggtgtacatgtaccatatatttttattcagtcacctattgatggacacttaggttgattatgtggttaacatcttcgatgatgaagaaccatggagttggcaatttggctatgaatacaaataagaagtagtgctcatcaggtaactatagcttgcttttttaattcacagaactacctttaaatatattttattgcctgtaccttacaagcatcagaactaaagctcataaagattataggtaacttgtacaaagctaacaggttgagaatccaagttcaaaaaaagctttactactttgtcataggaaattactatggacttcaccctaaagttaattcagctctgccctatttcaacgtttgcattctcttttcactctgccataatatttcacaacagaagtctcaagtgtaaagactcaagagaaacaccgggtggtaatttaatcaagacaaagttcctgggataactgtttatattaaaataattaaaactctaaaactctaaagtgtaatgaccatacaggtgatataaaatgtgcagctgagtagagaagagagatgtaacttttttcttagtgttgaggaagtctttccaaagagataattttaaaatgggttttaaaggatgcataggagttcaaccatgtataagggcaacatgggtgacctgagcaaaggattagataaaacaaaatccgggcacttgacatgctcagggatcaaatagtccaatgtggctcagggtttgtatcctccttaccttcctctttttgtgatcagcacatctcaatattttagctttccctaatcggcttaattttaatattaaaatattcaatattaatattaagattaataaaaagacaaaattttgaaatgacagcaaattcaatgatgaaattgccgtaagtgctaaagcaccaaagaactaaactaaaaacagttgcacctcttcttggctccctttcttcagggtcccaatatctttaccactgaaaattatttttttaaggcacagatttttcaggaaggaaaggaataaaattaacacaaattgaatagaaatatgaatagttcaaaattagacttttactctcttttagactttctaattccaagcaacactatccgacaggttatgatgcctcagtttgatgacagcttttttcttgaacacttgccaggatgaggaaacccagggaaattttcatgaaagacctcctaaaaattatgtgaaaattcaggcaagtatttgaggcccctgctagacttttttagtacatctgtaaatttacagattttttttttttatagaacaagcaaaatcaccaacttaaaacatccatgaacctgaacaagatattttatccaccacttctttccttcccaagagggagattctctctaatctcaggaaacaaatattttcctattgtgtggttcctcagacctggcttttgaaatttctgctaagtacacagttgtaatcatttattacataatctatttctaatgtcttattctacacataatgtttgtgaaatgcatgtagcttagttgtctgtggatatattccttgcctcttgcaagattcttaaaacagatttttatgattaataggtgtctctgttgctaacctcaagtcactcaaactctccttttgaaatgaacatttatttcagatagtacatgctctctgcggatagcctgtccacttttcaaatgtaatgtcctgtcttccatagatacgaaattttcaaaagatattggcataatgcaggagaaaatgccatccttttattatgttcaaaattgatctgacccctgaggtagcactttggggaattgggctacataatcatgtagaccctttcaggaaatggcttatttatggatttattttttatatacagaagatttcacacttctggctttatacaattgcatcctctcttcctttccaatatgtttccaaagtaggaaagctatatatggcaggagaactgaatttctatatcagctagaaatctgtcatctgctatatattggctctaatgataatgctttaagaatacatttatcccatatatgcatccagtcctctccagcagaacttttgcagttctcatttactgaataaagtaatgctaaagatagtgctatatcctggtcattgtccaatttttttttttttttaaaactgacttctaaatttattttttaaatgtctttttccccctgaagaattgatgtattttacactcttagataataaaagtttagtaagtctgcatgtgttttttctcactgcttagtttacatttagtaggtcatctttattgtattaaaatttaaggaaataaatcatattaagtacatattaaaaacatagtataaatatcaagcccttgttttgtctgaactttttattattcaaattgttctttatttttaaaagttaaaggaagaaatgtagttaatctgtatatccacataaagcaacacaagtagtccaactaaacccgctgatcttggttccagtcctttcgaaatggctatgttttaaataaaacctatttccttaggctaacaaacagtctataatccattaagtctttatgaacaaatccaaggcttttgaaattagtgcttggggaagaaagagtcaagtaatgaatttcaaagaattatgaaggtgattaaagaggaacaaaggatcaaactcccatcaccatgatttctagaacagagcctatcaaatgggcatttgggaattttatttatcatctaatcctgaatatgaaatagaaggtagagggaagaaggcaagaaacagtgttaatttagaaaggaggtgggatagagaaatagaaaaaagaatatgagagcaatttttctttaatggacatttgtaagctaaagagcaaccaggaaaaggtaataatactgacaaaaagagccgttgtttctgaagtttcaaaatgtcattttaactttttaagctggactgagtaaattgggtaagaccaccctgatcctagtgatgccagagatatcttagttacaaacaatggtttgagttatacttgttgtcacagaactgaaaattgcaaaactaattttctcttatgtactcaagtgtactatggaaaaacagagatactacaaagccaccaactccagtgggaaagtcatctctgtgctggctccaggagggtttatctgtggcagagacttaaaattgtcccattaataagctttctcattggcttccctgtctaggcagaattctgagctggccacaaggccatacaatataaagaaggaatttttcagtctcccttgcagctaagtgtgaccatgtgactaactctggccaataggatgtgagcagacgtgatgaggtccacttctaagccatgctcttaaaggggaatgtggtctttccctatgagaatggccatcttgtttttgtttttgttttgagacagagtcttgctctgtcacccaggctggagtgcaatggcactatcttggctcactgcaatctccgcctcccaggttctagcgattatcctgcctcagcctcctgagtagccgggattacaggcgcctggcaccacgcctggctaatttttgtctttgtattagagagggggtttcaccatgttggccaggctggtctcgaactcctgacctcaggtgatccacccttcttggcttcccaaagtgttgggattacaagcatgagccaccacgatcagctgagtagccatctttgaccaagcagataaggatgcctcatagggttagtgaacaaaaatacaaaaagagctggaactcctaaaaattctccagaaaagagccatctcacttgttcagatctggttattcagactctacatgagaagttagatgtaaacttctattttgcttaaatcatttaaatttcagcctcttttcctgcatcagaacttttacaataatagcaaacacactatagcccttaccatgtgccaggcagtgtcctgagtgcttttactatattaactcattacataagactataatttaaaacataacattattatttgtgtctacagacacagaattcaagcactgagaggttatatggttgatccagggtctgaatccagaaaatctgactccagagtccatatacttggtcataccatttagcacaacatcatacatttaacatatattaagggaacatttgtttaataagttaacaggtaatctgtctgtttaaaattgcataactgtgtttagaagtctcaacatcaacagattttttatgtgatctctgattttcttcttcaacaagggaaaagtcatcaatttagatggtaagcaatgtcctgtagggtactctgtaccctgcaaccttttatgtagccagtttctagcatctctgagaataccctggcatgtcagctactgctgagcaaagatgtgctctgacaatacaggaacacaagagaattgaaaaggagcacagatgaacagcatgaagaatcaagatgaggcccattgcctatttgttttccattctattagcatggtgcctactaagtgccagggaccaaatgtttggtgacagtggaagaggtatacaaatgaatgagacattctttccctcaaagaattaaaatccagcctcctttgagtacaaagtctttccaaagatctcttttgtgttcttcccttaactaataggcctctcgaggataagtcccagcaaatcatttttcagtggaatggaaaaaggggaatactgacaaacatgaagaaatatttttttaaaaaatttcttttaagaaccagaagttgttggggcaatgaagatatgtaggaaaaaaaatgagaaaaaaatataatgaagttagttttgaaactaagttttgtggcaattttatgacaaagattagggccatctctttgagatttttttcttctttccccaagtatcaaggaatgaatccttgaagtttcttttttgcagagatttaagttttcaacttttcaataatgaatagccactttgctttagataactttaattaaagtttcataaatgcaccaagagccatagggctttttgtattcttgaaataatgaataatttaatcaattaatacataatgggagcaaatgactaattgcagattcaagatacattttgtcaatcatctttattgacagttatagattacaaagtccaccataccaaaagtcaagaatgccttgattgacaattaattgctaagaccaattccattatcatgacttctgccctctattttccaatttggaaagcgtgttgcagtttcgatttatacactgggaagttgtattagtatcaactttagctcttatataaatgtggcattttaaaataaacattctcccaaattaatactttgtttctgcaaacatgagcaccaagcacatggctgaaaacatctttcattacgctagtttcaagaaaaaacactccttttcactgaaatttaatttgtaagacatttagggtatccctacactatatttttaattgaattttaaaggaaggatggagaaataacagttccgaatttgttggatatttattattttgaaaaataaatctgcattcatttatttgccatagtctaccaggccatccatccatccatccatccatccacccatccatctattcatttgttcatccatcaacgcatacatagatactttatcttttaagagtcaaaaaaaagtttttgaactaaagtccaaaaggaccttccgaactcagtctgcctagaacaccacgcttgagtcaaaaattctggaaatgtgttgctgtaaactcatcttctcatctggatctcattggagtaacataatccacattttcttcttttaagcatatacaaccccagaacacatccaatttgttcacagctatctgcataattaatcagtagtctttaggttcactccacacttaaattttcacatatctatgcatgcattggatacatacctcacaggatataatttctggacaaaagaatgttacttagaatgatgagcgtctgataaaactatggctatgctctcaatatcaagacagtttggctggtatggaacagacaaattaattgaaactcatgtaagttttattaatcacatttcagagtggccacatttctcttctttggctttatagtctttacagccaacttaagtcattatcatgcattactcatgacttgtgtatcatgtctatatacttccacacttggttatccctctgattgagagcactttgaaatcagtccctaaacactctgtgttataaatattctctgtaaacctttcatgtgtatttgcatgtaaataatgaaatatttgataagcagaatacaccacaaaaaattacatcaagacaaaatttattgaaaagcatcctgatttttgtcgttaaaactcataaaactagagcttaatcacctctagattctttttacaaaagttaggtaaaaacaatttccatttacattttttctacttactatcctatgacctacatagttcagcataattaataactggaaatttttgacctcctctgtgtatttgcaaaatgtaatattcccaagtataccttagcagagtcttctgtggcaaaaaaatattcactaagaattataatctagaaagcctttgtctatctatatagcttcagacaaaatagcattttatagatcataatggtaatgtaaacattcataacttaccccaattagctgaaagtcttgacatataagattacagccatagatcgatgaagatgcagcagaaaaggtatggcatatttagaaggctagttacactcatcataacaacagaaactaaaatatgtattcttttggttatctattctgggcacaccgaaataaattgtgaaccaaaccctataaagacaaacccaaaatgtacccagaactgtgcacattaggtaaatttttattagaatacaataggaattgaggacaatgcggtcttattaaataaactattaataaaaaggctgaaagggttgaagattttctgggctctctggagatttgaactatctttgattaaatgtgagctaaaaatactccagatatcaaaaacaaaaacttgtagtggtagcaacgaactataggtatatgtagtacttattcattccataccacaataattcaaaaattcctaggagccagctaatcccttttcagcatttgtgctcagggacttcttcactttttatagctgggtaatatataaacacaaatgtccctcctttttacttgaaccccagaggaaagcagttttacagagctatggaagcagatcttattaattaaagtctattttttgttcctctaaatttatcttttactatcagtgtgttgtgtgctaaggaatggattctaagacttatgaaatgggaagcatctatcacagtgttcaatgcatgctaaataaatgttcatcctccattaatataaaggtactcactgagaccgagtgtggtggctcacgctataatcccagcactttgagaggccaaggtgggcggatcagaaggtcaggagttcgagaccagcctggccaacatgttgaaaccccgtgtctactaaaaatacaaaaatcagccgggtgtggtggcgggtgcctgtaatcccagctactcgggaggctcaggcaggggaattgcttgaacgtgggaggcagagggtgtagtgagccaagattgctccactgcactccagcctgggtgacagagccagactgtcttgtagggggtgggatggggcggaaaaggtactcactagtttattaacttggtaaaattaaattgtatccacattaccagcaggcaaaacaagtgaagacttttaaaaaatgattttacagactcaagggctgattccttttcagaaacagaaacgagttacagagctttcaacttttatttatataatattatccccgtaaggtttaaccaagaagataaagtagatgtgattggcaaatcttttaaaacttgatgtacaaatgtttgttaaatatccagggtcctaaaaatcaaatagccatttaattttgtaaacatgtttttaatatagtcttgtaattccaatgatgatccaataactagatttaaaatttaaaaattcagtaaacacataccagaaacaagaaaaattttatttgttaaatttaagatttaagtcacaatttcaggccaatggattcaaaatactttaaatcttaacttgagtcattaacaattaatactaaatatccaatgccccaaatctcctttggtcctagattagctgatgacaaatgacaagttgattgctaataagcatagatcacaattttatgagaaagtctatttgtggcttgatattctcattaatattatcaaagtccacacttccaaaaattcaaattgcttttctgtaagaaacacaagacagagtctgctctaaattggtattcccaatgttcctgcccttgggagttataaagaaggtaaaaagctatcccttcttttccctgccaattctccgtccttccatgtgagaacagactttcagaaaataacattttccttctttcatgatcaatttagccctaccttattttttcttggctgaattggcccccacctgttgcctcctggttttgttaattaaaatgagacaagtgaaaagcactgacaacctagaccttgtgtgattattaaagaatgacaggtgctttggaaatcaaacctaacaccaaacataaagaagcctttagacctctatcttacaagataattacattaatcagtgaaaaactagattaatctattggggagttaagtaactgaaaatgggacaccctaaaaaattacttggtacaaaataagaaacaaatgtcagtgaattcattgagtagtctgggacttctttttaagtcactatggtattggtcttttactaataaaatagatgacttattaaagcaatatttacactgattaattcacaacggcagtacctgagacccctaagaaaacaactattcctttaaaatccagcctgaaagtagtgctcaggtgtacacactgagccttttgtctttaacttagcaaacactcagttcaaaaataattttgtcattcagaggagaagctattttatagataaaagattatgaatttcacagctgacttgagctctactcaggtcaacaacattggtttctactttgcaagtaggatttgttctgtcaatgcagatttctcagtaagtactttcccctttcaaagaaacatttacatttttttatataaatcaagtcactgattatattagctcagattcacatttgatgcacccttgtgcccctcctcctacacttcagctaaaatggaaacagactttgtttctaacttttaatactgacatttttgagtgtaatcaaaattccagagtgttggcttagatggagttctaaactgaagaaaggagtaagggctaaggtggctttttgtttttgttgtatgtattttcctattttataaatagttcttcagtttcctgtatgatactaacaatatgcatgtcatatattaaacaatatatgcattaaaaatgaggaactgtctgccctaatatgagcatttttttgtgagttttgttttgtttttttctgagatggagtcttgctctgttgcccaggctggagtgcagtggcgtgatcttggcttactgcaacctctgcctcccgggttcaagcaattctcctgcctcagcctcctgagcatctgggactacaggtgtgcaccaccacgcccagctaatttttgtatttttagtagagacggagttttacattttggccaggctggtctcgaactcctgacctcgtgattcacccacctcagcctcccaaagtgctgggatcacaggtgtgagccactgcacccggcctcttccttttatttagtttatgatttatccttattatatattttgaaagcttagagacatgtcaaattaggaaggatcaagaaggagcttaactttttgtagggggaggctctgattctgaatatctctaaagcctgaaaagcaatttaattagtcactaagtgggaaggctccatttgatgacaggctgtaaatggcattactcttggtcatctgagtagaatgcagaaaggttgcaaatgaaatggtaatggatttaattgcttattctgatattcataaaaatctgagatgtttctcaagccctgtttagactctaaacaattttatttttccttatattaataattagtgatcaggtcgaatacactgaagccttgtctatgtaaaaacaccatcaagtgactattttcatgactcctgacttactctcaactgcctccataatgactttatttaaaccatgatccattgaaatgactcatgaatttcagaggttccctttatcttttccgtggatttatacccaaagctctggaatagttgtatgaacactagaaaaaaagaaacagaaatgacaggttccaggtaatcaatgataaaactactttgaaaaccaagaagaaataatttcatttatggagttttatgagcactgtatttaagctgacattcaacttttaaaaattgtacgtatttaatgtgtacaacatgatgttttgacatatgtaatgaaatatttactgcagtcaagcaaattaacataaccatctagtcacagtcacagttaccagttacggttacctttttttgttgttgttgttggtagggagagaacttgtctcctgactactgtcttagcagttttcagtgtacaatataatatcattaactttaataatcaagctgtacattagatcactagacttatcctgaaaaacgtcaattgtgtatacttttactaatatctctccatctccccccacctccctgaccctgctaactacctttctactgtttctatatattcaattttttaaattattttttattttttacgtttttagagtcagagtgttactcttttgcccaggctggagtgcagtggtgctccttgcttactgctgccttgaatttctgggctcaggcagtcttcctgcctcagcctcccaagcaactaggactacaggcacatgccgcaacttccacgtaagtttttatttttttttaattttttatttttttccagttttttgagatgggagtcttgctatgttgcccaggcagctgtctaacgcctggcatcaagggatccttccacctcagcctcccaagtcttcaggagtacaggcttgagctactactacaatcagtgtattaaacatttttagattccacatgtaagtgagaccatgcaatatttttctttctgcgtccggcttatttcacttagtgttacgctttccagacattcattttcattgacaggcatcatacatgatgctaaagagcatggtagacagggagtcagacagatttgggttaatgatctgagcccaccactcatccaacgatgtgacctttaaatgggttaatttatcctagtcttgtgttcctcagctaaaaaatggggataggttgataatcgttaaggttttgtaagggttaaacgagacatgtttgtaaagcacttaatgaggtcagacacgcaggagctgcccagtaaatattagctacaaatttaggacctaacataaagggatctctcaagaaaatcactgaatgcaaagacaagtattttcttaatactttacagctgagtatttgatccaaggttctttcccatttatagatttgttatttgatgcatttcattttactttttatgcagatgggttggttagcccggcctcagttatcatttgaaactcaaaagggcagaatgtaaaacaagatattcttatgattccaaattgaaaaatacacaaacatcaatgtcttcaaaactatagagtttttactaggacacagtttttcctctaacttgatgaaaaatcaggagttctggcttccattggtatctctgacactaattaattgtgaaggccttggtctcctttatttgggatatgagagttttgacaaaatgacctcttaggtcccttcagtatgtctgaaaactaattcagaatgtaaccctaatgccgtttgtgaggaaaataaaagagacttttcccctgtatgtcataaatcccaacctgtgacaagttcttcacatgtgtaaaattctgtcctggttttctatggcagtccccatgatggaaactcttttagttatgcataaaatcaggccagtttatcacccagaaaaggaagagaggcgacatgcttccagcctatatcgtctagactaattttcttgttctctctgatgccactatgggacccttgccagctgcctcctaggaaataattattaattgcacttactcaaattagcctcctcctaagtccccttcaagatcacactacagagatgtcctgagagcctagcggaagcagagaaactaaaaaaaatgttcacaatctttcttcttccaaagaggttcctgcaaatagactcatgattaaaatggacctcataacatgtcagcttcttggaatggaccctccttccaaggctagaggcctgaggattgcttctaaataaaagaaagcttgctatgttttcagttccagatggtatatgtgcactaatagacagcaaattctaaaacgacatgcctctggcttcatcctggagtctcagaagcagagaagaaatgcattagaaaaggaaagagagagtatcttgctcttgtttgtgttgggatataccaaggcaacatttcaggcagcttacactgctcatagattattttgatcaaaattgttattgctcacttctttcatttcttggataagttaactgaccacttggaaccattccccttaaaatgggtaacaggaaatcctaggtcctctaactctcagcacatattcatagaaaaccaaagttgcaatactgtaaaaggagcagaaataactaactacaattcaatatatttcattcagaacgaggctttgaaaaaagcaatgatcctttgtgcccagggctgctcaatttgattactgcatcccctactttgtgaagtgatattttgtttctattttgattccaaactgctcaaatagagtcctcctcaggcaagtgtataagaatatagcatattttggcctcaaatgactcttattaaagaataataaatcaatttaaacattattattacttcaaaaatcaaatctgtaacaaatattaatcaatctgatacttctactgttattggagaacatttagtctataaactacattatggatgtcatggtcccatttcttaaaatatgtctaggtatatgcttatactgatgcataattagatatgtttatatcatatatatactgattcaacagaggagaaaatattcgtgaagacgagattaacacagcagacagaaagcatcacatcttaccttataagactgcatttataattaccatgtggtagaataatggatgatctttttcattattatgtttcttaataattttcaaattaaaatatttgaagaaaacaaatgcaatatcctataatttgtataacataaattccattttttccctagataatggcaaaggccgcatgactattaaaactttagataagtatgtacatatacacacaaagtagccttttttattttaatgtgggagaaataagctaagaagagtaatgctatctattcttctattagatagggttttatataatacatgcttacaaaaggatcatgttgtcaagggtacctcgtcttctctttaaaacaaaactaatttcaaaggttgcttaatcaaatcacaatgaagtttcatacttttcaatttaacaaaatatcacagaaaagcatgcatcatagaaaatcatatcttcctagataatgaatttccaacaggtaattttggagagtctctatttataagctaagaatgatgatttgaatatttaaagatatgcactgctgacaaataggagtgtatttatggagtacaagttttagttatctaaggtttctaaatccccaggagctcaagaatgaagaaaccatgcactgataatccgaacctggatagatgaattctagacagcaacttgtgtactcccctcacagccacagaggtaggtggaatgtataatacattgtcttgtggaaatcataagctcaaaaggaccctagaattatcttcattgctatctcatgatgaccttttcataatatgcagccactgatcttcacgtctcaaattataatagtcaataaagaatcactttatataaaaagtatttgacttatttcacttatttgaattccagggtagggagactgtttgcagggatatttagcttagctttcaaactatctgtggttcctaactgtcacaacattcaggagtatcctaaatatataatgaaatgtctgtaaacctaaataaatgttagtataaataataaatacctacacaattggaggaatagtgtcatattgaggaattaagtcaaaatggtttaatcatgaaaagctatggtagacactggggaatgaatggcaaaaataacagaatatagttagtgtccctcctggctttgagtaatatatgctgatgtaaaaatttttgattgttagtgttaaccactgtatttattcactaatctgtaaatttgacacaatggatttattaatgtaatttaatttacttggcatttcttctcctgagaaagactcctaatagatttaccctttaccagtccaaccaaattatgagatttctcccctatttctacctcacaggaggaacctggatatgcatagattcaggatcttagttttttacttttaatgaagaattatgctattggaagttgaacaaagatatgcagagttggaggacagtcatagtatgcaggggttaaaaaaagaaaacaattttgcaggcacttgatgtgggcatgacggtggtgtgtctatgagatggctgttctttgtgggtttttttttttcttttaatcttgggaaactttgcagtttttacacatgttcatagaaccatgatctaaatttcaatatagctagttttgacagtgcttttacattttcaacgcatttttattttcccctctgacaattcagcttattctattaagtgtacttccaacctctctctctccaggctctcatcctacacacatgttaaacctgaggtatgttttggaagtaggggatctcagacagtccatctgattttttgtcacatcctctcatctagtcactagaaaatgcttctatcagatttgtgtcataggtaagccaaatacatatgttgcaatttcagctacttcatttatcaccagctaaaaataaacaaaaacaaacaatggtaaaattaaaccaccctccatttcctgatcatataattttaagttttgatagaggcaggcagtgcttgagcactacataagcaacttgttagggcatgccacagaattctgatggagttcttggggctttcttgggagtcacttccttagaaagagagaatggaacatagatggctgtagacactaataatatatatcaagaaataagttaaagtatataacaacattatatatgggtaaatgctacaaaaaataaatcaagaagagagtgatatttctatgggaagatttaggtcaggaatttttttctgatgaagtcgactttgaatagagctccaaaactatagtacatattctaatatgtctagaattatctcatcagtatctattaatcaaggatggtgaataactacagtctcattctttttgccttatattctgctcactcttacttccctagttcccaccctaagctctcacgattatactattatgatttgattcttcactgacactaatattgctcctctgagtgcctaggatgagtgtttatttagtttatttatgcatttatgatgctcttgagtattttgacaatcaggaaccacagaaatgtgaggaaagccaagccaaatgcacttcaagcagtctccctgccatgaaagctgtgagccctgaagtcatttacctgataatctgttctatgggtgctagcaagcattagaccccgtagacatgtggtgctggggaggctgtaagccaaggaatctgggcaggtataacaggaaccgaagacttaagcagaaagctgacaagaacaccataccgctacttctctgaggtcaccaacagcatctcagtccaagagtagccagacccattaaacaaaagcataaatgatgggaatcagatccttttttggaagacatcaggattgctaggatatttagtgtctttagggaagaaaaagtatgaagaaaggcagctaaggacactggagacaaatgtctcgtgttttcatgattttacttgttaactttccactcggcagacagaatctgggcacagggactttgcctgcagctgtcatggggagctctgctgtaaatatattagcatataagcacagtatacaaggaatttgttagtctgacagcacataatgtagtttaatcaatataattattgaaaaaaataatttacacacaattgctcattcactcgagtatctgggaacctcaaagagaaaaagaaatggtttttctatgctgaagatgagagcttcagaataggtagattctggttgtaaggcagtcttaatcttaataatggaagatcttaatctttgatggtagacgctagtcctcctctcacataaatactgaggaatgctaagaaatgctagtttctgcagacatctttcctgcttcaaaaagacaagcttcactttgatctgtttcccatgtggactctgtatgatttctttcagagggggaaaaatgaagagagtcctgccactttaaaaaacaaaaacaacatgaaacaaacaaaacacctctctctaaaatctctagaaaacactccatccggcctttccctttcctcctcagctcaaatcagaagcaactcaccacaattaaaacaaagagtttccttctcatctttcatcactcaaaaggccagaagagctctaatccctcagagaaaaaaaaatcattccatataattatgggtgcattgacatcaatgattttctgagtttattttttaaatgccattgtttggtaaatgccatttctaaaatgtcattatttttttaatgccactaaaccacattaagagtggtttagtagcattgaagtgcaaatgaaaaaaaagaatatattttttgtaaatttaagagagtaagaataaaaggttcttaggactgtatactctccataagaatcatgaagagtaatgccgaagatcagagaaaactaaccagtatttataatgatgttcacttctattgtggcctgagccttggggtgtttggagcaatttttcaacccttctgagccttatttttctcacttttaaaatgagggtgttaaaggcaggtgatctcaacatcttttcccaacttacccagctttggatttttttttctggttataaaattattctgattattttttcttagaaaaaatatagataggaaaatgtatatttctgttaattctaccactcacagataaccagttcggtgtatattcttctaggtaatgcttgggttctttttttaaaagccataacgaccacaataaacacagtagaatctcttttctgctttatctctctgaagaatatgtgagcttttttttccccctgttttagtatttaagtgcttaacaattgaggttctggcaactaaaactgcacaggcagcagctccgtttttctcagaatcaagcgaaactgaacaggcaattaaaagttactgaactgcaaggtaaaattacttccctgctatgcttctgggtgactaaagaagggagacaatggaaaccatatttagaattaagatagaaggatggaacatagcagtctgctctactaaaatggaatctataagcattacacataatcagcagcacttcaatcatgctctttgctcacagttacatggaagattacacaaaacaaatgtgcaatattcaaatctgtggcattgctggttaacagaaggcacttctctcccagcccacacggtgatccaaattgtctcctgtacagtcagtgcccatctcacaaatgggctatgctccaagcatctacttgtaagctcattgttccattctctgtattaagtttctcatagaattaatgttataaattgtcctcagattcctaggctagcctatatgggccagcttattaaaaggcacattatcaaaaaataacatcaagaagactatgcaaattaaccaccatagtaatgcttcttttgaagttgtattcagaggtcaattgtggaagcacaagaatagctctcctcttctgaaaattactggtgacagtttccatccttagagacaaatggtaagacagaagaataaagtttaaagaatttcgggaattcaatcaggaggattcagggccagagatcaaggaaaaggattcacattgaactgggaaagcagtaaacggcatgagatgaaggagttggtagtatgcctgataatgcttaagaaaggagaaaatgattacagtatggagaaacagagccttcttctagggtatcttcccatgactttgagctcttatcttagttagaagcttggaggctataatatctggatgtcatctgttttccacactcagtagaaatgttgggggaagaggatttggtgaactggggtaaagataaaaatgagcagtggaagtctggggaagtattaagacatttccattccaactgaaaccttatgtctatcacctctccctccactgaggactctacctggtgacttgtattgggaatagttaagatgcctggaaaatgcagtggatcttgaaatgataatttcaaacatttaatagggtagctcaaacatcaaacaacaatgaaaataaataggaatgtggaagtcaagcaacggaagatcttgccacatgcaaccagtatagccatttgcacaataagaatcacattaaattggattaagcaatctgtgagaatctccttaggataatatttttacataacaagggaatcaacaaagcagattttataactgatgtcatgtaataaaatatgaaacccactcttaaaggttatgattctattggtacagttaagtataaatctgctggagatagtaaggtagtaagattaataagtaacaaacacatgttctgctataaaggtcacttttgatttaatgagaaatacaaatttgccgaaaatatgtcttccttctttaggaggggatggtggtactaaaatttaataaaatagggtaaaaaaatgtcaaaatatcaatcagaaaacctaaggtgaactgaaagcagttactgtggagtacagtatctactatgagatttcttttaggtaacttttttatgtcgtccaacctcaattatcaattttcctcaaaattacaattcgaaaataccaaaagaaaaaataataactgtttttgggatccacgaggacattattaaagagtattttggagttatatttgctgccaatatcatgtactgaatgttcagagaaatattttctgctctgcgtttaaaaatgacaaataactatgaaagacatgttactagacatggaggagataatcaaaagaccaaaatacatgtaatcactgttccagaaggagaggggaaagagaatggacaaaagactcacaattctacataattgattaattagacaaatcctaatatcaggaagcccagtgaatccaaagcaagaataataaaaagaaacccttaccaagacagacagacacatgagcaagaaataattgaaaatgcaaggaaagagatctttaaaacagtcaggaagaatgaaacagtagttagaaataaatgataactagatttacaactaacttttcaacacttacaatggaagctagagggcaatgggataatatctccaaaatataagagacaacagctgttctattacaattgctatacccagtggaaaaaaaaattcaaaatgaggttaaaataaagctatttcaaacaattaaaaaatgaaagaatgtactaacaaaagaccttcacgaatgaaacatctaaataatgtatataaaacaaaggaaaataatcacagaaaaaaacgtctaagatgaaagaagaaaagtaaaaccatggcaaacatctcagtaaatctaaagaaagccttactttgtaaaaatattaacagtgtttaatttatagagttcatacaacaaaagtcaaagccaccaacaacatgtcattccaaaaagatcatgaaaggaattgaaacattcaaaggtccttttattgtctgagaggaaaatattagttaacattagatgttgtaacctcagctattcatgttttatatttaatgatttcaaggtagaggtagaaaagtatatcttaaacaggatattaaaatacaaactataaagggaaatactgataatttaactatatcaaattttagaactccattcaccaaaatataccataaaaagactgaaaattccagtcacatactagaagaataaacataacaaaatataatgaattctaagcatcaataaagaaatgataaataatctaataggaaaaaaatggactaaaaatgtgaacagatatttcacagaaggggaaacacaaataacccagaaacatatgaagacatgtacaacatcattagtaatcaggagaattcaaattaaatcacaatgaaataccattgtacaatcaccgcactggcaaaaaatttaaaagtttagatgagaacacagagcaataggaagtcatcatcccccagtggacagcaggtgaatggtaagtaattttactaggaacgttacatgtgcatcctgtatgcattatatgtactgcaacaatactgctcctgagtctatgccctagagaaattcttgtgcatgatccagagtcacatgaaacagggttcaaggagcactgtttgtaagagcaaacactcaaaaccacccaaatatccatgagcatagagtgggttacaatattgtgattttttttcactcagtagaatgatacacagtggtaagaatgattaaattaaatgctataataaaccccaaacaagtttgacagacaaaaatgaaggaataaaactactattattccatttatataaaattcaaaaacaggcaaaagtaaacagtatatcatttactgatacatgcatatatgataaaactattttaaaaagtaagaagattataaacacaaaattcagaaggtagctagctatctcaggataaataagaggggcatacacagtgcttcagataggtactgctgtatttatgtcatgtgctggccacaaagtttttcaatttttaattacattttagtagacacacatgaattatataagttttaaaggtaaattattatcacaataaagaaatatttaatattgttaattgcagtttaataaacataataagtttaaattaagaagaaaagcttttcttttaaactaaatgtttaaaatttgggatttttattaaaaaatcacatttaaagaaacatggcaaaactggagtttaaatgggggttcttttctgagtcatatatttgcatagtgtcagtggaataataatgactctagttattctgactgaaagttgaaaatgtttgtttgtttaattattttagtttgtacttcatttttatagcattccctcacattaattatatattgtagttgcattatgcaaaatgaaaacaaataaagttagaaatactatgcttcataaaacgtagcataaagttacactggctgatactcacagtcatttgtatagccattgccttgaaatatactgatcacaagctcctttatctccaaaatgtctgaatgctgttaacatgagaaaaagacacctgactaacttgactgacctgcagcaaaattatttgttttcatcgaaaaggaaggtgccctcctctctgttactcacttttttcctttctgaactaatttctgagaaaattactcaattaatagcactaatttataaaattaattgtgtaatttgcctagattccaggcattcattagctctcatggaagcacctgtgtggagaaaactatcaggactctttggaaagaagacagtggcagacagtggcagacagtggcagacagtggcaccgtagcacctcaaataatgcaacaaagacccctacgcgagcttgcatcctgtcaaagaagctgttttctgctctattgaaatctttggcttcaagcactaacctcctctcatattcctttgtcccttaagctccaacttcactatgcaatcgtcctctctattcttgcctcctccagttctaactcaagtttcagtcttattagaaataggacatgctcactttggcaagacatggctccttttttacccagagggtaaagcactatagcaacaagaggtacacaggtaaaggacagtgttatcgaaacctaacatttccctaactatgcccaccctcactcctcatcagtgagcttctcctgtaacctggaccattccaaacactaacaatgactgagaagcaaaaagtttccacagccttctaacatcatcaattcaagtgcctaacaattctaatgagaagggtcttgaatgataatatttaaagctattttttcttattttatcagataaataatcaattttttaaaaaggtattcatttattcttatacctcaatcatatatatatatatatatatatatatatatatatatatatatatagtatatgattagcatcaggttagtctgggagtaggaatgggtttgtttgattaagaaataaaaaataagcatagtatcttactataaaaatgttatacttagaagagaatgtatacatttaaagagaattaaaatgaaaatgttttcatttctatatgttaatataatacagtgccaaacgatttggcaatggcattaagtgacacagaagttcaaagcacagacaaataccaatgtgagcaggagtcataaaggcttccaagaggaactagaaagagagctaggatttagggaattgatgaatggacaggagctaaaaacacagaggggaaggaggagggtatttctggcattggaaatcgaatatgaaattcagctcaagcatgtgaagataagtaggggctatgaccgtgaggtatggagggggctgatgccagtagctgctctgatgagaatatgaagagaagtaccacaaacactttgaagtctggctgtttcattcattgaactattggaatgtgcattgaatgccatctgattcaacagcaatggtttgtactcttctatcctctgataatttgctggcagcacacaccttctgtcatgccaaattactgcagcctgaaagttgtgtaggaaaatctgtggtggcaaattaagtccttgccatcctgaaagaatccaggcattcaggattgattattaacaactggaaagctgaggaagcaaagagaaaatcatcaccgtctacagccaaagtcccaaagccagtaaccatatagatattaacattaggtagcctcactggaacaaaagcattctttggtctctaaccacatataattcagagagatagcacagtatgcagaaaaaccagactaagtatcctggaatgcatgactctacaccaaagcgatatataaagtatccagagatacctagtatgacactgtcactggtccaacacattgtctgtattcctaaatctaagaaatcatagaactaacagggattatgttgttgaatgcagtatgtcccattagaacaaggagtgaagtgatattcactcactgggagaaataaactgcagttcgtgtctaagatatagaaagattcaccttttccatcctatggaccagtaacataatgtatacctttgaactttaaagagtttaaacagtgcatagctttataaatttgtagtgagaatcagggagacataaagttacaaaatgaacatttttttttcctaagtagcagtacttttcgagaaacggaaggtattgaatattcactaccttttaaaagatagcaaatgagagaggcaaggtgctttttgtttggttttgttttaaattggggaaaatgacaaaaattagcagttattaacttcacttttcattagatttaatactatcttccattctacaatattgtataatatcccattctacattgcactccattctaataataataaaataataaaacaattaaccagaagtagctaactagtatctatgaaaatacttacatgccagatatgacattaaatgatctagaaacattatctcatttaatttttatatttactgtaatatgtattatctgcccattttgtagatgagaattagctgagttatcattgatgcttagattagcaaagtggtctacctgtgatcacagacgtaaaaaattacaacatcaaaaaaaaaaaaaaaaaacagtctgtcatgtgcacttcaagcctgaaatggattaaatctagggactaaacacctactacctggtcagatgttacaatcaaagaaggttcctggagacaagggctaactagaaggttaacacaaggaccacgaaggccaattcctttttatcaccttagctatgtaaccgtaggagttgcctcaaaacaatcatttataaaggtgagaacaaacaacaacaacaaaaacccagaaacctccaaatacttcgtgattggaagagtgctgttgtggggtatgagcaagctggttgcatttaataatctgaccatcaagaaccattctgttcacttctgtattaattacagtaaaatgtgtgtaatatatctgatccctagaagatacctttttaaaagtatgcaaacacattttaaacaaggaattgacaacaatgatttcttagacaaggaatttttcaggtgataactgttttagaatgatgctactctgtaagtatgaaagttctctaatctatcactagattggctaactaatgaggatgagtagagacagaatatgaatttaaatacgcattcattccttgccttcaccaagatttatttgtaaatcaatgttattttattttcccattagttatatttgaagtaattcattccaaatatagaaaataattaattcttgaaaaattaaattcaaaagctacaatttaaaaattaagtttcatggagttaagtattaaaagacattagtcctaaacacagtctattccttgacaccagtgttttctctgtaagccattctgtataataagccgactaacattctaacacctactctaaaatgatgatctctctcctaactgtaaaataattctagtattatttttcattattaactatgattttgaaaagttgaaatgatttagttgtatgacagtatatattagaatttagtggaatgtaagcataaaaaactatttaacaacgttcttctaagagtcagctcataggtcatatccttcataaaacttatcggaagctttcttccacccaattaacaaatccctgaggggtcaactgtaccctatatggttgttcagagtctgtcattccttgagtaatacattataatagtagctctaaaactttaacatacagcagaatcttctggagtgctggttaaactacaaattgcagagcctcacagtcagagttcctgatttatgaggtctgggtggaacaaaataatttgcatttctgtacaatcctaaggtgaagctgatgctgtcagtctggggaccacattttgagaaccactgctttcagagtgtttcattttcaaaaagtctgcctcccactatgagactagaaccactaaagagcagatatggtgcctagcatgttctaggcactcaatacatatttctgaatgaaagaatgcagaggcccctgcaatgtttggaggagaaccaaatgaaaaatgagaagactgacaacgcaagtttcgggaaataaactatatatatatatatatatataacttagcagattcaaattttatttaaaccactgtgaagtcaatactctgaccttacaaatggttcagtgaaaatcttttgatgtaaagaaaaatgcgaagagtttgaaattaatacttggtctaggttcctctaagtccttttccaaaatatgcctatgtgtatctgttcattaagcaaacatttactgaatatataccataagcaatcaagctagaaaacataggaaacgacaagttgaccaaagtattacttcattttaacaaaagtggatcaaacaagtattcatcatacaattctaggaaaggggggtaccaaccgccagaaacaagagatgttctagaaactcaaagtagttcactagtgaggattttgaggtaggtagcagatagggaatcacagaaagagctggaaaactacgtaaacatataaagctggcccgaggacgggaaggctttgaatgtaagactaaggaatttgaacttacttttgtaggggtgagaagaaagcaatacttagcaaaactaaacttcaggcagggtatatgcttgagtagaaggagactagaggcagaaggactagtgagaaagctactgaaatgttctccacagaggtcagagcgacctaaaccaggtggtagcattaggagtgaaacacacagaaggcaaaatcagcagttaggcaaccgattaaatgcatggcaagagagagaaaaatgaattaaatggaaaggttttgagccttaatgacccaataaatgaagatgccacttaaaagctaaagaagccaagatgatagagtcaatatacttaaagacaattaatcataaacttcagaagcactcacttgcaggaacttctatcagagccctgggttgggggaatcctagcagtgtgttcactttgccatatacatgtgtaaagtgtgtaagtcttttattttattttattttatttgtttatttatttgagacggagtctcgctctgtcgccaggttgaagtgcagtggcgcaatctcggctcattgcaagctccgcctcccgggttcacgccattctcctgcctcagcctcccgagtagctgggactgcaggcgcccgccatcgcgcccggctaagtgtgtaagtcatttctatcttgcctgcttaagcttctccttccactcctccaacatttccttagtcacactcacctcccaccagatggccctggagaggctgtggtcatttttatttaacttttggcattctttccttaattggaactccttgaattatattagctttaagccctgaaaaatctgaatctgaccctgcaagaatagtttctggttgtgaggaagctgtgctcagttgtattcttggactttgatgcactacccagaatttcaggtggaaaaagcccaccatgggtttaaaaatctagcagaacatttgggactggggaaatacatgaggatagttgatgaaattactcaagaagagaaaacagacagaggggagaagacctaacattaaatttctgtaccctgacatcaagaacaggaagaagaaactgagaaagaagaagaggatggaacaatcagaatggatgaaaacaacaataaaacaatgtagtccagtgacataaatgccaagggaagaatgaatcttaactaagtaaagatgtagactgttccctgtgctgaaaagaccagaaaagatgagtgctgatataaagccattcctatggattggtggtcactggaagggaagatatgaatagagggagaagtttgtcatgccccccaccaggtcccatggcggagctacaggacagtttttctaacctcccttagggggatggggactaaaatttgctgctgctctagtgacaagcagtttacatatccactggaatatcgtaagatggtaagctagtatgattgacattttacaaatgagaaaacgtgtccaaagtgacaccaccaaccagagctggaactcaaattccagattttcctaactccaagtctactgtcttattctcatggccaattttaatagcaatgtacctatctatcttcactattattaacagtattattcaaataattacctggaatttagaaacagaatagccttgtctaattttaggactgttttctgaggttccacttcaattagaaatgcacacattagaaaatgcacgctattgcttcagtaatattttatatgtttgtaaccctttatttaaaaattaatctgataacatttgtgaacatgttaaaaagctaaaatgtcagcactttacttttccttcttcacagtttctaatctgtagagcctaacaaaaaaatgattaacatttcaaaagaaaacaaggaaaaacctggtagaaatatatttagcagagaaagtttctaagtatgatctgttgtttgaatatattttttaaaaagaagttcaaagtaagcattttacttcttgcattcataaagtgtttatcagttttcatcaaaacaaagaaaataagacacgattttgtttttttcatttcatgggctgatttttcatattttaaaaatattttacgtttgtagtccaatattaatatttaacacatggattaatgtacatgtgctgaaagatgaattgaataaatgccaggaattattaacaagcaatttcaactaaaactataaaacaatttcagcaacaattaccttaagtgataaattttccttcaatttaagaaataattttatccctcagctgtttattgaaattattattttgtacttgctgtatctgaagacagcaaaagacttagcccatgtaaaagtagaaagtactttttcataagtattttaatttcttacgataacacttagctattaaataaaattgcgggctggcagctgtaggctcaggcatataatggaagagaaagatggaaataccaaaggggcaggtagtcatgagcaaggacctgaaactttgatatatttgaagttttcacctgcaaccttatcttcagtttggtagtaacactactatttagtgttacttgcttatagttgtttctatccattaacttgctttgttaccttttgctatgtatataattatattctatgtacataattatatagagttgatgctatcctaaacaatgctttaaagggtatattttgtaattcctaggctgttctttgctaagggacttcagctagagcacacctatggtgcaatttactgtgttgaaactaggcagaacatcaacaataaaatttggaacacaccttaggtatggctaaaattttttaaactgacaatactaagtgtaaacaaaaaaacagaaacactgtaattctcatatattatcagtggaagtttaaaatcatgcacccaccttgagaaactgtgggacaaagtctaacaaagttaaacaaaatcctgtttcctagcctttccacttttaatatatgctcaatagaaatgactattgtgtcccaactcatttaaaaatgcttataggtataatagccccaaactggaaacaaaccaaatgttcttccacatgagaataaataatcaaatcgtggtatatgcatacaatggaatatgactcagaaataaaaaataaccaaccaatgatacatacaacatggataaatttcaaaaatatgatgatccaaagaaaccagacacaaaacagaacattctttacaatcccatttatatcaacttcaggacagggaaaatcacttatgatgatagttatcagaatagcagctgggcagaggagaactgtgactaagacgtagcttgagagtcacttcctagaattacagaaatgccctgtgtatggatgtgggtagtaaacacatgtgggtatatataggttaaaattattccactgacttatacacttaaaaacttgcacaattgtattgtatttaaattatatttcattgttaaatagaagtcaaaaccaaagaaaaccttcatcatgcttctttttcttttttcttctccctccctccctccttccctcccttccttcctttcctcctttctttctttttttttgttttgacagagtctcgctctttcacccgggctgaagtgcagtggaaaaatctcagctcactgcaacctctgcctcccacgttcaagggattctcctgcttcagcctcctgagtagctgggattacaggcatgagccaccttgcctggctaatttttgtatttttagtagagacagggtttcaccaggttggccaggctggtcgcgaactcctgacctcaagtaatctcccgccttggcctcccaaaatgctgggattacaggtgtgagccactgtgcccggccacttctttttcttacatggccacttatttttcttctttttcttatattttttatatgtgtattctgattttcctcgtaggattttttgcttgttgaaatgaagcagttaagatgtgactaatacaacagagagcatcttgaaaagaatgacatcatatagcaagcctgtccaatctgcagcctgcatatgacctagggtggctttgaatgtggcccaacacacattcgtaaacttccttaaaacatgagatatttttgtaattttttttgttttttttttagttcatcagttattgttagtgctagtgtattttatgtgtggcccaagacaattcttcttccaatgtggcccagggaagccaaaagcatggacacccctgtatagcatgagtaaacacctcagcaccaaggctagtaacagaagagatgaatgacttaataacatttaattccctcactctcccttctccaggctgcagcattctcaagaatgaattggaaacttcggttgggtgtggtggctcacacctataatcccagcactttgggaggccgaagtgggtgaatcacgaggtcaggagttcgagaccagcctggccaacagggtgaaacccatctttacgaaaaatacaaaaaaaaatagctggcatagtggtgggcacctgtaatcccagctactcaggaggccgaggcaggaaaatcgtttgaaaccaggaggcagaggttgcagtgagccgagatcgtgtcactgaactccagcccaggcaacagagtgagactccatctcaaaaacaaaaacaaaaaaagaattggaaacttttcatttcctactaattccgtcaccgctataaacttctgtcacctctcctaaattccaaaacctcactatgctagtaagagcctcatgcacttgactcctgacccagaactgcttggtcaaccttctaacacatcttgtctcttgttatttcaagcacagttatctgagtagatgctagctcaataccccctgcctgtggaaatatattaaatgcctccacatacagaatcatctccaaggggtagaagataagaaggctagaaaagaagttaacaatagagaaaaataccaatagattgattacaggaaaatattacattcctaaacattaatagcaccataaacaaaattaaaaggtatgtaattaactgagaaaaaaatgttagcaatatatataaaaatactaaaaagggctaacaacatcaataaagaattcttgcaaatcaatgtgaataaaaggaacacatcactaggtaatgcaaggtaatgaacagataatttggtgaaatacaattggcaaatccacatgtgaagatgttcaaacgcagtagaagttaaaacagtgtaaaacagttaaaacgatgagggtttttttttcttataaaatgataaggactgaaaataataattgcaatctgggaggcccattgtgctggatagtacaggaggtagtataaagaaacatacagaggaggagaactcagtttggcagtgagtattaaaaatctaaaaataactataccttctaactcatttccacacttcgtacacaatacaaatatttagattaaactatcatatataacagtagtgtgtgtgtgtgtgtgtgtgtgtgtgtgtgtgtgtgtgtatatatatatatatatatatatatatatatatatatatatatatatatatatatatttttttttttcccccccgagacggagtctcactctgtcacccaggctacagtgcggtggagcaacctcggctcactgcaacctccacctcccaggttcgaatgattctccagcctcagtctcccgagtagctaggaatataggcatgtgccaccatgcccggctaatttttttaattttaatagagacagggtttcactatgttggccaggctggtcttgaaatcctgacctcgtgacccacccgcctcggcctccaaaagtgctgggattacaggcgtgagccactgcacccggccagtgtttataaaatttttaatggaaaaaaatctatctgtccaatatcaaaaagattggtaaaataagtgcagtctagatgatatgccacgtatctctaaatatttatattatagaaggaaattaatatcaacaaaagatgtgtatgatgccatattagtttttttaaaaaggttgcaatacagtctgcacagtaggcttctatttttttttaaatgattaaatacataaaggcaaactactaaaaggaatataccaaaattttaatagtgattttctttagatacgattctggatattctattttcgttctcaaacttctgttttccaaatcttctatagcgataattataatcactaataaccaatgttatcgaaaatttccatgatctctaaatgccttaaagagttcgacagaaagaatttaaaaacataggctctcctttttcttctttcattagtgatgatgggctattaaaacaaggccacgtccttttgctttaacctcccatccccagggatttcacattagaatgtccttcctcccaatacctactcctaaccttccccaacccagaagttagtttctctccattaaaaaaatccccacagtagtataaattaagcaaggaaccattttaaactgtcagcttaatggtgcacacaggaaatatggctgctctcagtgcaagaaaattttaatgaataaagtagcttaagaaaaagatattttccaactataagtggaaaacttgttcagtttctcagaggttgtttactgccataggaattacctatttaaacttcttcacaacgttatcacttggatatggttaggttattctgcgtgtgggcgactcattaataaagctgaaggaaaagcaggacagtgctaggaaagaaatctagagctggacatttaatattcttgtgtgtcagagactacatttgtaatattaggggtgggaagtagttacttgctaaaatcccactttatactccgtttctgattctaggggtgtttttgtcatccatacaaagtcaaaaagaatgcaaaattataacccaataataatgtcattttttaaagaaaagtatagatgattcaagaccaagaaagaggcagttcataaaagatttaatgttgaaaaaccacaaacataaaaggaggctaaaattggaaaagacattataaaatctaaaactttaaaaatttgatatgataaaatatatgctggaaataatatgcaagaaagctgcatcaaagctttcttggtcaaaggaaaaagtgttaactattaagagattttttaccttaaaaaatacaaagaaacaacttagtttgcattatagactaaaataatcttttcaaaggatattgagaatagaggaccaaagagtgtttttatggaaggacaaaaggagaatgcagagtgagatttaaaagttgtgtgtgtgcatgcatataaccctcaaaagtataactccacaccaaaaacaaagaagtagctgtatctagggatgttctattccatcaaaactatgtctgtgaagctttaaagggaatcttcttgcagtctacttcctatatgaatactctctatgtataacagttcattctaagagaagagcaatagatttaaccacttgttagtatccttgttagcagtatatcaacagcaattgatcactaatgtgaaggtatcaggttttaggtaacttccaacaccattctccttgtgttcaagtgattttcctgcatcctctgaatagaaaccatcactgctaagaattgctccttagacagtacctgctggaggcttgcaaagatcttaggtaaaaagtcgtaagttgaagatattagttgataatggcataaggtcttgttcctcaagcaattgtgctaggaccgtctacattataatctcttaaagtggatatttagaaatgcaaattcttgagccctacccccagattactcaatagaatctttaaaggtacaacctaggcatgtgcagtttcagtaaactccttaggtgattctgatacagtttaaattttaagaattaaaatttaattatatctgtttgtattacatctcttcaacatacagcaaattttaataaaagctatcgaggtactaagaaatgaattgtaaatggtgaaatcacaggcaatggaaggaatatttaggtgttgcaggcaatttattatagcttgaaaatcataccatgctaactgtagctagctttaaagtaagttctgactaacagactgaacatattattgcttctgtgtgagtagaagaggttatttagaaatctttctacaaacatttgagtatctatgaaaatttacttttgcacactgagatataacaaaaaccacactttctgtcctcaggaaatttaatccaggaaaattagagctctgttttgaaagcagaggaagttaatttaaaaaacacagactggatgtatcttaacatcacctcctaagctcactaatgatacctgaaagcattcaccttcacctagttggagagatctctgctgcaaggaaaatgttaaccatcttgccagctaggcatcattcttcatactataataagcaaaaggcatttccaaagtgagactctctttgtaaatttgtttgtcattcttgtgaagaatcagatgctgtaattattaagctttttacagaacatttcaattttccaattgctctttaataattcccagcaagtaattggacattttaattatatgtagcttcttgtcactgttcatctaaaaaacatcacaacattaaactaagatgctcagcctgagtgttttcttgggttgtatgcatattttttgagttatttcaacaatgatcaaaagccagtgagttcatccttcaaactggaatcctcatttcttttccaaaagacaaaaactaataagcaacaaaaaaattaaaccatcacactaacaaaatgtattaaaagtcaatcgataatactggccatcacaccaacaacctctacctttattttattttcccataaagagccactaatccattttgtttttttctactagcttagcaagtccatatggactggaccctttcagtgtttctttcccagaatccctgcagaatcattgatctccttgatctactcatctctttgatcttttgaggatagtctacaaatagcctgtgctcccctacgtgggtggcaatagcagccctggagccttcaaaccagcttatggggttatagtcccagctctgccagttacaaacatgcgactaagtcaggccaattaaagtgaccgggctgcaacgttgccctacctgcaaaatggggcaaaaatcttccatatttaatttacaggcttgtgcagatttcatatgaaataaaaagagaagccactgtgtaaaccttgaaatctctacaaatgtgaaaatgaaaatgaaccaaacatctccccaatattagcatgacatctatcaggctcctatagaaatcagtaatgaaggaggatgtgtgcccacccagccatgccatggtacaaatggggcctctggtgtgtcagaaaagcaactggaaaatggaaaagagatggttcccatctttcctgtgtctgttctaggacactgcgagtcctcccgaaggtgtctgaaagaacacaaggcaggcatgttaagtgtgaaagacagcagaatggatttgacggcctctattaggcctgaggtcttttggcagagagtgagagaatgtcctattccaagcagaaggcacctgataagcacttgattgattggtctctgcattcttggcactcagtgaaacactgatttgccagcagagtgtgtaaacacccacattttggtaataacctaaatatctgcatattgtgaatgaggaggctgactgaatgaaattgtgtaaaaacagaaagtcaactccctgcaagtcttgccttcaccattctctttgcagatgcaggacttttaacagtgaggatattaggacatccacaagtgaaggatggagccctgccctgctctttgggagctttttgcctgtgtgtgtgtgtctggccctcattcaaggatatgctcctctctggcaactcccagccaatgtctagagagcacagcactgtgttttccaacttaactaagaattaggtctctttgctactgcctttccttaagaccaggaccaaatatatatatatatatatatgtatgtagatattgtttaacgggcctcacgtctaggcaaaatacacacacatacatacacacacgtacatacaaagtcattcattcaatagtaagctgcatttgtctggaattactaacaaaaattgaattagcaattattgcactgttgttttcttttaaaagcacaagttaaagtagtgttttctgctcatgcttaataagattgcctttctctctatttaccacatacccatctttcagagcttctctaaaagcctatgtctttcttgaagcttttactgattcccttgctggaaaatgtatctctgatttctaaatacctacactgccctagcacagattgctaagtcatgttctttggaggtcctatttcccaaatggcaggcactccatcacaagggtctccaaaattctccaaaacactagggaatgtatgaatatgtgaggtgggaccgatattcatattggctccagaggagccaggcaatgctttctccagggatacttttcactattatctgttatctagaaaatcgccttcattttaagatatttagaagaaaatccaagttatgtggtttcatagattaaacttattgctggcacttacataccactaaaagttaaccttggaggaggggcgatacagactataactttaatcatatcagcttcttgtcttaaccacatcttgctttgactgaactactctgatcctaaggactcctgactgttgatatcacagcttaaaggctttcttcagactccgggagagaaagtggtgggacactctgtaaagtgattcagttccaaagtatatatatcatcccaggtgatcatagagcttaaataaagttgcttcaaactagcatgaaattttgtctaatacacagtccccaaaagaacctctttagaaagaggatgaaaacatttaaacatggatgttaagttcctattaaaacactcatttattttaagaaattcgctagttatgttttaaaaattgataattaaattacagttgctgagcattttcctttgacttggtattttgaaatgcttgtgttctgtctaaatgctagattcttagcatttggctaaggtatacgcatcaaaatggccacagtaaaggaagtgacattagtaattctgggctaggaagcactgtttctcttaccgaaatctctcgcaactgtaatccagccaggtaaagatagctttgtgtttgctgacattttcagagttgattgggcaaaaaaggtgcaatcattttcctaagtttttcctcgtcatctttaccctctccccaccaccccctgccgttattttcaaaaggcttaatctaaattctaaaggaatgttctaagagagcgaggaaaaaaatattcaacactaaactgcagcaatagccttgacagttcagttctgctgcaggtgtcctggtttaactcccacatggacaaaggggatacaaattgttgggttactacacaatatcctcttgttaacatcgtgttgtcctcttttggaagaatcagacaccaggaaaggatctcaatttcaaccctttgtcttttacttaaagaatctaccaaatcagtctagaatgataagaatgaaatgtgttttaaaaagctcagaggagtctaccttatatctaacctcagtcctttctgttttttttttttttccagagcagaaaagacccactgttggagaggggttcatctgtcacttgaggggcagcagcaatttatcagttcctgtgccagatgtttacataatatcaagtcttcacaacagtcctacagaggccctatttcactccaggcaaaaccaaggctcagaggcttaggaactgcccaaggtcagatagttagtagacgcaatgagaattataagagtaatcctttatgtcacaagggaattccagaattcctgtaatgttattttaagtggaatgtgtgaaatgccagtaaataaacaacaacaattctggtgttaaattgaagaaacaaaagaatctttaagaacaatgtagttaagagactcaaactagaaagaatttaccatcctttctgaatgttgctccaacttatagtctaatataaaaactcataagaaatgagtagtagagatgcttaaattctctatctagtctacaataccatgcatctagaaacgacacaatttgatttttaaaatcttcaaggcttcataattaagagaccataattaaaattagaatactcaaataagtttattaattgtcagtcttttctctatatcctgccttcagaattatacgattttatttaaccatttgcaggattcctttcatctcaggagagtataatcatataatcagactcatcaccactgttcccttttaattgtaaatcatgactgcgcttgcaaattagtctattatcacagcagattatcaatttggtagggaaagtatttgccatctagaatgaaagtagttaataaacattaataaacatcttaaatcaatcactcctttactcttggtgtgccgacagatgtcatttgagattaataaatcagtcagaacaaataaagtgatgaggaagcgaagcacaaggaagcctctcgatgccctgtgtacttaagaatcacaatgcctaaaaactaattggaagataaagataaggcattaaaccttcagagaaatgacttgttggaaattagacaaagtaaatccagatagccattctctgtgggtctgttatgaaccactggcaataaaagctagaggagaaacaaaatgctcagtcagaataaattatgtttattgacagcataatgtagaggttaaaagcatggactttcttttttctttttctttttttttttttttttgagacggagtttagctcttgttgcccaggctggagtgtgcaatggcttgatctcggctcactgcaacctctgcctcccaggttcaagcgattcttctgcctgaccctcctgagtagctgggattacaggcaaaggccaccatgcccagctaattttgtatttttagtacggatggggtttctctatgttggtcaggctggtctcgaactcccgacctcaaatgatctgctcgcctcagcctcccaaagtgctgggactacaggcgtgagccaccgcacctggccaaaagcatggactttctaattggcctgcttgggtttgaatccagggcccacaacttccgtttcagtgacttaactatttcttaattttgctgtgcctcaatatccttatgggtaaaatgggagagtaaagtacctatctcataaagttgttgtaaggattaaatgaatcaatattttgttaagagtttaaaacagcacctggcatataacaagcactgagtgattgttcaataactaaatgatataattggccatttactaccattttatgtgctctagttctttctctgcacaggcttttatgagggagaattggggttgtgaagtaatcccacaatattttaatcacttcctcactataagccaagagttgaattaattcattttgtaaaaataattaaaatttaattaattctattaaaaagaaaaaaacacaaatttttcatttaaaaataagattactgaggcaaaatgttaacagtacaaatagactgttgttgtatagtccagtcattaattaaaggcatccagatatcaataccttgtgtattaacacaagacttttgtataaagatgtttaccagaagcccatcaggagtgttccacttttagttatggcacaaaacgttatccactagcatcatcaacaactcctctatatctcacctaggactagtcccaagaaaaagaatgagtagggaaaccaaatacattatttgcatatttaacagcatgtccaattagccactttgctgacagagactaatttattattcatcttattccagcatatgttactactttgacatccacgtgacaaatgactgatacagcacattgtgattttgaaaatgttaactgtggacttcaagaaaatgtagcttagactattgaggaaagtttctctgcttcaccttcagaaatatggaatctagaaaatgatcaatttttctactatgtaggcacaaatggtccaatatgacataattttcagaaatgagtatgaaataaaaggaaataagctatcaaatggtgccctgaaaaccaaatagaaggttcaatctctacgtacatcctctaggcaaaaattctcagaggtatttaaattagacatgttccagtattatttctctatactagattgtaatatattttataattgaaaaggataactatacataaaatgatatagatgcatagataggaactaaatcattcattcaattaacaaagacagaatcttgaaaaatttgaaagccaagttcctcagaaaaaccacatacttctttcaaatgtgcttggatagttttatattagaaagagaaaaaaaaaaaaaagataaaacaatgtgttgctgcatgccccttcaaaatgtgctcatcggttactgtgagagtactgtgtcacggggctaccacacttttcctgaatgtattttttagaacagcatcacagtcaactcctagtgaagtactttatgctctgtaactatccacactttagatttttcagtcttaacataaaattaaaaatttcagaatctaaaattatctgttttaagtagcattaaaaataccacttctctttaagcagctctgaaacctgaagtcatctagaaaaatatgccatgatgaccaaatggtaactaattgccaagacagactaaaccacataaataattacatgtaccatcgttagtccaatggcaacccagataatcaaaaaaaccatgattatcatggcatcatggcagaagtgttgtccaaataagtaaatttcactgccttgtattttaccacatattaaaaagcactcttttacaatctgttaattttttttctttctttatagttgctgattttcagagatatatcataatgcttttaccaattttaattatttgacaaacaagtcaccaaatatatacaggaacatttaaaagttcacaaccttggtttaaaaaatgtaggtcacattatgcaatacatttaaactggggatctcagagcccaaagggttctatattctgaatttcacaacaaaaatgactacaagattcaaagaaagttcatagaaaacaacatatacataaccacataccttgaaaatacactggagaaacacctttctatactgcctcagttaaaattcacaaatctcaccgatattaagttcccacaattaatgcagcaggttcttcttatctacttgtatatttagtgattaaaaggaagtctgtacaggaatcatcatcttctagtgttaaagctttttagtatagtggttactatttaataaataacattccttatcactacctgagcataacccttcaagtcaaatttgagaacagtcctcatttattaatccatctccatcttcctacttactgactaagtaccacaaggtaatattagataaaattccttccactgaaatgcagacataaatttcacatctatattgacttgaaattcttaataactatgagttagctactcttttgtggctaattttattgttaatgaagaacattttttgagacatgaattggaaagtaccaatgctgggacaaatttcaggtcttctaatttaaatccagtgggttttgtttgttagtcttttccaaaaccctgccttttatattgtcatggaaaagcaaatgtacagtggctatatattaattaggtgaacctgacataatcatcacctctttaaatttgtttccttgtcagcaaaatgatgatcataagccctgccgtggttgtgatgatgattaaatgagacactttatatgaaggcactgtggaaatatatacttaaaagatagctgttttcactcagttctgtcaaaagcttgagggaatgcattgttatgtgatcaacactgaacaatcttgtattttgtgagagaatggaatattttaaaaggccattacaagcttctatgtggagagatattctacaccctacatagaccagaaagggctgggcaaaaagaccaaatgaaagaagcgggtgcttttctaagaggaaatccttgagacctcagttgcgagacaagtactaggccaaatgcaccttgagcctgaccaccacgccatggctcctgtgcacctaagtaagccactcccagaataatcatgaggacaattagatggcttaagggacctgaatataatctttgcaaaaatatctccagttacaatatgtttagaatcaatacgtccctgggaaaagacaacaagaccatgaggattttaagaaatccttatgatcaaaggaaacttagaattggaaatgatcttagaggtctgctagtccaatttaaaaaaaagagagagagaaacagagaaaaacgaaacaagaatatgaatgacaaaacagtataaaaagtcatgctcattattattgagattgttaacatctcaaaacataaattgtgtttttttctttaaaagaggcacacactgtagcataaatgagtcatcgagggctgactgtggtgatggtcaacagtaaaggaaagctggttttctctgtatgaaccaagtttggttgctctattctcttctcaaagaccaagcctctaatcccagttaattgtctaaaaaggactgcttttggtcatacagtatacaggtgagagtgtagatgaattagtgcaggctttcccttctattggagtacaggctttatggaagagtattccataggaggaggaagatgagttagaagatatgggtcctgcctccatctctgctgctgatttgctgtgaccctatgagtgtagttcacttaaattatttagatctctgttgtcacatctgtaaaatgaaaggaatatactcctcaaactttagaactgaaagaaatgatgttcaaagtggtaactgaattccataagtcactgagttaataactggctgaactgggacaggaactcaggtcttctgattttaaggtctagatttcccctacatgtgctctaaagtctcttttaagtatttcttaaaaaaaaaaaaaaatcattgggaacctactatagtctgggcacttttcaaattcatggtctcatttattcttcacttattgtattttcattttataaatggagaaaacattcttagtaaagataagcagcttcgtacatttacacagtgctagtaaatggcaatggccaaatttttacacagatatgtttctgagaagtatttagtcagaccagtctgcattaattattcattattagtgtaaatttaaatcactgaattcctatcttaactacatttacaaaacaagacttatatctgttcgaaaagtagaaattgttatgttttgttagaaaaaatatatgcagcaacttggtggaaaacaactgtataaagagctctttctagaacattaataatgaagggcaatagaaagtggtgtagataaaatttactattttgatgtttttatcagatcatttcatggtgagtcccagatgattgctacatatacataaactttatgttttttgcatttatgcttggaaactatgtatttttaaggaaaaaattgaatttgcctctttaaggattaactctttccaacaatagcttggatttttagaactaagttgtaaacttcttgatggttctgcctccgatatcttgcctcctccaacctcaactctactctcatccttattattctctggtcctccatggtacctggtacacaaatacaaacacatgctcatagtaggaatttatgatatatttagtgaataaatgaatgcatgaatgaacaatctaagaaataaatctattaaagttttgggcaaccaaaaaattattctaaagtgccagggttacttggatcatcattgattcaaagattcttccaaaaatagtagctggccatcttgttgaaaacagcatttaagtgatataacattttgtccaagaatccaaagtaaggaaaaggtgtggaacaccagtgtctgtttcagcagaacagtcatagccaaaaacattctgggtcacacatatgaattcattaccagctaattaatattaaacattaaagctaaatatttccccaatgtagagaatattgtcaaaggttttgctagctctcttggttgccacacaaaagagtaaagggattactctatgaaacattaacctcctgcctcctggaaaaacagagaaacaaaaacctcctcagcagaatcaatgaagtaatctgcaggactccagtgaggtaccaacagctttctaacagtgtgcattattgttaaaacatgcttgaagcaaaacgctggaccatgtatcttgtaattatttcttaagagatcaaccattaaacggcatagaggaccctcttagtttaagtttaagtttaaaaacctctgagctcatagaattgctctgggctatgggccataggccttgattctaattcctctttgactctgatcagacatctggctccgtcttttggcccatttatggtatgcctcagtatccctacaggaaaatcacattcaaactcactctgaaacctacctatcctcttagaagtttggtatgtgtactgaaagtgtctcagaaacagaaacattataaattcaagatataattattatccttatataacaccattaagcaacttcaattacaaaccacacttttaaaatctgttaacacttccttctgggaaagcccttttgccctttaatagtgtaagctaatcatggcaatataatttccagagctcatatttgtgggaggagaaaggatggcactggtggctttctccttcctttatctcctgaaattattgagagactctaagctaattttctaaagtatgcagaggcacttaggaaagccgggagctgagatgggaacctaagcatttcactgacatcattccatgctccccacatatggcacatcacataagcagtactggctgagcacactggtctattctggactcttgttggcgttaagtagcattcttaattacaagcaggcttgctttttgtcatttacagtcacacagttctccctctatttaactagaaaaaaaaaacacaatttttctatggaggtagtttcaccatttatgtttttgagccaatgcaaaatataaaaggaccctgcagtgttctcaaaacctgcttctcacaggcccttaaaaaaaatcctcatcataatctctgcaactgggtcagcttgcacaaagatactcgggtagccatgagcgctctctgcgccctgcaaaccttgtaagtgacacctcataatagtgcaaatgaagcatggcaagatgagaaaatgaagaagaatgaacctggatagtcagcccagcagctttcaaaacataggggactcaattttattccttaaactataccataaatgaatttttattttacacattcaagcatatacatgcattctctattatgaaagaaaatgtcttacgattcacagaaattctaatacaaccaaacagcctagttcatttgttcatctagccaaataaatttgcaatagtctcagattttgaactaaacctcattttcacttgtcttgactttcagctatgaatttatcatattgtcattaacgtttgtgctttcctttcaccctcatctattaggctcaagggttctttacttgtgggtcctttgtcccaacaactagcgaaatattcagagagctattgacccaacaaattcaacatcacctctttcttattaggtttctctttaagccatcaccctgcctgccgtgttctcagtccctctgcactcacacctcaccccatttctccatcccccaccctgagaggcttattttttatcctaatgttccttgattgttctctataaagttaatattattttcaaaagagagaaaggatgaagtatgagaaattcacacctggcttttatttggcaggggttggttactgacatgtaagtttgcgcctctgattgaaaaaaacaaagaatcagaagaggagcagcctcttccaaaagagtaagcatgaaggagagtgggcagaaatccaaaaatacacaaacacgaccatacaacagaaccttcgaaggaaacagaaagttctttgacccaaaagaataataccaaccactatacacacaacaattttctctactatcctattctttctctttttcgatgacagacacctctgatttttcattcacatgcagagacaatcactgtattctggagggaaagaaatgtttgtaaaggccagcagacggcgcctgactggggcagaagcttgcagcggagaggaaaaaggagtgccccactctgcggcagggccccttggtcttctcctctcccacgtccccagcagccttatccctctggagagaggccgagacacagaaaaggagaagttgcatatgagattattagccaagtgcttcccactggcacaattaggtgttccacctgctccatacacccatctgcctcaccacacccacctacccacactctgcccttcctgcaccctggcttgcctccgtccctcaggactcacacaattctgcacaaaggcagggcagtggttgagaactgcacccaggtaaagggaacaacaagctcctagaatactgtgggcttgtggtgagatcaccagaaactccttattctttcagagagatctaatctctgttacttataaaaataatccctagcttgggacatcactctcgtctccatactagacactcttaactggagagaatttctgggagagaactaggagaaggagaaaggaacaaattcctagaacccacagggatgtgttttttctagtatgctcccaaagagggcttgctaggggacttggtctctcttcagttagattatgctatagtttttcatatctaaccagaattgtccccaggtgggaaacccccaccccaccctgcatccatggaataaagggccatcctggtagcaccagcagctgctcagggcagagcaaactcataaggagtggggcaaaggattctgagctgaaacaagtctgaaaggtgacgggtcctgcaagaaagaggtggaaaatggatataaaaaaagtgcccacaactttcactctgctttctaaacaagtgcattttacaccggggtagaataaaaattgggagtggggaacgactcacaaaaacagattgatgttttaatttttggcaattcggggaatctggaatagatatttatctgaaaattagaggaatctggcctcacagtgctggtcactctggaggagaaagctgccaaccaaggcttttctctacactctgctgttttcaaagggacagggcattaggagaatagtttcccttagctctaacttcttctccaggcagacctccgggcttagcccagccagcattgactgacttgcccttcctggaaagcattaatcactgaaggaggaagtaagacctccctggttccaatagccttcacacgtgatcctccgggagatgggtatgtgtagtcaagcctctctctgttccatttagaaaagaactcagcctaattaccaagaaaaagacatatatttatgtgcagagtggatggaaggggaatggtgtccagaggtcccctccatgcctgcgaagggctggcccgcattaaaggggatgactcggttgccctcctagcttttctaattaagggaaggcgtgggggcaaaagtaattggcctcctgttgagtgagtcccaggactgcttcgctgtcactgcagtctgggcgcactttggaggaatgtgcgggctggaatctctccctccccgccccccggggccagggaagatgggcaggaggtggggcagcatatacagcacagacaaaaggttctgcagagccctcttctctctggtgctcaggtcccttagctgagcgcggcgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacccgcgacgccttcccccatcccctttctattgtcttcaaagagataagtggctcgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgcaaggatgccggtgacctgtagattgcaataggcactgaatgatgcttgctgctgccatggaaatggtggatgtggtgcgctcccaaactggatgccccccacgccactcctaggaggccgctgagggtgagcgggactatccaaagcagggccaggcgcccccctgcgccgccgccgccgccgccgccgccgccgcccccgggcgagcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaagcgcggagcgggtggctgctcccagatttccagggctccaggttctcgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcagcgcgcggagcagcggcgcgcatcgcctgctcccgaggcaatctccgcgtccgccgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaagaaaagaaaaaccacacacgctggtgaagcaaggggctctatgcaaatctgcagtctccaaacagcaaatcactgaagctcggatgcaatgcagaggacgagcctatgtaacgagggaggctggtctagcttcccacgaaaatcgccctgctttgcctctcccttgcattctccacgcatcaaagggacacgtgtaaggcgaaacgggaacacctaaaaagcaactctccctccaccaggtgatccctccatctgaactacaatggcaaatggcacccttcccctacccaatggtttagatgtaaccagtgtctttagagatcttaaaagggagagaattcgggtctttttattggaccaaacttgttctaccaggtgtttaaactcaatctgctaaatatggcttgataccttgtactcaagcatcagtcgcgatgatctgttaatcacatatgttactcataacaaggattcttcttcccattaccatattatatctcatataaggcagtggaagttcaggggaccaaaactcacaaggagggaaaaggatgcattaatttggcagctgcagaagaggcagaaagtggaagaatgggaagagaggaagagaagggtcaggagagaaacaggaagaaagcagaaaagaaagaaatggcatgaataaaattgcttgtatttcagtcaatattttaggaatatttaagatcttccaagatctctatagaagccccgctgtgatgatctttgctaacagtggaactcctcctttctctcatcctgtcttataaagaaaatagcatcaggaaatgaaaattcctaaatctagtgcccccaagggaaataggacatttatatgcttttgatgaaatacagcatctttaactgaaagctgtgtgtcctagatgaaagaccagcaaagccagcataaatttaagagtagaaatctagcaatgcaagtgaacttggctaggaggaccacaggcactggatgctggtgattaagacttgggactatgatttaaacatttccctgatttccaaaagatgataaaaaactatgacatgtccagtggctggacttttttttttttgtctttatttctatttaaagccaaaagaaagcaacattgaacaggaatgatttctcactagcttctcaccatctacataattgttatcaacaaatataaagtccagtattttttaaaaaatgtaattctgggaagatttgattcaaatcagctactaacccaagtggccatttagacttgtatattgcttcctagtccaaagattcaaccatgggactctgatgcccactatataaatagtgtccagtggcccccaaatcacacctgtagcaatcacacatgtcacattcctgtcaaaagtttattttatgatactaaaagataattcttcagtagtatattgattgaaacagttcagccttgctaaacatgatgcttttatctatttaaatatgccgtgtctcccaaccttccacagctgctcgaaggccagcagacgcaaaatctatcattttccactgtgaactgtttctgcccttgcccccagtcatttcttactcattttgttattttgcaacatatgtattttaattcactaacaagagtcgtgattattcgttttaaaaatatcaagtagagcttcaaaaagaaaaggaaaatcatccacacagtatgttttcaggactgcaggtccatattctgaatttgacatttcatagtgttagcatggaaagagcactggattaggagttaggaaatccgtactgcatttttgatgccaccatttactggttacatcacattagttactgagtctttccctgaggcactgtggcttcctttataaaatactcatgtttctatctttcctaacaatcccacagggtagaaaggatatcatgcaatatttaatgttggtgttctttaaaatatgtcaactgctccctgacatgaaggcgttatgtctcttctctcatacaggtctaacatattcaagctgatcaccatgcacaatacattcagttgccttccatctaaaagatacgtagaacattgcattgttttccaataccctcatatattgtgttaatctatcctttcctccccaaataaatggtagatgcctgaaggggacaagagtcaagtcttcattcctacttcctctagtgtccagcatatgtgaaacatatctagtctcttagtacttacagtcagttctcattattcacagtagctgtggcaaataaagtccctgtgaacactgaattagcaaatactgaaccattgctcccatggggaaatacagggctatgttcctgcaaacctctgatcacattttcatcactgaatcaatccattgccttgttttatgtgtttctgaatgataatgacaccttccttaatacataatgttgattcatcaacattgaactcatgaccagcagcactctaactcatgcctaaaagaaacatatctaatatgtattttctccataaggcacatcacatctttcttgcatttaggaacattagacagccctttagtattatgcttgagggccattttaaacagcaaagtcaccaacgtaaaacacaaaaacgtggtgctaaaaagacctaaaatagcgcacttgtttacagtgtgagagctgaaacaagaaggaagccaatagtcttgttcaacttcagccaggaacatgtgcattgggaacacaaacgtttgccattctctgcgtgtttgctaaggatcatcaaagtgccagggctacaaataaataacaaggatcaactgtatttgttattctcttgattgctaggaatggataaggctgggactttggagagcgatttgtataaggaaaagccatagaaatagaataagcgtagaagattgtgaataaccttcccaagagcattcaattaggaagatgcttcccctcctccctcactcccctgcctgtcttatattgtctggggccttgggagataaaggcagggttagagaaaggatgggccagaaatcttagttttacaggagtctcaagagctaaagagaaaatatttatggctgcctcaaaagaagaaattgtagctgtagtcttccaggcagatgtctagggcacctttgcaatacttaggaggttctagggtgtatgctgtgatacggatacagcaatatttgttataaatgattgtaattttgtggaacaaggagcaattctctgtctagatagtgtagaaaaagtattgtgggcaaaaacatgagtaatctggatgaagcaaataaagcttgtgtgtacccattaatttgtgtctcttcagctactcagtctttgggcttgcaattttgttatctaagggaaactgaggcagaatctcacaaattgttctcaggtgattgaagaactggttggaggaaacatggtttttggctaactgtaatgtattctaaaaaaattcagcacagacagtgcgatgtaagtgtttcttaacgctgtctgtaccccaagagtgtcagtgcctttatcaggaatttatgccccaacacctcagtcagaattacagcagacagaggtggcttctagaagccttgtgctactatcatctctaattatgatgtggctgtgctcattagttataatatctgttgaaaataagttatcactgatgaaattaagggcttgttaattggtccaacgaaagttaggaggaagttaatcctttgtgaaattattaataggcaagatgcgtgaattaactaaattttacctgaacacgcctcacttctacataaacagagtatgtgactctaagaggcttttcaccctttattatgaggaatggttccataataatagtaataataaaaactaacacttatttctagcacactactctgagtgatttaaatgaattaattcatataatcattacaaaatgatatgaggtaggtactattgttgatccctaacagttcttagtcacttaattctgagagatggtgaggtgggtgctgtcgttgaaatactgtcatatttgcttcaggaaaaccatttttggaagacatttttttcaggtacttaaaagaatgaagagctggaacttcaccaagcttctagaataggctacaaaattttgtgcctactcattaataaatgtctagatctgtagcagaagttggtcttggtgttgaattcattatgagctgtacttgtgtgaactcttggaaacggggttcacactcagttgccgccaacaaccatggctactgagatctacctaaaagaacctaaggactgtatgtgctaagctgtcctaagcccactcacgcctgatgatttatcatgaacaagaatacagggagcctacgttgaacaacagttaagaaatgagacatggatttgaaagttgagaggaaaacacaaaagaaatagaaagagatggaagaggagagtgagtggaagagggagattctggagaaatgggaaaggacaggccatttcaagttatttcttcatattacaaaaatcaacctttttgtctcaaaaaacaggatggttgtcaggcagacactttcattcttttcatattttccttaagcttaattggaaacccttaaagctcagtattaagctttttaaatagaaaagtagacactaaaatcagcagaggggaaatatattaaaacccacaggcagcactaatattttaaaaattaaaaatgagaagagtgtcggtcttgcattttgcatttctaccagtatccccataaagtaaagataagcagaccccacatatccatctacctacttttctgagtttgaactgagcgtcagtaaaaagggacagactcagaagagggtttgttctggagagctgtaaagctaaacccctgatcctgttacccctctggattattgcaggtccctaagagtaagatcagaaaatgagagtaagagcattgataataataataataataataatattataataataataataataataataataatgccaggctaaaagcatctctggagatttactgcaatctttttattattcagatgataaacttgtgttacagaaaagtcaggtttatttatgaagtgtttatttatcttgaggaacactttcacctccaaccaccgatagtccagtcatagatatagattggtgaattcagtcaacttagctattacctagcacctccccaatgatataacaaatcagagggagtgctggggatcaagatgagccaatgcggtactcaagtcactcaaattgaattaaagcctagatgtgcagtttgacttggaaacgtgactagatttattcaagtcaagattggttgtgtttagctctgaaatattctgtaatctctatcttgtctttcattcgatttaataaaaatttcatgtttggtggcttgcatacaacttggtgcttaagtaccaagtcagggtcatagagatttcactataactgcaagttcaagtgttgcaggcatcacaggagcaccaaccaataatatgccatcttttaatcactgtcagcttatatagtttgtagaattgtttcaaccgatttctgttggtgacaaacacttcctaggctcatgctctttcagtttcaatgtgttcataatgtagcgtgacaacatgagactggagtgcctgactgtgagtatgaatccaagcttcattgtttttattcatgtgacattgagtttaagggccccttgtcccagtttcctcatctggaaaatgattataacgctaaatgtaatgaaattggaaccatttctaaaatctattaaacacacaataaatatgttattattctttattcatgtgtacttagtttagcttatttattctttattcataggtactttatgccaaagacataaagataatgagctgcgatgtggtttttaatttggccatattctaaagtcttcccactcagtctatagtcaagctcagccacttcttaatttattaccatagcctctgtttctctaaatctgtgttgctcaaactttagtgtgcatagaacatacactagaggggctagaagggctgttaaatcacagattgctttgcttttgatttccttaatctttggaggaccctgataatttgcatttctaacaagctcccaggtgatgctgaagctgctagtccaggggaatgccaaggtccttatttcaggttttattaactaacacatggagagctttctcattaagctccttaccaatgatctcacctcccgttagttgatccaatataactacaggcagatcagtgttccctaagcatagatcatagtgctgttcccagttctcttctttaaagcattctttaaaaacttcaagatgtctattatataaacctatttgttctcatctcacaccatgtaactataaattctctttactacagttagaaaaaaatattctattttccttctcatcttttgtatttgagctcttttatttgttgccttaccagtggctatgagcaggaactcagacactacactagggttcaattcttgcttctacaaacttgctagctatgtggccttgggcaggttatttaagctcagttttcccatctgtaaaaaaggttaattgtagggttgttgtgaggattaaatgagtcgacaaatttaaagcatttaaaatacaatagtgcctagagtatatgtgtgtgtatctatatatacactaccttagcgtctagagtgcatacatatatatatatatatatatatatatatatatacacacacacactagctttttgctgttgttttctgaaatgggttttttttccccttgttttatggtagggagaaaataaatcagaatttatgataatattgttacatataattcctaatactggtcatccaaatagtcaccataacaaaactaaactaaacaagaacaaaaattaaaaagtcccttccaggtctgggcatattaggcctccagtccaaccagcatcagctagagaaaagatcaatgccatgaactggcaacctgggatctgtgtgcctgaattccaagacactgtctgtcatacacatctaccactgcagaaagaagcatgagattgttgagaacaactagaagtggaaggacaactctaaggcaatttagggtaatattaagactaaagcataatttccaaattctttggtaaacacagatactcaaaccaggaaccagaaatcatgtaccatatgtttaatttcctgaatgtccaaggactcagagcataaaacaatttgatttatctttgtgaatatatgttgtagagcatatactacaatttgaatgcactgagaggaacttaatcatgcgattcaaattgagtctctatctgggatctataatctaatccccacccaattcagaaattcaggatatataaattatatatatatacatatatatacacatatatacaatatttatatatacatatatatatatttgttaggttacacattttgtcagagatattctgatgtcaatactatagataagttggtatgactattctactatcaagacctttttaccaggtaaaattaaaattctgtagcatgttatattaagccctttaaaatgtgcctccatgcctcttgttttacctccatttcaacttctgccactttccccacaaacaccccaggctccagccacatgaatttctcactcttccataaaacacactgcacactttttgttgttgttgtttttactttgacatatcccatgctattctctctgtaaaactatcttttctacttccttcgtctcttagtattgcattaattgttctatcaaatgttaatatatatttccccattggaaaaatttctgaactctgtcatttttttgctaccttctcaagtgtagaatattacaaatacctaaaaaaagagtgaggatatgtaacagtgtattcacattactattgtgcagaataaatgatgatcaaagcaactggttaagtctatcaccatgtttagtggttaaaatcaccaaagccaacagagaaatgaaacaaatcctcttcaacttacccttataggtttattggtgagttatttttattatctaaaatatataagaagtttaggcttaattttaatttgaatgctaagtaagctggttataaagaatgatggaattcattgtcatattttcctactcatgttataaacagatgtctttcttttccatacttcaaaaaaaaaaagaaagtactgccaagctaagatgcttgctgccaagttgaattacagaacaaacatttatagccaacttataaattcttaactgtagggttttataatggaaatactgtcaccattttcactataaccattcaaataatattactatagcaaaacttatcatctaatatttttttctgggatggatgagggaagactagctataagagttggaaaaacttctagtagctcaattcaaattgcacaattattccaatagttcaagtctcttagaatattgattttaaagtaagaagtatatgctccaaaacatttattcttaaaagataggaaattttttgatacctgtataagaaatatatgacctctgaggcattttgaaaaattattaatcaatgttgcttttctaaaactgtcttattttccttttgtaaaagaattactttccctcacattttctctgttctattgctgagatgattcccccggagaactgtgtgtttatcttgacaggtgttagtagatccaaagacctctgtggaattgttcctggttgcgttcaagtacagtagaaaacattatgcctgcaaagcaatgaacttaccttattgccttctaaataaaataaaccacacagcaagtggaattaatctactaatgtcttcctaatgaagctttcattagacatatggtgtggtcttcaatatttaacacgacaggtattaaaacaaagcatatctgatgatttttttaaagcatacttgatgactgcctcttacgttatttttaaatgaactagtttaccttcagattgctttaggcacctaatcaaagagatacaagaaaatatctagacttaagatttttttttaatcaaatagaagaaacaaatgcctcactaccaatgcccttaaatgatgaaaactgggccaggtgctcaggcctgaaatcttagcactttggaaggcgaagacagaaggatcactggagactaccagtttgagaccagcttgagcaacataaggagaccccatctctacaaaaaatttaaaaaaattttgtagaggcatggtggtatatatctgtggtgctagctaacataggaggatcactttaacccagttcaaggcagcagtgagtaatgataaggccactgtgctccagcctgggtgacagagagatcccatctctacataaacaaataaataatacatttatttatttatttatttttttttttatttattattttgagacaaagtttcactcttgttgcccaggatggagtgcaatggggcaatctcagctcaccacaacctctgcctcctgggttcagacgattctcctgcctcagcctcctgagtagctgggattacaagcatgtgccaccatgcccggctaattttgtatttttagtagagatggggtttctccatgttagtcaggctgatctcgaactcccaacctcaggtgatccactcacctcggcctcccaaagtgctgggattacaggcatgagctaccgcgcccaggcatatttttatttatttatgtgctattctcatattgaagggagaggcaaatttccgattttctgtgcagtgtaaaatttcatgcattaataaaatttataaggcaaatattaagaatgaaattgttttagcccaattcacagtggtttgcttcagaagtagcaaacactggattcccaggcaagatggccaaataggaacagctctggtctgcagctcctagcaagaccaattcagaaggcaggtgatttctgcattttcaactaaggtacctggttcatctcactgggactggttagacagtgggtgcagcccacggagagcgagccaaagcagggtggggcgtcacatgacccaggaagcacaaggagatggggaactccctctcctagccaagggaagccggtgagggactgtgccatgagggatggtgctatccagcccacgcactaggcttttcccatggtcttcaccaccgacagaccaggagattccctctggtgcctacaccacaagggacctgggtttcaagcacaaaactaggtggctgcttgggcagacaccaagctagctgcaggagtttttctttctaccccagtagtgcctcgaacgtcagcgagacagaaccattcactcccctggaaagggggatgaagccaggaagccaagtggtcttgctcagcgaatcccacccccctggagtccagcaagctaagatccactggcttgaaattcttgctgccagcacagcagcctgaagtcgacctgggatgctcaagcttggtgtggggagggacgtccaccattactgaggcttgagtaggtggttttcccctcacaatgtaaacaaagctcgtgggaagtttggactgggcagagcccaccacagcaccacaaagccgctatagccagactgcctctctagattcctgccctctgggcaggacatctctgaaaaaaagacagcagccccagtcaggaacttatagataaaactcccatctccctgggatagaacacatgggggaaggagcggctgttggcacagcttcagccaacttacccactcctgcctgctggctctgaaaagagcagcagatcttgcagcacatcgctggagctctgctaagggacagactgccttctcaagtgggtccctgatccccatgtctcctgatggggagacacctcccagcatgggttaacagacaactcatacaggagagctccagctggcatctggcaggtgtcccactgggacgaagcttccagaggtggaagcaagcagcaacctttactgttccacagcctccactggtgatacccaggcaaacagggtctggagcggaccccccagcaaactccagcagaactgcagaagactgttagaaggaaaagtaacagaaaggaaaacaaacagcaggaaaactaacaaacagaaagcaatagcatcaacatcaacagaaagaacgaccacgcaaaaactccatctgaagtttaccaacagcaaagaccaaaggtagacaaatccacaaagatgaagaaaaaccagtgcaaagaggctgagaatttcaaaaaccagaattcctcttctccttcaaaggaccacagccccctgcaagcaagggaacaaaactggacggcgaatgagtttgacgaattgacagaagtaggcttcagaaggtgggtaataacagactcctctgagctaaaggagcatgttctaacccaatgcaaggaagctaagaaccttgaaaaaaaggtagacaaattgctaattagaataaccagtttagagaagaacataaatgacctgatggagctgaaacacagagcacgagaacttcgtgaagcacacacaagtatcaatagccgaactatcaagcagaagaagggatatcagagattgacaatcaacttaacaaaataaagcatggagacaagattagagaaaaaagaatgaaaaggaacgaacaaagcctccaagatatatgggattatatgaaaagaccaaacctacatttgattggtctacctgaaagtgaaggggataatggaaccaagttggaaaacacacttcaggatattatccaggagaacttgcccaacccgcaagacaggcccacattcagattcaggaaatacagagaacaccacaaagatactcctcaagaagagcaaccccaaaacacataatcatcagattcaccaaggttgaaatgaaggaaaaaatgtcaagggcacgcagagagaaaggttgggctacccacaaatggaagcccatcacactaacagcagctctctctgcagaaaccctccaagccagaagagagtggggatcaatattcaacattcttaaagaaaagaattttcaacccagaatttcatattcagccaaaataagcttcataagtgaaggagaaataaaatcctttacagacaagcaaatgctgagggattttgtcaccaccaggcctgccttacaagagctcctgaaggaagcactaaatatggaaaggaaaaaccagttaccagtcactgtaatgtgaaagaccaatgtgtgtaaagaccattggcactatgaagaaactgcatcaactaatgggcaaagtaaccaactagcatcataatgacaggatcatttcaaacataacaatattaaccttaaatgtaaatgggccaaatgcccaaatcgaaaggcaagactggcaaattggatagagtcaagaccaatcggtgtgctgtattcaggagacccatctcatatacacagacacatataggctcaaaataaaatgatggaggaagatttaccaagcaaatggaaagcaagaaagcaagggttgcaatcttagtctctgataaaacagactttacaccaacaccaacaaacatcagaaaagagaaagaggggcattacgtaatggtaaaggaatcaatgcaacaagaacagctaactatcctaaatatatatgcacccaatacaagagcacccagatttataaagcaagttcttagagacctacaaagagacttagactcccacacaataataatgggagactttaacaccacactgtcaatattatacagatcaatgagacagaaaattaacaaggatattcaggacttgaactcagctctggaacaagcagacctaatcgacatctccagaactctccaccccaaatcaacagaatatacattcttctcagcaccacattgcccttattctaaaatttaccacataattggaagtaaaacactcctcggcaaatgcaaaagaacagaaatcataacaaacagtctctcagaccaccgtacaatcaaattagaactcagcattaagaaactcactcaaaaccgcacaactacacggaaactgaacaacctgctcctgaatgactactgagtaaataacgaaacgaaggcagaaataaagatgttctttgaaaccagtgagaacaaagacacagcgtaccagcatctctaggacacagctaaagcagtgtttacagggaaatttatagcacataatgcccacaggagaaagcaggaaagatctaaaatcaacaccctaacatcacaattaaaagaactaaagaagcaaggtcaaacaaattcaaaagctagcagaagacaagaaataactaagatcagagcagaactgaaggagatagagacacaaaaaaaccttcaaaaaatcaatgaaaacaggaggtgttttttgaaaagatcaacaaaatagatagaccactagccagactatatataagaaaagagagaagaatcaaatagacacaataaaaaaatgataaaggggatatcaccactgatcccacagatatacaaactaccatcaaagaacactataaacacctctatgcaaataaactagaaaatctagaagaaatggatacattcctggatatatacaccctccgaagactaaatcaggaagaagtcgaatccttgaagagaccaataacaagttctgaaattgaggcagtaatttaaaaaaagcccaggaccagatggattcacagcctaattctaccagaggtacaaagaggagctggtaccattccttctgaaactaatcctaacaatagaaaaagaggcactcctccctaactcattttatgaggccagcatcatcctcatatcaaaacctggcagagacacaacagaaaaagaaaatttcaggccaatatccctgatgaacatcgatgcgaaaatcctcaataaaatactggcaaactgaatccagcagcacatcaaaaagcttatccaccacgatcaagtcagcttcatccctgggatgccaggctgattcagcatacacaaatcaataaatttaatccatcacataaacagaaccaaagacaaaaaacacatgattatctcaatagatgcagaaaaggccttcaataaaattcaacagcccttcatgctaaaagcaatcaataaactaggtattggtggaacatatttcaagataataagagctatttatgacaaacccacaacaaatatcatactgaaggggcaaaagctggaagcattccctttgaaaaccggcacaagacaaggatgccctctatcaccactcctattcaacatattattggaagttctggccagaaaaatcaggcaagagaaagaaataaagggtattcaaataggaaataggaagtcaaattggctgtttgcagatgacatgattgtatatttagaaaatcccattgtctcagaccaaaaactccttcaactgatgagcaaattcaacaaaatctcaggatacaaaatcaatgtgcaaaaatcacaagctttcctatataccagtaatagagagccaaatcatgagcaaactcccactcactcacaattgctgcaaagagaataaagtacctatgaatacaacttacaagggatacgaaggacctcttcaaggagaactacaaaccaatgctcaaggaaataagagaggacacaaacaaatggaaaaacattccatgctcatggatagagagaatcaatatcgtgaaaatggccatactgcccaaagtaatttatgcatttaatgtttttcccatcaagctaccattgacttcctttaccaaattagaaaaaagtactttaaatttcatatggaataaaaaagtaccccgtacagccaagacaatcctaagcaaaaagaataaagctagaggcatcacgctacctgacttcaaactatacaaggtcacagtaaccaaaacagcatggtactggtaccaaaacagatatatagaccaatggaatagaatagaggcctcagaaataacaccacacatctacaaccatcttttctttaacaaacctgatgaaaacaagcaatggggaaaggatcccctatttaataaatggtgttgggggaactggctagccatattcagaaaactgaaactggactccttccttatgccttatacaaaaattaacttgatatggattaaagatttaaacgtaagacctaaaaccataaaaaccttagaagaaaacctaggcaataacattcaaaacataggcatggacaaagactgcatgactaaaacaccaaaagcaatggcaacaaaagccaaaattgacaaatgggttctgattaaactaaggagcttctgcacagcaaaagaaactatcatcaaagtgaacagggaacctaaagaatgggaggaaatttttgcaatctatccatctggcaaagggctaatctctagaatccacaaggaacttaaacaaatttacaagaaaaaaacaaacaaccccatcaaaaggcgggcaaaggatatgaacagacacttttcaaaagaagacatttatgcagccaataaacacatgtaaaaaagctcatcatcactggtcattagagaaaggcaattaaaatcacaatgagataccatctcacgccagttagaatggtgatcattaaaaagtcaggaaacaacagatgctggagaggatgtggagaaaaaggaaaacttttacactgttggtgggagtataaattagttcaaccattgtggaagacagtgtggcgattcctcatagatctagaactaggaataccatttgattcagcaatcccattactgggtatatacccaaaggattataaatcattctactataaagacatatgcacatttatgtttattgcaacactattcacaatagcaaagacttgcaaccaacccaaatgcccgtcaatattagactggataaagaaaatgtgcacatatacaccatggaatactatgcagccataaaaaagaatgagttcatgttctttgcagggacagggatgtagctggaaaccatcattcttagcaaactaacacaggaacagaaaactaaacactgcatgttctcactcataagtgggagttgaacaatgagaacacatggacacagggaggggaacatcacccactggggcctgttgggggttggggagcaaggggagggatagcattaggagaaatacctaatgtagatgacaggttgatgggtgcagcaaaccaccatggcacatgtttacccatgtaacaaacctgcatgttctgcacacgtatcccagaacttaaagtataattttaaaaaattagcaaacaccagcttaaattgcagttaaaactacatagtttaatggccaggggaaaatcaactgtaaacaaacaaaatcagtatcttttcataggcagcattttgatttagcatttgttgaaaataaaattcaaagcctctcacagaaaacctgcctccttcagaaaaatcaccagttttggagcatgtgtgatcccattccagctaatatttacagtagcatataaaacagctacaaataagtcacatcttcattgctacattatgccaaatgcttaatttcccattttatgttcccttgtcaattctctcctgcttctctcctgtataatcacagttgtccaattgagacctgatgatcttatcagtcatgcacttttactattattatttaaatttgctcctttcaactattatttattgccaagctttgcagagggaagaaaacagacatggtaaaagaagagtaaaggtgggtcttttctcttttggcagtagcaaccagaaacagtatgaaagcaatggatcatgaagaaaagcaatttcctacttgagggattagatagtaccctcttttgtactgttaaatcaaagttttagttattttttccaagtaatactgattttttcaatttacataaacagtctctagggaaactgcaagagacccccaaacacataccctctcagccaatcaacagaaaagataaggaaaatgaaaaaaagaaaagaaaaaccaaacttcctttatgttgtactgctttgagcaaggctttacacagcatggcaaaaattaaactgctacacaagcaaaagataattagcttaacagggaagaatttgaactgatacatgaagctttttttttctttttttcagtaaaagtataggtgatttttattttgaagcagttcacttttgctagcattagaaaattgaaaactatgtaaatttcagcaaatgtttgctttaatgtttaggttcacattgatattaaccacagctatcagttggtaataaattcagatttgagaaaatttgtagcagaaaactactctgaaatgtcatgtgaaaatcctaatcaattttaaatgcatttacattcatggaggaataaaacctactcttaaataataaaggaaaataatagtacatgtataaaatgtgaggaaggaaaatcatgagtctattttcacagttcatttgtaaaggtttatcacttatatgacgtatgtttaagaaagttacaaattttctatagtgaattacttttatgccatataattaacaacaaaaagtcttcatagctaaataataggtttttgataaaaccttataatttatttcagcttattcctgagttgcccagtttttaatgtcttaaaatccatcacactgttgacagatacttgaggtaacattaggtgattagctgacaaagttctagctactattttaattgcctttttcccgctttgtcaaaattctgatgctattaagtcattgttgaactcatcctatatagacagtaagaacaaacaaataagtaaattaacatagcagacatttcttgctttacatataactggagtaatgttttctaaatctggtggaacaatctattgaatacactacaaattctttgcaaaaatgaaatagaataaggaactatgcagggaagccaaattagacgactgcaggtctgtagccaagtggaatataatttgtccattacaataaaataaccttagaagtaggttgaagtcatttagtatggctgaaatttggagggatgaatgttactttcacccaacataaattccttaatccaatagcagataataagaataggttagttgggtaaataaagtttgaatccactgggttttctcggctggacactttttttttttttttttacatccagagttggatttgctgacaggttagagaatgcaacgtatgttgagatttcccagattaaaaaatatataaaaatgaaataatttgtaataagactcagatccaggactaaataattcaatagtctcctatgaattactaggtagtatctatatagaaacaccaagattcatcttaaaaatcagtgactgttcagtcgtaatatttttggagtagccctgtccttggctcactagatggggctatcaacttagacaggctgttgtgacagagtaattctagtttagtattcaatatccattctgccttcttcctggcaagtagaaccatttgaaaggatgagggggaagtgcacagagtagcaatatgtcccactaaaaatacttgctttccaaaacatccttagagtgagagtgcccttgtgacccagttaatcttgaaaaaatgtaaattgaatttacataattaggacaatattttcttaaaggtaggttttggtagactgtctcccccaccccactattttttgccataaaaccttattcctgttgctctcaatgcagagtgaatgcccacgacaataccaattctgagatcatgaggtcaaaaatcacacactaaggatggagaagaaagaagacagaaggagcttaaatgtttgaggtctccctgcaggagttataccagccctgtgtcacctacctttggacttcttattcaatttgaaaactaaattatcagtttaatcctatataagtcaggtcttcaggttttggaagctaaatacacgcctaatggatataactattttcttgaaaggatgattacttagatgggtgagtacgccagctgaggcctccaggcgtctgggagagacatttatccttaaggaaagtagggaacatattatttgctttgggtttctccagatgcattttaggaaagttaaggtactttctttaatacaggagcccattagaaataataactcaaggagaataaggctatcctcgtctcttgaacagaagaaaatgtcgttgagtaaataatactatggaactaaagaaatgcacctatagtccccttcttaaacatgccataaaaaaggaaaagatatccatttcctgtagaagagaattagagcttaatgaagacacactttcaaccaggaggtatctgatgtgggcttattagtaagaaacacatcttcccaggtaatacaactacatgtgagtaagtgcagcctgccatacattctttcatccacttaattatcaatatatcaaattatttatttatctagcaaatatttattgagcacttactctgcaacaggatctgtaccaagccctggactcattcagaaataaatgattggggggtttggttctaaattgaggaaacaagtctttgggcttactgcctcctcatcctgagctgggcagatccccatcctctcttgaagtccatgaaagcatatctaccttctgacatgcagaaatggccctgcaaatggaatctaactggagctgaatgagtattcttgcctcagttaatgtattttcatacttagccagttccaaagcaacaatgtgcacaacttagacatgcttattggccaggtgcttaccacctatttggcaaatgctgtttatgaagtttttaagaaacaaatattgatccaaaatttcccttgcgtttaatattctgtcattctgcaaggccagtattaagtttgatgtacacatacaattacctgtctatctaaacagtttcaactgccctaattcttgggcaccacaccgtgattaaatgtatacaagcaacaagttcttgatttgggcagctagaaaaccactgtggcataagatcaatagttacaccacttagcaaagactgtctttgtcattgcttcctagagtcctcaaaggtcctgataaatacttaaatctagcttgttctttcttttgtgcacatgttgttcatgcaaatgaaatcaaaatttacctaggaagattccagaggacccatacaggacagaagattgtttaaattatggtagagctcatgaaacacattttcaactggtgggatatcctccttatgagactcccaaattctttagagcaagaaacattaacaagcataaatgaaaaaaaaatcctgtatgaagaattgagaaaatagcataagcacagtatgaggaagacctaattctatagttgttattacaaaaaacctggggatttttactaaacaaaaatgtaacaggcaaatttgatggaccttttagcagaaatgtttgtatgaattgaattctagtatccagatcatgagagtaataatcatttttctgaactttgcataagacacacacatgaggtatgttggacatgccatgtgctcattttaaaagatactttgaaaaacaggtgagtgaccagatggttataagagccatattcagtctaaagtaacagagagtaaaggagatagaatagacatgctcaaatctttaaggattttcatatagaagagaagtaggctaattttttattggccttgaaactataggaaaggccaacaggtagaaataggttaataaggaagcacatattgatgatactcaacatacatgaagtggagtttccagaaagcaaacgagtgggggtttggaactaacctacattcccacagggagtttttggtttttcccctgcctaagatcttgcctctgaacatttctttagataaagaaattatagcatttgtaataaataacaagatggctttaggtttaattgtcagccaagaaaacagagtaaattcacatgtaagagtggaagggaaggagcaaaacatcgacattgtgatacatttgggtgtaccctgactaggcaaataactcatcgccaagtaccttcccagggagtcaggtaaccactaataagaaaatagacttatggctataatcctatatattttcattcatatgtctagctcagagaaagaggtgagtggtgagaaaaatcacagcaactgcagacaagggtctataaaaggacatttaaaataaaccaaaaaacccgaatgaatacatttacttaatgtgtattatatatagcctatatattttttattaaacacttccacacttaacactgtatctaccaaactatcagtttcagattaagcttattaagtgtactctgtttgatcataagtataaagagttttctcagcaataattcttattcttccatgccaaatcacatggattgatcttacaggaagttaacaaatcctatatttccaaataaataggcccaaataatttataatgtgatggtgttacttgtcttctatattctggtagaatcgatggacagctaccttatgtgctttcaatctggaaaagtagccagtttgtgatgttctttttgatttctgactataatttccctccataatattccctgttgtctgaaacacctacatatctgaagctaacgggcatctttatagtaagtgatgctgaaataacttctgacctacagctccaggaagagtggctaatcgaagtaatgatcagtgtctcttctacccatttctgtgaactctgatgctttctgaatgtacggagactggtcaagatgttaatctcccagtgtagggctggaggacagtggtagagaaccactacatcaccattgggaggagactgtagtgtgaactaagcaaattagagaatgtagaagaaaggccaaaaggaaaatataaaatgaataatggccatggctaatcgcaaaggtaaatgtatctcttcataaaagaaatttactctatttattgaaagctgacctcaatttctacctcttttcattgagactccattatctactcctatactctcttcagttgttttctctgcaattttgttggcatgattttagttcccatgtattgttattctatctctgcatgtacattgtccctccaactatattgcaaatacattagggcagggtacatgtttgatgttgttttgagtctccattttgtcagcaggtgtttttcttcttcccaaaatgcagcctgccagccacttacaacattttcccataaagccatggtttaatattgtacatcaccctggacttagtgaatttgtaggatgtgcttaggaatctgcattcttaacaagaaactaagcaacaccgatgctcacaaatgtttgctagcctaaggcctaccacagaacaggtgctcgtaaatgtctggtgctgctgttagaatgatgctttctggcatgtctgtatgtatctataaaaaaaacaaagagatgttgatttgctcaaggtgtcctctctctgccactagctagtaaataccttgagggttcatgtcctttgcagacagttctctgtatctccttctaaatttttttctatagcactaagtacttcctagaatgtaccataaataattgtttatgttaaggagtagaaagggaaaggtggtggaagaggaacagaaaaagaagatgaatttatggttgggaggcatacaagggaggtgttattcagaaaactcctttgctttagcgaacacgaattcaaaagtgctaatgaagtctcttcctaatcctttctacttaattcctttgctctgctcttgctaagactgaaaattaccctcctatgatatttttgagattactaaagacagtcttgtgtgaactgaagacaggtcacaaatgactggcatacaacaaatatgtccttagtatctgagatactaaggaactgccggtacctatttttcctcctcaaattcaatcaaaggaaatcatttccatgtcaacatgcacatgcatgattgtatatatatatgtaagtataattacttcaagtggataaacttagcaatgatctttgtcgattgagggcagtgttaatgagctgtaaaatggactcaccctggtgcccaattgtcttttattacaaagggcattctttaacttccactgaggtctaactcccacacaaaccttctgtgctttcatttgattattaccaatagccaaaagtcaaaggtggaaattgagacttaagaacatgttgcttacacccaaagcaacagggaaatgaggctttattgcctctcttctttaggcttcaatactatcaatgttgagaaaacccttgctctccatttccatttgattatcctgagaatatgccttgtactcaagaatttctaacaaaaaatcaaatattttatttttaggaacagaaagacctatatacattaaagattgtctaatcactacaccttaattatggggattatgtggtcagttgagttaagtgatttattcagagttgcaaggttaattaaattatagaccagatttttatcctgggatctacgaataagtttcaagggaaggatgaaccttcaaaattttatgcaaattgtgtgtgcacagctgtgcatttttttcatctgtgcatttttatggaaagtggatccacaattttatcagaccctcaaaatgtccctcaacatagctgggacagttactgttgcaatttataagatatttttatatttataaaatatagtaaaatattaaaggtcatgtaatccaagcttacagccaataaatggattccttaaataataactctgatggatagcatgcaaactctaccttgtatcttaagataattgataaccaaccacctctcatgttatcatggttcaaagcttgaattaaaaaggtattcatatagctgaatcatattatttctttcctataccttctcacattggtctaagtactaccctttgcagccatgagaaacaaaatcactgttgcttactccaatgtctttcatacatttgaagtaaattcctgttacatttcttcttcggtcataagagccaagatccctcagtattctagtcaccactctagactcaaacttagagctggaagaaacacatttcagtttgtcagtattctctaaaatccatataacaaaaaacttaaaaacaatgttctacttgtgatctgacttgttgatgactatctccttctggtggatgtgttctctctttttgctggggaaatcatggtattttacggtctaactgggaagatcagagcctaatgatttttatataggttttccacctgaaatgcaacaaagtaaataatatgcagctggccattcagacccaactctagataatcacatttcaaactttaatagtcatgaggttcacctaaataaacactggcaatttccaaaagagaaacattaagcacttttatttagatgaataatccagtactttgcccagaggttgagtcagaaacaaagaacaaaaaacctcagatttataaaatgagtacagcaaagatgacttagagtataaagtttttctatttcaaatgtcagaaaaatgctcaccagatttacttgattacaaagttccaaaaaaccttttattttgcaatactcactcatatcgcaaactttagtgatgtagcaacaattatgcaaataatttaaacaaagtaaatggactacatgaaaaattcaatcctcatttctatattgattatttataccagcactccccaaagactgttagaagcaacattgatcctaccaaatgctcagaaaagataaaaggccaacaactgaatacacttcaaaaacacaccttaccatacctgcttcttgggactcccactgcaaatgacatattttagtctccaagaacccctctttttaatgacatccattagcactccacaacaccattgttccttataaaagacattgagcattgctataccatgttgatctaattaaccaattttctgcaaatctctactttactctgtgttttaacatctcaacaagtatgagtgtagactcttgggtaatatgatctcattctcctctatgagagcctcctctgcctggttccctgtgagccaaaccacaccccaaggaggagttaatataattacttagattagggcattgactgttttacctaaagaccaggatgtccatatcagatttattttattttattttttattattattattattattattattattattattattttgcctcagattgaggtagaagactctgagactgtgagatcaggataaaaattgttgttgatattcctcttccactcccggcagctggatctctaattgaactcttctgctccctagctcccatactctcacttgcaggaagatataagaacaagagtgacaaaaattcaaatttgcaaagaaatctctcttaaatttcaaggtcatattgggtgatttaattcaatttttatagagagccctgaatttggaaagaaagaaagagagagagaaagaaagagagagagagaaagaaaagaaagaaagaaagaaagaaagaaagaaagaaagaaagaaagaaagaaagaaaagaaagaaggaaagaaagaaagaaagaaagagaaagaaagacagacagactagtcacatattctgtattgttttctgagaatcctggggagtaggggttactgaggatggtattaaaatcatttgcaggtcttggctttaatatcatcaaattagccccaaagttatttgtgattattatttgcttttgagttcttgtattttaaacgttatcattaaaatatttgcaggtagataaggaaaagctccagatttgcttcaaaatgatgcagttggaaggtagagattgaaagggttagggttacacataaaatggtagttagaattgcacgatggaggctgggtgtgggctcacacttgtaatctcagcattttgggaggccgaggtggggaggatcacttcatctcaggactagcctgggcaatatagcaagacctcgtctctatttcaaaaagaagaaaaaaaaatagccggctgtagtgggggcacacctgtagtcccagctactccggaggctgaggcaggatgattgcttgagtccagaagttcaaggctgtagtgagcatgctattgtgctccagcatggaggacagagtgagactctgtctcaagaaaataaataaataaataaataaataaataaataaataaataaataaaattgggtgatgatttcatttggcttccttttacttgcctgttctcttacttgtgtgtgactgataaaatctgagattataattaaataataaagcaccaaaatctcacacagaactatcaaccatcataaataaactcatagacataagtggaagagttggaaagtttttgccaagtggtcaagatgttcactgctgtaactaagagcttccactgaagttactattatcaaccacagcactcataaacacatagcactcctgggcacattttctatttatttaagtgacttaccttatttgatcaaaaagaaaatattaaaatcaccataaaactatgtaattagtgattgcatggtgatctttatgtgatgaaatttttaacagttaatatctaatatagaattaagaatcctacacaatattttaaagttatattttcaaatccatattttgtggatttcaaataattccagtttgaatgcttgcaactgcaacaggtttctgtaaaagcttttgagtttcacagccttccttttgacagatttcttaagttatggaatgcagccatcagcagtctgtagaaaaatgaaatgctgcaagtctatttttatgcagctgggatcaagttactaaatggatcaaaagaaataatttctttgaagaggtggctgttgacaccagtgccctaaaaataagtgcaattttgtgggcataaaaatttgtttatatcttagtgaaagtaactatagatatattttctatatatacacttgcattcatgatatattggatgccattctaaacatcttttaatataccttagtttaacattgcttttaagaggaaagttgcatgctttctcttgaataattgatgtagctaaagacaattattcataccaggcttagcttactgggtttataataaaaacaatgatagtaatttacctaactcttactttgtgccaaataccagccaaatacttcccaacattatttcatttgattttagaattacattttattttaataactagctattattttcacaattgtatagatgaagaagctgattcttagagagtgtaacttgccaaagattacacggctagcatgcctctgagttaaaatttgaaagctagtctgtttaattctgaagctcttaatcactaaattttatactacctctttaggttggatggcatatcaactgatttgaaactatagaaaaaaattaggaaacagaataatcttttaaaatatctttgtatgtgaaagtaagcttgcttatagaaaatgtagtaaattgaaagactattactattgcaatagcaatagtcaaactgaagcctatagaactcaaatgcatgtaagtgtcaaaatagccaagtaataatgcgatatgatataattttttatcataataaaaagtcagaaaacaaaattcataaagagggctctatgatacaagaggaaaggttgatctaagggtacaaactaaaacattttaaataaagtttttggaaaaaacaattttaggctccgaaataagaaataaatacaaccccttcacagataataataaagaaataagccaataagcccttaaaatagaacgatatagtcttagctctggaggacaaaatattctctacttggaccctgactcatttagaactcctgcacataaatacatatatatatacacacacacacacacacacacatattgactatattgctgaaggggagagtaaaggaaatggtgaaaggatcatcatttttattatttcattaattcctgaagaaaacacatacacaaattgcaattgaagcttctaaaaaacctagaaaacagtataaaggacttagacacagtacaagtatttcctaccatgtaagtctgaaagagagaaaatcaatttttatgaaaacataaaacagtgatttgggttgtgaacaaaattatttgtctccatttgtgttctattggcttactgctctgccaaattttgaagcaaaatgaaaaaaaaaaaaaagagagggaaattatagcaaacctcccaaaacatatcccttaaactccgcaatgtatttaaactacccaggttctgttcatggatatactcaaacattgagaaattgtgggtgtactgggttttgatgctgtactttttgtaacaacttgatattggagtcaaaacatgtttttctatcttgtgttgctcagaaaggtatgagcaaatatatttttcccacaaatttcaattaattaagaatgattaaaatgtggatacttgcaagggaaacattaataaaaacatgaagtgtagacatagagataattttctctgtggcggatgactgatcatgtcattaggcagagctttgttcccttaggctctgtagagtcagagctaggataaagaatcacagatttagagttgaagaaactcttaacaataacttaacaaccattccaatccccttgatttatagataaggcaggttagtcttagaaagaggaaccggttctttgtgtgagactcaacaagtcacatcaccgctctgcgcttctgttcccaaattctttttctttctttctttttcttttcttttctttttttttttaaatgagtaagggatttcctttattattagtgagattgaacatcttttcacgtcattattgaccatttttatttttctctacaaactgattatccaaatctttctcccatttttttcttttaaaaaattaatttaagatccaagatacatgtgaaggatgtgcaggtttgttatgaaggcaaacatgtgcgatggtggtttgctgcacctatcaacccatcacctaggtattaagcctcccacacattagctatttatcgtgatgctctccctccttccaatccccctaacaggccccagtgtgtgttattctcctccctgtggccatgtgttctcattgtttagctcccacttataagtgagaacatgcagtgtttggttttctgttcctgtgttactgtgctgaggataatggcttccagctccatccatgtctctgcaaagggcatgatctcatcattcctttttatggctgcatagtattccatgatgtatatgtgccacatgttctttatttaatctatcattgatgggcattttgattgattccatgtcttttttattatgttctcacattcttaaaattaaagttgggactagttgatctccaaagtgcccacatactaaacgctgaatggtttcaaaagaaaagtgagttaatggcagacaataacctcagatctcagttcctaccttgttctcaccagtccagtttgtgttctgccatttgctcatatatttcactgtcactacgtacttatgaaatttgtaagtcaataaatggtgaagaaaagaaaaacaagaaaagtcatccacattttagaagggcaaaattgtgagtaaggagctgagtggttgaatccgaatattttcattaattccaaacaaaggcaatggaaagtgggaaggaggggaattgcagttctataagctatagttgctccataggagaaagggaagagccagcagtaatcaggactttttaaaagaactgtccaagttcaatgacaatatcatctagctctctgactctaggcatctgccaagaatcatggaatcttcatctcagtaaactaaaaccaggctagacaaagcaggcacaaagaagaagagaatcacattcaataggttagtcagtatatggtaagctagatcagccatggaaatatgcattagtcaataagtttgatacctaaatcaatggagacatggtctaataactgacctttcattttttggggtgattttcataggcatacatgtttacatagcaactccatgagaatttacaataagtagatgctgatattcattgactattcagatagtcttcaacttaagatggggttatctcctgataaactcatcgtaagttgaaaataagcagaaaatgcattcaatgcacttgatctatggaacacaatagcttagcctagcttcaaatgtgctcagtgatatgagcttacagttgggcaaaatcatctagcagcacagtactctgtagaatttcggttgcttaccctcgtgattaggtggtttactgggagctgtagctaccagctgctgtccagcatcttgagagcctatgaactgctttctacccacagttgcaccaccgtaaagttgaaaaatcctaagttgaactgtattaaattgggggctttttgtaatcatttaggagtattaataatatgtaaacagtaagagggagaaatatacagcaataaatgcagatggctcattcctaatttgagaaacaagataatgcagtttattctgaaaagtgattataaatttgaaatttatggaaggaattcaacatcaaacaggtaactttaagagggaaactcttcctgacccttagctagactaagttatgttcagataaagcaatctgacttcacacacatatgggttgccggacttttctctcacttacataattttgaaataatttgtggaatcatttgtttaatgtaaacattcttagattttccagagagattatggaccttgccttggtcatgggtgtagtcccagcccttagaagagtatctgtcatgcagcaggcattcaaaaaacatttgtttaatgaagaaatgtccatgctacaatatgtttgaacagaggagagggatagaaagaaaaaaaaagactggaaaagaaagagagagaaaggcattattcagaggaagaagataaaagagatgaacagagactggactatccccatgacattcaaaactgaccaactgactctttgtttcacacattgagtgacccaggtcaaagccctatcagtcagtatactcactttgtatccctgacacacatatattttcctaagaatggttgcagagaaaggctggaaaaaaaggggatggaaatgaacattaaagagactgacagggaataataacagtgaaacagacaaactctattgtgtacaactccacagtcgaacattttctacctccctgagaatcagtctcgcttgcaggtagagtattgactgctaggcagagcaccatggctataaaacagaccactgagctaggcaataaaagagagagagggagagagagagaataagaggtctaatgtcttgtttatgtcccctttatagcatctttgagaggctctgcagtcccacagctggctttagttcatatgcttttctgattaaggcaatacgtaccaaagcaatctaatattaacgtgcaatttagaaaaaaatagaagggtgtaaaaaaggaggaaatctccacaaacagtgtaactaaacaataaacagaatacaagacttgcttaattctttattaaatacatgctttattttaagtccctaaaacatttgtatctcattttaaacacccagttctaccatattgtgtttagtgacactaatccttctttatagcctaaccctttgagaaataagattatgttcccagtaaatagtagtaacaagttttattataacaatcctgatcacagatttataaaaaccttaaagaaaaaacatggaaatagaaatggctaggataatatccaatatgagaaagatctttatttaacatgaagtataaagcttggctgatgaaatgtctctaagaatatttccaagaatatatattttttacttttcattaagaacttgactactctttttaatcttagacattggttttatgctttataaccttaccattgtgaaactcagcgagcctagagaagtttgggtactgtgtgcaaatctactcaagtgtttagcttaccacattgctgagaaatgaccacatatgtgtgtgtgtgtgtgtgtgcgtgtgtgtgtgtattttttttcccaagagaatctatcttaactctgctgattatactatataacatatcatgactatcttaactgtcaaaatggtcctaaggttttgacgcaactgtttcaaataaacagttgttttcaattcttttttatatatttgtatctgatcttgagatttagattgataataatagtagagtggttaagtgaagaaatttaagagtcagagaggttataattctggctcagccacttactatctgactgagcctctgttttctcatccataaagtgggaaaaatacctagccactagggattgtgtgaggattgaataatgtgccttgtgcaaagaagacagcacgtgcccaatacataatgtgcactcaataaatgatagcaatttataactacaataagtgattgttagtattaataataaaagccacccgttatagtgcagtactgttaccataacaaagcctgatgtctatctcaattctaagaaaggctattttctacctcctgtcttctctgaatttctacttatgccatattatcatcaccaataaatatttcttgtaagcctaataagcataaggtattacattaggccctctaaagaatacagccagaatcaatcattctctcatgtgggccactaccagatctgtacttcctctatcatagcagcaatattctatatagtgatgatttatttgtctctatttaacccactggatagtgtgctttcatagataagtcttactctatattcccagcacccagcataatatcagggacataataaatgcctatccaatgcagaatgaatgaatggaacatggataagcccaaagagttcaggttgaagagagacattatggacattcaaaagcctagagaacaagacaaagtttcatatacttatgaggaaaaaaaaattgccttctctgtgtcagtgaaatgctattgttaattcataaatgaagtagtagtctcatcacgacagtcttctgggtggtttcatcttatattgtgaacaaaggaatgggtggcagaagagggaggaagaaactcttaaaggatgaattaccaaagagtacctggggaaacaatgtgattttttactgggcttacggcatgccaatcttgttagttttgcgaataaactgacaagtagaaattggaatttagtgagaagtctaaaggggactcaggcttttaaacacacacacacacacacacacacacacacacacacacacacacacacacaatctgcttttggctatgaaaaggagctagagtgatatagaatggcatccaagagagtaatgcacatcagaagaaactagctccagatactattaggttggtggaaaagtaattgtggtttttgccattactttcaatggcaaaaactgcaactgcttttgcaccatcctaatagttttaaatgcaaggtgcttaaactaattgtagaaccagccttcttggccttatcaatcaactagcaaatatgcttcagtgtaagtcaactgatcagagggacttttgccaggagtagtttcagagattctaagatctggggccatagatgcatacagtaggaatgatttaagatgggtctttagtgtagaatcctatgaattccagagaagactgttacaggacagagaagttatttagtctgaccaaccaggactgggcttgaggtagtttctgaagagggattctgcaaggcccagagtagagcagagagagttgctcaatctccgaccagaactaggagaactagtttaaaaggaagttgtaagaaagacctattactctatttatgaatgaagtaaaggaatgaagaccttacaagaaagatcagaaatccttatcactagcatacaatgtctactatacagtaggcaccaaatatcatcttgttaaattaatttgttgttgctctgatacttccccattgtattgatttatctttaaatgcttatcatgattttaatttggaaataagaatagtcttctcataatattggagtgtcaagtgagaaataacaaattgtggttagacattgacaatctctgataatctgtcaagacttttacagactttacttagtttaattatcatgggacgtcagagggaatatttacaccagtggatactagaaaaatgaaaaatactggtttcttcaaaagtatagggaaacaaagaggaaacctttctcctgggcatcatcacttatttttctttgatatttattaagtgcacacagcattccaggtctgaaatagcctatggccaggaagcttctcctcctggactggcattatttctccctagatagagagttatgaaactccaaagcggaaggaaaagttcagctgtatacgtatcatctgaagttccccatgggcagaccagttctgattcaagtcaggacgagaagagattagcgagtgggaagacagacatacggtgaatgtcagttgtctctgaatcttgattctaatgaaaagtcacagcttttactggtaatgccctgaagaccaggctaactcagagataacctttgcttaggaagacttcttgagccgcctcaggttcaccatactttttctcttgctctgaatcctcctggtacttatcctcacagtatctacctcactcatttgcattatcttgcctttttttattttagaattgttcccatcatcatatatgttcttggtcacaagcaacttgatcgtaaataatattaattttccttatgatctgattctttcagggccaatcaggttgtgcagaatgaattaatgtgaattgaaattttcctaaaactttgaatcccaacttaggtcttcctggtatactattgtgaggatttcagcagagtacaactaggacagaatatggtctggtctgatcattcagtattgaattgacctaggaaatactctagaagatacttggaacccaggtatcacgcggcctgttttccattcagattcaccatcatcagttagcgtaggagaaaaagggcagaaggaagaacaagaaagtaaacagctgctaccattaagaggaaatctccatacagtctgagatctcccaggctcaaaacacatgagatttaaaacaaaaaaaaattcttttaaagttttatttttagttaatacacaataattgtacatatttatggggcacaatgtgatgtttcagtacatgtatacattatacagtgatcaaaatatattttaaggattcccttcaattgtgcattggccacaccccctactatggctttattttcttctcagaaagaataaacctgacaaaagaaaactaggttaagagtgggaagaaaaatgggtcctggtactccctgaaaataatatacatttgacaaatcttttacattgcttctctccataactgtaaaattaaaattcttgagcggaatgatcccttacagattttttttcagccctaatagtttatgctgctatgattctagctaatcaaatctactcctgacagtttctcaccactgtggaaagtactacaaaaagaccagttgggaactggcagctaatcttccatccttctgatagctttgctgaaaagccagttcaacttaccccgtttatacatgttgaacttgcctagatgcctgacctttgtcagattttgaagagaagaaagtaaaggaaaggagaaaccttctctccatccaacttttactacacatgaagtggtaggtcagcattaaatgactttttatctgtttctgccttgtgtatcagaatatggattttcctaagtgacatcaagcttaaaaaagaaattagctagtaaatgttttcctatctattgacacaaagtaaaattatgatggctttaaacaatgcattctcagccgggtgcggtggctcatgcctgtaatcccagcactttgggaggctgaggcaggcggatcacgaggtcaggagattgagactatcctggccaacacggtgaaaccccatctctactaaaaatacaaaaagttagccaagtgtggttgtatgcgcctgtagtcccagctacttgggaggctaaggcaggcgaattgcttgaactcaagaggtggaggttgcagtgagccaggatcatgccactgcacttcagcctgaatgacagagcaagactccatctcaaaaaaaaaaaaaaaaaaaaaaaaaaaaaatgcatcctctacataaggtattgtttagggcccagtttcagttgctgattgtccccttctctactaaattcttcaggtctgtaggtagtactctttcccatgcacaaatacccaactaatcttcagacttggaaactccacttaatgggttgtcccaacattttctttaaatccatgaatttcacacttacttccttttttgttcaatacttcaaaaaaattattattacttttagagccacatacaaccctgtcttgcatctcttgtatttttctccacctacacatgggcctgttttctttgattctcccaggtctatcccagctgctccttagaatcattcacccactcaactcttggcaacttctacattgctgtcccttaatcttggaacagccttccaatcaatgtgttttgagccacctcctaacttcagaaagaaaattcctcaaactccatctgtttagagaccatctagtttcaatgatcagtctcctcaccattttgagaactcttctaacatgttgaaatgtaaatactaattgttttcacataaaaattagcaagcactttagcgtttaatccaaacacccccaagctacactttgaatgaaaatcttcaatttcccccaactttcccattttaaaaatgggattgttttatgctgaagttaagaaatgaatctccattgcagtctgtgcatcaatgcatgagtgaaggaatgtttgcattgctttgggcactgtagagcctagacactgttcatgtacacatggttaacaatttacttctctctgcagtattaaatcttctcatgtcagagactaatagatcacagcatagttaacttactcaaatgacttccttaattcagtactgccagaaagcatttgaaagcagcaaatcccagaagtcttagtgacttctacattaagctaatgaaacgcatgtattcatgctacccgggaatgttggtggcatgtggcttacacctcaaaccaacactctcagtgggtaaaccaggagtggcagcgtgccattttcgtatttcttttcctgagctgcacactaccaccactttgatttctatcacagctgattccctttctaggaaactttccaagcttgttctcacacagcctaagagctgccttttttcaaccttcatcacttagaataccaacaatcaacatcctcatgtatttcccatactggtcaacaattttatcaatggctttgataaaagtaacagaaggcatgcctcttatatttatgaatgacctcaaaataaaaaacgtcaaccttaaggtaagtaaagttcagaaatttcctaagaaaaaaataaaattatttattattaaatgtatgtaaataaaactttcttaaaatatgcactacgaaaaggtggaataaaatatatcaaactaaaatagtgatatattttatcactaaaataaataactaaatatacatgcatatatatttatagatgtataaatatctatgatatacaaatgtctacatagatctctacataaagtttttctatactttccaatttctgtttaatcatgctatagtactttgataagaaaaatatattttaacaagtcattcattattgaaatgcattttgttaaatattaaagacatcaatcatacagaactgatggttgtaagcaaaatatcattttgctatatttgacagagataaagttaaaaatttctgcacttaaggtttaaaagataaaatctgtaagtgcaaaatattggagatttgtcttaatagtaatataattgaaaattatcttagatttttttttcaaattaagagtgatctcaacacaagccaatcatgagatttggctgccaaaaaagtaatggttcataggaggtaatttcaactaatgagtcttacagaagtaggaattgagcggttgtctttttttcagcaaacccagaatgaaagagcaaagtcataataagattatagactaataagatgaatataagcaagtatgcccaacaagcaatagaacccccaaattgagaccttcaagcaaattgtgggggcaaattgacagggagctactgatggcatcttatgcccccttgcaacttcaatgattcaggataccaagttgcaatggaaatgggaatgacagttattgcatcctgtggagacaaacatatacttcccaagaatgaagtgtgatctgtgtagtgagaatactgggctacgcaggagaaatactgaattggtggccttgagcaaggcacttagcttgcagttccttaatctgcttgtatttagtgttatgctgcccaggggctggacaaggaactggatggtttataaacacaattatacctatgccttatacaatactccatgagagctaatactattttcaatttatagttgacagaacaagctgagtgatctagtgcatagtatccgaagtttttttctaaagttagcattccttgcttcattgcaaaaagaaaaattagagccacctcaagtttcaaatctgatcatatagggtctgattcacccaatggttcctcacatttttcatgtgttgtaacttttatccatgaatatacaatttgtctggtattgtaataaaacaatagactttcaggaggaatgaaaaggaggtggtgaaggaatggaaaaaagtttcctttaagtaaagctagagtaatctgcttggcattcctcacaaagtttaaaatatatcccatttataacaattataatggacttcagggtgggtggggtaaattgatgagagataagaaaacacctgaaaaggtaaaatccatttctagttaattgttatcaattaagttgtttttctctcactgggacactgttctcagtgccctcaggccccaactacttacagtgaacagaactaatagcagtcagtttcattatgtctccttaacaacacgggaacctgttgtcctttaaaaatatataactgttttaacctttacattttttatttactcatacctaaatagagaacttctgctaaggtaggagaagtgaataccaagttcagctcaattcagttagttgtgctaaaggctaaaattacaggaacagtatgaagaaataattgacagctgaagtgcatggtcctatgaagcttctcttcggggaatctgtgattgctcttaatggcattttcaaaaaaaacaggtcctgttaattttcaagatatttttaaacactcgattacttttaaaataatcagcaccattatgaactcccaggaggctgtgaattaagaaatgaatacctttattttataacattttacaaaacactcactgtggacaataaatatcaaatccactaggggcttgggtaatgaaacacacgtcttgaaaaagtaaaactgaaagatgattagataattaatcacaattaaatttctcaactgattttgaaggagctaaacacaagagagcagtccacagcttcatcttttacttgaaactttttgatgcctcaaccccttacagatttaaggtacatgctgagtaaaccattttggagaagaaccaactataccaggtagaaaaactacattttgggcaatctggggtggggagtacaggcatgattctgaattatgccattcataatacagtgaagtaaaatagactgattatgaatataccatgtacttgaattgtccttgcagtggcacagggctgatatcaaccaacacaaacaataaatataatgtacctacatttctaattgtttataatgaccatcaaatatgattctagttctaatctctttgacgatcttctagaggtcataattctgtggaggacttgccttagctcgggcaacactgagaatccagtacatgtgtactggcactttcatagccacttggaacacatacaaatgctgtatttatctttattgccctgtatacaaaccagggtttggctttcctgtatcctgacagtcaaaacatcttccggaaatgcttctcagcaggaagttggcagtaactctaaaattgggtttctgacagggcattctctaaggagtatcgttgctttggaattataattttatgctccttagattccattcaattatattgaaattcaggatatttgttgaaaccaatcctgatactctgggaatgatagggcattcttttcttatcatatttcagagataactatcaatcattcttttagtcttccatttctttgacacccttttattgaacatctcccactaaataaaggttctctgattgattttatgcaacagcaaagtaaaaaaaaaaatattgttactttgagatgtttatagtctggttaattatgtggtcactacattaaacaaaagaaaacacatcttgtggcgttagcagtatgctgacagcctgggcaacgtggtgaaacctgaagtctacaaaaaatcccaaaaatcagccaggtgtggtggtgtgcacctgtagtcccagcttcttgggaggctgaggtgggaagacagcttgagcctgggaggcagaagctgcagtgagctgagactgtaccactgtacttgctagacacagagcgaggccctgtctcaagacaacaacaacaaaacaccaaaaataaaaagtaaatatgtgtgcaagcacaacatcagaccaaaatggtgataaacagacagattcaggcatatgaataagttgacatgtccaatgtatctagtatcagtcttctttattcctaaaatatggaataaaatatgaacaccatttagtccaatgataattcttacatagagaaagaaagttagacaataagttctgagacaatgtccaccagcatacaagctatttaaccaataaacttagatttattggttaataataataactggtatcaataatatatgaacatgtcattgatacaagtaaatctcttgattagacccaaatgtatgaaattctaatactgattctttgtcttttctctcttctcttatctatgtccaattagtttttcaaggcctctcagaggttatttctttcagttcccaaactacattaggttctcctataatcttttcttggtttgaagcatcttcgataattttaagttaataaattgctattttttatcaatgtccatcttccacttttaaacttaatttcatttagctgacttgtctgcctttgccaatatacctatgaccataggagagtaactggaatgtagtggatatacatatcgttaaaaaagctgttgaaataacccaaaccccagggaaggcctcatattcaaatggaactttaaatacaccattgctggttatacttggtgatgttatggtatctaatttcttttcgtgaaaaggttaaattaacaaattaaaatttcagactggcatgtcaaactcagaattatttataccaagttaggcaatgaaatgcctacatcttatacttgattttatatactttcttcgtcttaaatagtagtattagactgtattgagtatcaaaccataagtatgcattctttctgtaaaaatggtcaaataaagacaggtaaaaagcatggattttcctgtatgtttttatagaaatttcatgtaagctaataagttataggtttgcctatttaaacaggctttcacctggaggacaatggggtgttacaggaaataggagaaattctcataaggatgattaagttttcctaacttctcctcctgccctttttttaattccatgaatcaaaagggaagtcccctttgtacattcttcttttaacttataaaatctatttgaaaacttataatttaagagaagatctttttgtgaatttaggaacttattcctgagagcaactaatttacacaggctagtgtggctcacgcaatgacttaatttttaaaatatcaatgctgtgtaactgtactattgctacaaaagttggtgacaggagaccttggtaagtgttatggtttgactgtgttccccaaagttcatgtgttagaaacttaatctcccatgcagcaatattgagaggtgaaaactctaagaggtgattaggccatatggatctttcctcataaatggattaatgtcattagtataggagtgggtttgttacaaaagaaagtttggccccctcttgctctcttgtgctcccttgacccccacctcccctcaacacacacattttaccatgggatgatgctgcaagaaggccctctccagatgctagccccttgcttttggacttcgcagccaccagaactgtaaggaataaatatctgttctttataaattatacaatctgtggtactctcttatagcaacacaaacagattaagaaaataaatcatattagtatttcacaacctagaagagcaggaattttaagaataaacccctgaagcacagagttgatgtcatttattctaatatgctctggactgattttcccagactttggaaatgttttacctttaacttccagaataactttcaagaattttggcctccctagtagagctcagagagctaaaacagcagaattaaaaggtcttgggagtgaggcagggcagatgaaaatgagaatgttgtctcagatatgttagagagtttcacaagtttgcagaaagaaaaaaaagcaagaaaagacaactgaaagatacaagtaaataagactgagataaaatgctggaataaaagagaagatccctgagttgactgtgcattaatatggaatgggaaggggaattgaaaaaaaaataaagcctatagagcaaaattttattagaatagcaatatcataagttaatgagtttggttataactaaacctaattatagtgctttaaaaataatcttcttgggaagagaatccatgtgtttcaaatttacattacatttgaaatacaataaaagcaaccctcttaaaatatagttattagggattttatcacttattttgaaaatctaatacatgatattgaagcgttgggaacactgggacaatgttggtttttgtcacaatgcagctttatggcaaggattcctattcttgtttatttaagttccaatgtactaataagataggctggcttttagcaaatggatcaatgagtcttaatcccagatctgagactctctgttggttacaaagcttctaatttacacagaagaataagaattaaaatggtcaggctgcaacaaatggcttagggatgaatgagaaacaattgaaagtaatttcctcaattatgtctcttctctttttacatgcagtttctgtacaattcagagaggtacatacagagggaccacttcatttagtaatctatgtttccgacaataaaagaaatcttatgaacaattgacttattttcatttgtaaacatctctgcagattaatttttgctgctacttaatgaggcagattatgaaacttacttattaatttatcaaagttgccatctatgataatcattgaggtgtccctctcttgaactactatctgttcatcaccaatacagccaatcatgcaattctaaaatgatgtgatcacaaggcttacatgataactagcgatgaattcatcaaaccaaacttatttaataataccagaactagcaaaaatacactaaaggagaaattaaactgcaaataccttctcaggtaggctttttatatgattgtcttactgcctttctaattcccatagcgacctcctttgttattatcctgctacataaagagttgactgagttgaaattacttacagattatcactacaggatgcattttactatactagcgttttgatagccctgactgtaaaacattgccagatgataggatcatagaagaggaatagaaatgtcaatgcatttaagtcatgagaaggtgccttagactgcaataggtaaggtgaaaaagagatgtcttttacaaagatatgcaaatattaaatatcataaatcagttctaaattttgagctaaactctcagaccagaataatttcaactttaggggaaaaggtgaattgatatacagtaatagaggacaaagagaaagctcatagtggaagtaatattctttgtaattggtcatagttggtgcttgataaatacatgtttcatacatgaataaacatgcgaaaacaaagacgtagtagagaaaagttttcaaatgggtatcctgaaagctatatcaggactgctaactagatggtttggccaaggtagtgtattaaaagcaaaatgagcttggtacagtggtgtgcacctgcagttctagctaccagggagggtaaggcaggaagattgcctgagcccaggagtccaagaccagcaaaatgtacagtgtttaaaaatcaacagattttactttaaatcttcatttctttaaaatttggatgacatggaaacattcccgggaaagaagaaaaaggggagaactataatggataaattgcaggcaacaaacccaagacattttcaaatcaacaggtgccatctcaagagagaagccattctattgtccagatgttatcaatttctaggtattgtaatttaagggccctctccataccaaaaaaaaaaataataataaaacatatgtatactggatgttttccttctttgaaacaatttatttctttaacatccaaagcgctaaacattacgtctgtttttcttatcatactgccatttattctcagaactcaatcgcctctttagacaaagtgcatttctcacggtacctggtttctttggtcatttaatttatctgcttgctgaaatttgagtcttgtgaccctccaagtagaagttcaatgaaatatttcagggagaaggattacaggatagtgtgctgttttcaaaatacacaaaacaggaaactgttaatttaagaagtaaagatattttggctgtggaaaacagaaagaacttaagaaaaatgagaaagataggtaaaattaggctgttccaaagtctggattttttgaaaacttgagatagaatgtatattgttcctcacttttatcataacaacttcatttttactagtatttttattctctgaagtttgttacatcgaagtgttcctttagcaggaatagatagatttgaaaaataggcttaatctactatttcttcaggactttctccctacatgagaatctggcaaaattactgctcacttgctgctgacacatacaattcccaggaaaaaagaaaataagaggaagaattatgcgagaaaaatcacaggcagcaaataaacccaagacattttcaaatcaacaggtgtcatctccagagagaagccactttgttgtctccatgttgccattttctaggttttgtaattgaagaatgtttctctacactataaataaaacatctgacacggtagattattctcttttttgaaacactttattttttcagctttcaggatgtcacacgctagttctatttttcttagcttgctgaccatttattctcagtattctctgctagattctgttattttgtgacctccaaatatgagaaggctcagttttcatatctcttccccatctaaactccctttctgggtaatttcatcttgtcctgcgactacaatctatctatatgtgatgatgcttatgcttgcatctccagccacaactctccctgaaaattctgactcatgtatccatctacctacttggatgtccactaggtatatcaaaaccaaagtctaaaaacaacaacaaaacatccacttttccactccaacctcccccaaaggataaaagtcttgattttccattcgcaacaagtcttccgctaataacaccactattctcacaattaagtgggtcagaattaaagaatatatttaaattccgctttcttccactccacacctctaatctgtcggcaagtgcagtctgctctgtctctaaaatgcatgtgggattttaccacttattggcttgaacctcacaaccacctaaatctaagccaccactgtctcttttgtggacgcctgctacagcatcctaatacggttttttttcctccctcttctctgcaatctattgtccacactgcagccagagttatctttttttaaaaaataaaagtcatcctcatgatcaaatgttcccagtggctttctaacacacttagggtaaaattcagatccttttcaataacctgaatgatatgagaaggcatctggcctccttcctgctcttcctggcctcctactctttttccttcctgctcatgctcctccagttacccaggtcttcttattcttcaaacatctgcatttgctatttccatgccttgtgatcctcttcaccaagacagtcacatgactacttttcttatttcattctagggtataataaaaggtcccctttcaaagaagcctctcataatttttcctaatataatctcctattactttctagctcactttttcccatttccctgctatgcttttcttcataggtattatattatactcacatcatattatttcttttttctttgttattgatattctccaatagaaattatgttctaggaggataagaattctattttgtttacacttgcccataaagcctgacatatagttgacactcaacaaatggttgccaaataaatgaataaattaaagactacgagattgaaataccagaaaatgatcataacacttgtcctaattctttacctcacatcaaaaagtgctaaaatgtgctgtttaggaacccaacaaagatcacttaaaatattttattaaacatactcttctacaagcagaagacattataaaaaagaatttttttctacacattatttatcttgctcacatttactctgatataaaaatggattctaacgtatatatcagctctaggaaaaatcaaagcaggtcctttatatgcttgctagttttaaaatacagtctgatttcatccacttcaattgaatacgcaactaccatttccttgtactctgctgaaacttgtgaaagataacaaaatgaatcacaataactattgtttatagaacaacttaacttatgccagggaatgtgctaaaagctttacaagcactatatcatataagttcctgtgacaactccatgaggtataaggttccctatttcagagaagacaaaactaagtgagtcagacaacttgtcctacaccagacagctgttaagtggaggtgaaatttgcatccttgcctttctgatggctacattggtcatttttagtgtagaactcactgccactagcaggactcaagaacactcctggtgaccctgatgactcagttcatccaaatatgtaaatcctctgctctgtcgttagggactaaggttgttgaaggccatttacctatgtctagagtatccttaccagtagattattgaaaagttattgaattactaaaatttagttttcataaactaaaattagtacttaatagagtttactgagaattctaattcaatatcctaatgagaaagctggctgctacccaacacctgagagcaatgcaaatcgcaccctctgcaagagcacatgcaaacaggcagaactgccaaaatcttcagcacagataaaagtgtaagtggttttcaagtgccatttaaagtaacattattcctactctaaataacaaattcctgtttatttagacttcattattgtcaatttaacatgtgaaagtttctttgcttaacagtatcacatgtaatggtacttatttgaatcagaactatttgtgatctaaaattgtattatggatatatttttagatagctacacatagcaaacaatatgaatcatccacattcctgctacaaagcaaatatatacatatatcacaccctgcttgaattttactaggtagtgaattttttgttatcaagagtttgagagttttttgttttgtttttggaatgggttatgaggaattgtggtcaaaaaacgagaacttctttttggtgttaacagggctatgtctgctttgctctagtgattcctaacctactgtgcgaaggaggcatagcaaggcaagactgtttaagtataaccataaagggactcacgcactctcaggtgaagtgcaaaaatactgatcacggtgctcaaacattctggaggagtaagcattcaaattcagaaatgtaagatgatttctcaaagaaaagaggaaaaacctatcattaattttttaaaatatatcttccagagcaggtttctcaacaattttacatagaagacgagtatttttgtctccttaagatttggacttaaggtcaaagttgttgaaggttgatcggctattgtaagcttcaggtgaaacctagagaggagaagggaagaagataaatctactatcctagattctttttaagaagcagcacgttccactcctgactctcccgaagatggtctcaggtcttcaggtgaccctatgcaaggaccctactgtgcactctgctgagtgttctggctctctggtatcaggtcactgggcctactctacttttggtgtcattctggccctgtgaagaaactatgaggagaatctggtcgatgcattttgtagttaacaccgcaaaggacatgagaaacttagccagagagctattagagtggcgatcagtgacgctgctgctctacccagtctgtcttgtgtgctttaagatggaagacacctaatgctgacttagccttccctaaagtgaacagaccactcttctaaggtttctgcttgttgtcaggaagtataagcaaagaatgacaagcagaacaatggacatttgttaagtgattggcttgcatacgttggctccttcaatgctaacagcaacgagtaggtgccattattacagccatgttacagatgaacggtgggtactattattaagtccatgttacaggtgagggcgtgaagcttatcaaggagttcattggtcatttcttgaccaggacacaagctcctaatgtttctctcttttttaaatctgagttttccaacactttttgatttaagaattgatctggaaagcccttcattcacagttgttttctggctactgtcagtaaaaaggataggctcaaaggaaatctgttgtgtttagaatggtggaggtatgagagatttcttttttatctttaaaagcttcattacttgttttactggtgttagttattgactctttttcctttatagtaacagaattatttctgtatgaaaggttatttaaaaagtcacattctaatggcaatcaattaattgaccaacaaatacagtaaaattgcaaaacaaaaccttgcaatgttcttaaatacatttggacactcaaaacaagataaaatcttacagataatgtgaatacattattagttatttcacattagaaaggaagaatgttggaaaaaaacatcatatttggtttaaacattgctttccacacacacgtttcagaggctgtgacattttcaggatcatagattctttggctgtttttccccttttaagtggggatgatttattggctaagtttccacagtaactcccagcacttgtagaactgtttagcaaatctgcattattttgcatttccactaaggtcacggttttcatagattcaaacagcaaggaattttaaaatttctccctctactaaagtttactggctattgtactcattatcttagcattcttattagtttcttttgagaaagtacacctggtaaagtcgagtaactaaaaagggtatactattcaaacgcaatgttattcaagcattggaatcctactcaaataataaaagaaaagaaaactgaaaatagagtgaacaaggttattatgttaggcagagaaaaaaaacagtattgtggaaaacataagtatgtgtaggatacacatgagacctcaaacagatgcatctttgtggaaatgtaaataatttattatagcagataaaactgggaaggagcttctgctaattaacatacacagtcattttccctgtgtagagaagtccaaaaactgtttccatttgcaggcatgtggtcattagactaatgggcactgcctttggacaggatttacttataccccagctggctcaaaaaagtaatcattctctaattaagaggcttcctcatgtgttttctattgtcatttctagagttccactatatctagcttggtagtacaaaagtggtatgctatttaattatcagccagtagtggggctgagagataccctgagtttcatcatgcagtcatttgtttctattgatggtagaggataggagggtaggtatacaagcatatacatgaaagaaactttcttttcccactcagttggaataaattataacatgtctggacaaatatgtgcgtgactattttcaggactgattggaggtcataatggattttcgaaagtaaaactcaaatagagaataagcttgattattctactaaccctctgtttttatgtttttcacttagattttaaagggttgagtttttaaagggctttagtaattttttaagagacgaattcaagaacaggggaaatggccactcctaaatattgcataaaacctggttgacaccacatgaggtctggaaggatatatttcccattattaaacctagctgtccctcatataagaatgggttacttgcattattttttacttttccattcttgatcaatattttcaaatgtttctggaaatgttttccagcactgttagagggtaacacattttctctactcctgagttcatgaggaaggattttatttttcttctcggtttttccctatgcctttgattaccacagttgggaaaaataattttaggcatgttctgttcagttccatgcttcttcctattgggagagcttttataaggaagcacagggccctttgctctttcaagggctctaattcatgggtgccccttgcccagggcccatcacttgtgtgcatggagttaggcttgcctaacccaggggtccagtaagcaggttcgtgtggctctcaccactaagtcatgttgtccaaattggtctttgtgcattcaggtgtttttgaaaaaccttgttcagtattctgcaaaaacttacactattccaaatctacccagctctgtaacgagagaactggtaaaaaaaaaaaaaaaaaaaaaaaaaaaaaaaaaaaaaaaaaaaaaaaaaaaaaaaaaaaaaaattctcagaaaaatattatcattgaaaggcatttaatttttaataaataaatataataagaacaggtctttagttaaaaattaaaaggataatgttgcttgatagatgggagtccaggaaagaattgtggttaggagacatgagtaaaatgcacaaatgtcaggtagacgagtacaattaacacttgccaaacagagcttgtggcataatgcaccccaagaaagaatagtctgaacaaactgtacttggttcctctacagattgttcccttcacctatttgtatactttgcatgaaactactgttacttgctgatataaaacattaatatgctaggaaaaaaaatcacaaatgaaggaagcgatgtcgagtttcctttatactgacatatttcccatattccaatatgtgtaagattttccacattactgaaatggaaaacatagcagaacagacaaaatcaaggatgataattgtttattcatctacactttccatcttttttaaatattcaaattgtttagaactccataaggagtgctattggggggtaggggtcttcagaaacgccgttgctcatataaacataataaagtgggaacatgattaaaatacttagatttctgattgtaatgaatataataaagaaaaactagcttaaataaataatgccagagggtatcaatggctggacaagataagagtttcattagcaaaaccacaaggcactagaccagaaagtttccaggtgaaaggacattaaaaaggttccattggactaatgaaattggaatacactaacaaacatgtcagtgtggacaagtaaggttctgctcaaaatctgtaaacttatcaagaaagtatctgctagaattctgaatgctgaaactgaaaaaaagtgtgctttgggcaaacaaagaggaatgttttgcattcaagaagtgtatgttttatttttataagatttggtagaaactgaagatatgaatatgtttaagaaatatacagttgattatcaaagggcatgttgtgatgatatttcacacacctgggttgatgctccgcaagatatatctattcatgtcatagtgctgtgtgatcaccttaatgcaaaatcccagagcagaggctcttgtgaactgcactgagaagtgcccactctaataatgaaatattgtggaccttttctgatactcagaaaagtgggttaaccaatgtaacatttcaaatttaaattttcttccatgattttctcggatatttttggccctgttatcaaaatatgttcatattagataccaagcgctttgtttaggccttcaggttcctcattcacactcaatgtgggaagatgcttacattaatttttgtttctaaaatggaaatattttaaaatctataccttaagatgggaaggcctgctagtaaaattactcttaatgtatatgtgtgaatcaaataccaatatcactaatggtttgaaaaatcactgcccaggagtagcagtaactgcaggacagtcaggagatgttccagtctctccctgaaagcagacatgtgtcctttggcaaatggtttgataactggggacttggcttcttcactggtgagagcggggagggagagggcttaagtggcccataaaactaaaatttctaagattccttctagatttgattcccttccaaagtatgactaggggtaccctaagggaagacaggacactttactagatgaattcagctgggatcctacgtgagacgtctttaattggttatattaatagctaatggcaaacaaaaggcaaggcagagaaaaggatggagcaattattgcatgctgagaccattttggggtaggcaagttgccacaagagcctatggttggaattttattttattttattttttacaaacaaaacaattcatttaaaagcaacttaaaacacaaccagggtgattttcctaacagctctttctggtatttcaatatcttgctatattcaaagctggagataatcatgcaaaccagccagccttttcacttcctggaagccctagttcagattattttactcttagggaagtgacctctcttcccctattgacctgggaaggggcagaaaaatcccagtagagtgaactgaaggtttgatacaagaagttgctcaacctggacttgcctagaacagcagccttttattctgattgaatctgtggaaaataagacccagaggaactcagactagtatagcttgtcttcttttatctattactgtttggaaaataaaattaatctgtagcagaagaaaaataaaggtgacaaacatttgctctaggtacctagggatcaaagtaactgagccttcatgtctttttttccactaatttaatacatccattaattttataagtatggatacaagagaaatcatttttttgttggtttttttaaatggtagacttatttgctacatcagctataattttttccacaccccttttttaacatcaaaaaaatgtaaaaacctttgcttcaatgtaaagtatgttgaactgtttccaatgatgaatatcatctgccaatctaataaatgtgagtaaggtgaaaacggaataaatagaatgtgggggcgggaaacaacccttgaaacggtaatcagcaagtaaagctgaattcctatgccatagtgtcccctgctggtcgattacggaagtagtagctttcggagagcaagtcaaacctcttggttaggccatatcatgttttgaacaaaaaaggcacaaaaacgaaaggaatgtgtgcatattgttttttgtctatttctttttacatagtcatcattggcagtgggacgaatgggggaaggattgttttatgcgtgaagaatcccagagcccattagaactaggcttagctcagccacttctccagtgatacgtgatctggcactcacagatctttctttaagcctcaactcctccctgtaaattgcaattagtaataataataaatgatagatttactgcagagagctgttacaaaaacataagaagagaaggaggaggaggcggaaattacacacagtaaagtgtacttaaaatgatatagcgctttccaaaacaaatattaatgtaagggtgcggattgggggagacacttccattaacaattaaactaacttcccttataatcatcaaaaggtaatccaggctgggcaccccaggcatggttgctgagctatcagactttcaaattcctacaacatcacctggtttccaaggacttacttgggtacctttgaacaatgtatgttgctcagataatttatattacacagaatttactatatacttagagaggtctctactggttggtaaacagaggtgatggggtaaaggagattaaggtgctccttgtttgcttgataatcattaatgattgagtctccatcctgttgctagttgtctgaccagcagcatctgcatcacctgggagcttattagaaataaggaatcttagatttcatcccaaacctactaaatcagaatctgcatttaaaaattatcccaggtaattcttacatatgttcaggtttaagaaactccactctttcacatttgggctataagctttctctggcaatacatcagttgttatctagtacatatgtacagaatagtatttttgacttgaccttattttaaaactacttggagaaattaaattagaaggaaaaactatggctaaggataattaatttttatgagcctcaaaagagacgataataagatgactttcctaaatgtaacttagtattatgctactttaaaatttttacagctttgtaatactaattttaaggtaatctcatgtatttgtattaatatacacattttatatttgcccttagtatctgtgttgataagaattttaaaatgcagattatttcattagaagagattttagaaaatagactcaagtctaagcagacgtttgaaaaatctaagagggccgtagcttccattaaaaataccatttacccaatcttttgtcagttaatgccctctgaacataagacaatgttctgagttgttggaagtggactgctatactagcaacacctatgatcacagtttctctatagatacaattttaaaataaaccaaacttggaaaatgagtggatgggtattagaaagaaaattcattctttttcacttactccctaccccctaccacttaccctaagctccacctcacaccctctgttgtgtcttcttcctttaggaatattttgtttagtttttttttgtttgttttgttttgttgttgttgttgttgttgttgtttttggtcatagctatgctctatttaataggtgaaaagactttaatgccagtgcttcacccaggatagtttctttctaactggtccttgctataaaagtatccattctcctcctattatttagtgtcctggctataggtgaaggaagtcatctgattcaaccagtgcacactgaggtgtgtgaactctgaacattcttctttaacctccctagtggaaacccactgagtttttaggaaagacactcacacaactcagtgaaaagcttcttagcagaacttcatacaatttaagacacaaagagttttagggttgaagtgggagatatttcaggacccaggtacctttctgggtccattaagcccctccaatcttctttagcctattttctacctaaactataggctctagctagctacacaggtaatatccttgtagaagggtaacaattgtgagaaaatatggatttcagagtttgtctgatttcctttactgaacactcctttgaaagtattgaaaagtcatatgtttccaatcactaaagttggacattaaggatcaggaaaaaggcctggagggggatctttgcagtataagagttttgactccctgctctagtggtgagagacctttcagtcagagagaaaggatcttgacttgagagagtaacagggtttccaatctgttcctttcattgaacagagttcaaaagaggctcaagggtgcacctctcttaggctctttatattgacacactcttctcttgccaaaagcttggtttgcagaacaaatcaaaaacacacccttgacaaacgttctggtctagaataatcacctcttccccaacttactatgccaaagaggggagcttaaaaatgacaaggtgtgtgtgatattgtctatctctgcattcttcataaatcttcaaagtcaatatatctggactgaactaaggatatatgatgtttctcatgctttcatttaaagtaagatcttgaggatctttccacttgcagattgatatgcatcacagaaaagtttccttgttgatgttcaatgaagtcgcaggctcaacacatgagcctaccaaacacggcaaataaaaatttgttcaagattggaattaagggcaaaatatcaaataaaatgctattgcaaacaatggtgtctcttcaaatgctaggtttggcatagaaaccaacaatctccaagaggtggaaagaaaatgaagatctcttaagggcaatgcaaacttccagagacattaggatttgcttagcatatagaaaacaatgaaaataaagaaaataaaacaaaacttctttctattgtgtcacagtaatccacctgttggtagcacccaatttggggactgaaataatggtgattttcaacagagaaaattgtacatttcctttatgcatcctttcttcactatgtttctgactttttcttctacctcaacatggtacagtgggaagcaaacaaaattgggaatcagaagacttattttgctcccaggtttattactcactcacgtgactcaaacacagtgctttaatttcctgaggaattaattatatttgtatgaaagaagtattgcactctatataaataataattacaggaaaaataataatagctaattcttaatgagtatttcttattctccagtcatttttgaaggtgatttacaattgttaattcattgaaattctcacaaaactctgcaacgctagataatattattatcattgttttatagatgaggaaattcagccacagattggtaaatcatttgtccaagatcatgcagctgataaatagtgaaatcaagattaagtttaggtagttgagctccagagcttacagtttttcatgttaattctcctcctctgatacattttcaatcccctattttgatgccatatcatgcttttccaatgttttctgctttctataaaatgttgatacctctaggaataagtctttaaataatggtttcacacctattgggagaagacatgatgggaaaaccaccataaaacaagatggaacttttaagaggagacacagtcataaatctgttctaataaataaaggggaaaaaaaagaataaaaagttaaccccttaaagaaaaacatacttttaaagtctgtctggatcttttgtgaagagcaaaggaaatgctgaataaaaaaggattttgattgtcctttccaaaatattgtcccttacctcttggacattggtgacaccacccacactccacccacctttaatgacctctactttctagtaaaaaactttatctttgcataaactttgttgttttgactctgcaatcaggaagatacttcatagctatatctagccaggtgtaggtaggatctgagtggaaagacagaaaaggaagttatattcattataaattaatgacatgccaggtattaggcatgtccacatccataattaataacattgggttaagcatttccatttaatacagagagagacagacagagtttgcacagtatctttcctttggttcttatctaatgactgactctcttccatgtacctttaaaaccactaaaataaatggtctacttgggaggttgatatactagccaagctataggtctaaacttcaaatgcaatttaatctatgcagcattcctttttcatagtgaatctttaaagctcaattttttgcattgattgatcatcctgggaaacagaaaaacctcaactcacagcttcaagaacttgaaaagccctaatccagtgcctatatccatcacctctgaggacaacaggaaaattgaaaaggaagaaatttcctacagactcatgataaacttattgatagtagtaatgatatacattttttaaaaaattatcaaattgtgtattttttaaattattaaactcccatggcctcaatattctactctgccaaatgatgggaaaatttaaattgtttctacaatttcccacatctctataacattaaaagatcaacttcttaaaacatatgtaacattttctttccttgccccaagatgcttttaaaggttttataaactacccttctttggacatttttgtcatcaatttgctacttttctgttcaaaatgaataacagcttcccataggcaatgatactattatcctctctgcatatgtaaactacctcgccttcaggacacaaaattcagtcccaaatcactgtcttcagcctcattgatattgtccctctcctaaagactcctatggcttgaatatgtgtcccctccaaaactcacgttgaaattttatccccaatatggcaatattgagtagtggggcttttaagaggtgattgggtcatgagggctgtcccctcatggatgtgttaatccatctgtggattaatgggtcatcatgggagtgggggtggtagctgtataaaaagaggaagagagacctgagctagcacacccagccctctcatcatgtgatgccctgcaccacctcacctcaggactctgtagagagacctccgcagcaaaaaggccctcaccagatatggttccttgaccttggaattctcagcctccacaacggtaagaaatatattccatttctttataaattacccagtttcaagtattctgttataagtaacagaaaaaggaatatgggaaagaccacagcctttattctctgtacatggcttgggcttcatcgtcttctcactcatactattttaacatctgttgtatgtttgtttttcctatccaattaaactaaatgttaaataatgacaatgcactcaataaatacttgttgtccttccaatatttattcagtaaatgttttcagtgtatagtatctatatgcccatcttggaaatctaagaataaataagatataagcccagccctccaagatcttaccatctggaatggtaaggtctcacaagaatggcaatgtaaattcagtgaaatatttccaagggctactgtgaagaatgcaaatctgagtctacaatagattaacatgagaatttccaagtagtaatgagagtctggttaagtttattgcctggcacaagatcacactaataaagaatatttattgagcacttaccatgtccacatttagttctcactacaactctaggcagtgtttctatcttcattttgccagtgagggaattttggctttggagaccagtgttttcccaaggctgcatgatgtagctgagatagccagggcttggtggaacagtctggctttcagtcagctgtaaccactctgcactacttcctcttgcttacttggtgcttttaaaatatttgttgaaagaatgacatgatgtagcatgcatcaacagtgaaaaatatgctctgcaatagactccaaatttcgaggtccccctaatttggctgtaacattgattgtgtgtatgtgtgtgtgtatgtctgtgtgtgcgtctgtgtctgttttagaaatgaatttacattctacacctgacttccatttgcccctctgcattccctattgccacagctgaagagtagaaatgctttatggctctaactgggagcagaaatcactgcaagtcaagagttgggtgaatcaatctcaatctctctctctctctctctctctctctctctctctctcatatttatatgctctaaatctgactgcaccttttcagaacatcatgcatagtatgaggggactaaattaaaacatctgacacaaacattgagagcaggaaaaaaaattgacatgtggtaactttttggagtggcattctggttgatcctttttcaaggggaggggagggttgtttacagatgagcccaagcttgatgcatgctgcagccaagaggcagctctcccctttgatttttcctctatataatctccatgtggtccccaaatgcttaaccctctctgccaaatgctgtaaaatctgtcttttgatttcacagatggaaaagacttattagctcatgaagctcacctccttaggagacaaggaactcatcaaataccatttaccccacccttcgagtttgaagtctttatcagtttcctggccaaaactgttcaacctcctttactcatatgacatcctaagtataaagaaaacaaaacaaaacaaaaatccatctttttgtttggcttctagtggtcttgggactttcttccaaagtgtttctcttgctgtgtttttaggcagtgccctaggcaaagagaaaatgaccatttgcatctcttggttataagtaggcttgtcattctcaaaacaacaacaataaagagacatacttaagcaccctcttttgcattgggacagcatcacctggaccagtttaaacctttcaaacagtacataattatactcaagatgaggattttaaagaacactcgacttggaaaacctactttttgagttaagccctgttaccaccaaatcatttggttttccaaagtttagtttcccagatgatgaaatttcaagttcactacaatagttacatgtataagaatgtaaggtgctgtgtcaacataaacacatgatttgattatctattagaatttagtgcaacctgatagatatgattaggcaattctttataagtggacacatcttttgtaactgattttattatactcttcagttaaaaaataatcatcgttccttcattagttacaggacagagttcaaagctctcggtattattttcaagccttccctaaatctggctttaaatgtctctctgatctcatgttgacattccctacgtgaaccctttactcctgccacattgacctttttgtcctgtgtccttcccatcagtgcctgatctgacatgccccttctttctatccctcctgctcccctacatacaagcaaggatgtagaaactcgacaatcctattctccaatataaccagcaatttttaagcccttcaccaggatagagtgaagaaaaaaaaagagtacctctaaatttgtctcttttttgccaacacttaatacaatttcaaggtctggctggaatttacttcttctctaaagcttgcactgctatcagacctgtgatgctctcctctcctgaattcctattgtttttgttttctaaaacacacatgtgatacttaacatatcctaccacctatgatgagctacttttgtacctatctgcctctcagaagtatgcaggatgtcaactgcacatgtgcaatgcatgttctcatatgtgtacactcttgttgtatgttgtatattcttaactaagctcctggagcaaagaactattcacacactcattctcccaaagaccagccccatggatagtgtgtaatcagtaaaatgaatgaatgaatgaatgaacgaaagtaaactaagatgaaattttaactgctgacctttgctaacactcccatgctaactcacaaatatttcagaaaaaaaaagtataaaaaagacataatgatgagaaaagcattctaggcaggcctattgatcttgccaaaaggagatgcagagtatagatggcacagactatgaagctgctgagatgtgcctcacccactttgaagagagaccagggagcacagtacttgcattatcattccactgttggtctctgaatcaaaagagaaggaggcaagttcctagcttaaataaattatttagaatattgatttaactgcctgaactgtgttaagttatatctgaactaaaagacaaacatttgcgtgtttcctttaatggaatctgtgaattcaaacatatatttgggtttttaaaaataatctccctctccctctccccctccccgtccctctccctctcctctttgcatggtctccctctgatgccgagcggaggctggactgtactgcaacctccctgcctgattctcctgcctcagcctgcccagtgcctgggattgcaggcgcgcgcctccacgcctgactggttttcatattttttggtggagacggggtttcgccgtgttggccgggctggtctccagctcctgatggcgagtgatctgccagccttggcctcccgaggtgccgggattgcagacagagtctcgctcactcagtgctcaatgttgcccaggctggagtgcagtggcgtgatctcggctcgctacaacctccacctcccagccgcctgccttggcctcccaaagtgccgagattgcagcctctgcccggccaccaccccgtctaggaagtgaggagcgtctctgcccggccgcccatcgtctgggatgtggggagtgcctctgccccaccgccctgtctgagatgtgaagagcgcctctgcccggctgcgaccccgtctgggaactgaggagtgtctctgccccaccgccaccccttctgggaggtgaggagcgtctctgaccggccgccccgtctgagaagtgaggagcccctccgcccggcagccgccctgtctgggaggtgggggggcagcccccgcccagccgccaccctgtctgggaggtggggggcgcctctgcccggccgccccatctgggaagtgaggagcccctctgcccggctgccaccccgtcccggaggtgtacccaacagctcattgagaacgggccatgatgacgatggtggttttgtcagatagaaaagggggaaatgtggggaaaagaaagagagatcagattgttactgtgtctgtgtagaaagaagtagacataggagactccattttgttctgtactaagaaaaattcttctgccttgggatgctgttgatctataaccttacccccaaccccctgctctctgaaacatgtgctgtgtccactcagggttaaatggatgaagggcggtgcaagatgtgctttgttaaacagatgcttgaaggcagcatactcattaagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaataaataaaaaataaaaaaaataataaataataaaaataatcttaaagagacataattctctcccttttaaaatacatattcataagtatgtatatttataaagggttatataccagggcaaaagttactgataatgattctgcaagaactcttagtttattgccttcatttttaatttataaatgaaataatctagttcttaggttggctaatacaataatgttttgcttttttttcactctttataaaattcattttacttattttagatacatgtcataaaatcctcacttgcatttgcttatttttgtggtaagctaagaatttaatcttactgaaataattataaaaaattaaagcaatcatacaatataataaaagaacatagtctgatttttgtaaaataacactcagggtatgcagatatatgacagacataccttttttccacacatctacaatgatacaatgatcttattttcaacaaaggcaccaaaaacatatcctggggaaaagacaatctcttcaagaaatggtgctgggaatacaggatccatatgcagaagaacgaagctagaccccaatctttctccatatgtgaaaatcaaaccaaaatggattaaagtcttaaatctaagacctcaaactatgaaattactacaagaaaacactggggaaaatctccaggacatttttttgggcaaaactttcatgaggaatacactacaagcacagacaaccaaagcaaaaatgggcaaatggaatcacatcacgttaaaaagcttctgcacagaaaaggaaacaatcaacaaagtgaagagaccacccacagaatgggagaaactatttgcaaaccctctatctaacaaggaattcataacaagaatacataaggagatataacaactttacagaaaataatctaatgatccaatcaaaaaatgggcaaaagacttgaatagacatttctcaaaagaagacatacaaatggcaaacaggcatatgaaaaagtgttcaatatcacagatcatcggagaaatgcctgaatagacatttctcaaaagaagacatacaaatggcaaacaggtatatgaaaaagtgctcaatatcacagatcatcggagaaatgggagaaatgccaatcaaaactacaatgagatatcatctcactccatttaaaatggcttataaccaaaagacaggcaataacaaatgcctgtgaggatgtggagaaaagggaacccttgtacacagttggtgggaatgtaaattagtacaaccactatagagaacagtttggaggttcctcaaaaactaaagattgagctaccataagatctagcaatcccaatactgagtatataccccaaagaaaggaaatcagtatatcaaagagacatctgcactcctatgtttgttgcagcactctttacaataactaagatttgggagccacctaagttttcattaacagattaatgcataaaggaaatgtgttacatatacataatggactactgttcagacataaaaaaatgagattcagtcatttgcaacaacacagatggaactgggcattattatgttaagtgaaatagccatgcacagaaagacaaatatcacatgttctcacttatttgtgggatctgaaaatcaaaacaattgaactcatggacatagagagtagaagaatggttaccagaggctgggaagggtagtggggtggggggtgggaagaccgtgtgcaggggaggtaaggatgattaatgggtactaaaaatagaaagaatgaataagaactactgtttgatatcacaacagggttactatattcaataatagctgcattgtacattttaaaataacttaaaagagtgtaactggattgtttgtagctcaaaggataaatgctaggggggatggataccccattctttgtgatgtgtgtatttcacattgcatatctttacgccataaatatatacacctgctatgtagtccataaataccccataaatatatacctactatatactgacaaaaaaattataaaaacataccttttttgggggaatatttttcgaaatataccccataaatatactccataaatatatatacctactatatacacacaaaaatttgtataaacatacctttttttcttttgggaatattttttgaaagatgtttttttaataaaaaacaaacaagatataaaatacatgaaaatctttgagtattgtctatctttctttgggtaaaagtcttaaggttttggacactactatccttcttaattcatactaaaaatcataatcactcctaaagtgtagtaagtccctcggaaaattattaaatgataagcttaaaagaaaaatttaatgtatatactataaccatttaaaaaggagagtgttttgaggttgtataacctttaaaagtacattttgaatttctatattaattttaaagtgcatcaattttgtcatatgaacgttcgtaataccaaatatatcaataaactgtaaaaattgagaagggagactatgttgaacttaagaaaatttcatttgaaacctattaatttcagaaacaaaccatacatatataacagaaataatttacaattaaaatttttactgaagctctttcaatggacacccttcatctttcccattactctcttgtcacttcataactatgacatggatcaggcacattaaacatagttctacatgaaggagtaaagacaatgacaaaaactgtggaatggtacataggaaggacttcatagaagcagggagtaggcaatgagttttagtgcttttaaaattgaaaaaagaagataatcattactaactgaaggtctttctataaaataaaaataacaaggtagttcacattaaatacattaaattacagttaaagttatttttaactccacagattaatgcactttccctttcacagaactcattttctattaactttagcaaccagacaccagaggttgcagtgtaaggtgtatttttttatggctcaaatataatttaatcattgtattttctcttcactagattgacaaagtgcactatgaattggtggaaatgcgctgtctcatcatgtgatgatcagaagctgtgataaagatatcatttgctccaacatttctagcacacgctgcatagagtctgcaaatgttctgatgaagcatggataatgatttgaatttacacttcagatccacagcatattaggctatggtctcactggaggcatgtgaaatattagccatagagatgtcttaaccaccatttacatttgttttaacataaaatcagctagggtataaaaatgcacaagtctctctaactgtaaataaccacacatcatcataaatattgagtccaggaccaataccttatcactcgtagttacatctttttgcattaattcaagaagatcttgtgacatagtctctcacaatgtgatatgctaaattacattaaaaaaaaacagaaaaaaatagacaaactctgtagaggcttgtagtttcatcactgtgaatcactttcaaattctatattcctatttttatggccaactgttagtagttattcaacaacatacaaaaaaaaaaaaaaaaaagcttggactagtaccattgatttgttcattcaaaaagaatttgtttagtacctcctatatggtagccctatcctagccactgggaataccatggtgagcaatacagtcaacagttccttccctcaaagagcttatacttcagtggagacagatgggcaataaacagaataactaagctatataataagatcaattgtattctgtactatgggggaaaacagagcaataaagagagagaattggaagtggtggaagtgattgtaaatgttaatagggtaagaaaggcctcactgagcaaataaaatataccaagaaaggagacaggaggaaggcaggaaagtaaaaggttgggagaacaaaatgcgcaaagaaagctgagaaacactaatgtgactgctggcctctgtacctaccttaagctttgtgttccctctaccagtcccaggtgacctccccaaatatccctttggtcttatgctctatttcactcaccataaaattaataatttctatttccttctattttaggagacatatgaaaataatatattatacattttcactattgtattagtctgttctcacactcctataaagaaatgcccaagactgggtaatttataaaggaagaggtttaattgactcacagatctgcatggctgggaaggcctcaggaaatttataatcaggcagaaggggaagcaaacatgtccttcttcacatgatggcaggaaggagaagtcccaagcaaagagggaaaagccccttataaaaccatcagatcgtgtgagaactcactcactatcagtggcatgggggttaccacccccattattcaattacctcccaccaggtcccttccacgacccttgaggattacaagaactacaattaaagatgagatttcggtggggacacagccaaaccatgtaaactattgtttaggatatgtgtatacctttttcagaaagttatattttgcattagtgcagtaaatgaaactgcaatatttacacagattcattttgaaatcttaatcaaaaaacagtaacggtttcctttttacagttacataaaaaatgaagaagggacccacccattaaacctaccttgaatgaggaaagagattgagactgaatttcatttctgcctccagtcatgttttataaaagcggtcaaaccagttttccttacaagcagatgtccagttgtatctgtatctgcctgcctcctcaacccatcctccacaagattgagaaaaggaagacagtgtgctcttgatctggatacacatttcaagccaaagttttataaagaggaagttcaattcaatgtagaaatatctgaatgctgtgtactattttattgggtacagaataaaaggggcagcagagtaactttttgacttctcactgcatcttttgttttcctaaagcttctgcttcactacgaatgaagaagactaaaatttctctgaagagaaggaagccatccatgatttttgacaatgttaaaaccctgatattctgcttggtcctaggtattctgctgtatccctgacattctgcttggtagtagggatttgcactgtgcttggtccagaagacaaattccaagctcctacagagtctgatggctttacaaataacctagctatcacaattctaaataagtgtgaaaaccctgttaaagcacataggaaggggacataacttgtttggtggggagggagaaggcaaggctttcttgaggcagtaacatttgaattgaggcctggaaaaagagtaaaaattaaagaaacaaagaagaaatgtactgaaaaagcaacaaagtccaaaagaacgcacatccaagaaaccgaaaagtgcaggatcacaaagagaagtataaaatgtaaagaaggaataagggatagatggggctgcacagataagaaggctaaaatatcacatgtggattaagaaggaccatcctgaaggcaaggtggaggaacggagtactgagaagttttaagcagaaaaataaaatgaccaaatgtgcattttagaaagattactagttcttccagaggtctaaccgagaggtcaccatgatgatgacctgaaccagggtagaagctggaggaaaaataaaatcaaaaggattttatttcctttgtacttgagagttatttaggagatgaaacaagtgaccgatggaatgtagggaggggtttccttcttggttcactgagcacgtgcctcttcttatatctctaaagcaagcaggaatctccactgagtcctgaacaggctcaaaaagtttcaccaagaatgaatgtgcaactatcccaacaagtttcaccaagtataaatgtggttcagactcattcctcaacacatggtgtaccctccttgcagcctcccccaacacacacagctgttttattttagatgctgcaaatcataaatgtgtattacagatctaacaattgtaaaatctccaaataaagttatttctttgagtgactggaacggagaaagggagcggtgctttgtatttggcaggaacttagattagtgtcttttcagaaagcccagtacattttgattagctcaatcatcattcaacaattattctctctctgattttaaaattttcattaaaagcaaatttttaaaaaggcatacccttgtacaggagaactcccttggtattgagcaaattcatccagggatcaagggaaatacaaaatattttcacaccattatcaatgtttatgctgtagcagaggaatcagtctcaaacacaggcaaaatatgcatatatttttaaataccttagatgctatagtaataaaaatattaaaatatatatggcaaatccattaatctactctgagtatgtctattaacatgtttaaaggcataagtggtttatcatatttttatcatatttaagttacaaaaatcttttttattttaagctttttatcatttaaatcatatttttattgtagttaagttacaaaaatctttgactctcctttgaatattttcaaatcaattccataagtgaagacaaaatacacaattgaggaaggggccatgatttgccccaaaattgtcatcaaatgaatgaactcaatgacttctgaatcacacttttaaatcagatgttcccatttgatctgtcaatttctccaggtttgatacataggtgtaaaatcatcacactcttaaggcaatgaactgcaggcttaaataaatagtatatctgaaagagattaaggcaatcgtatctttcagaagaatcatatctttcagaagacatacttggtaatgagttttggactgcaagtatcagttcttagacacagcatgtgacagtttggttgcttggctaaagtttcacagcgaataattcatctctgcatcagctggaccctgacctgcaatctcattagattcattctagcccaatattaaaagtatttcttgctaataatgcaaatgccattatcatccaagtaataactagtgtctggtagtatactgatgaaattttgggtattcttttgcatttttgtccaattttcattatttctcagtgggaaagaaaaaagaaaggaagggaggcaataaggaagaaaatgagaaggaaggaaaaaagaaacggagataaagaaagtaggcaggtgggtgtatcttacaaatttgcatacatacaatagtttgagtaaattggaaatacttaaactttatcctttgtaatgtaaaaacattaaaacaaaaattctccaccatgaaaacagaaaatatatatttgtatctcctcccattatatgcttttatgagagatggttagtgaattttacacttaaatagacacacttctttttgaaacctcagttttacttggtaccaataacactgaaataatcctccactgtatcccagctaatgcttctgcatcccaccaaatacatctgaatgcatggctaaaacagaacacgtgatctggccagccttacacgtgtaatgaaaatctaaattaaagagaatgagacagcagagataaagaggatttggggaaggaataaaagagactaaacatagcactgagaattctcctctttttacaaaaatgacagacttaagagagggcatggaacagattaagagaattaacatggagaggagagcagaggtataaaaggtatccaagaaaagtaaaacatacaaaggcaattcaaatcaaagtgagcactgcctatatacagacagaaagcgagtcctctatgaaaccatacttggcagaaagtactcattattaatagaaagtgaaatcattttgatatctacaccagcagtcattaaataggcccacagactacccctggttttgcaaataaagttctattgtaatacacacatacatacatgtacacacacacacacacatacacacacacacacacggcaaaaaccaagcaaacaaaaatcatgagtgacatttattggcaactaaagttatcattgatttttgctgctattagtggagtgtttgcattgccctaacactggccaatggagaaacaaatgtggatgagccagctgtccctatgatacttaacatcatcaattttgtgtttaacatttgaccatatgaggtatttcacttaaaagtaccttaaggatgaggttctagcattgtgtgataaagtacagctcatgaaatccacataattttctggttgttcgtaatttccttgttcatagactgatgaatcaaagaaaaggactggtaagaattctcaaccatataaccttggtctgtgttttgctgtggtaatcctattagggtaatcataatttaccacccaggaaaggacacatgatagtggaaggtgttaatattaataattaataccagtacaacaagaatacatttggattcctctaagtaaacagatgcatctggtcctggtcaccctagtcaaaatagacctgtgtgtgtgtgtgtgtgtgtgtgtgtgtgtgtgtgtgtgtgtgtgtgtgtgtgtgtttcacattgttctatccctctggcctaccatattcttattcatatatcttgcaatggacccctgttatttgctaggtgggagaggagacattaataatgcagaaatttttttttccgggtatttttcatgtcaaaggacttttacactaacgttatgatatgctgcatttctacaaagttcaatattgtgcttgttttaagaaaaggaattatttgtggttttccactttgcatgccaaaacagcgattttcaatttcaaaactgttgtatgcatcggtaaggatataatttacatctattctcccttcccccttcactttctaaatggagcgacattaaaatataaattcatgcaatattaggtaagtgggaaagtaaggcctttcttttgactattaagcaaagaatacatcttaggaacaccataaatcatgcttgtcaggatattcaaaagaatcattctgtatagttaccattctattatttagaaagcacagacatgaaacaatataattcagctgggctgcatgtatctgatttgcatatggctgtatctttttaatctgtgttttcacaagatgaatataattagcaagatttaatttatctttaaaaccactgaactatgttgattacctgcaggatgacatcacccatatgcactagtagatttggactcctaaacagagcaattcaatgtattttgtagctaaacaaagtgcatactgcaagttaaaaagtgataaactagtcatccatgcaagatgcataattcatcatgaagagatcagaactgttgttttatcctgttttcctatttttttctcctaaagaaaccacaaatgatttgggatagtcaatttacaagtctgtgaccattgattaaaaaaatattaaataaacccttcagtggaactgcatggatatattctctgtacttctcccatctgagcccttcatccacctttccttcatatacgctttcaggttaagaatttttcacataatgaattatctctgacctaacattctcaaaggagcttatttgtgctaggatgtttgactttaaaggaacgataacaagaaatatcatgttaaacttgtcagctataaaataaaaagtataatttctaatacaatgcattatttagtcatatccaactttttaaaaaattgtacaaattcaaatctgtggttctgggatgttagaggctctaattgcacacaatgtaacatgataatcaacataatttcctctaaaacaccagtttgtgtccccatgaattctaactatagcctagagtaaaaacaaagaaaaacattttaataaggacaatgtattaccactgggctgattattttcccagagaaagacaaccatgaaaataaataaaaataaaattgtttgcattagaactggcattattagatatattttactcattatggaaagaaatatctggacatcgaagaggaaaactcaaaccacaaacctcataatgaactgcttctcaactgaagttgccatttagtctgactgacagtattttatttctagggttggctttatgttggtctaatctagattttgtattgaatacacacagacatagcagaatatttcacaactcctcatcaatctagatcaattacttatctaagtgcagatgaagatttgattcgtgatgtgctatttctcagagaattgtctgcttaaccgtagcaaccagaaccacaaatataactggtaacacaacaaaaattgagagttaggtcagctcatagaagaaatatacaaggcagttacgtggataaatctttagacatcaaacacatgcaaaattttcccaggcttcctgaccactctcagttttatatgaaagtgcactttaacttgttgactgatgtcatactgattttcctcaaatatcacttttaacccaccacattccatggaaaacgttttgctggccaaataaaacccaaagccttgaattcaaatctcatcacagtctggcataaactaacattttcagtctactagctcacaattttccacattgaatccttgacaagtgagaattatttcctcattccctggtgaaacatattcctttcctgtctatctttacttaagccttctctcacctggaattttgtcttcccttctatcatcaaacctgtggttctttcatctgatttatctaactctcatagctagaagtaagcccttaaaaacagggatatatctgtatgccccagcatgaaaaacctatttgtgattgattgattggatcccctcctatccaaactcatttttaggttttattgtacacaccctaccttgcctgacttttcccagcaataagtgctggtttgatctgccaggttacccttcaatgctgtttggctttgtgtcctcaatgggccatcttattctatctttagcaaacacaaagaagtcaccttaagaagaaaaacgactagaaaagaaaaacgagagagcatcataccagttccattgccctagaaaagagataaggaagcgagatattaatttttttcataattaattaataaaaatctttattgatcccctacatatctactaggagctgaagatacagcagtgaataaggcagataacccacccaccaagagcttccattcctgtgttggaggttataatggtgatggagagacacatgataaagcatcagatagtatcattattcactgttattcaggaaaagaaagaaagaaatttgaaaggattgccagatgtcaggaaagtgcttactatagagatgatgtttaagcaaagatctaaatatgagagggagccagccagaccagcagctgggtaatcgctggtatctgccataggcaacagcaggtccaacagccatgaggtgagatctcctttgcccacttccagaactgaaaatttacagtggagaaagaacagcatacagataggctggagccagatcctgtgaggctgtgggccacaataagaagttcattgaaatgggccacagtgggaggttctgagcaagagagcaccatgattctttaccttacatgagaaagaagaagaaggaggcggaggaggaggaggagggggggaggaggaaggggaggaggaggagggggaggaggaagagggggaggaggaggagggaagaggaggagaaggagaagaagaagaagaagaggaggaggaagaaagtgaggaagaggaggacaggggaaggggagggggaggaagaagaaggaggaggaggagggggaggaggaggaggaggagggggaggaggaggaggaaataaattttgggagagaaacaagatagggatttaagaggagaaatgtttgcaaatcagagagacggtacctggacctagaacctctgacatttatgaggactgggagacactctgcttgtctcttggtaggctggttgagtgcaccggcttagagagagtgtaaatgacagggagaatatgggtctacctaacactggctctctaacaataaatgacaaagacctaggtaagccagctctgaaaatctgtgatactaaaaatgttttcttcatatgtaacagtatcaagcacaacttaatttaattaattatatgacttctattagcactttataaataccctgttctaggctaagctttgtaaagaattcaggaattcagcacccatatctaatgagtatcagtcctggatacctatttgtactaaaaaccaaaggcttctccttctttgctctgattctaattttctgaccttgtatacactggttacttacagattaataccagtaatatcagttatttcgtattgcataatatttttctgttaaaaaataagaagcatccctttctaccaattcactgtagttcttcattctacatttagtaacaatgagaaactgctcattgaagtaaagcttctcaactatttaaaaacaagagactggacctcagaataagaaaaattgtgtgcagtgaaacaggttgtaatttataccaccacttcaggccatattgtgcattttgccagaaaaataaaaaataccaaacttgatggtgagcatgcaactgactcctgaactcttttgtgataaagtattctttcaagatcctaagatgcaacactaaaacataattgcttgtattaattgtcaatagtagctcataacaactaggaaactaagactttatactggaacaagctctgttttgttgcctttcaatcaatgtcttccctggaagtacaagcctttatttaacctacacgtctggatatctgagaagtttcaccttatgacttgtttcaattataaacatccattacaaccagcaagcttcctgtcttacaactactctccagctgctagatttgtaacctgcaagttattgtttgtgttaatggcatcctagtttttatttttatttctgaaaagctatggaggcaggtagaggcagagatggaagaggtggaacagcatttggtattaaaggccaacatgagcccataattatgtacatcttgatctttgtaaattaagatcaagtatataatgttgaaccctaaatgctttctattctaggatttgttcaggttcattttcctttgttaaatgctctggttggctccatgttatatatttaacacctctttcttcttgtgagtttgatctaagggtttccaaagaagcatgatgcctttgagatgaagaggcatgtcgtcataggttacccccgacagggcccctgttgctgcctgccacaccttctcaccttttcaagaagcttcattctttcctacgggaccttgaacgtcacttcaccggtattcttcaaaaacagaaaatacaggctactaaagaggaggcacactgggcatgccaaattgtggacatccttatcatatcccaacctctgtgtgcatctatcagtgatacttgttacagagacattttaacatcctttcaaaaggtaactacttgtacctacagcttttgtgatacctgaaatcaaatgatattatttgaaagatatgagtcatgtgcttcaaggtaaactgaccttgcctttttgatcttctaaactatcatgtggaaacttgaaatttcacttttcttagtagagaagcttaaaagaccaactctaggataaagctgcaagcgttaaagcttaaagaaccgtgaatgccaccaattgtgtttcttagttgctgtaactgtaagagattgtataggtgaatgatctaattctcccaacaaaatcagtctagatgacttttattaattaaaacaattcttatcctagtatacctcctcagaggaggacaatctttttaagcttcatttagttgagaaacattctcctaaatttgatgtattttataaatgaattttttaatagcatgcgtactgcacaaattctacagcaacacagtgtattgtattttgttttctacattcacacctcccagtacatggtgacatgtatttgagagtggagagaaacttcagaagcatatctgagttcttccaggacaatttccacatctaatgtaccaattctttagaggtcagtcttgtaaaatcatctatttcattttccctgagggatgcagttatttttgttgcattcggcccggaaaaatttcactgcaaattcagtccctgacccatgccaaagaacagaatatagctacccaaaccttaagatgtttctatggtataatacatttcaaatgaggtccctttgtcatgccaccatcataattgacaaaatatacattctctctgctccacacagtatttctttaaattcacagcctttctttcaatatttgaacatttagaattgtgttgtacactgacagcacttaatgtacctgtaaggggaatgaaagagatatttggatgtattttcaaaatttgaagacaatatatttactgccaaatttgctatgtcttagtgctgccactctttactgtcagaggaatattgacattccagtgatgtctcacaaactaaaagggtggattccaaattacaagctatcttgtttaagatactaaatcactgacatcatctaaatctatttttgtgacgataaaaatactttaattataatccattgctctcagaaagttataggacgatatccaaatgagaagccatcagcttgtaaatacataaagttgtgcaagaataagttaaattactggctatctctttaggacaaattgtcaacatgtataattatacagtagtttaactggtgaggggaaggtatgcaacatatattctgccaaaaaaaaaaaaaaagcccataacattctgacaactcatccatatctctcgcctttgctgccatatctggaaatggcagaaatgcttacatttttggttctgctcatatatcagagtatgtgtgacccattaggttggtttctctagcagatttccctaactggaagtgtcatgtaaggagacatccacaaagtgtgtggtattggtgatgtgactgctatcttcctctttctctaacaagttgtattaatgcagcaaaaatcaactggaagggcatactcttgtccagaaaatttagaatgataaaaatatctaacctaaatcaatttggcaaagttgaggtgctacctgcccttgcttcagtcagtaattgaactttcctttggttctgttgacacaataacaagacctaaaagtaacttcttcgaatacatttttaaaaatttcatgtcttatccattcccattttctttatattttgtcttctgccatgtcctgagaaaaatgcctgactttagagagaatccttagatttaccacttgaaacttaaaagatcaagtctgaaaaatggatacaaagacaagtagcctttttgttggcgaacagaagaattagaaataggtagtctaaggtcagactcactttcattttcctcttctttataggcaatcttctgatgcttgcttttcctgaaagaactcaggcccaaattctttagggggattgtcaatcaagagaagcgaggataagatgaaaaataaaggcaaggcgaggctctgtggctcacatctgtaatcccagcactttgggaggctgaggagagagaatcacttgagtccaggagttcaagaccacctgggcaacacagcaagacccccgtctctacgaaaaaataaaacatttagctgggcatagtggcacacacctgtggtctcagctactctggaggctgaggtgggaagatcacctaagcccagaaggtcgaaacagctgtgagccatgattgtaccactgcactccagcctgggcgacagagcgaaaccctgtctcacacacaaaaaaggtaaattgtaagaacaaaatatggtacacattttcattgagagacacatttagaacttggtttttaatttaagaacttttgtaaatacatttaaattgttctattctgtaaactgtcttcagtcataaggtagttagatattcgtttcattgtatctttccaagaagacataccttatgattagaggcgggacggggaagtgggagagcaaggaaagagattagctttgctaactgtctaatctggatttgtgtctctgaataacatttattagctctgggcctttagaaaaacaacagataacgatagaccttgctttagcacatatatccctatgctaagaggtttacattaattttctcatttaatgtgcacaaaaatccaatgagaaaggtactctcatgattaaatccatttgaatagaagaggaaaaataactttgccaatgtcacacagcttctaagtaccatatttatatatttaggtctgtgaacacagtatattgcttgtctgaacaatatgaaactatgtataagtaaaaaaagcatgcgggtattaaataaaacctaggtctacattctttgaccattgtttttactcatgtattttcccatgaaagaacaacatttttgccatacacattttttggaaataattttaaaattccttattttatattacatttagaattaaaagtagtcataataatgggaataataatgagagcatttcacagctctcatcgactcctaacctgagaggttgttaaaagtatatagagtgtctctaaaatatggaaatcatctctttttttaggaaaaaaaaatacttttttttcttttcttttgagacggagtcctactctgtcaccaaggctggagtgcagtggtgcgatcttggctcactacaacctccacctcccaggttcaagcaattcttgtgcctcagcctcccgagtagctgaaattacaggcacatgccatcacgcctggctaattttggtatttttagtagggagggggtttcattatgttggccaggctggtcttgcactcctgacctcaagtgatccacccacctttgcctcccaaagtggtgggattacaggcataagccagtgcgccagccaataatattctcaaaattttaattttgaagaaaataaaaatagatccaagagaaatagatcaagagtaactcacacaaaatctttctaggaaaaataatatctttttttacaaaaaaatcctactgaagaacaaattatccataattttgtatgtattacctaatatttgaggcaattgagcatcagccttcaaaaaggaaccaccccagtttctgagatcatgagttgtgccccatcaatagaacttctattgtgggcataatggaataagacgagagaagcacggtgatcagatgaagggctatagaactaaaaagtgatcaaaatacctgctgcatttgctatcacttaagcactttaattatatatctattatgaaaaattgcattgatttacatattaatattctacatttcagcatgtgccctttatattcacataaaacagaatacactctgtcacacacatttaacctacctgactcagccattaaactaaaatttgagagtgggagaaaaaagaaacagaatgaatacagtactcccattgttctattcaatgccttggattttaaatccttaactgtcactcaattgaactctatttttgtcattttgcctatcagtcatgacggggagtttaacctagggtgagccatcagtttgtctccaaaccattttttaaaatggtcttatgttcctggggtagggacctatgtgcaaattttttatatcagtctgtaatttcactttaatctcaatgactcctgggcaggtagaaaaaaacagcaagccaatttgtgcagtataccaacactatccaatagaactttctgtgatgatggaaatgcttcttgtctgaccagtcccacacaatagtcattcgccacatgtgactagtgagcacttaaaatgtggcaggtgcaactatctggtttttaattttaattaatttaaatttaaatagtcacatgaagccacagtgatgtcttggtatagtttatgtacttgcagctacattatttaataacaagcacagccctgtaccaggccccaaatttctaggtgactgtgaaagacaaaatgctggaatagtaactgtctttctctataggcttgtgtgtgaattaccagtcttagttaatgtgtttctgggtttgtttcaggaatactgctgagaacatttcaacatctgttaaattacaccaatgactacaagtcagggtatctaattcctaataggaatccttactaccatttggacaccttttgattcttctcatttgaaactcttgcattggccacagctgctgttctaaattgcctccacattcaacatttttgtcctactcttcaccttcaagctcagaaaatacactaatgcctcatccacaaaggagcccaagttcatatgatactagttctgtgaatgcatacatcactgccaccatgcctcaacctctctctactcttccatattatactcttcttgtcaacaaagatgcccatgctttttaaaatctcatcctcatacccgtgacatcttattaacccctttctacctgatctgatctcttcttcaaacattatctctgtcttctttttgtatgtccaatctttgtctacccactggcttctccacttaacataagccagcaatttttcccagttccctccactaatcacacttaacactatcataattaccatggcttacctattcgtttcccttgacatcctaggtttttcctaaatgacttctttgaccagtgacctgacaatcacctaatccaagatactttaaaaactcccttggttctttctgtagctctttaattgctcattcttatttggtatgctccatcattccattgcctgagattgggcatttttcaagataagagaaaatcaattttcagcctacaggttaagcctgctgaatttttgtatggcacaaaggctaagaacagatttgtttttgtttatttttatttttatttttttaaatttaaaagtatttcacattaaaaaaccaaaagaatattaacatttgacatcatgtaaaagtattataaaatgaaaacataattgtccaggaagtgttattataacacagccatagtactcttttacctattgtccacggctgctttcacactacaatcacagagttgaatagctgcaacagaggctgtatgatctgcaaagcttaaaatatgtattatccagtcctttacacaaaaagtttgttgacttttgcacaagatggttctcaacttttttttttctttttaaaccttctccctcacttatcattgctgttcccagcactttcatatagtaaggcaagaactaacaattgttgaatcctataagaagtcaggcactatgccaggtgcttcacaagcatcactgtatgtaatcctcaccactaaataaggcaggcaatgctactgtacagatataaaatcaggttaaataacttaaataacttgccaaaagtattgctcgatgttagctagcaatttgcggagaagacttcctagttcatttcagggagtgaatacctatgctccacacccaggctcattttctaatccctggagctccacatcattcactgcattccaacccggtcacttcctcccctagaagggcttcttttcctttgaatttccctcgccattagtttaggtcagaaaataactacctcttacctggattaggacctgttattctttaatgcctttattctcttctgccttccatttaccctgcattttcttatcaactaatccctccaaagaaatactgtctaacccatctcacgcacgtatttacatctctgcaaggatcttgtaaaatgcttctcaatttgtgatcttgccactcctctagttaaaagccctccacagatgctagttgcctaaagaataacttctatacttctttcctgttacttaagtatatttataatctggtacaccctacaacaaataaagccagtctggattgctcattgttcctcttctttctgccacttggaattcctgtcccttcatttacatctgattacttgagacaggagagtttttatccttctctccctgaaccactttcctttcatgtcatttttttctaactgcctggcaggagaattttcagtatgcatatctaatctccataactctactgtaatctcctcaaaggcatgtactcatcttattctctttgtacaaaattcctgatagcatccaatacaattcaaggtagatttttttagttgttaaccaacagctatactctcattttcctttttgccagcagaggctccatttttgtttatacagtgaaggcttcccatccccgatttccgattccccatctccagtggcttggtcataatggacctaaaccagttaaggcaaataaatggctcattgacatggaaatgagtccctcagagaaagaatttcctccttaataaaaaatgatacatagaaggaaacacccttcattgccagaaacaagcttcaactatcttaaaacagtgaggaaaagcatagttatcacactcaagctattctatggaaagatgtaaagctccttggtatttgatgacttgttttagccactgagttagtcaatcccactgcagtcttatttctagacttctcattaagaagtaatagaaattcattactgttgaagctacatttaattgtgtccattattatttgcagagtcttctgattcacatgtcaataaacatttcttgaaatttaaatatatgagtgcatgtttaaaaatacacaaacttatattgcatgtatgttctgtactcagctatgccatgtgttattattatttttcattattacataaaatactatttggtactgtttttggaagatcttcagtggaagaaacgtttcttctatatattttctcagtataaaacacattacagttgtctaacattgataggtagctagcaggaggtaataatttttttttttttttctgatttcttcccagggagttatgggcagcgaaaacgtagtagaagtatgtatcactcagattattcaaaaatgaaagagaaacataaaagagagaaaggaaagaagaagggagtgagaaagggaaggatggaaggagttggggagggagggaaggtggaagggagggaaggaggggaggagaaagggagaggggaaaggaaagaaaggaatattttgtatgcaaatgataaataggttgcagaggtcagtagcctgatactgagacaacttcagaaataaaagcagatggtagagcttttgctttttttctctcttggccacaaaactcctgctaattgaagtagcaactgaacaagctgctctttcactcccctgacaatatttatgtttcacttaggttctgactttcacattaaacactgccacacctcctgcttactccttgcttccggtatctaagccatttttttttttttttttttttttttttttttgagacggagtcttgctctgttgcccaggctggagtgcaatggctggcgcatctccgctcactgcaagctccgcctcccgggttcgcgccactctccttcctcagcctcccaagtagctgggactagaggcgcccgccaccatgcccggctaattttttgtattttttgttgttgttgttgcttttttttggtagagacagggtttcaccgtgttggccaggatggtctcgatctcctgacctcgtgatccgcctacctcggcctcccacagtgctgggattacaggcgtgagccacctcgcccggccatcttttgctttttctatgggtggattcctctcttcacatgacttcatcttgaagagaaacaaatgaataaactaccactacctctcaaagtatctcccaagactgaataaggtttcctgaaagaaggacaatgagctactgtgagtaagtgacatatcctgaatgagaaatggcagtttcctacaagctggacgccagacttgaaagaaacagcacgaaatgggaaggtcatctttaagagtctattcttatctgtgaaatatatttacagccaataaaaacaattttttaaaaaaaatttctttgttcactttttgaatcttgaaaccatggaatggaattaatgttaccagcagtaattttattgtctatcttggactgcactcttcagaactttctcactgctgctctcataagactattttttttttccctcctgcagatcagactttatttccagaaatggaaacaacatgaaaactgctgagaaatttgccaacccagcttgcccacatatttatatctgtgtcaggatacagtattgtatttaccaagattaaattatctgctgtcaaaactcaatgaaaatcatggtatacaccaaattgcactttagaaatataagcacctattttttttcaaaatgcaaataacatattgaactatgtatatttacggggttatactgtacaaaatagaaacaatataaaatacaatatataaaagcattttagagacagaaaaaagtacacggttgctaagtttagcagagagagttggatgctgaataactaagaagattctgcagaaatgggttcaagttccacatctgccactcaccatctgtgttcttatacaatcatttaagtagtcacctgcaaatcggggataattcctgccctccctgcttcatttataatgaataaatgtaaacatgtatgtgaatacattatgcaaactataaaatatatataattaaatgcaagaaactttgaaagatgacatatttgaattcccgaagtacttcaatttctgctccaaaactcaattcttctttctagaatcataagattttaaaaatgtaaagaaacttaaacattatgtagtctgcatagtattccatggtatatatgtaccacattttctttatctagtctacccttgatgggcatttaggtttattccacatctttgctattgtgaatagtgctgtgatgaatatacacaggcatgcgtctttatggtagaacaatttagattcccttgagtatatacccaataatgggattgctgggttgaatgataattctgctttgagttatttgaaaaatcaccagactgttctcactatcaagtgggagctaaacattgagaacacatggacacaaagaagggaacgacagacactggggccttcttgagggtggagggaaggaggagggtgagaattgaaaaactacctgttggttactatgcttattacctaggtggtaaaataatctgtacaccaaaaccccgtgacacacaatttacctatataggtaacctccacatgtacccctaaactaaaataaaagttataaaaatagaaaatatcatgtagtcaaactcctttattttacatataactaacataagcccagaaatttttaatcacttatccaagtttaaaaaagaaaaatctaaagaaaaagaaaattttgaaaaagaagtctagattacaatttaatctattgttcttcctggtaaccagctcccctactatttaatatagaagtgtttaacacaaggctgggcatggtagctcacgcctgtaatcccagcactttgagaggccgaggcaggcagatcaccagaggtcgggagttcgacaccagcctgaccaacatggaaaaaccgcgtctctactaaaaatacaaaattagccaggcgtggtggcacatgcctgtaatcccagctacttgggaagctgaggcagaagaatccctttgaacccatgggcagaggctgtggtgggccgagatagtgctattgcactccagcctgggcaacaagagtgaaactccgtctcaaggaaaaaaaaaaaaaatacaaagaagtgtttaacacaatttactgctttaaaaatgattttacattgatatgaaatgttttagttgtaagacatattttctaactaaaatcccattttatttttactaatcccagataggtttcagggcagatattactttcttttgaaagtgtgacttttcagaacaaggagatgagtagcagaaccagtcatggaatcaacattttgtacttcacctggtatattcttccatctttcagcaatgctcatcatattttggctagaagggattctgtttcttttaatagtgctgaatagcatatatttcaaaatgtaggacaaagtaaaattaattttgctgagggagtcttgcaataccctttgtgatgtctggagatactcaatggtatctcaaaactaggataaagaatgcttatactagattattccatctcccaaagtaatttgtctcctaataataatcataattaccttctacagtatccaaactgtagcctctttactaggcaaattatttactgcaggtaggaaacctctggtaaaaactgcttgacaatatgctgctagaaacagtctttcattttccaaatccattctgggaaaccacacaagcacacctactttcaagctcatacgtgaatataaaaggctattttatttttacaaaatgacttattacaggaaaacctagttaagtgaagtattccttgctaaagacataagtaagcagtataaatacacactagacctgctcaaatcaatatttaagcattcaacatatccacaaaatcccaagtaaaacttttgtgcccatttgtcctcttggcaccaagatttttctactctctacctacctctactgccaataaccttataggagcctttcccccatgttctcaatcagggaaggatctcgtgtcatttatatcttccaaataaatgttctaacgcaagtcccagtgttattttcacctaaagccgtatctgtttttgttagtcaagaaaagattttgctttctgtgaaaataatttcagtgtcagtgaataaattgtagcagtattacatgcttctgtgttcagtgtgtttgttgatatcatgtgttgagggggtgaggctgtggggagaagagaaggaaggaaaaggtggaggcaaactcttgtctctgatcttgaaattatgctagtcagttcctactaactacttcatgatacagggagttctggatgcatttgtgtgtgtgtgtgtgtgtgtgaaaagacaaaaagggaagattttctaaattactgacattttggttactaatacaacgctggtcaccaagaatccatggataatgtctgggtgaaatgctttgcatcctctgagccagaaactgctcaaacctattaaaattcatttgtgaatgtccattctataacaatcatcaaaacacaatttcttccaattaaacagcagaaaaatcttcctggggactgatagtgcaacaaggaaagaggatcctacaacctcagttatcacttcacagcagactcactgtggcatgttctaagttctacagccagaaacaccaaaaataaatttcctgttcttccacctggggctctattttcctactgccccaaaacctgacttctagtagaatcaaaaaaattttcccaggtcatggccaggagttaactgagtatagcacagccttctcctttctgacttccagtaggatcaaaaactcttctccaggcatggttagaagttaactgagtgtacaagaaccctgagtttttgtgtttcaatttgcctgatttgcatgtggatatacagccccagatggagaaaactaggagtgggatttatcttacatgattcactgtagacagccaaagcaaaatgtcaaccagtgaatctttgcttctagcctgtccaggaataggccctgggaaaaccttctgactgcactggaactggggggagtggacttgttctgagctgactcaaaaatgctaacagaaaatggcaggctactgcttaagcacagatgtcactttattgtgtcaacttggaaatgatcagtacaatctggcaagtgcaatttttctcacattatgagtgtgtttgagcaggtgctatgcttcactgaggtcatatattgtttccatgttttttaatttttgattcaaattataggatgaaaaagattctcaaatatagacctgtcctaagttttactggagaataaaaacgactaataaatgttttattaataatcagaaaagggtctaatgcttctccccaggggcatatttggtatatatgctttaaacttctactaaatgttgaagaaggaaaaataacagtaaggaaaaatatagaaaatattctccaaaatagatcttctggtggcttctcctatgaccacgatgcattctgttgtcattcacatattgtcttgtttggcaaaagacttgctatttctatagtcactatggaaagttgccacagctactcaaagtaagctgtcattggagggatatgcctttacataaaatagtacctcacagtcggcaggggccactgtgggttctaatggctagctttaaaaagccaaaattgtgtctgtaggatcggtggctctcttgtcctgccaaaagattgagatcagacatggtgactacaatacctccagcactaagagttgcagcttggaaacaagcaatgcaatgcagttgtagctaggttgctgggtagtatgtttagtagatgttttgtctttgaatctttctggttgcccctgaaaagttgtcacatacagtaagcataaggtagacaacagtgcactaagttttagaacatagagaaacataataaatagtcattgctttaagaaaacccttaaggaaaactacagtcaacaaaactgaatatacaaatatctgaacacaaaagtgaacattaaagacagtgttatacatgcagtagcagttctgacagacgcagagagcctgatatacaaagcaattggaaaaacagattcctagaaagttctaaaaaaggccgggcgcggtggctcacgcctgtaatcccagcaccctgggaggccgaggcgggtggatcacgaggtcaggagattgagaccatcctggctaacacggtgaaaacccatctctactaaaaaaaaaataaaaatacaaaaaattagtcgggcgtggtggcgggtacctgtagtcccagctactcgggaggctgaggcaggagaatggcgtgaacctgggaggcagagcttgcagtgaaccgaaattgtgccactgcactccagcctgggcaacagagtgagactctgtctcaaaaaaaaaaaaaagaaaagaaagattactgaaaggtcattatgtgctaggccttttccataatagatttatcttcatgttacagattaaaagaattactcaaaatatgcagactaaaaatctacattaggcactttataaaaggtatcagagctagtaaattagcagagcatggatttcaatctccacccaaagagtccaaagcccacactggatcatttatgactagaggaaaaagggaaagatttacggacacttcaactcatcctcaagagttgtcaggatttgttccgttggaagcaaggatagcaggatattccagtgaggatttcaatatgagcaatgacagcaaggcagggactagtatggcatacactgggcatgaggagataggctgattagaaagggggaaggaaaaaggagtaaagagagagtctggttccagatgacatagggtccagaatctccaaagagattcttagagctggacttaagtttggagatgggatgccgagagtatgtacaaccacttaatgtttcaaacctgacggatctagtttctgaaaccaaatctgactatagtctttattattattattattattatttagaagataaaatactataccaaactgattgtatctctgcccttatgaagtcaagatgaataataaataaatactaaaatagatggtttgatagatgtcaagtttaaatgagaaaataaggcaggaaaggaggacaaggaggataagataggaggtgtataattttatataaggtggcaagaaaaggtctcattgaagtagtaatgtttgaacaaagaactcctccttcctcagtttttttgttgcattgctgcctctctttcccccagtgtggtttaggattatcacaaacaataatcttatatttcctctaagagttattttttcctttgtgctcatatttttgatttatgaaaaggtgcacataactttcaagctatcatgatctttatgtttaagttcataccctgattttctatctgatcaaatgaaaattttcatttgtttttgatataagaagtttaaagtccatccattgtgacacaggtgaaatatgaatctttaatagatttatgtgattccacttcactctgagtcttcatcatagatactctctgtagctttttcgattaaagaaaagccagacacattaacacagattttaagcaattgaaatacagagaagattatcaaatttctagaacttctgattgttctgtatttgatgccttttcttctacagaatttttgaatttggtttttcatcagaacaccattgaagatatcacttaaggaatctagggaatttaagaaatgttaatccccgtgattcaaagtagatattttatcttaaatgtagccacttgtcttaggggtccccaaattataaattggctatataattacctatttcatggtaaatggattattagttcttttttacttctctgatttcacttcttcttcctctttttaaaattaatttatttaaaaagaaggatctgggtgtgaataagtagagatatatttcttgtatgtcttaaaatttaaaaaaattatacaactttccattgacacggaacatttaacaaggtttactttagtatgatattaaaattcaccctataattttaattgggataaatggcatttgttctttccagcagtaggtgggaaagttagaaaacagtatgtgtttcccaagagtctaataggaaaagaatggggttgtgcattttgtccaagactcctactccatagaaacaacaaatcgtctgtataacttgttctgggctttttattttgaaaatcaattattttaagtgtagtcataaatggaaggaacagggaagatgctgccatatagacataaaacagcttgatattattttggtcttaaaaatatcgaaaaaataaaaattttattgaaaatttctgaaaacttatgtaaaaaatggtcatccatcagcatctgatttggtggtttcctgcccataaggcagatacacctactattcaattctgtattgtcaaaaatcttggaaagaatcatgggatgatatgataaaccatcagctctttccaagcactgttatatgtttacagagttggatcagcatccactggtagttccttccagtgaagtctctctagtcagccttcagtacactgtcttaacatatgtccatcactgtggctatactgcatactttctatagtgaacataattgttatgaacaagtacccaagaatgagacttcatgggctcaaatctcagctctgctacttaatagctctatgatcctgggcaagtttcttgacctttgtgtgccttggatttatcatctgttaggataatactagtgcctgtaaaatattagcaccatgcctagcacatagtggtcctacatgttgcctatcattattatttctaaggtctatatatatgaaatattacaaaatccatactttaaacacttgaaataaaagaagaattagatgccacacatatccttaaatttcctttgttgtaactttttaattaagtgcacacctatacacctattgctgaagtttcaagttattcagattatccaaccagataaactgaggcaccattttctaaaaagggagaagatgaaggagggagaaatgtggagagtgaggagggaagtaccaggacttcaatttagaacacataaaggttgagatacctgtgagatatacaactgaaaatgttaagtacaattttgcatgcaaaaatctgaatatgacatgtctgggctaatgacagaaatatcagagttactggcataatgatagtatttaagggcatgagaatggatgagattagttggacgagggatattaagtgaggagacttctggaatcatgtcctgtgaaacatcaacatttaggagacaggtagagcagcagagttggtggacaccttggaagaagtcacagaggaaggaggacaaccatgtgtgtttagtgccttgttttgaaattgattaagtattgagtaggatgattagataatgagtaggatgatatctgaaaaatatttaatgaatttgacaatgtgaagatgattggtgttctttgcaataggagttttggctacatgctttcacgggagccagattggagtgggttgaatagtgaacgtgggtgactaattgacattaggttttattcataattgaaaactttcacagagcttggctgtgaaggaaaaccaagaaaaagcgcatgaggtagatgtttaaggttaggtcaagagaagcaatgtttggtttatttgtttgtaagattagtacaatccattaaataatattgacaattcaagggggggagagaaataacagaaagactaagtacttgaatagataagcaggataagacagtaagcacagttccaaaatacagtatatgaagaagaaagtggagatggtgtgaatataggagaattttcttcttattgcttttagctttgtcttcaagtacggccttggccttcagtcgtatagaaagtgtgaggccagaaatgggtcatttgtgagtttgtatgaggacagctagcagctcatgttcttattatctgtttgttagtctgaggggtggagcactggtaactaagtgatgtcatgttaccgagtagaaagggaacttcactgagaattagaattccagggtcctagtttgcaatgtgcctctaaatcagtatgtgatctgggcctaagcatttgaaaatctctgaacctcagcttttattttatagaaggagaggcttggggatcctttagaatgaccagtgaatgatccatgccactgtttggttcattacagaacttaaagaaggtcttcaaactgcagctattcacagtcaaaatagttccatatatacaatacttatttgtgttcatggactaaacatgtaaaaccttccagactttcaatatacactttataaaatctgtcctctgttgtctgtggggatttttttctgtcttatagattgccatttggaaatttaaaaataacttaaatatttgactgtttaattacaaaaatgtacctggggcataaaaggaagaattaaacataaaatttgatttgaattcttggtattatagatggactgcttttgaggagaaaactactgctaaccacaacctgttcatcaaggatttttcacttcctccttcactgcttttgtgactttaagtgtgctttataaatttccgtccaatgacagcacaatcaaggcatgcaatgattctttcattcttctctgataaaaatctttagtcttagatagctaaaagtgtagtcaaagacatttaattttagccttggggtatccattctctgtcacaggaaaaaataaatatacataaaagtaataagatttcatagaaaacagtgtgggacagagctgcctgactttaattttctgaaatgcaaggggatgcaattaactccctggttgtgattagcctcttggaagctgaataacctcagtaaattacagcacccacagaacccataatggcgtcatatactcaatattgtttacttgtctttggatttacagtcctgcagatgagtcataggatttatgcattaataatgaatcaagccaacttcaagaagcagcgctgcctctactcgaattacgtgtctgcctatcggacctttttaaagtaggtattggccaggactagtttgaggcactggctcaggggcaatatttaagaggacaccaaaaagtcagtgagtaagataaataacattttaaatcaataccttaaaaatcaaaattaatattttaaaaataaaaagttgttcatgatgaataacatatcaaaattttaaataaagacaagatcaataacagtggtatcctgagctgtactggagcctgaggcaaaagggaaattcaataatattgatgctgtctttatttaaatttttcacattttgttcatcatatatttttgcattattcagattgtttttttcaaatattgcagtaaaatataatttatcttgattactgagctttttggttcccccttaaatttaacactcaggcaagtgcctgaccctcatctcagcatttataatttaacaccaaaataactggcatgcaggaagcactgtgcccgtaacttgttcctgctgccataataaaagcagactttgcctctggaagcattccacattttaccccactaagttcttttccttttagtttccataaaagggtttattcatgtgctgtcctaaaagagtcctgctggatggcccgcaataccccacataaccaaaacaaccactgcatcaggagagataaagagtatcaggaaggaaaataaattccatatattttgctcaaaatcctggaacagttgtaaggaaggcagtcgcaaagaagtaaagtttttcaactagaggaagtacgtgaatctctcagtgcatatacctaacaaatgtagatagtcaatagcttttatccacataactcttggatcacaaagggaatgaatcattgcagtcaaagaaaaacaatttacaaggaggctgtgtccaatctcaaaaggcaactaaatgaaattctgagctctgaaaaatctgagatccgcctttattatcctcccaatttgtgaaccactcacctcagcaagactacaaactccatgaggggaagaacaaggacttcttgtttgcttatctttgtatccttagtgtattaggatacatgggaatttcacttatccctatactctgcacgaggaaataattgccacaatgtaggtggatgggtataattgtcaaccttaagcaatgacatatgaaaggactttcacagcaaatgagcaaacggtatgacagaaaaatagggtatgttagggcaaggacacctgtggcaatatttctacctagggattggaaagaggagattttctcaggagaaggcccctcaggactagggacatcccctactctttgtccattcctcctctccattgcttttctaaaagataggtcctgaaacatggtattgacattctcaatttctttatctttttaaatagacattaaaaaattcataaactgcaaggcctggtttaagttatccctcactcataaagcctaagatatttatactgtattgtatcatattattcttgattatacaccaactcatattgctcactaaagcacataaggtaactttgtgtgaactggaaaaaaaagaaaaaaaaaagaaaggtgtgccttcatcaagacacatagttgcagaaaaccgtatcaaaataatggtgcaactagttgaggtggatggtgccttttacatttttgtaatatataaattgtacaatcctatgcaatgacccttggtcactatgtctggcttttattttatatctacatagtaaagttaactccttacttccttccctccttcccccagtcccttcctccctccctcttttcactccttccttcctttcctatctccccctgcttgccccttccttccttccctccttcctttcctccttccttccttccatcctttcccctgttcctccctcccttcctgcctcccttccttccctccctccttccccgtcttcctccctccctcccttccttccttccctcccttccttccctccttctttccttccttccttctttcctccttccttccttcctccctccctccctctttttctttgttccttccttcctttactcttctttgttctcaatacttaacataatcctaaacccatagcaaatactgagtaatactttttggctgttgaattgaaatcctcctttaaaaggggagacacctaactgtgaaatcataggtgattttattttgtcttctacttgttctatattttaattgttatacaaatatgcattatttttataattagacaaaaatgatttaaacctgccaacaaatttagatgttaagtacttattcaatggccaagcccaagtaattgtgccttgtctgatttgagggaaagtgccctgcatatttacaaaaatgtattataataccatgcaattcaggtaatgcaatcctttatcttcttgttaaataaaattatctctttaccatattgctacattttagatctctctaataatgactgcaactgtcatgtagtgagtagaatggaaaatccctcaaatatcagattgcattctgatactttgaccccaaactaatcaaactaaatataaattttgacattttttctggcccttccacagatttaaaaagcaatgctgtctgggcatggtggctcatgcctgtaatctcagcactttgggaggccaaggtgggcagatcactggaggtcagaatttcgagatcagcctggccaacatggtgaaaccccatctgtactattaataaaaatacataaattagccaggtgtggtggcacacacctgtaattccagctacttgggaggctgaggcacaagaactgcttgaacctgggaggcagaggttgcagtgagctcagattgtgacactgctctccagcctgggtgacagagtgagactctgtctcaaaaaaaaaaaaaaaaaaaaaaaaaaggaattctgtcccagaaaaggtcgatctgaaatcaaattcatatatatatacatatatatatatttcaaaagatagctctgtttacatccaggattttctttgtttttatttttagaaataatcagaaatctcacttggtttctattaaaaatgcatttagctaatattcacctgtgtgagtgctgggagattcctagatttttaaaaatcacatagtaagcaggggaacgttatatatatatatatatatatatatatatatatatatatatacctaattccctaaatgtactatctatcctgcttatggcttcttcagttgaaataaaaatctcaccacaaatgaaatagagaacttcactaatttccattcaccaatgatggcagaagccccccatgggttattaagtctgagagatgtgtgaacaaacatgataataagcaagtaaagtgtatcgtaaaatatactgtgttcatttattgtgacaactggggtgtaattatactaggaaatgtactgcactttagtcagtgaaagtaataaaatttgaacaccaggagacctttctctactccgtgctattaagctacttttgaggggaaggtgaaaaatctaaaaatatagaatgaatgttcacttttatagattagcaaagcaggggttagtcagattctctggtcgtctaataaataaaaactctgttctttcctcattagctgtggatacaccaccaaagaacattttcctcaatttctgggtaattataatgcctaactttatgtggattgcttatgctattcatctcactttctccctccaattaaagaatagaacggcaaaaccaaacctgactccattgtattgtaactgcttctacaaagctacaagtagaaaagcaggaaaaaaacgtgcaaaaagataaggaaacaaaggggccctcggagatgataatgttgcacaatgaggagtaggtgtaatgattaaagcattagtggtggtcactaggaaacgtgaaaggaacatgtaatttcagattaggaaaccctgagcttcccagagtgaactgctatttgggaaagtgtagttaattgaattttatgacactttttactaaactaaaatgcatatcttttattaccctaatagtttcattgctactgtgatacttatgtgcagtgatacactaaaaagcatatgcaacaattcactaaagagcaccggagtggattattaccgtttccttttgtgctttggcagccgacaatccagatcataattacaggattggagccacctgccgactcactgaacagaagcacgtggctccacataaaatagagcaattctaacactaaaatatacaaaataaaataaaataaataaataaaagaaagaactatgttaaaccaaagagaccttcaggaacagcctatggaaagctggatatttattttttcatgaacgccaaatgactgactctcacattattactggcccagaacgaagcagagtttgccaagatcttcctggttaaactagatcatctaatgaaatatctgcatcccaaattgactggtgaattcagaccttttatggtcaaattcacaataaatctttgattttagagcatattatttctaatgcatagacgcaggaatgcaggaattgtcttcacttgtataaaactgttgccttggcatgcatttagcctgctaaaccagtggagattaccaaaaagtaaaagtaatgtaaaaatggtgaagtcaagaaagtgaatccatacagaatttttctaattggatattctcatttactaaacaagttaatccaaaagacgacattatttctttctgaatttttccaaatatcactttctaagagaagtcttccctcatttccttaagtcgacttagtcactccttcctctgccctttttacatgcttctattagagcagtgcttcttacacttccatgtgcatatgaatcatctgggatcttgttaaaagcatattcagagtcagtaggtgtgtgggggagggaaggtctgtgagtttgcatctttagtaagcttgcaggtgctgctgatgctcctggtcctctgaccacattaaatttcaacttttattttaaatatgggagtgcatgtgcaggtttgttacatgggtatatgtcactacattttgaaaagcaaggtattaaattacttcataaattgtcccataatgatctgtacatgtcaggcatttcctcttgtgtatgagctccttgaaagcaaaggcaaaggcagtatctcaatagctaccaattatataattcctactagttttggggtacagggaggatgttaccatacatcatctttaattctcaaatcaaccctgcaagatctgtaattgtgtttccattttacagatgaagaagctgactctcagatatgttaatcaacttgtctatggccacacagatgccatgtggcagtcagaatgcaattctggatctatttgtctccaaagtctgttttttctactgcacctgaagcctcatctgtttacttctgtaaatatagagtgtagcaaagtacctattgttatagaaggtgctcaagggatgtgtcttgctctgtgatcactttatatataaattcacctttgctcacagtatctcccttgtgtgaaatgctcttcctgcttctgtcttcccaattaaggtccatctcacttccaacgctcatttctacttagccagcacacaattgtgcctttcctctcttctgaatgcacacggcaatggtttgcagcacacaatgagcacttaaattgttagttatcttattaacagtatatttacttcattccataaatatatactgagtatatattaaacaccaggcatggttggaagcacttgtgataggtcatggagcaaaacagaaaaaaaaaaaaaatcccttctatcctgggtcttggaaataatttccccaactaaaatgaagacttctttgaggcagggacccaatcactccactttctgtatttctcattatgttttgcacatagtaactgctcaattaataatagtctcagtaaggtaatttaccatgtagatatgttcctaatatacagagtggaactacacacaaggcctttctcttttctcataagttatccttggaaagtgaaacgatgctttcacgctgtttctcactttcctccaactgcgttttaggccagaagcagaggtattaaagtcacacacagtgcaggtatcagccagagagacagaattcactaaaatttaatcatagcagcttttagcacaaaaaatatcttttcacaagtgtagaaattataggcaggagagataacctcatgaaaagttactttcactagcaaatatcttttttcctttacactccgaaacaattgactagaaacctgctaactaggagaagtcacatgcttaaaatttcacaatattttgttgtcgtttgagtcaaggtctccctctgttgagtgcagtggcatcatcactcactgcaacctccgcctctcggattcaagggatccttctacttcagcctcctaggtagctgggactacaggtgcatgccaccacacccagctaatatttttgcattttttgtagagacagggctttgccatgttgaccaggctggtctggaactcccaggctcaagcgatctgcccagtttggcctcctaaagtgctggtattacaggcgtgagtcaccacgcctggcctacttcacaatattttgttcaacaacattttgaatgtgcactatctgaaataaaaagtataaatgttttcctggttatttgaaatgctccattttctacttcacaaaaccatcatttttaaagtctgctcattcactgaacgaggtatacaaagctattctttttgaaggtatagctcttctaaagcttcattaggttgttagtcacatgtattaacatgtacaggaggcagacctgcagatgagcaatttagaagggaaaatagtactcaccttgctctgcatcggttcttcctcatttttgcaatttcttatgttaaataaatctacatatattaatctaccttgtatacattttaaaacatttgaaagagaagaatgcagataactcttctcaacttagctattttattcaatactgagatatttcataacacgatctgtggatggcagaaaatggaatttgaaatgagttctaattcttattaacatgagaacacaggcatacatcttaagtacagtttttgtaaaattgatgtcacaatttttattatgcaagaatgttatgagaagaaatatatttaacatatcaaatcctagtttattgctgatgtttagttagtagtagtattcctgcctatattaacacttacacatacacaattatattactgttttttaattatgaaaaagcatttatttacataccagtaataattacaccagcatttagctaagcaagtacacaggcatgatctctgcattcgcaaaatatttcaacttaaagttgatgtaagtagatatctgaaagaagttataaataaatagctacataaacatgaaagaaaaagaataggtgaagtctttgccctgtgtctcaggattaattcaaagtttccttgctgaaaagaggaagacatcccattaatcagatttctttttccaagttcttcctttttataggaattggcaggaaaggtctttggctaaaatacagcttaagattcgtgtactgtggctgagctgtaggctgcatcctagaagagccttaaacataagtaaaaataggtctgagggttgaggaaaaagaagagaaagaatatagtgacaatgaatcacggactcttagctctacagaccttaaagacaaggcaaaccaaatccctcattttataatgaggaaactggggcccacacagctgaagtgacttgctcaaggccacatactgggattacagccgaagaatctttgcatgtaaatcctatgtgatttaaaaagaaataaatatgaagatcttactagatatgggctgctaaccagatgggaaactgtgtttggaattgctggtaaactggaatcaatttgtttagcaagtggtaagaatatacaaacatggggaatgttttaggcaacgaaaaagaatgtcatgtgaagaatatgtacctaatataaatggcaattttgacagtggttctgttgattcaagttttttgtgggtttaaatctctttacagacaaggatgaaactttaattctcaatctatataaattatcaggctattatttcaaagaacacaaaagaatagtaatagagaaatgtacacttggatttggtcattctcctcacactggagggaaaattttgccttgaatagcatgaataatgagaacaggaacttttcaaacattttcaatattgccagccaatgggagaggctgataatcaaaatgaaattttgtattcttttcaaatcaccatatattaaatatccaagatagtattaaaaccctctcataaatgttgccatgatgttctatttacaaaatttctttgggaacaactttcattctattaaagtctttcattatctggaaagcaaagaactaaagaaaggactttaaagataatctaatagtctaatagtccttcaatgtaagggtatattagaatcatatggaggctcctaaaacatagatttcagagcactacctcccagagttcccggttcaggaggtctggggtgagatctaagaatatgtatttctgacagattcacaggcaatgttgacaatgctgatccaggtaccaccgtttgggaatgactaatctagtcaaactatctattattagtctaattaccttctttttgattcaggtagacaaattctagtattcttggaacttattatttaaactttttttctcaactcctccaacaaccaatttgttctgtttctgatgttgtcactatactcatcacctattaagctgatttcaggtatattctactaaaatattgaaccaaaacaatcacgcaaactaagtctcttgttcttggtacggttgcatatataaatgctatcttttgcataattaatacggaaagaaaaatcaccaagaacattttcaattccaactataccacatcaaatggacatttgggtctcctgtggcttctgcaaagggaacacatagagaattcttcagggacactggaggactaaagcagagcacagaagtgatatgctactactgtaagagaaatgggattattatctccagagagcttatgttattgctggaaaaatacttcaagagtgtcaaatcttaaagcttacataaaaaagatcaaataagtattgtagcatttcacaatgatctgatgattcccgtagtatcagctaatcagtgggaaaaaagtaaagtgaccaaaaaatagttatcttgaaatgacaaaatatcctagcagttgtcaaaattaatatgataatatacaggccaggtgaggtggctcacgcctgtaatcccagcactttgaggccgaggtgggcagatcacttgaggtcaggagttcaagaccagcctgggcaacatggtgaaaccccatctctcctaaaaatacaaaaagcagtggggcgtagtggcgcatgcctgtaatctcagctccttgggaggctgaggcacgagaatcgcttgaacctgggaggcagaggttgtggtgagccaaaatcatgccactgcactccagcaagggtgacagagtgagaatccatctcgaagtaaataaataaataaataaaaataattaatatgataatatacaaatcagggctgctgcaatggaatgtgaagaaaatagaaaatgtttgctaaatccatcatctcccatgatatgtatacgtgcccatgaacatatacacatacacactcacatacaaacttttcctagatacacacacagaacctttactcaaagcattttgttcctagttacggaataaagatattgaaaaatgcattttcattaatgtgataaagcataataaattactcctgccagatgtgatgtgacatgtacatattttcttaaaagagctgtagaaatgggcaaagatcacacacacacacacacacacacacacacacacacacacagttaattaacggatcctccaagacaccaatcttcaaatattactgagcatttaataagtgttatgagaaataataccaaaaacagaagaatgagataataaactacagatgagaaataaagacttatacacataaaaagacaactctagacagtaaatatttgggttcagaagcagaagaaccatcaagtaatcaaagactgcactactctggatgaacttgatgtgagctggatcatctccacaggctgaattttcttaggcagagcggaaggagggaaggaagaggacagcccaaatgagggcatcatttagcagggatgaaggcataaagaaaaggtattgactacaccagtgtgtctctatacttctctgaatcaaagagttgatgccagagcatgtgaagaacaaagcatgctgtagagttgtcgcataagattgtggaggaacttaaatgtggaaagaataaaagaatgccagaaaaactgcatgttaacaaaacctactgacaacattagaaaaggaaatattgagatagtggagagagaattttcctggagacctcaaaaccataaatgagagataatactgaagacctactccatttggctttacatggccatagctttcagggactcagataccgtaggcactgaatgtcaaaagagaggttgcatttagaactcaggcagcagcctctcatactgcactctatagatcaattttagtttaatgagatttaattttaaaatccttaggttttatctttagcacttcaacacactgaaaatgcttccaggttttgatttacagaattactgtcactgtcaataaaagaaatgtgcctgacacaccaaaatccagtttaattacttctgtaatgtctcctgcagctaagaggaaatggtatttctctgacacttttctgtttttaatttagcaaaatggagcactttcccttaataggacctgggacagcagattcagaattgatgtcatcaaagatggaccccacagtttcagcaacactgtcttactctgactgtgcaatgattgcatgaatctggatccttggtattggattccttgaagctgggcactcatcaaagatttgacacggaatcatggctgggatatttagacattatgtcatcacttggagaagctttgcaagcaaattcaacagcctgcttctacctagaactcttaacaatgtcagcattgccctgaactgctggaatccagatgaggccttgaaagcttccaaatagaactgccaaatatcaaaatatacactgtaccactggagtgaagaaaccaagaaaaaatgtgtactttatatcttctgctacatattccatctgcttctctccctaaagggtcatatgttatatatttataagaagtgttcacacctacgcgaacagtttccactgtctccttcaaatacagcctcctccttgttcaagacccatttttttaaattcttctatggtagctgaaccttttatgaaacttgttccattctgaaatcatttcaagttaagaaatgcccttgtaccttcctatctcaccaaatcctggggagattaagcctcacactctataggcctttttctgagagatgtgaatttagatcattagggtcattaaaatcacacaatctataatactcagagctaacatatcacctttgtgctttatgctgctatagaatgctacaagagagttaaaacacgtatagcatcacagaactgtagagaaggccataattcctccccataaaagaattctatactttttaactggcacagtaaatctcattaaagacacagaatgctttgttcagggaagcaaaagggatccctgggcaaggtgcgtttccttcacagtaatattttttttccttatgacttgaattattccttaatgcaagcacaatgttatttttatcttgaccttttttctggactctacatgtttccccaggctttttttcccttccctacaaaaatgaggggcccttggtcttcactattaatcttgtattaacttttaatacactgggcttcatgcatcctcttgtatttctctgtgtatctaccaaagaccttcataggccacactaataacctccgacttagtctttttttctttctgcctcaacaactgtataaagaataaactcaggtataattaacataataaatcatttggtgcacattcattggtcaacacaattctgaatcttaacagttaatttcccactatacagattgtgaatctgattcacataaaagtactttgggaagtattttgtctgatttcactatcaaatattagattattatttttgagaaactcagaaaggctgtcatggaaaaatcacagaaaattcccatctctctttcataatcagtacctttttaataacagagctggaagttaatgacagtatgcttttgacagctcactctgaaattttaactcatctgtagaagtgccaactgagcagttgaggggaaaagcataaggtttaaatttacatctaagaattaagagtgagaaaagcatggaaaaacattacacagtgttaaagtgcacttattactaatttctctagggaattttgcagctagggaatttcagttgcattattattgaatctatccccctttaacagagactgtgggtacagaaaagaatatggccttgaaggcagacgcattcaagttctgtttgtgccaactactaaccatttcagcccaaagaagttacttaaaatattcatacctcacaatcagcaaagggaagagacaatctaaagaactggagaaaatatttgcagactattaatccaaagaaaaagtaataaccagaatacataaagaactcaaacaattcaatcataaaataattataacaaataattgaatttttaaaatgggcaaaagaagacattcctcaaaagaagacatataaatggtcaacaggaatataaaaaaaatgcttgatatcactaatcatcagagaaatgcaaaaatcacattaagacatcaaaatcaaaatcacaatgagatagcatctcactccagttaatatggctattataaaaaagacataaaataacacatgctggcaaaaatttggaaaaagagaaatgcttgtacactgctggtggaaatgtgaattagtacaaccactatggagaatagcttggtggttcctcaaaaaatcaaacacataactaccgtatgatccagcaatctcactgctgagtatatatccaaaagaaaggaaatcagtatatcgaagagataattgcattcccatgtttactgcagcactattcacaataaccaagataagaaatcaacctaagaatctgtggataaacggataaagaaaaaaatggtatatatattccaatacgagttgaactggaggtcattatgttaagtgaaacaagccaggctcagaaagacaaatatcgcatgttctcactcatatgtgcgagctagtaaaattgacctcttggagacagtgaatagagtagaataggtggtaaccagaggccataaagggtagaaaggtggagaggatgaagaggggttggttgatgtatacaaagataaagataagtagaagaaataagagtagtgtttgataacacaatatggcaaatacagttaacaatattttattgcatatttcaaaatagctagaagagtggaattggaatgttcccaacaaaaataagtgataaatattttaaatgatggatacccaattacccagatttgatcattacacattgtgtgcttatattaaaataccacatgtaccccctaaatatgtacaactatcatgtattcataattttttttttttttgagatggagtttcacttttgttgcccaggctggagtgcaatggcacaatcttggctcactgcaacctcctcctctcgggttcaagtgattctgctacctcagcctcctgagtagctggaattacaggcatgtaccaccaggcccagctaatttttttgtatttttagtagagatggtgtttcaccatattggccaggatggtctcgaactcctaatcttgtgatccatctgcctcagcttcccaaagtgctgggattacaggcatgagtcactgtgcccggcataaaattttaaaaaatctatttatgcttcagtattcttctttttacatttaaagtaatcagatatttttggagaaaaggtaaagcttataaaatttaaatggcatgcatataatacatattaattatgatattagcactgaaatatgttgatgtaatctacataaattttttgtagttctttttatgcactagctaggcatatccacagcaacaaagtatagaaacaacctaggcctgatctaacacttctttccaaatccaatcataattatattattttaaaataaaagatttcataaattataaggtaattatgtgtaatcctatactttaaaaacactcctgataatttgatttcataaagtgggagaagtatttaaccgtttgctctcttcaaatatcttcctgattaataaaatgatactaagtatttttttacttttattttagatccagaggtacatgtgaaagtttgttacataggtaaacttgtgtcacatgggtttgttgtacagatcacttcatcacccaggtattaagcctagtagccaataattattttttctgctcctctccctcttcccactccaccctcaagtagactgtggtgtctgctgctcccttctttgcgttcatgagttcacgtagtttagctcccacttacaaatgggaacatgtggtatttggttttctgttcctgcattcatttgctaaggaaaatagcctccagctccatccattatcccacaaaagacattatctcatttctttttatgtttgcatggtattctatggtgtatatgtaccacattttctttattcaatctgtcatactaagccatttattatttgtacttatttggtattgtgcaaggttctgataattcactgtgatttatcttcagtttgttcacacgggcttttggtacatcatttttagagaagtaaaatctatataaaaagtaaaattaaacttaatggctccaagtgtcaacagttagcacctctgattaaggcagtatccccatcctgccttgattctgcacctgttgtgttgctacagatggaagtaacatgataaacacggatatataatgcattcgcatggaaaaaaaacattcagatgaggctatctatttgaatagcatttagtgataactaaaaccattgtctttccttgagaatagttagtcaaggtgactagcaaaacctcctctgaatgcagctctggttagctgggctctggtgagataggatagtgttaccacagtaagaccaacattgaaagccacctccatatttacctataagatcgatgatgaagagtgctaacatttgagccaaattaaggtctacacagacagagttttaatgaagccagaaaaattagagcatactagcaggaaaatccataggtgaagaaaacattctgactgggtttgcttcctttttgatttctaggggccaaggtggcagaattcacagactaaaaggctgctgagagttgaatcatcaagctgctcaacagtgcaagggactaacatagataattcaaatacagcattactctattcccttttttgttgtttttctccccacctaaattttctcatatagatacagactgaaactattattcagctgcccaacaataatataaaaagaccaatgcttccatttatgcatctacttttatgatgtcaattctaaaaagaagaacaaagataagtttacgtaaaatagtagcagatagcacttctatgacatattacatttctctgtcatacattatgctttattttctgtccttcattacattttcttacttagtaggaaaaatattttaatcctttatcattcacctgaggcaggtctgaccctgtttccccatagtttttttaaggtgttttcagtaaagattgcttatgaattgctttaaacagcttaagggcttccacttagaaaaaattcaaggttaataagattcatcatactcacaaagagtatctggttgtggacatagctacttgctaaattttattcagccctaagtgacaccagcagcaaatcagctcacagcttaatactactggcaactctaaatgggagagaagtaacattactcagatccaggtttttaaaaatatatgttatgattcacttccattagttcatatattgatgctcagacactggatattggattctctttcaaacaacaaaagaagctgagaaacaaagctgaagatatttttaaatgtcatggtaaaaagtcacagggaagtgtattttatcctcatttcagcgaatgtttctaactctcatatgaaagatacaataaattcctatcagaaagattttctcttggcaaagtttaggattctgaaaacagccttttaataaaacagcacccacaccctcctaagctgtagcaccaaaataacagcactatgttatattcttcccttatggtaacagacactgttgaagctgaactgtaatttggcatacaacatttctatactaatgtaatgtgacaatgttattatgttcgctattttgcatacggtcatagccatgttcatcttctccaacctgacattaagttagcttaatatggtaacattctattccggaccactgggtaaaaggagaaaaggattattgtgtagcacactggtgtgatgatggtggacgaatgtgtaagtattaataggtgatatataaaatttacaatgaatgtaaacttttagcacagaactggcacatagtaagtgctcagcaaatggttacatccaagagaaatttcataaacagctacaccatacaatgtagtccagcacactgtttcctacaatttcagaagagggaaaaataatgtcaagctcagaaaacaaaggaagtttccatgggacaaaagagttttagtagagattgaaaaggaaattatatttcttcaagcagacatagtgaaagaatgcattccaggtggaatgaatgcattttccaggtggggaaattagcataagcaatggtgaggaaattggaaagtgtaatgttgttcagaaagctgtaagtaaattggcagtaatatgccatatggacaaggttctgcaacagataagtatgaacatgaaggctggggtcagaccattgaggtccacgaattccacattgactaacttggagagtagtattggacactgaggatatatttgaaattcttctgcaagatgcatgtgtctagcacgctttgattttagtgagttattacaattacatgcagcatgctataaaaacactgggcttataaaccaagaaaacagagaagaatgttattcctagtagaagtatagagtcttatagggaggtaagactaaacataggtaactataaggaaaaagtgatggcaaattaaatagtataaacaaaattctataggaagccagaggagaaaaaaaatattgcctctggttaggagaattaggagagactgatgacatttaaactaggaagaatagaaagaaagaacaaaactggcagagaggcacagaatggatcagaggaaagaggaataagaaatgggagataactaagaaattacatgatataccagaaaaattatacagaggatctaaaatttggtattgatatggaagaaaacttgaagaggtgagtatatgacattaccctgtacacacacctgcatatccacatacacacatgcacaaaacaattgtttttgtcagtgagtaggtcacttagatggcaattttccggggaagaaagggtttaacaaacatttcattaaaaatagcctttggcatcattttgaatagcacttctttttgaaagattcctttcagttcaattaattagtatgatttatccaagattacatttacaagctacaaagtattcccatcttcccattgttaattatatctccaggctaatataaatacattttttctagttaccctaacccactctataaaccttatcagcgagatgacatttagaaattctattttgggggagggaaggtctcatttgtaatgtggcatgttcgtttccccattaaaaagttttgtttctattttcttttttgttttctatgtaattggaggctgcaatcacagaatttatgaaaaaataaactagagatgaaaatttcattaagaagtgaaatgccttaaatggctttattttaaaagaaaaatcagcttctatacagaaaaggagtttgttaaaaccccaggaatcacactaattctatttgtgcatcttagagaaaaacagtgagatgtacagacaagatttattttgatcaatttaaaaagtgaggaaagtgttgcatgctatttctattgcttattaattccacgtcttcaaagtaacaattgctactatatcttctaccaattataattgatacaaaataagatttgcttttgaatattgatttgtacctatgtattctcaccactgaaactccaacgtataagccaaggaaccatttcacattttcagaaaacccactaacaggtaatgatttaatcaaaatgcatgtattctgagagctctctaaagtaattttaatgctgatttgtgcaagaggcatatcaggagacacatttattgaatgacatttacctatttacaagaaaataacgaatagccttatcattgtcatcaccagtactatcacccaagagcagcattaaaatagttttctgtaaaaatcattcgaagacagcatgatacttatggttgtatcttggtgtttctttagggaaagtctaacaaatacatacacaaaattatattctttatatttaactggtatatgaggatacacagtctgccacaaccaaatggcaactgtatgtaaaacatggaaactacattaagcatagtttggcagaaaaagttctttagcaacatgaaaaatattttcacaccaaaaaaatccctctcaactaccacatgtagtcatacatctgtcaggattgtattcaggatgaaaaatttgcgataataaaatcttaacaagtattcagtcttctgattgtccttgaaaataaatttacgccattttctgtgaggcaggaacaaatgcaggaagtaatttacctatacacacatatacatatccttatgaaaagcacatgtaaggctgctatatgtatatatatttattaagactttatgtaaagttgtttatataactcaaaatggcgttattgtgttttaagtgtgatttggcttgcagagtgttcgcaaatgtatgatagtttgaatacatgtttattgcttcaggtttactgtaattctatgggagaggaaactagtaaaatgaagaacaaatatttctccatctacagtggcatggttgttaaaggcctcttccacatatgttttaactctgtattggttgtgcgtttttccaatagtcaatattttggaaaggaaacctaaagacagcaggtaaattgtactttattgctaggctgcaacaactcagttcagaggattactgtagctttaccccatcttctacattgcgatgcacatatctgttgacatgaatacagtctcaaatagacaaaggtcaaaatgaacaagctctactctttctttaaatccacattcaaattcagcctctgctacaaaatctaaaccttcaaccgttgcatcttctattccatcatcctggaggtttagcttaagtgttgtagcactgacaacatatagcacgtattctattttacaaccaggtcaatttgtcaggaatattctcttaatatagcagaatgcaatgttttgtatgaaattcttttatcattttgatgatgtgctgtaaatcaggacctattagaacattaagacacagaacttcatcttatagatcagttaattccatcttcaaaccctcactgctgtgatataaattaggcactagcagatatgccatgatataatgtgaatcatgtgttttattttcatgcttatattgtaatacttagttaaaggattttaaggggaaaaacataagttgctaagatacaagggagaatggctgaagggacaatgtttgaacatatttttttaaaagtaaaaggcagcaatgggcttaaagagatgtacgcagagagaaaaatgagacctgtaaccattcagtaaaattacagccctcgagacataatcatatgaaattaagtattatttaatataaaacaatatgaaggttctttcaaaaaccaagggagaattgtcatatattggaaatgaaaaacattcttttgaacaaggtgatcattagtaattaaaaaataacaataaacccaaaaaccaaagaatcaccatcatcacaggatttagccactttaacaattagtatttcaaaactgtcctttccgtagaaacaactgcttctatgggttatgacagttcgactgactcagagttaatataaggactttcagtgttagactttagatatcaaacagtaactggaagcaacgatgagtatcagtccatactcagagaggtacttacggtcattgcagagtggtccactgaaggaagtcatactacagtcacagctgaagccatcccattgttgcaagcacacaccttgattggaacatgagtcctcttggcaggttgtgctgggccctgcaaaacaatccaaaggaaacttgggttctttaaaagaatccaaaagcattttatacatgagctagatcacatgtagtagttgccaacaccacagatgatatgtccaaactagtttttaaagttctagttcacacacctgaattaggaactgagaggctgtaatatgaaggttttcttaagtttcaagtataggataaaatacattataatcataaactaaaccaacaaatagcaaaaacaagcacatagcttctagtatgattattgtagcaggtaatctcattccaacttcaataattctttatcactattttgattttagaaaatgaatggatctccttaacattctgaccaatgaatagagacataatgagaaatggagattataacttcatgaaattgagataagattggcaaaataactgaagagagttatgcaaaaatgccctagaggtttccaaacgataaagttatgattgctgggtgttttgaataggtatgttggcaagtatcaattcacatgcttttaacaatttcatgcaattaaacataaaattaaaaactccatataaatggcatgccctcaataaacatacaagtaaaaagaatgctagtctatttctaaagaatcataactagaacactgaaaaacaaagaactaaaaaaagcatgatcaaagcactaaaggcaatcactatacaaacatattcaagactgaaagcctttatacaaactatgctacaaagttaggcttcttgcacaacgttcaagaaaggaaaagaatgaaatctgaacccaaataacagttactgcagaaatgtaaaatatgttattttagggtttccactgtgtattatggggtttcagtcttgttatatacacacagggctatctaccttgcaagtcagctttcatcaatgcaactttgtcagcaaaataaaaaaaaaagcaaaatatattaaatgttagtaagcaatactgaaatggggcaaacacagaagaatgttcagattcaaaaggcatgctgctgtaaagagggagaaaaatgctatgtagagcaaacaaattaatactaacagccataaatcttaagagaagccaaaaatgagaaagcagaaatttattagaatttaattgtacatatgtatatatataatggttaattgagccaatgacatgtaatgaaggaaaattaaaagggcctttgtatgtttcctctcttggatagatatgaatgcattaccaaagtgactgtgttgcttatttggaacatgcagcaccattcatcatgtgcagatacagtgtagactatgatcagtagcaaagcaattatccctttctatgtttttccctctagatcctttatctttctgttgcaattaaggcttcaaaccgtaatgccagccattcactgacaacagctggactttagagtgacaccaaccaaatgctgcataaatgatactgtatatcatttagagtggatgaaagaagtaggaaggatggaagaaataaactgcaatataatccatcataaaggaattttctgaataaaatttccatgtgcagcgtttatccttgaacttaccagattgggtatatgccacttatgaatttcagagttacgtctgtattttctacactttcacaagtattttcaactcttataaacttccctgtggaataactgttacagtaaaacctcactaataagaacctatcttagaggagggtgaaaagggaatacagtctacctaaatagctttagagtataaactaaatatattttctagtaaataaacatataggttttataaaaatagaaaaaaagacaacagctaattagatgctattaatgtaaaagagagagcctctgaggtgcctgctttagtgaataaattagaattttctgtaattatattttgtataaatagatgattttgaaaatggcttctaaacatgtaccttacaatcacatttgtattataaatttttagtaaagatactctttattgaatgttattgaatttagcctagcctctgagaattcacaaattcagaaaccatgatattgtaaatcttaattctgtaataataataataataacagcaataattgtaacaataattaaaacaaaaatagtagtttatataagtagtaatataataagaagacctcccaaatccaggaaacctgaagagagtaacagttgtttttttcaacttagttatttgtaataaagaactaagaactaacaaagaactaagaactaacaaagaactaagaaccactaaactcaacttagttctttgtagtaaagaaataagaaccacttaattgcttagttttaatttttgttccaaactgtgagagggaagtggtctactgatccttatcccatggcattagagatcaaaaataattagcatatttttaaaaataaaatctctcaaagcaatattccttagcatatttcttccagtgttaagcaaataaacagggagtaatacaagcccagtttggggagatgccattttatcaaatagctatttgctctctgacctgcacagcagaagaaaaggtcagaagcaagaactaatgaagatccagattttggtttttgttttttcaaaaattatcagaaatgcaattgagaaacaatgctaaactctaaaaatagtaaaactacaatcttagaaaaataatctgcccatattgtagagcagcaactcagagtacctgccaagcttctatgtaagcatacagacgtgctgtattttattttcattatcacaatagtctttatattcaggaattacaagacaatgcatgcctttgcctgacaagacacatttttcaaagtactcaccttctagacaatacttaaacattgacaggtattacacaagagagagccttaaatttatttttctttttagttatgtaatattatctttattttatcactgaataaaattaggaaaaagctacaaggacatttgtattaagttatttaaattaataatatgtctaaaagggaaagaaaaatgaagataaaactacaatttccagaaacaaaagaaatgatacacaaaagaggttaggtgtctctgctttcaagtaaggtaaacttgagtttgaaacttgtgtcatccacttactaggtgtgggactttaggaatgtcaccttacttttctgaggttcaatttactcattaaaaaaaggcaatgatacctattgtatagagtcttgatgatttaatgagatagtataggtaaacatattcccaccagtgtttaatcaatgatagctgtcacgattaaacagaaaattattcctgtagatataatggagcctagagctgaatgttacagttgtacaaaaagagcatctattaaaatttcactctgattttatgtagagatattatcttgactttagtgggcctgcttattggttgaattccagtgcccattttctgctacataaacagaaaaaagccatccaaagtatggtctccagtataacagcatcagcatcacttgggaacttgttagaaatggaaattctagggctctatctcagatctattgaattagaaaccctgggggttgtaatctagtgatttgggttttaatgattctgtaagtgattctgatataggctaacattcaggagacaataatctaagtagacttcgacgggttaaaatccgtactctagctgaggtgaattttataaataaaatgaaccattactccctgaaataaattagaaataaaaggcaacaagtgattatttaggaaagatcaaaagttttttgtatgcaagaggcttagaggtgtgtgggtgtattggataggaacaatggaaactcctcacaagatattattaggttataccaaacatatgctaagtagtcctatcaatatggagcctaagtgattccagtgtggtttggactcaaattccatgacataacaatctttagaaagagaatttattaggtatctacagttaaaacactaatcctaaaaaatgtgtgaatctcatcaactgtacctgtaacaggtaaatctaagattattcctagaaactatacaggtcagaaataatagtaaattaaaagttgttcaccttgatgttggaatgaaagaatcaggacagaaagtaatattctaagagtaaagaaaaaaaggggtgtcagggtgtgaaaattataaaagctcagatatataaagcattctagataaggaaagaaccaatgccataagtgactgggttcaaatgttcaaataatagtttaatgtgtaactaatcatcttaaccaaattccttactagattatgtgggtaaacaacaccaaacatcattactgcaaatgccctttgttagtatatcctgctcctcttaatctacttgcttccgcccactcactcacattacataccagtggtgggggtcctgtgtgtttgcctcttattttctatctcattgggtatatctgcctgctctcaccatttcttgtaggtgagaagtcacataccaaacaacttgtagaaaggcctatttttaacaaatatgttccataagggattgtaatacctttctttaaaaaataaaataaaataaaggtacacattctcactaatgagatcacctccaagaattattatgttgtatcacattcttgtgttcatccactaatgggaattgatccccttaacaattttgtctctcttaattaaaattaactgaaagggaaaaaaacatagtttccttatgttttacagaggcattatgccaaaatatcaaataaagaaatatactaataacattaaaaatgaactcaacaacaccttccattactaaccttatcctctagtattactgaaatacagtttaaatttcacctaacatttcatggaaacacatgctgcacagaggaaaaaaatgtattttcaaatataaaatttccatgtacttaagtaattgctaaatataacgacattattttggctgagaataaatgattcataatcacctgggggacaggaattcaaatttctttcttcttctctcatataaaacatcctcatcctcataaatctaaaattttcaaaatggcccaaactgtgttcagtattacaggagaggcagcaacacatgcagagccacaaaattcatgataatgtgattaaattacatttatggaggaagaatttgctcaaataatctgaggtgttgaagtgaaaattatctaaaatgaaagtggcaatcaaaaagtactcctacagatcttggtctgatagagagcacaaaagaaaagaagatacttcagtgcatttctgatataggaatattagcctggggtgatacaagaaacttgtttttgctaaaacagactgaaaatatacaggatacagtgtttctgccaggtacacaccaactgaatagtgctttgagaatggggtatctgaacttttttcttttgttatatgctattggatatagatttacttatttttattttactttttttttaatttcagtagctttaggtgtacaagtggttttcggttacatggatgaactatatagtcgtgaagtctaacatttcagtgaacctgtcactcaagtcttgtacgttgtacccaataggtgttttttcatcattcaatccccttcccacgattccagcttgtgagcctccaatgtcccttataccatgctgtatgcttttgtgcacccatagtgcagctcccacttataagtgagtaacatgaagcatttggttttccattcctgagtcacttcacttagaatattggcctccagttccatccaagttgctacaaaagacattattttgttctttctatggctaagtagtattctgtggaatatacataccacattttctttatccactcattggcttttgggcacttaggtagattccatatatctgtaattatgcattgcgcagtgataaatatatgtttgcagatgtctttctgacatagtgacttctctcactatccttcacaaactaatgcaggaacagaaaaccaaatactgcctgttctcacctataaatgagagctaaatgaagagaacacatgaacacatagaggggatcaacagacactggggcctactggagggtggagagtgtgaggatggagaggatcaggaaaaataactaatgcgtactaggcttaatacttgagtggcaaaatcatctgtacaaaaaacccctatgacacaagttgacctacataacaaacttgcacatgtaccccctggacttaaaattaaaacaaaaagaatgtagatttttaaaaaatgggcacaagttgattaatactcggtggagcagtatttgtttaatgctataaagcaagcatcgtagaactgattaacaaactaatcaaatgtactacatagctcaaaaacaaaaacaaaaacaaaaacaaaagcaaaaacaggcaaaaaaaccaagatccatagatatacctcccattttacattgggcattaatgtaggcttgcaaacagtacagaaaatttaaggtttatgagataaaaaattaaaaacttgaataaggatgtctaagcccaaattgggtatttgaccagttatcagaattttgctggacagtgagattcactctcagttagacaggtggaattagaattatttagagcatgatgacaaaaatctaataccttcacatcctctctcgatctgtccgttgcagaaaagagcatcggagatgaggtccggaagccgtccatttaaatcaactgatgccaggcagccttgaaagccttctttggcatgtacaagttttggtaaggatttgtatgtttctttagctactcctcctatatataagtcacctgcaagaagatcaaagtctttgttacaaaagtaccatgtcattgactttaaacacacagtaggatggagaaaaaacagggaggtttatttttcattaagttaataaaaaattaatttatgactagctgttttccccaaagtgctaaacaatagagacgtttgaataatatactggcactaggagacatttctaaaagctatttccatagacaactaaagtaattccatattatgtggtcaaattgaaggaatgtgggctagctatagagatgcatacccttgcgtggaaatccaggcctggttatttgcaagccctacagccttgtgtgtgtgtgtgtgtgtgtgtgtgtgtgtgtgtatatatatatataagtttctctgattattagtatcattgtttctaaaatgggaacaataaaaacctatgccagagggtttcatgatgattaaatgagatgaaatatatcaagcatccacaagagcaaaagtataaagtggacacacagtcaacaggcattattattaaattcaccttctgcttagagatctctgtgtcttccatttcatcagaagttcagtaaatttcttcttgtatctaaagtcacttctatactaggctgaagcccactatccttgcttgcacctctcttgttcgataattcacataatagtctgtacataagtggatattgcatccttcttgaggtatttctgtttttaggtaaaattacactactttcaatttttaggctgctctgaaatccgttaacaaattttcaacttatttttctaattttattgcagtttctaatggaagacattgcttagctttgtttaactttttctctctaggtttgagattccccaactttatggactattacttaaaaaaaaaaagagattacaatctatgttggattctgtttctttttctatttcagattatttaccatatctggataatattcaataaacataactaagtgactttagtaaacatttaatcaatgtggaacataaggaaggtgagctcaaaattcagtaatatgctgctatagctccagtctacaagttctgtaacatactctttttatctacttcttcaactttcattttcatttgaactttctttctcatgttaaccattctattcaacttgatgtcacttggcacattttccccagtgtaacacaaaaatcctgcaatcttactgttcacctgggtccttctgtgttgtcttcacgagacttgggaacaaggagaactgatacacagactgttgagctgtgagtaacaaattccttggtctcccatccagaaatattctgtcttctgcaggcacccattaaacagtaataagctaacctattaatttgtatgtagggtaaaatcaaaccacagatataacactcttgaactgtactcatgaataaattgaaatagaggaatcatgtggcatactcaaagtcattcaacgttaaaaactgagaacttaggtccttgacctaactaaaacttaagttttataactatataatttgcattgaaagtactggatgtatttacttccccccttttacataaagcaaagtctactgactattaaccatcattcttaatattaaaagacagcatggttttggtcagagaggggatactattttgaagaattatttgatttttcttccatatttccattctgtcctttgtttttgctctcacttaaatttcaggccattgtgttttagttgcctcagagaaaggatatgaatcagaaatcaaagatacaaaattagctttctgtatttaagtctaaaaatcctagactcttcgaggaatgaaatagaatacattggagtttacataagaaaagtaaagctttcctactcctctttcagtcaagcaggagataaagttggaagaacctagttgtgcaagtacagtcattggcaaatgtcaaagagggtgctgatttctaatttaaggactgagctctggtgaatctcaaaacctcaggtaagtttcaaggagtaatgcaaacctctgtgcatttcctcaggagaactaagagggagcagtgagagctctgaaaagaaatggctgcatggtggacttagataacctgagaccttagacagtctcacacaacgttccgtactcctctgtgccatgggagctatagaacaatttccagactggcacagaaatagcaaaaaaaaaaaaaaaaaaaaaaagtccaacctaaagaggtcatgcacacaagaatgaagatgctgggtagcacctcagtgagcacctgagttgtgactctagaatatttgaaacaagcttccatgccacctctctttacccgcccgcccccctaccaaaaaaaaaaaaatgagtacagtagaactcaccccattgagttatttagatatgacacaagaaaaagaagggaactaaaattgcctgagattgtaccttcactaactcaaagaatcaaagctcaaaatagaaaccaaggtgagttatagaaaaatagaaaagttacatttcttgtacatcagagattgtgggctgagatttataatttgacatgacaaatagcaatgaaaggaaatactacctactcctttcatttgttgaacaaaatttgttagaaaatttcagctctcctccaggactaatgaatgtagtagagtggggaattgaatgaagaattcttggcacagctttaggcttttcagatgtagaactcagtaatagaaattatgtatagaatactatatatttattaatcaatcttcctctgtctgactgtaacctcctgaaggagagagactgtgtttcccagagtgcccggtactgggctctaagcacggttggccctcaataaatattgtcagccaccttatggattgaggccacggtagaaaagaataaaaaaagaggaaacagtaaggcaacacatgaggagagtgctaattctaaaatgcaccaacttacttccttttcccacttcctaccacaatccctatgtttttctattaaaaaacttacttgcctgacaacattgtaaagcttattgaagagaactagtaatctttcccttgagttactaaagagcagaaaatatcagttcaagcagtgtgggatacaaccttcaaacatagcaaggtagacgaggttggctttataaataggggactcattctcattttcattactgaagctgtacttagcaccaccacttagtactgtttataaactctttgatatagcaaatagtgatctaaagtcccttggtgggttgccacatgaagagaacaaagaaactcctttagtggtctgagccctgtgtactattatcactttatcaaagatgcaggttctctttttgatccttgaagtgacgggtttaaaaaaaaaaaatgacccattagcactaatgggtcctgcaggtgagtccctgtgcatgtgaaggaggatatacttaatggctctgtgtatgaacaagagcctgcatgggcaaccagtaaaagccaactttcctgtagatatgaagctagcctgttacctcttcttcaaaatgagtggctgatttttaattcatatgttttaaggaccatgtaggcaattgataaggcaaaggttgaattgggacactttcagcaaaagaagtagagaacatgtacaataccaaaaactcaaaagtctaaggggtgagtttcttaaaataatctcaataatacccttatttttagtactgtatatacacagccactatgttcctctcaagagtgttatctgtgaatgaactggggtgatatcatgagtatccattccgcagtaattgagcagtaatgactagggaatagggcacaggcattttggttttctctgtctacaaaccctggctctgccacctactggctgtctcagtgtaggcaagttaggttacataacttctttaagagtcagattcttcatctatgaaatggggttgataatgcctaccttgcaaggccataaggattacaaagtatgcacataaagcatctagtatacagcatggacttagcccgtcattgatactggtatggctgtcagtatatctgtaaggatgacacatctatgatgtacctcaatctatgctgattccactgagaaatgcagaagaaggagaagtatagtttatctcctgtttctagcacaactggagtgacaacatgtcaattttataaattctccatgatattttttctattggatttagttgacagtcatttgtgtgctgaagtgtgccttacactattctaaaagtagctcacagagctcctttgacttaatttgaaattcggtggcattgaatctggtaatataaataggaaagttgcttgacaaatatcttctaatttgacacaaagcgattaagaggacaaaaaaactctatgaagcccaagggccaggttgtcagttccagactaaacatgccttagaaaatcagagaaataacaggtttttgtggactgtggttgcaaagtgggggagcatacaaaagttgagacaagaagaaagtatgggagacattactattgtaatgatataaatgtggatgccagacacagggaacagcacaattgtaccatggagacaaaatttatatggcatttaggaaagagaataaaaggcttgactggaagagaggagttttcagttatttattaagttatgtaaataatattgtataagtaaagtcaaaggaaaggccaccatagaacttatgactgctggctgaaaaaaataaataattaaagataatgagaaatccaaggatcaaagcaaagcaggctaggaaactagggaatttgaagcagtaataatccggaggagaaataaaattgcatttaacgtcatgtatgtggaatttgagtaggaacatcctagaggaatccagtgatatgaacctgggccttagggaacggaggttggagcttagaggccttccttgggagccaccaaccaaaagcagacaaatgacgcggtagagatttcctcttcacttaaaataggaagcataaggcaattagagtaaagaccaagctctgccttacagtagcagaatgcaagtgtcaaggtataattagttctttgactcagctttcctgtttattcacatgtacttttttgaacctcttaaatatctcactttcattttaatttttttaaaaagcatacagaaaaaggacaattgccttatagatttgaatagctaaaactccaggaaatatgaaggaagctctcacaaacttttataaatggcatttggggaaaaagaaaaagtgaagtcacacaaattagcttactttcctatagctggactagagaaagtgcaattctagacacttcattttaagaagattggaccttggagagaaaatttgggtgcagctttttctcctaattcttattgtgattggatggtaaaagtagtgcaatcaagcttgggtagtttctgagcacattctatgggaagggtgcctttcggggaacaatcaacctctgtccccaaatttgtaccattatctttaattttaatattgtattgcacacacataaaggaatatctgtaggtcagaccttatctagatacactgagagagcttgtctttaggtgacaaatccaaacctctaaaacaggtgttccctgttagataaaagaaaatgacctataatatctgataaacaaacatttgtttgctttcttagtagaaagcctaagtgtgactgcttaaataaataatattaaactactaaaagaaaaagcatgggaagtgaatactgctctaatctatttgagcttacaagtaaacaaatataaacttctataagaaaccacacagaaatgaacaatgaaaactatacaagatcatttctaagttcaaggcttgtaaaatattcaaaatggaaatcaaatgggcaattcaagcagacattttgctctgagacacaagatctgtgtctgtaataaatctccattttttaaaagattaattttagaaactctccgctgaagagatgttaagtggtcaccagcttgatttattgttttttaacttctatacatcttagtctcccttggtacataaaaggtttagccttacaacaatctatttttgcttctgtaggaaataaccataaattattatctttaggcgtgtcctgaatttctaggtccagcctaaaatcaaaccttcatcatctcccttgctgtgaaattactttttctaaactttcatgttgtgtaacagccacatatctagtctacctgctctccagattggaaattcagtatcatttttaactttattttatatctcacaccttacaatcaactactgccaaggggtgaatgactcaactttgccaatatttctgacatttgttgtttcgttttcattcccatttccagttcttatctatttttcttcttgtacacaccttttaagtactaacctgttacctggtgtcactgtctccattcagcctcctcatcaacactgtctcagtcactccactgtgttctgatatcttcaatacctttctgtatcatctaaattaagtctaaggctcagcagtgatcaagattttgaattacttctcttcaaaaacttttgctaaactttgaactatctttcaaaaataacttttgccaggtagaagattgaaataatatctatcttcgccccacagtccgacctttagtcaaactttgttggcagcctttccccaactctgcattttcccactgctccatccttgcttgtggtatacaatacttccagcatgaatgcctttcctcttctgatgttgttcttcaaaatcctactcaacttgggggactcaactcaaactccaccttggaaatgtgtacctgtttccttagccacagataaatatcttggaatcctcataaaaaattgaaccccttttctgaaaatgattttatctttttcagttctttgtatgtgtaagccttatgtaaccattagtttatacattatttgaaggaataatcctaaacacgtttatattctcattttcacttagtaagcatttgataattagttgttgactcactgaatgaatggatgaattagtagttcacattcaataaataatcattgaaacaataaggacacagggaaggttttatgtcagcactcatatttgtccctggctctttttacctgagcaataatgaattaagttaattgtggaaaatttttcatctactaatccatttctttttcttttttttttttttttttttttttgagatggagtcttgctccgttgcccaggctggagtgcagtggcacaatcttggctcactgcaacctccgcctcctgggttcaagcaattctcctgcctcagcctccagagtagctgggattacaggtctatgccattacacccggctaacttctgtatttttagtagagattgggtttcaccgcgttggccaggctagtctcaaactcctgacctcagatatccgcccgccttggcctcccaaagtgctgggattacaggcgtaagccaccatgcccggcctgatccctttcttaaacacaaaggtgaagccatccagctcattaagaaaatttagggaattcaatggcatattttttcccactctgatagtgtaacttgatagagtaatacatgaccagttttaactgacacatactgaatttatttgtagaaagagatacagagatgaagatagaggtgtagaaacagtttggagtatcagtgtgcgtagtaatgagaacccatgcatgaatcgtcttctccaattaaaatatgtacaaaaatctttggaggaaattaaatttgagcctatcctggccttctgtttcattctggctctatgctgctccatatacaaagatgacctgattcatgcatcctccataggcatatggacaccatgagcacttcacactgtctctccagactcatctgctctgttattatcacaaagaaagacatgcatttatttgctgtgtgtgtctgtagaacacagagaagctaactgtgtggacccttagtgctctgctctagtgagtttgttaatcctcatctgcacttccttttggtttgcagatgtttcactccttctagcctttgggccaccactcaaagactcctaaggttagagtccttctagtttgtagcttctatttcttggctccttgtcagccacaggtgttcctgatgctacagcaggcttacacatctaacagtatattgctttagctaaaatgactttgagtttcacaaaaatcaccgagacaactgaactgaaatgtacagagtcctgagtgagagaggtcttccttactgctttgaatctttggtaatcagtgtcaggcattactatggtcaaaaccagaaaaaacagctctgacttcatcattataataataactgacatgagttaagtatccttaacttgaccaagcatttgcacatatattgttatatctggtttttgcctgttgagctacaagaggagtaaaggttatcagggatacatgttacagatgaagaaactatggtttagggctacaataccagaacagggcagggtcttattgcaagcccaggtcttctgaaactatgttaattgtccgttaatccagactgacacgcacatgtacaccctgtacactctaagtggcaagtggccaatatgtacagcttcactactacaacatacaggaaattttggagagttgtggctagttgataaaagtaatggtaataaatggtagcaaaaatccaagcaagctaacaaattcctgagacaactggtacaataagagactcatctgcataataatggagtaatctcataaaggcaaagtcaattttcttccataattataaatattaggtattcaaattctgatacataagtagaattcttatgttcaaaactttttaaatcaaattttatcaaaatgttttttaccaaaagtcaacatttgatttttagatacagcagttacttttcaattgtctcccacaaagagataaatcagacacttgtatgtatccatggcccaatctagtacaaaccagcacttacgtgggacaagttggggaggggcaaccccaagaagataagagtttagaccttaacgttttcctgtagtgagttttggggagttaatattgttattatccatatcaacagaacatataattctttcaatattctgaacttttgtttctttttttttttttttttttttttgagacggagtctcgctctgtcgcccaggctggagtgcagtggcgggatctcggctcactgcaagctccgcctcccgggttcacgctattctcctgcctcagcctcccaagtagctgggactacaggcgcccgccactacgcccggctaatttttttttgtatttttagtagagacggggtttcaccgttttagccgggatggtctcgatctcctgacctcgtgatccgcccgcctcggcctcccaaagtgctgggattacaggcgtgagccaccgcgcccggccgaacttttgtttcttatttaaattttgaaacaaaactgcccccaaaaagatttttttaaagtatgattctgaaacttacaacaggaagacagattttgtttgtatgtttggccaacagactgtgaggaaacctggtgggcatgctaaatgggaaataataaagtgaaattgctatgggagcgtgtagagtaatccatcttcttttaaacccactctatgccagtaacagtgtggcagatggggtgcgagttcagggatataaatccatgccaagctaacttcatctaatggctttaaatttttaaatttacctttaggtaaaaattgggtacaaacagtttcagttttttccttttgtctcatccaaatgacagccagtttaaatacctgtgacattccttacagcagacaattctgtcaccattccatgtttcattttttttacttactgtgtaatgctctctgggactgcatatggatttgcaggggttttcaacctcacatatactgctgtaccttacacatgcataaacagtgcagtttgaaaggtgcttttttcagaagcttttgaaccagagtgactccatcttgaataggggctgggtaaaataagactgagacctactgggctgggctgcattcccgaaaggttagatgttcttagtaacatatgagataggaggtccacataagatacaggtcacaaagaccttgctgataaaacagaatgcaataaagaatctggccaacaggcgcggtggctcaggcctataatcccagcactttgggaggctgtggcgggaagaaaccccaactctactaaaaatacaaaaattagctgtgcgtggtggcatgcgtctgtagtcccagctatttgggaggctgaggcaggagaatcgcttgaacccgggaggcagtggttgcagtgagccaagatcgcgcccatgcactccagcctgggcgacagggagagactccgtgtcaaaaaaaaaaaaaaaaaaaaaaaggaatctggccaccaaaaccaagatggcaatgaaagtcacctctggtcatgctcactgctcactatatgctaattataatttattagcttgctaaaagacactcccaccagtgccatgacagtttacaaatgccatgtcaacgtcaggatcagaaagttaccctatatggcttaaaaaggggaggaaccctcagttctgggaatttcccactcattttctggaaaactcatgaataatccaccccttgtttagcatataataaagaaaaaactataagtatactcagttcagcagtccatgacgctgttctgcctataaagtaggcatttgtttgtttctttacttctctaataaacttgccttcactttactctatggacttgccccaagttctttcttgcacaaggttcaagaaccctctcttgggttccggttcagggcccctttctcgtaacactttcacatctcttactccatttgatccttgttgcaacccttcacaataggtagggtggttattattatccctacctgacagatgaacaaactacccttctgaaaagtttagttacctgcccagggtaatacaagcaatacaagaataataatgccagcacttcagcgtttgactcccaggctaattcttttctgatgcaccacactctctcctatttttactaaaacccttctcaatgacaggagtagaatagatagaggagtttagaaatgactgttctggaaattaaaagagactgataaatagggaacaagtagcagaacttatgtaaagctgttattttttcccgaatagtgtatagaacaattagactttctttcccaaaataacttttcttatttgaaagacaggtttttttcttatttcaaaacaaacgaacatttattttgggtggggaagacccagtggtataaagggcaaatataaaagaacagctctttcctataatacgtctctttaatgtaggtgaaaaattggcaccggctctcaacttagatataaacaggataaaaaaggttatagccaccagtggttttctgtgtagcttgaaaggacaaagtagtataaagcacacacaaaaaaacttacagacattgccaaagagctttcaaaatattatgagcttcctggagtcaaatcacactcttgtttttccttaagtatctgaacatttctgtatttttttttccaaaaaagaattccttctgtgctcgaaagatggaatattattaataccaataaggtcatcacatccagttgctatagtgtaatttcctagtgcatgtctccaaacactttgttcttccaacataagctattcttaaggagaaatggagatacttaaaagcagggatccctcctccaggtcagggaagtgttaggaacttttcctaaaggctaaggaaattaagggctttgagagctgaatgagcctgcaagtagccagtttgcaccagccgatgactgattgataggccaacccccaatcacccaaccaagtactagattttccagagcctattctacatacctataaatgcaaatgttctgcagaatatatataaaggacacacagcaattaaagttgttagctgtattgtttgaggagaacttcaggggctaagaagacagaaccaatatatagatgctatgcaaggcattggggagagaagagcatatagaaagtaaagtggaaatatccagttcctttgcaactaccagaagtggaattttcaatgttatacaatgtagtagaaaagtagaagcttgattaagattttttatggaatagaaagtgttttattttatgatatttccccccaagattaaaataaatgttagcttttcactgtagacattcagaagtaatcctttcaaatattttggcaaatacagatggcagtatttaaatactgccgtagacctgggttcaaattctgtttctattgctttgtgctacgtgacaaatgaataactcacttaagccttccaagtctccattatctcatctgtaaaatgggggcactaataattcactgatctaattgttgtgaggattcagagaccgtatgtgtaaaataaatactaaaattgaatttctgactgaagtgccaacacagtcaatatcagacaatgtgagaatgagacagacatccagattcaaaatttatcaaggaacaggtgaaatactggttctaaggcccttgaacccctcagctacattaaggaaataataaaaataaaatggatcagaaatgggaaggaaaggtgtctgagaatattttttgaagtagctcgtactatgcagtgagtttgtgctcctacattctagctccaagcctagcaaggcagctctcagaggagggtctcctggagtgcttgctttgcgttcccgaccactggaggatgcagaactggcacccgacacgctgagaaaactttaaagaggtcaagatggaatggaacggaaatgagagcattgggaatggggtacacttccaaggttgaggggacaaaggatccatggaaactcctcgtgggccgagataggccccaagtgcatgacagcaagctgggcaggactgcctagagacaggtcagcccatgtggtaagagtctgtgaggagggagcagaagcatccccctacacagggattaaggttggaagttctagcagaaaagccttggatgaacccaagaatgcaccaggagaggaggaattcgagggatctgccagaccaagagtcccaacatcagttgatgtgccttgtcaaaaagctgtcgaaagataattgcaggaaaaggcagtagccgaacttgccctttgccctactgccagtgactgaccaaagcagagggcagcctcaattctgagctttgattagtaactcagattggtggtttgtaattttaatgaatgttatgttttataatataaaattattatataattaccttaacagtgaacccaaacatttactctaaatcagtacgtggtacaaaaccttaacacaatacattttaaagtgatcggttgcggtaaaaccaaaaaatgatattatagcttgaccacattaggacatcatacttatttaatgtaatgctttcacacataagcccttaacatgatgcatgacatataggcatgcataaatgacataattgataataacgaggatgatggtgacaataacgaaggtaatttattatatctttgaacagagaatacagacagacccaagccataagatagtttttctcacgaaaacactcagttttctacaataccactctattgatgtgcatgattcacacatgtcgcagccaaaagacatttaatgtcattttggatatcattttgggaaactgagttcattgggtttcacaaaaaatatcgggaactacacatgttaaatttttaactgtcaaagggctgttgtgttagagaaagaatggtacactagtacaggcccttatagtgtttgaattctttttacagtcccagaactctaaggggaagccagtggtgagaggcctaaggagtctgtgtattgtgggtaggggagtgtgagtggggcatgaggaggggagagggaggagagaacttcccacagacaggttaggaatattgataactaacatcatactagtcaacctctaataaacttgagatggcaaatgggctctgcttgtactagggtagttatgggaaattggcctaaatattgccaacacctgtcagatccaaatgagccttatgagccctcctagtcctttttatgaacccttgagcatcaaagaatacactggcaaaccttgtgtattgttctgggaattaattgagatgagataccatgtgcaaatctttataacagtacatgagatacgacgaacccttagaaatggttacaataatttctatttagtattactatcattattgttctggtgagatgcttaacctccccaagcctcatgttagtttcatcacctgttacatggtgataagaacagcaacttcatcagtttgtcacaaaaattaaagagaaaatatatgtagctgtcttacctaatgcctagtaaaggtagatgaggatgatggtgatgatgatggtgatagtgatataccctgcctaaggaaatacacaaaagaaatggcagagatgctatttcacccaggtctttctgacgtcaaagactgtattattaattataatgctatatgcttcttgtattgtccttacgaacaaccaaaataattaattgcaaaggccaaaaaggggccacttttaagaatggacacagaaaaccacattcatgtgatgtcaatgggggacgctgattgacctaatgtggttcctaaggagcactggaagtaccctctagtgcatgaaaataaagagccacaacagtgctatgtcattaaaaatgcactttcctgtgtggataaagatggcagatttagcttttgagcatttctaccgtgggagcagcaactttgttttaagcccacccaactttcaagtctatttccatgttgacccatggctcaagaggaattgtacagtacccgggatggaagctggctttcttctggcggggactgtgttattactgaaatccaactagatgagacaattgcctgaaaatgatagtgacattcccttttgggaatatagtaaacaactgtaacattgcccagatgtcagcctgggcccctttgtccattacagatctagatgagtctggttaggaccctcgcatctgcacagaaggtaaaaatctaaggtcctccttcttctggcatttcctgtgaattcctgggaacctctgactattgcttggctttgctacctcatgtactccctatgtataaacaaagtctctgtctccacccaaaaacaaatgctgctcactcaagcacttatgagtttcatcatctaaacatttgggtatcacctagcacctagtattctatcaccttgaagaatttaggccctatcctcaccccctactccagagcaaggcaaaccctgtccctgaattcttgcatagcaggttaaaaatcacactttttgagcctttgatatcttcatttataacccaagtagcctatccccatatttctttaaacaaatccagtaaactcatatttgtataatgtgactctgtctcttattccctcaacctggcacagggaggacatctgtcttgatcaaatgtactcttccaagaatttggcactagaactgctaaacttaaacgagtctttcttgggtgtttgagttgatcaggggtgaaaagccaggtctgagaaggccaagtttaccaatgcttgtgaaagcagagaaaactagtgtgcagagcaggagaggaacaagggaatgatccttgggcagcttttgggaggcagctcacagccccagtagagaccaagtgaggctgcaacactggcttattgctaagagctttcctgagtacgccttttatggagcccagcattgatctttctctgttcttgtccgtgggttcctgtaatgctacatcctgtctccctgtccctttccacatcacttgtcagtctgaatggttttatgctactgtactccaaagacttctgtataagtctcccttcagcaaaaggagggaggtctgagagctaggaaaaccctgaagatttaaatcttacttgaatgagagagatattgtcagatatctgccttctcagatggctgacaaagacagctcttgaacaagaagctcgaattctaagaagacaacgcatcaccactcctggcattccctaaagagggacctgcaccaaaggctcatctctggatgacgatgaggtcttgtgagcagtcacctgacctttgagaactcagctctgagcacctgcaggtacttgctgctccaaggcacaaatgtcaccaccttgaagagctcaagccatctaatcaccatcctgctgggacgtggtaaactgtcagcttatcatgaaaggcatctgggcataggattgaactttccagtagcccacacttggcgtggaaaagctgaagaaagctatttctccctgtgcacaacctccttgtggctgttccaagcatggaagccaaggcctgtggctgtcagagttcagctagtgtgctgggtgagaagaaaccagccccagggctttatgcatctgcaaatgggatgggttgggatctttaaagtttcaccaaaagcagagtcaataggtggcactctcgctaccaatctccatcttgggcctgtgactgaacacaccaataatcttcaccaatgaatccacacaaaggtgcagatttcttttcagtgtgttgctgcaggttgtcactagcagtcaattgagattgatatgagcaacgcaacttctatcttctgagctatggtaaagaaatgtgaaactgggatagctgtgcaggtcaacctcccctgagcagatttctctcatctgtaaaaggaattggtcacaccagacaatccccaagatcacttatacttcctaagttcacgtgattctaatggtgggaagagagatttcaaataatatagttggagggagttgataaaactaaatatagacaacccatggttaatgtcagaaaaattcagaaacaagtaaaatgggtgaaggaatttttaaaaaatgcttttagtagagaataaagaatttacactctgctgaaatactgtgagctgggccaagaaccacagggaagcagagggaagaactcccaaaccaaatgttggatagcaggtcccagataactgcatgggaagggaatgttttaatcccactctcaacttcccgcctccttaaggtaggattaaaacacactgacaaaggctttacagtacggagaacagattgagacaaattctgcaaaacccggggattcaatggatgtggcagaagagaaacagtttcacatctctgtctgtctttcaagtaactgctctaaaattcttgtgtaaggaaaggagtaacaatatatcaagtcttatttctacatactcagaaacttattgtctttgttctgtaccatggcaattgcctcaaaagtggtgtcttttccctgaacctcggctcatccatcccattgaagccaaaggaataattctaatgagcattgtgaactctcctctgcttctcaaaaccctttaatttcacctttcccatcttctggcatggcgttcagggcccttcaaaatgagaaaattaccctgctcttttgtcaggggttacagacggccttccaacccatagtctccttctcttccctttcaagttcaaaaagctacctctgtgtaattgtgtaattggactaaagaagtgagcctagccagtagcagcaggggaaaagcttatgaagttatagcctagacccaggtccacacactgtattaaaccctgtactggggggaattggaaagtgagatgaagcagtgaatggacagaagtggaaacatacacaggaataaaagccataggtgtaagccacgagacagaagaagccaagattggaagaagccagcaggcagagaggagccatctcacagcagtgccagcagacagaatagagcgagggtggctgcactgctgtcacggtggggcaatggattagggagcagtgaacatgtgtatccgagggaaaaaccaagaggatggctcttgagatcccagtatgactccaagaacaaagttcttatactctgtgaggcctcattgctcaacagctgaaagggtttcttgtctgtcttacttcctactggatccttaaaataatctacaaatggaaatagtgttaataaatctctttcccttatatagactaaaaaaaaaagtaacctcaaacagcaacaacaagaaactaataaagatggcctaaccacaggacagcaggaccttccctccacttccggtgccatatcctgctctaacgttaagctcaacatcactcttccctgaatattttctatttaaacaaagtatctgggcaagacaagtgggctgtcagatgtcctgtgggctgaatgtacaaagcctgggcatgtttaaatgtgattatgactttgaatagaatctggtttactgaatgacagcagtaaagatttgtcaagtagcaacatgaaaaggtataaaatggaggggatatgtgttatattcaggattggagagggcagggagctgagtaatagcaactggtcagagatcaagaagaaaagagcaagaatactatttatcttcaaactttgcttagaggttgagtatatttgaaaagaaagtccctgttgagttgtttctgattagggacatttaagtggcttcgtagcaggatgaacaatagcaggcagttgccttcagggtgagatttaaggaggaatactaggaaggttgaggaggagataaatgggtgatgatcctggtaagaaggaaaaggggcaagatcagaagacaatgaagacaatgccagagctcaaaatccttgaaggagttttgggtttgagagggagaacagaggaggaagaaaggacaaagtactgcctgggctgacctagatgtggcccataaataaatcactgtactcagttttatgtagttttgctaggtggccacctgagggcactctatgctacacagctaggaatctttaattttccccctatcaagtaaactatatatatcctcaatttgctgaaggataaacttagctaatgctttaaagaagggtactcattgaaggtgggggccaaaagcaattcttcctccctattttttccctcaactagattaataaatgagcaagactgacctcaatttaaatccctgggtaattgcaaggattaaatacagtaacttcagttaaatctatttagcatttagtaggcacttaataaatattagctccctcccatatatatgcacatcctaacatacaaatttgccaaatacaggaacaagagaaggaacacaaggaggaatcgcaccaaccatttatctctctaaagaaggcagggctcagaagtcctaaaatgaatacaaagctaggctaggaaatcattccagagagcaaatttctgctgctcctttcattgcatgttgctgcttgtacataataaccagagggaatagaacacaaacagctgggaaataaagatgaaagcaaaactgtatcagcaggaagagacacacaaccccctgagaatcgagcggtgtcatgagagataagctgaacaaggccagctgcatggaatttatcttctgagagaaagatcattagattcctacccatttctgatcgtttctattggagtcaaggtggagaatgaaatacatgagccccagttttcaaagttctacactaaagtcctgttcctataatgaaacagagccacggacaaaagaatgcatcactataaaagccaactgtggaattttagatgtctgaaaacaaaagaaattctacttccccttgcaaacggagcaggttgaggtttccccaactcccgggtcctatgcagcatgttttgtggccttctgctgccctctagtgtctttttaaggtatggtaaaacataaggaggataaaaaaaattctcctaataatcctaaccagccaacaatgtgacttcagcccagggctggtaaaacaaacaaaaaaacagtaacattctgaaataaaagcaaaaccaggatttatacaaaaatttaaaagtgagttaaatttggcctcaacatagatcttgcattatttcaggactctgaaataatggcatctctatcagtcaatgcactttaaaaagaaagatgcctgttttctgtgcatctctctcaaatgattactgccttggttggtctgagataggatccagaaatatgaacttcgcaaacaccacaacatgattctcaagtagctaaagttggctgaccttcttttgagaagcaccaaagatggctgcaatgactctcagcaggatggagagtaaatctgatgttttctttaattctttaagaatacaatctattgaccaaaacaggtcaactttcatttttcctgcagctcagtgctacatgattagtatgcaaagaaaatactgctgtccatgtctgagcgaagagttcatgtagaagttctcctttatgaataagtccctctaaattccagcaggcatccaggtggaaaaaagaaaaaaatgcctcgttgctcttgctcacccttcaaatatccctcaaacattactgctgcaaaaaagccttccaggtggtcccagcttggtttcaatgccccactacagctccacagcacctaaaagtgctgtccttctctgtcctataagtgctccctcaacgccagtgttctcatagagacggagagctttgcattgcagaaaccctgttgtcctctttccaaagtcaatgctccataaatactcatgctctggccaatgcccacagccacccttacccaaagtggtgatgatgggagacaagacacatcaggccccacagcaggctgttctcaaactccctctagctgatggtgcacatgataagaggcaccgtgggatgactgttgccatcggatcacatacccaatttgttagctcaaacttggactaattttagaaacttgctcttacttttctgcaatgcagaaggtattattctatactaatgattagccccttcacatgggaaattcacaaacaattttaattgtgctttttaaaaaaacacaagtacactgagagttcattactatatatcttaatactatgtaatatgccatttttaagttcatacttacagtgttttttctttattatgggcaaagcctgttttatcttcagagttatccatcacttaatgctttaataaaaataaactctgaagtacttaggtgtgtaagtacccccaccagaaagaatcctagtctacaatctcctattaccttcacttccatttgttaatgaaaaataagcagatatttacttctcaggagacagtgtcctaactatctgaagaaatacaatccattgtctcacacggcttctctggaccctcaatgtgtagggctgtacatgccacatacttcaaccaattataaactgctttttttttagccattttaatttccaacagagtatccctaatttccagtgaagttcacttatacttactgacgtctcacctacacaaacagggcactttttgctttagctttggtgactcgatcagcacactggattttacaatctctccctttcttttgacaattaccacctgagcccactgtgcaaaacagggggccatgaaaaatacagaagaaaaagctcttcaatcagagggaataaagagaaagaggtttggcctgtaagaagcagttctttgaatttcattttattttttgagccaagctattagatttgtgggtacaaataagatctctttgaagttagcaagaagcccactgtgaaagaagggagacggccattaccacacattttatatgttgagcaaataaagtcccaggattcaaaatatattctgcaattacagaaagcaaaacacttttctttctcctttcaccttgtttagaaagagcatttttctctagaaagagttctgttgaggctgggtgcagtggctcacacctgtaatcctagcattttgggaggctgaggcaggcggatcacctgaggtcaggagttcaagagcagcctgaccaacacggcaaaaacctgtctctactaaaacacaaaattagccgggcgtggtggcgggtgcctgtaatcccagctacttgggaggctgaggcaggagaattgcttgaacctaagaggcagagactgaagtgagccgagatcgtgccactgcactccagcctgggtgacggagcaagactctgtctccaaaaaaaaaaaaaaaaagagagttaaattttctctttccagtttcctaactcccctcctccgattttctacattgagaataacaggctaataatactttctggaatgcctgttgtagtgttaaattagatgggatacacacatatattcttagtgaatcacaaaatgtgattcaaatagaaacttcagtcatttctcttctattattgacatgttttctcagcattttgtcacgtgcatttgagaaatgaagtatcaataaggaagagaagcgtatgttaagactttcttagcagctggtgaaagaagcattccgtgtgtgtgtgtgtgtgtgtgtgtgtgtgtgtgtggtgtgtgtgtgtgtgtgtgtgtgtgtgtgtgtgtgtgtgttgggatgggggatagaattcactgttggagacacagggtttctaagccaggctcaaactcctgttggtcagggacttaggatccaggaaaccttaccaaggaaagaaaactaataagctctataataagctcctatatatctggttccctgactccaaatcaattgaaaactgttgggacttaagtaacttacaaatgcctttttaatatcaagaccaatattatatttttctcactttttacattttaatcatgcatgcttccttaggtgctgcattttttgagctgttattaaaaatacataggttcctaccacattaaaggggagcagaggcttgtgtgttgtattgttaattatgtgctgaaaatgaaattctggtcagtctttgcagaaggtacaaacacacccctaagcaaaggattttccatgtgaagggagaccgtgtggtgcaaggctcgttgctctgacttaacatgcacttactcttgaggtctaagttcctggctccggcggtgatttgcgttgtgatttttgtgtcaatctttacagtgtggaggttgctggtgtcccttgatatcatcacgttgtgccactgattgtcattgagaggtttatttgagcttcctttgatgaggttagcaccatttcccaaatcaaacacgtaatgtaagtacctgggaaaaaaatgaaagaggggaaagtgccatcactttttaaattttgatgaacctaaagtagatattacaaatggagattttttttcaggtggttccatccttactagaagtcatgacaataagttacatagaaactcagctatcaagaaggtaacaaacactattctgtttcagcaaagaggattattcagtgttttaactaaaggaaacagtgaaaattatttttaaaatcatggtctacatttaactttatgaatttggaaagcaatatctttcaccacgcgctccctgtttccacaattccctccatccttttctaacacttaaaatggccattcttctcgttcttgcacttgcttttctcctctatctcgattccctgtttgaggatagggaacgtgtactcatccttcaacatccaggtcagatagccactccctgctccacatgtttttctaatttacctgaagagtctcctgagcctttgaatgtgatcacctcaagaaacatgtcacagtgcttttcttttcttttctgtttatgtgttcatctacaaaccctaggattgtatgttggtgtgtgtgggtatgactcacagtggtagaaatctgagatgtgcatacgggtggcagaagtatatatatttatatccgtgcatggcacctgatgtagcatattgtaaatatacaccaatatttgcagaatgagtgaataaatgctgaaatcaattaaaatacattaaattttcctcacagttttaaggcacgtttacacaaatcttcctttctaaattctctaaggcactctgacatagaatgaagtttgagttaaaagggtttttttgaaatttaaacaatctgagtacttgaattagctatttaatttagcatagactatcctacaaacctgtatcaatgcttttgtggaattacattgtgcatagtcaggaaatgcccatttgaattgtaacattcatgaaatgcctaccataaattagagcccaatgtaatttgtatctcatatgtgaaaatgtaggtgcaaaaaactgtcctaaatccatattaatttaagatacctaagagatgatttaaacaaatgccttcttatttgtcctccacctgctccggcccaccaccttatgagccagtatgttcttcttagtgtatatttttggaaattgacgtccatttttccaaagttttatttatttgctattgaacaggcatgtactcaccctttaactaattcaaccacaataaagtcatttccatccccactgttatatagaattaatccatctagggatgttgtcttgaactggaaaaaaagatgcatagaagtgtaggcttgcaaggtagctaaggcaacatagctcgatttggtcttgaaggtgacaggatctgctatgatgttcctgaagccaaatctggcattaagctcacagtaatctatgtcgccatttttacacaggtcaatgtatgccattccattaaatgtcaagctctgcaggtgtccaatgaagttggaggggacagaagaaagataccgtcgttctgtgatgatgccagtctctatgttatggaactccagcctagtatgatcacctgccatttgacctaaaagagaagataatatatgattattttctgtatctgaaaggcactttcaactttaggctttcataacaatatcacattctaaaatacaaggagccaaatccctccttggtactcagttgcatataggaagaacacttaaatgatgccaaaaggtaagcctagattatataataaaacattcttaggccaggttataatccctgtccaaattttagtcttaacaaaaaatatcctcattaacaaaagtaatggtatcttttaaaggcgaaaaataaacaaattagcaagagagtgagcacatagtaaaagaaggagagggaggaaaaaaggaaagaagggagagtgcacagagagacgcattaggagcagtgactattctcagtcacccaactagaaagtgatacatctcagcctcatggataggtgatgttattccttataaatgttcttccaggaaaaaaaaatgtgactatatattttcctatacccagtagaaagagtggagagttgcagccctttcttccagtaatgaaacatgaaagtgtgtttgaagttaaatatacactattcactttccctcttcgtgctcaataatgaccatagtttttgttcatgctagtcttctaaatacattagaaatcctgttgatttcttcacctatgcctttttttgtccttaagttttctataactaaatcaagcaaaatacactaattgaaagcttgcccaattttgataataccagtaaaattggcccaccatgccccataccacaaggcaaaaatcttctttaaacatcctagggtgaagcttggatgcaaatttatttagcaactgactattccactcagtcctcatttctctctatccctgcatatttccctgtcaaacccattaatagcaaacttagtcccatctttatctccagagtgatcattttacctgtttgcaaggttgaaggtaagataaataagcaaagatgtgaacttgttttctaaatattaaaacacaacataaatataaggtacttgtatcagtaccagtgattcacacccaacatcttgctcttgtctaaataaactgtcagtcactctcttctgcaactaaaaatgctcatttattttgtaatcaagttcttccacgtgctagcttccctgcccgatttgccataattggaaaatgtttcaagttacctctttccatcatccacattattaatgaaaatattaattagagctaatcccagaatcagcccctgagaaaatgcattgaaccttttccccaggggtaatgaagactgaacaaccacctatgtgtgtcccctttggccagtttgacaaatttccatttctttagtcaagacagtaaaatattagacagtgtttaaggaaatatctgtaagtaaaatttagacgtcatgctttttgttgtgcaacaaaaactgtttatatgtttgcttaagtgactttgatgattatacatatatttgtacacaaaactcccctgaactgtacttaaccctatttcattttcaaacactcttttttagtcttgatcctggaaacaacattctactcatccttggcatgttctcttttcagccattggtttgttctgattcccttcctgcaaacatttttaaaacaaaaatgtcaccataaataattgtttcgtctctctctaccctcactaccatgcctcctgattgtctatctgatgcaaaagtactattacatccttgtcaattctggtttctcctgtgacatcatttctatcttctcccccagttcttcttgttcaatgacctcaatattgttctgtggggatctacttctttggtaaaaaataaaattaatccttaattatttccaaatataaagctctaaagacaccagcaacattgaattaagaagctaagtacaatgaagaatatgagaagcttaaaaatcgtctagatgcggtggctcacgcctgtaatcccagcattttgggaggcctaggggggcagatcacctgaggtcaggagtttgagaccagcctggccaacatggtgaaactctgtctctactaaaaatacaaaaattaactgggcgtggtggtgggcgcctgtaatcccagctactcgggaggctgaggcaggagaatcgcttgaacctgggaggcggaggttgcagtgagctgagattgcaccattgccctccagcctgggcaacagagcaagactccatctcaaaaaaaaaaaaaaaaaaagtcatatgggctttgatatccctttgggttgatttttattctatgccacattaaaatatgagccttaactcagtgacccctaccctgatcctgaaactgtcatgtttcatcttaaagtctctattgatgaaacaaccaatagtaaaaaaattctgaaaaaaatatttctaacacttgaaattaaatattacctccagttgtcaagttcttaccagctctaaaagaggaaagaccagttaattccagactaaggagttcagtaataaaaataagacagtatatctgttttcctctctcaaaggaatagaatatgcacacagagcataaataataaaaaggtagtacaacagcattgaagcaactatggcccagttacaagataaaaaaaaaatataattacagtgatggtagatatatttgttcactggggagaattagcccccaaaagccattatttgatgactaagaaaatattaactgattgttgccttctttaaaaaattattttttctcagaattttactccaatgtttaatcctcatcagtaatacagccacttctactactgtagatatttgttgattaaataagaaaaaattataagacttcgaaggggaaagatttttaatgttctaatgatttaaaaatgcaccatccaaggaaaatttggaataagcaaaatgcctctgatcacaatatttaaggtataacagattgacaataatctccaacaagacaacaaccaaaacatgtttcctagatgctgtgtttgtatagaaatctcaatatttccaagtcaaatatttttaccaaaatagatagcaaggttaatatgtgctctgcgttaggttacatttctcatgtcgagcaaaataaccctcccttacatccacttgttaattcacttaaaattgctgattgtgtggtatatgtgtccggtgctagccttggtattggagaaatagtgttgagaggggcagaaagggcccattttctccaaactcatggtctacgggagaaaggcagacaaaagaggttaaggttgtaattaaatctataataacaaaactcagagaaatgttatgaatttgatgaacgaggtattgtgttggtaaatgtgaaatggaagaagatgccaggtttgatatttaagctagatttgaagaattaaaaagagaaagccctgttaagaattggagaaagggaatcaagggtggattccaggaaggggagacggatgaaggaaggcttttggataacaaacagctacagagcatggctggagagctgggaacaagtaggttagtgacccacatgggattgaaaggagcgggagcgccagggtccagatttctcatagtgcttcttacattcagagctaaggaggatttgaagcaggggttaaccatgactcgtgtatgtgtgtgtgtgtgagtgtgtgtgtgtgtgtgtgtgtgtgtttattccctttgtgggtgcaagagattggagagtgaactagggcagttatagtagaaatgaaaatcatcaacaaaaagataatttcacagatataatttccaggatttactaatgatgagcagaatgaaggaagggaatgatgatgcctggctttcaggcttgggtaactggatatatggtgaatgttgttccataaaggacatacacacacagattaaaaaaaaaaaacacaattctagatttttacacagactggatgatgaattgaagcccagtgacttcccacttagggattccacaaaatttgtacaaccccttgtcatctatgacctaggaaatctccttccttgggcttctctgctggcaaatactatcctcacgatcctaggtgaggtgcaaacattcccaagaacagcttgagtatgtactgccctgtgttcaacagataactgacttaatagaattacgataaaacttaaagatatgggaaaatgtaggactttgcatgaagagtctctagtaccttccttgcagaaattcttctcattcagtgatttctgacttgctgtaaaatttaataagaaactcccattgcttctctgatttatgggtggcttcaagtggccactaggatatttgaaggaaatctcaatctaaagctttcattgccacatttggaagccttttatgtactacgtaaatcaagactgaattattcttatgaattgttggctttcatgagatctctgacaaaatagaagaagaaggaaggaagaaaggaagaaagaaaggaaagaaggaaggaaggaaggaaggaaggagggaaaaaataaacaatttacccaaggtatttaaaaaataactcagcatttgatgttaagtcttaggaaggaagaaatgagacaaacagtcgtaaagtaatcctgacttatttgttgccttcaactaagaaggcagaactactataactgccctagttcactctacaatctcttgcacccacaaagggaataaatacacacacacacgcatacccacacacactcagacacacaaacacacacacacacgagtcatggttaacccctgcttcaaatcctccttagctctgaatataagaagtggtacgggaaaagcaattttgaaactattttagatgcattattggattaagcaaatcaataaatgacattactgggagccaggattctcatcttggatgaaaacatatgaaagtatggaatgggaaaaataacgaaacaatgttgtaggtatgaaggtagcagtgtaaactcacactttataaaatgtgcattatgtgtatgtttatatgtacatataatgtatatgtctgtgtgtagatacatttacatgtatgtttgggtgtaggtatatatacttgaatacatttcttatctctgtctgctgaaggggtcaagtagcaatgataccccagcagcactgaggtcacctaccacccaaatcttggtctgtatcattcctcactaaatggaaattaaatggctaattctaggggcgaagtgtggtagacaaaagttgtacctggaacatcctgttattccgagaagtaagaaaagggccaggcacggtggctcatgtctgtaatcccggtactttgggaggccaatatgggtggatcacctgaggtcaagaattcaagacaagcctggccaacatggtgaaacctcatctctactaaaactacaaaaattagctgggcatgatagcatgtgcctgtaatcccagctacttgggaagctgagacaggagaatcacttgaatgtaggaggcggaggctgcagtgagctgagatcactccactgcactctaacctgggtgacagaatgagactccatctcaaaaaaacaaaaaaaaaaagaaagaaagaaaaaaataagaaagcgctaaaaaaataattggaatgaaggcatgtcatgagatcatagaggccaagttaatgaaactcacactggcaaaaattgaaaaacatttgcgcaccaaaatcataagatagcgtaattatgaagtattataaaaacatagcaatagtgggtctacaacaataagaaaaaaaggaagggaggaagaaagaaaaaaagagaaatgaaaagaaagaaaaattaaaaaaaaaataggaaagaagggagagagaaggaagagcccttgcttacagcagaatgctaagcattgactgtaaatgtggaaggagtgctggagtttgaaaataatcattttttgtaactctcagagtaaagattgaatcaagcaaaactctgcaatagatactaaatctagggcaaaattttgatgagttacaggatatttacatggtcttaatgtctccccacagacagtttattagttgaaagggagaaaacgtagtaattatacaatggagaaactggacaacatgttgaccaagtggtcaaattaaatcaccaaagacatgggcagcgtatgccccagatgggatactgtatagaggccataacatcaacaacgcggtatttcacccaagaatgtaaaatatacattcagtcatgaggaaatatcagataagcacaaactggtgactttatattaatacaaagcaggaagagattatatacttcaacaatgttaatgtgatgaaaaacaaataaagtttatggaaatgttctagattaaaggaggctaaagaaacatgacaactaaaaaaaaaaaaaaaaaaaaatagctggccctagactgcgcactgtgctggaggggaaaaatgcttattgcgtattgataacattgaatcaactgacaaagctggaatatggattacagattagaaaaataaattgttatctatgcaaactttactgaagtcagtggcttttatttcttaggcaaggggatattcccatttttaaaaaatacatgctgaagtatttcgggttaaagggacactgtgtatgtaacttaccctcaactggctaagagaaaagttagagagagaagagacagtgagagagcacaaatgtcaagacaaactggcttaaatgttcacagtagtaaaggtataagggtattctttgtattatttttggaactttttataaatttgaaattattttgaaataactttctaaaatacatttcttaaaaaaaatgtttttcaccattcttttgttttcatcctgctacatccaccgcagtacaggacttattactttacaccctagaccatccaaaacactgccacagaattaatttcgctcaaaacatattttctccacttactcttcagtttaagtgcagtgacttccaatttcctgaaagtctacgaaatataaactacttcatctagaccatcaagtcattggcctcaaaaggccattctagcaccatgcacttgcaagaagcaaaataaagcttcttagttccctgaaaattattctagccccaccagcatcattctttcttgtctggaattctttcttgcattatcctttctttaaagcctagatcaaacattatcaattgctttaaacaatacccaaaaccaagttccttaacttctcttctgaactccaagactataaagtactcaagtcaaccattcagtagttcatctgttactctatgtaacatatcaccctctataataatctgtgttttatatgtatgtatgtatttgccttataatatcatgcattgtctgataaaatactttctatagagccatacacttactagatattgacaaatataaagcaagggacggtaagtcaaaaaccaacaaaccaaaacacacaaaacaaaaaaataaacgtaggttctctcctcagatctcgtaacacattccaataaaacataattcacttatcctcttcgagtgccacttacctcatctacaaaatgggaatatgtgtgtcctatctacttcataggactctaatattcaagaggcactcagagattttaaaatgttctgttgtagttctggcatgatcttgccgttggcagctgcctcttcccaaactcttacatgtgaccttagatactaactgttcatttccatgccttttgataaaacccagttgtccaaactgtggatgctgatctaagaaacaattcattcctcttcaaagaactgtcctagaccaaaactaattgaactccaatgatactcttctgccctgtaaattttttttaccttcctttcctaagttaaggaacgattgtttcaaaagtttaaaatcctgtaggtaatatatccacattgacacagttgactgttctctgggcatggggacctccttcgaattgaatgaacagacacgtatccactgtacaaggaccattttgtgctttttaccagaataattaacatggctatctctctgaaaaaagaaaaagcagctaatatcccagtgggtcacgtgcttggagttgttttcaaagtaaataaaggcaaaaggatttttcttccatgaggctttcctatgtttctagggtggacctgcatacagctcacctcaggaatctaaaaatgggggttgaacttgacatccttaatattagaatttaaccaactgagctgagtggccaaaaataatctattatagcttaaaatgaaaaagtgtttcatctgaaagccagatagataaacgccagtatatctatcatcttacctagaagttaaaaggtaaaacttgcagttgttcattgccaaaatatatacaaaacaaagaaactcaacagaaattggcatctaaacatgactgcaatatttgatgaggcaccaagatatttatcaggccacaaaagaaaatatattataatttcttcttgcactattaaagggccaagaatatgacataaaatgtgtcatttttgaggaaaaacacctaacagactgcttatttaataaaatagttactagaaaaaaatagaataaaaatggattgtgtgaatacatttcaagttgtgtaccagccttggtgtgcaaaaccacctgcaagaaatgagagtcaaaagcgttagcataggaaaagacaatgggacagaggtgtttacctgtcatggcctgttggtcatccactgttaactttaaactttttccacgccgaactacacgcactgtgtgccactcgttatcattgaggttatagccagcaaaaagagtctcgggacctttgcctgtagaatatgccaaacagtcattatggacactcagaatcagtcaagcaaatgaacctcacagagagtgagagaaagagacaaggggggaaggtgagggagagagaggagagaaagaagaaaggaagaaagagagagaggagggagagaaaggaaacagagaagaggcgggctggaccaattttcaagcccattagagtcatagcaagcaaggaaaatgacaacttttacaaacattcaggtgtgaccatttaagaatctttaatcctacgcattgatccataacaagtgaattaacctgctgtcataaataggcacagtcaatacagcactgggaacccacccaaatttacacacacatttttaaaaataaattctctgatttttagttaccactttcctgctaacaaagtgtctagccatcatgtaacctctgagctctagaagacatctgactgtagcccattagctaatcgttttcagtgagataagtctcccagtagactctgggagaaggtactatcttgtgtgatggcggctattccgctcttatacctggtacctccagtgctcaacacgttcttaggttctttagcctcctaaatttatggaatgttgagtctaaaaaacacatcgaaataaaccttacaactaattgacctgtacgtcacaaatctgtctgtgtgtggcagaggcacttctggcaggtgtaggtataagtattgactcacagtaagtggaccgaagaaaaggaaagaaaaaaaaaaaataggcacagccaataaagggccaactgttgagcatgaaggaaaagtagtgatattaaacaacagtagagagcaagggattaccagtgggcatcgagtgggcaagaagtataactgggaaagtaactgctagtgaatctatataaacctatgcaaatgaaatttaaatggactcagcagagacatattatttcagaaaggtgtttggtagaaattattgaaatgattaagttagactatatccgtcacctcaaaaaaaaaaaaaaaaaaaagcaagggaaaatgcttttaacataaccagatatttttatttaaaaaataagtatttctactaatctgacattatgagtcattgagaaaaaataacattaaagatacattgtttggtaatgaattttttccctggtgtttttttaagtatggaaacatgctggtacattaaaataatgaagggcattatatcattgagtttcatgtctttcaacgaattgagaatcaggattggagttcacaatttgtttaaccaaattctgccagcaaaaccaattaatgcccaaggatcacgggaggatatatgagaaagtaaagatacaggccaaggagaagaagaaaaaaaaagaggagagcaagagagatcgagtaagagacagagaaccaagtaaaataaacctcagttttccatccacatgagatcattgttttctttcagaactacaccctatccaccagcctattgatttctctcttatggtgctactaataattcaagtgttgtatccttggctggtgtatctcaggttagaaatgagccagtgatatgagctaaattttaaaggatgaattgcctcagttatttatatctgtttgtatctttagagaaattaaattacaactccagatacatgaatttaaaactattctagatataacagttttaagagattgatggctaaataactagagaaagcctgctagtccagcaactgcaaaaatactttgagatcaaatgttgaaagcaagttccaggatgaaaaaaaaaaaactctttctaaattcaatagtgaagaaagaagtgtttaataactctgcagcatcttagcatcctgctggcagtaagggtcatctttcattttgatccttgaaaagagaacatatcattttagagctatttttatagggaactttttttttttgttagaaatatgtgcttttgaagcagcttcacttctattcttttcttttttaaatatattttgtcaaggaaaggaagcatacataagggtgatatcatcgttataccccatccttggcttgatcttgcagtaaagtcataatgcttaatctatgcaacaactatttccataacaacaggcataaaatccaattaaaaataaccctttggttcataaaaatctctgtgcgccaacttctagctcctttcatgcattattaaaattgtgaacagattgattttagaagataaggtttttaaaaaggcacttaatagtctcacttcaacacaatgttacccatgcaacatgaagtgtaatggaaagtgcactagactgggagttaagaattgcagttgctagatcatgatttcctactaaaaaagaagttgggggttgctgagtgcttattatgtagcaggcactttgtctgttgtcttgcttcacctttacattattaatctgcagatgtgaaactgaaggcctataaagctacaactacttgtcgccaggtcacacagctaaaaagtggtagaaccaagtttcatccttggcctgacctactcaaagcctgcatgcttttccctgcattattcagcctcgtagttatgagaatctttggctaacaacttaatttctcactttccccatattggaacaaaggagatggaaaagatcctctttgtggtgactcccagcttgccctacagaatgatcacactgctagcaaatcctacacaccctctgcacaagtcctggtggaagcaaatctctaagtaatacaatgtctatctagggatgctgaaatgactgttcctaaagatatgacacagaagaagggacatcattttaggacctgtctccacccacaatcagcaatttgctaacacactcaacttctggtggtctcagcattcccatccataaagtgaggagagtttccagctgatctttacagttcctttagaatttcactttctcacagaatttaacatatacaaacttgttaaagaaagatggtttaactgttgaaattttgaatttgagagtttgtcctcttgctataattttaatggcaaaattatagtaacttcaagctgttaatgacctttcaggatttcctttcctttgggggatatcaaaccatgcatcagttgtgccaacgtctttctccctgcatcaatgtattacagacttaatgtgtgtgtccctcagaattcactatgttgaatttctaacccacaaagtgatggtatgagaaggtggggccttcaagatatgattaggtttagataagggtggagtcccatgatgggatagggccctcacaagaagtggaacaaacaccagagcgtcccctctgccatgtgaggatacaaagagaaggtggctgcctaccagccaggaagaaggccctcaccaagagccaaatctgctgacacttcaatctttgacttcaagccttcaaaaaactgaggtgaaaaaaaaattctgttgtttaagccatccaatctatggtattctgttgtaacagcccaagaagactaacacagtgggcaatattttaaagacttttaagaaagtctatagctggctgggcatggtggctctcgtctgtaatcccagcattttgtgaagttgaggcgggagaatcacgaggtcaggagtttgagaccagcctggccaacagggtgaaaccctctctctactaaaaatacaaaaaatagctgggtgtagtggcaggaacccgtaatcccagctactcaggaggctgaggcaggagaattgcttgaacccaggaggcggaggttgcagtgagccgagatctcgccattgcactccagcctggatgacagagagagactccatctcaaaaaaaaaaaaaaaaaaaaaaaaaaaaccacaaaagaaaagaaagaaagaaaagaaagaccatagccttatgtctattaaaagacatcattccttatgttttgtagggagttttgatttgtttgtaattttacacttgatttttactgtaacatattatttaagccagatatattaatttttcattttatagttaaagaagcagatttaaaagtgttgagcgaattattaagtctcaaaggcagtaagaagtagagagaagactgagattttgaaattttctattttcattaaaatgtgttttccacagaaaatgatctgcaagtagtgtaagaggtacaacgggactgaatgcccccagctaatatttcaccagaccaggtcagaattcagctctacaggctaatgttatattaaagaattttagaactaggagggacatgagaagtgtagaatttcaatcatcatctacaaataagaaacatgaagtgcaaagacattagatgacgtccccattgtcacaactgttaaattaagaagcataggtctctagactctcagtctaacaagcttttttttttttaattattattaagacagaatctcgctctgttgctcaggctagagtgcagtggtgcaatctcggctcactgcaacctctgcctcccaggttcaagtgactctcctgcctcagcctcccagggagctgggattacaggcacccactaccatgcccagctaatttttgtattttaatagacatggagtttcaccatgttcgaggccagtctggtctcgaactcctgatctctgccagccttggcctaccaaagtgctggaattacaggtgcggaccacagtgcgcccagccctaacaaacttttaaaaaattattctgttcattagacaatgctgatttagaatgaatttctcaaggcacaccaaaatctgagtctgagtttaataagtctgtcagtgcttgtcaacagagtttgacctaatctatggtacaacagccaaattttttggctggtgatattcactgggtttgctggtgaccctgtagctaaaacctattgataacagatggaagtagaagcagtaaacatttcagttttccttaattcagtgtaaattgagtgttcttccacaacctacccatccataaattcaaggtgtctctaagattaactcctaagaagggctggagttaaccctaacttgaggcatggtaccgacagaggaaaatgtgtgttagcaagtatatgtgtgtatgtgggtgtgtgtgtgtgagagggatagagagagagacacacactcaaaagatggtagatttttggccattttagtaaccacatttgctaatgacttttacttccattttcacatcaacatgattcttaggtttctttaaatattagtctcagaacaaaggaaatttcatgctataatttgtagttatgggaggtaatggtaaagaaaattggattttgtccccagtctgtcatcaactaattatgttaccttgaagacgacatgtattctctctattcctatttttatctgtaaaatgataatcccatataaaagcatattaaaaaaaaaactttcctacagccaacttcaaactattgtcattcttagaaggaccaaaactacctcgcggctacatgaaagagtgcaatgttatagtgaatatctctaatggtgcaagctttttatttttattattactgttactaatttcatcacttttgttttggcacagtaggcagagagcagaccaagccttaaagaggctcttctacccaagaattactacactcaagtgaagccagaggacaatattaatacgtgctagaaaatgtgtttattattttatatagtcaaattttaatggtgataacttttttcttttgacaacatgtaattatgttacaactatttttgttaatcactataaattttgttaatcactataaattatatttgaaagtactgaagcacagactactaagtgaatgtatttaagaaagaaagaatagcattcaagggatgcatagctatgctacttagtccagctctccttttacagacatctccatgggaggttagttgccttgcctctgtcttccttgttattggcaggatgaaactaatgcctgggtcttgaacttatttaggacctaacatgcattacctaattgtctggccaaagtcagagagggtaaacattctttgacctttgcatatcattcctttccctatttatatttttacatattcaaaaaatattgttctaaatacattttaaacaaacccacctgctttggatagcagaatcagtacaatttacaaagaacctcactgccatacacagtttcggaagcagtgatgaaacgggtgtgttttttcacatacctctttacatttggttcaaatgtagattctcatatatttcaggggagatctgcatgcatcataagaaaagcttgaacttggttgagagttatataaacttggatttgaaagcaggtattgcattttctggttgcttaggcttgggtatgttagcttctttgagctttccttccatcatctataaatgtgagataataatgcctaccttatttcatagatttgttgtaaggactaagggatataacaaatctaatgtgtttggtgctttgcactttgtgtaatctcaatgaatattaatttcctttctctcctttttatggaaaataagttaagtaacagtgcatgagttctgcaaaccaccaaaggatctaccattaaaaaatggttgacagtcaaatacactatacactatataaaaatgtatattgaaagaaacatccacaatttttatttgaacacgcacactgcagtctagttttttgaaattaggcctcccaaagtcaaattttttggaacagttgccattttaacctgagatttcacagtatttgtgtttggttatttaattcctaagcattcaccctgaatataaaaataaatgtaaaatacacttgcaagggaacctgaaatagatcaataacgacatgcttaatcttgctgggttaaaataagatgtacatgatactaaatttggatgctttttgctacaaagccttctgtgcaaatatcttgtgaacaatttatactggtttatgaatgtggagggaaaatatagtgaagagaaatagagaagaataaaacaaagctgagaccctttcaagcaatggaagcaaagacctctaagagacaaaactggcagatgcctctggaactgaaaggtggatgtagctgtacagaaacttgaaaaaaaacaaaaacaaaaacccatagcagttatatttggagttttaaactcttagatgtatgtgccccaagtgtaaactcattgcatctctacacaccctttaggtagctttctccctctagtggtgcatatattttaaagaggttaactacataaatgaactatctttatggtgtaccctgcttctggtatatatatactctggtacagtgcaaaccaattggttctaaagttcactttatttgtctaacatattcattgtaatttctactttaaaattctacctagttatttcagtggttaatctgacttactcaattaaaccatttatcgagcatgaagattttgatgggtatttctgcaaaaccatcacctaacaaattgcacagatgatggacaggcaggaattttttaaaaatactagaatcaccttatatgtataaattggttctatatttatacatgattgttcaatatatttagacctacagcacctggtaattgaattaggaagagaagttacagtaccatagcatctgagaattataaaattttaaaactgaatggtccatattgtgtctgttgtttatcccatttagctactcatttattctgggttccatggcacccatatgctattaattttgtttaaaatttattttgtgccaaataccgatctcagcattgggaatatccgagttacagtcaaaggaacttacattctaataggtcagaagtcaaaacactttttctgtaaagggccagacagtaaatttatttgactttgccgaccatgtgttcaccattgcaactcttcaactttactattgcaatgtaaaagcaagcatagaatgtatgtaaacaaatggagtggctgtgtttcagtaaagcttcattaaaacagggagctagcttgagagctatagtgttcaagaccctgtaagataaacacgtatagataatttaaacgtttcccataaattctgcattgcatattaaagaataacagaaacatactcaagaatttaagtgcgaggaaacctgagttttagattcgatattgccactaactgtaacataaccttaaaaatactaattctcctaacttttttactgctgtttgttttcttaagaaacaactaaaatcaatttttaaaggctttaagcccgggctccccaccccccaggccacagacaggtaccagcctgttaggaagcatgccgcacagcaggaggtgggcagcaggcaagccagagaagcttcatctgtatttacagccgctctccattactcacatcaccatctgagctccacctcatgtcagatcagcagtgacaaccgattctcacaggaatgcaaaccctattgtgaactgcacatgcaagggatctaggtttcatgctccttaggagaatctaatgcctgataatcagtcactgtctcccattaccctcagatgagactctctagttgctggtaaacaacctctagttttactgattctaccttatggtgagatgtataatgatttcattatatattacaatgtaatagtaatagaaataaggtggatgatacatgtagtgaaattcaattatcctgaaatcactcccgtctgtggtaaaattgtcttccatgaaaccagtccctcatgccaaaaagtttggagaccactgctttaaatgacacaaatcaattgcaaagtccttctacttataaaatctaggataaattaggttcctttccttttctgcaaatttagaatagaaacattcattaaatgcttggggtgtgtgtgtgtgtgtgtgtgtgtgtgtgtgtgtgtgtgtgtctgcatgcacctttgttaaaaatttggttattaggtttctacgtatatcaacttttccaggtactaacaagttttatttggcagttgactttggggactgtagtctctggggtgaggcaggaccttgtgagaagctggaagcaagccttgtcattgtgacaatgatgagaagatggaagcaggagctaccactgcttgatgcctgagtcatagttgctggcagcagtacttcctacctacaaatgatgagaggatatgtttcccaggttgtaattatgacaccttcagcctactatttgactttcccattactttctggttttaaagtaatctgtcctccagttaaaaaaattcaaaggagattaactcctcattacaggtttctattttatccttctcaatttttaggtattgagttgtgagtgaaacctgtttgttttaatttttcacaagaatcagctagaacattcaattacaaattaaatttagacatgtaaatggcacttctaaattttcctttttctgcctcttaacattactagaggcaggatgagccacataatttgagagtccattgcaaataaaaatgtggagtccttattcaaaattaagaatttcaagatggtagcagtggagcattaacccaagcacaacacaagctcagcatatggcacggtgtgactgcataagttgtatgctgttgaagccagttctttttaggagtataagttttgtgcttatttatttttgatgcttcctttagtagattctacattcaggaatgagcagacaaggctggaggcaaaattcttcatttatctatgtgagaagcatagttgagtcaccttccccagagtatccacacttaatgacatggtctctggggtatcagagaagctgtctcaggcttgttttgctggccaggcctggtgccaatcatgaactgggcttggtgatacaccaataaccctcagaaccaggaagcaaaactacctgctgacccatgtaactcctttctcttttccttctctattcctcctcaagtgctcctcaatttagccaaggatatacccttgagaactattcagaatgtcccataaagagatgcttgcctccttttttttaataagcaaagagatagagtcctaaggacagacacatttctttatgctaaaaatactagaaatactcatcccagttaaaaagtactttgactaaatgatataaagtcagacattcagcttgatgtttgtttttcaaaaatgaacactaataacagagaaagacattttataaactttaaaaaatccactggagaaattaaatagtcatgtgctgaccaactatattgcatttattttttgacccacacagactgttgagttttatcctggttctacaagttattagctgtgtgaccttgagcaaccttcttactttctgcatgcctcagtatcctcatatatctcataagctaatactagaaacaatgtaaatgggtttcatgcatcttaataactcaaaactacttttaatcaaaggtttaatgcatcttaataacgcaagaagcttaccataatctgatttatggtaagctttcaattatagtagtgataaaagtaactatcatcagtattatgttgtcatttttatcttctcctcaatgagtttaaaatctcagagaaaatatgatatagctcagtgccttgaacataacggcaattcactaagtatttgttgaatgggtttatttgtgtaaactttgtgggacttttttttaaatggtagatgaaataccccttgatattaaattaagccaagtagttgatgaaaagtaactccatcttttaatgcctccattcactaagaaaggtaaatataaagaaaactctgtcctcctgttttcatatttagcaggatggaatttggtaacccctacagttggagaacttgagtaactcagttatctggataactatttggacagctttttcgctcagttacattgaaaataaacttcatgatgcatacagcctagtggaacaaaatgacctaaggttagcagtgaataacttccgagtccaaaggaaatagttggcttagaaattgggggaactcaaaacttactgagtatttaattataaaaaaacacagatcttgtcctcaagtggatgtgaccttggagagttgttggaaacaccctccagagacttttctgccattttcctaaatgatagcaaacttattctattatctacaaaataaatttcagtatttctcgatgcttcacctcctgctctatttcttctggcctataaatatcattgcctatgcaaacgaataaacaaggttaaaatcacctacttcatctactaagaaacattaagcctctgtagttttgtcattgattgtacccatttatgacagacaaggataaatatctcttatgtaaatatatttcaatgcgaaaaacatacattttaagaattataatttactttttaagaagagaattacatttacaacacagtaaaaatgaacacaaattaaataaatatatttctagaaaaaatgttctaaaactagcaatctttaaatctaatctagctcaactggcaagtttaagaagtataataaaataagcctaatacaatgaaagtaacaattcagactgtgattttatttttttcaaaaggtcaattccaagggatgcttatcacataacaggacagctagcagatataaaattgagtactaaatagttcaatttgcttttgagtaagcattaaaaactgaaaatgtattcagtgtttgtgtagtgttaaagaaaagggttatactgatttatagtaatactcatttaatgtattttctgcaatacatacacaatgccaagttgtctgaataaaaaaaaatcaaaaagcatatgggtcctgagcatttggatatttacaaaatgtaaactgatattccataaacgaagccatggattatagtcacaaatgcatttttttaaaattaaatatatcattccatgtctaaatacaccactgtaatagttatagcatttttttaatgaggtcaagaaggatgtacattttttcataattcaagatcaatgaatttaccttttactttccatttcttcttaacataaggatagctgaatattattaagtacatgactgaattcacaaaatttagttcatcctcagtatttttgagatattctagtataaactttttccaaaagtaagaagcatattagagaaaaaaaccctaagtttctgcctttattaagtttatttattttttcttcctttctttttactgggaagtcattataatgcgtagaaatctatttctcagtattgtcaactttatggacctatttgcttaaagaaaacaaattctaagaaatgtgacaattgatgaatggtagcatctcgtgtcttgctttctttttgtttctttacataatgattgttcaaatgaaggctatggacaaactgtacatgattattaatgcattcatcatgtgaacattcgaatgcaatatattttttctaagcaatgatataattattagctaaacccttctttatttgaattttaagattttaatgacagtgctaacttaattgttttctttaatcatcactggattatttattaagctagcttttagtcagtggcttgaattctatgattctctttgaccatttattttagtaattgaaaaatattggaattaattctttgaagttatctttgggcaaatgtcttctgaaatgaatggctcaccttatgctccaggaaatgttctaaaatggcaattgtccaactataacaataacttagcaattaaatcttaggccaaattaacttggtttatctgaagagacagtgtgtgaaggttccttggaactggtcaaaccactgatagaaatgttgagttatgtctctgtgcctgtttctggttgatcttcctaaggtaagattatgttagattttctattagtaggttacagtcaaggacgataacttatactaacacatctagaagcatcttctcatgtgtggctattcaaatctggtttatttctcatgatcttgttcacagatgctcccaaccagttatcatctgagaaaactgagatcactgaagaatcatggtataatttccattggtagacatatttttcctccctattatatgttacttcaactggctcagtgacctggaattgctttatataaccttggcataaaatctaagagaaacaatagattacatttaaaaatattgtatgttttaatcaaagacaggacataatgtttacaagatgttgctaaaattagagaacggggtgcaaaacattcctataccatggctctatatttttaaagaagcacatattataccatgtgttatatattaagtacataatgtgccaagtattatgtgctataagggcatttaagacattaataaaacttttctgtgaaaattgaaatcctaggctacttttatgtattttctgtttcctttagcctccaaatatgaatactatttctgattaggaacaaaatgttgttctgaaagatattcattctattttgagagtcaaaattagtaggaaatttagcctgtaaattaatttaaaatgtacatgatgtattacaaatatatgatctagtgtagctttatcctaaatattggtgggattggtttaaattatattttacttttacccacttttgattttttaatcacaatagcaaagaaaaaacattgtagaaattatagatgatgaatagaaaaaaaaactaaaaattacctcaatctcaccagcagatataaacatttagagggatatacttccagaaacataatagaaaagcaattttgttatgaaggtcccttgcctgttccataattgataactcaaaaaaaataggagatgctgattacttcttcactgcctattggctgaactaattttacttaattgattgcataaagaatttcttgattaccaatatattatttttagcagtataaaatttctcagttgatttattaaacagaatttattttatggggtttctacaatttttatttattgtactcatcataatggtctaactccatatttatctgcctatttcaacactattaggtgaatatgtctgactactaagagaacacctgcattatttgatttaaaaatttcttttttattttctttactagaaacttataattcatgaaaaatctgtaaaaacaactttaagacatgtcattacagtatgtttgttctataatattttggttttaatttttacatgcataaactacttcctttgcgcctactgaaatgtaaaacattttagaattctttaagttgtatagaagttcatacttatttacactggaaacttcctggttccaaagctggttgatttctccatgtatttgaaaatttaatgggtgcacttcactagaaacctacattcttcgtaagcaacatttaaaagggattttgttaactcatatcttaaatcacgcatttcaaaagcaattttaaccataacatttatctgtagaaaaaggcaattgtctttgaaatttaattaatttcaatagtactatgcataaaatatttcgagtctgtatttagactgatatcctgggaagtgcagttggagagtgaagaatttccacaattgtatgaatgatgaactcaaagaacaagtaataataaacaatccaattttaagtacattaaaaataaagtaatttagccttttagtatttcttattcatcttcaggaaaactgttttcataatgcatttcttatccatcttgctttttgctcacattgttaataagtaaaagaagtggataagagttctgagcacacaaaacatttcaatctccaaattctttgaccgtccccatgatttaaagagccttgcccacttgacttatgtaccacatgttagccagtaatctgttgaacagattgtaattctcatgggtattttatagctaaactgaaaacaattttcagtcagacaacatatagaaaagatgcttgtgtagaaagcttgctgctcctacatctgctctgaggagagtgtatcatgtggcctctattctaatgacagctatttggatcaccagtggatccaattggatccagcaactggatcatctgccaccaaaactaagatctggtgagtagcttatggggcgacctgaactgaaagatttgtccaacgggacaaggataagtaatagattcactagattctctttctagaaaagtcgaatatacaacatatagagagtatacagccagtgaaagggatgacagaaagaaagagagagagcagaaaggaagaaaaggagggaggaaggcagagaagaatacagtaaaggaaggaagagaagaaactcaaaacaatggaggaagtggggtatgtttagaagcagctcttcataacgacaacaaataaaaacatctggccaacatgctgtgttctcttagatttggggatatttgtataaaagaaactcccttttcacagaaactaataagagaatatcaagtttagaatgtttcttctaaaactttcttggattttataatactttttacctaggcaattgttataatgccgactctcaacaattgaagagaatttgatcaatttggtcaacactcaagaatgttgcattactttgagagtctctgcagtatcaataatgcttaacgtgaataaattaataactgtgcttggtttcaacatgcattcttaaactgcacaagagtagtttttagaatatcacagcattttatatttgcatataagcaatcagtagattaatcattcactaaaatagaccaaagcaatctacttttcaaccactcacagtatcattctgttgcctaatccatgtagtcatctaaatatgcaatgaaagctgtattcttctttacaattctcataagtttaaacatgtggataatttaaatgggcttccatttattcatttatttttattcattttttttttttttttttttttttttttttgagaggagtcttgctctctcacccaggctggagtgcaatggcgcaaccttggctcagtgcaacctccgcctgccaggttcaagcaattctcctgcctcagcctcccaagtagctgggattataggcacctgccactatgccctgctagtttttttgtatttttagtagagacggggtttcaccatgctggtcaggctggtcctagaactcctgacctcaggtgatccacccgcctcagcctcccaaactgctgggattacaggcgtgagccacagcacccagcctcaatttcgatattattctaaagactcattgccatgtgccaatacactgcctgtttttatttgttttctgtcagaaatctatgttcattctttacattttacatgcaattttttttgatttttgctgaaaataataatttataaactttcttttcattcccttcacatatactttaagtaaaacaacacagaaacaacaacaaaaaacaacgagacttctgttttctttatttatactttgaacttcccttattccttgagcagcttctatcctaggcaggtggatagcaccagtcactgacaggcaatgactggcagaactccacaaatcaagtgactgctgtgtgaaggcagaggcgaaagactcccttttacagttttctgctctcaggcatcaagcagcgactctaaactgaatatttactttatgttaacaagctccagcccctagaaatttcctcatatctttttaagtagcttctcaaatggcagcctgatcaaagcaatctaatatggcttaagtgccagtggttgacattttgcattcttttattgctttccatttttatctacataaaaattggtgataactaatatccatttgatcttttcattctggtaataaaatggtaatacaaagatcttattatctactccagacatccatcaaagtacatttttcaaaaatatactatgtgaagtgtttcttccctatacccaagtcaaaagcgaggtcaagtacttgtccttagatgccccttctctccaatacttgggcactggactgcaaataggaattgaacttcagcccttgatgctttgttcacactaatgttatatgtaattgtgttgtctctgcctcttaaatacactattttctgtgagaagccaaaagtacttggaaggtctgcttaaatattttttttaactccagagtttttattcttctaagaagacaagaaaaaagataacggaagaaacaatactggaaatgaagaagtaagaagagtgaatcttaatagaaagaaaggaagtgcaggtaggtgggagaacagacaaatgtaataaggcataaagaaagccacataatgcaaacaaaacaagccccagagatcatgagtttattaaatctatttttatatggatgcagaagtgtccctgaggacgggtgtggtggctcacgcctgtaatcccagcactttgggaggccaaggcagacagatcacctgaggtcaggagttcgagacgagcccggccaacatggcaaaaccccatctctactaaaaatacaaaaattagccaggcatgctggtgcacgcctgtagttccagctacttggaaggctgaggtaggagaactgcttgaatctgggaggcggaggtttcagagagctgagattgcaccactgcactccagcctggatgagagagcaagagtccatctcataaataaataaataaataaataaataaataaataaataaataaaataaaataaacgaagtgtccctaagccttccagtgaacaagaaggtcattccgtaattatgccattgatttggaaaaacaaaaagaatagaaagcataagaaaaccaagaaacacaaaaggctccctgaatccactgaatccactgcatatttaaagtagttactgatatgacaattaggacttacctatagttgataggagcaagtttagttttcaaaatttcaatgtatttacacctcaaaagattataggtctaacgatttttaaggttaccagaagaagagagaaagaaaaaaatggcactacttaatcatgcagtacatcacaaaaaaggccaaattttcagaaaaaaaatacatagaaacacatagcctaatgagtttggatgtatcgtttggaattattgggcaccaaacttgaaattgagaccatcattataactctgagattgacattaggctatgtgctttggcagatataaagaatgcagaatgagactaatgtcctgtacagaacctactaacaatgcacttgagaaaatttcacaagcaatagaaaattctttttgcattctttatcatttttaaatgacttactaaagtcatttaatactatggaccaggcaagagactgtaaaacagtcatcttctcatgcaaataattcacgtgctagtcacaaaagcaccttgttcaatatgatttaaggtttcaacaatgatttgttaatatttagtttttgttagtacagatttctttgatgagttttaaaatagcctacaatttgtgttccttcgttaattcagatagttttttcctttttatgttaaaagaatgtgactgtacagtcccttcccatctacccttattaaagtatccttcactgtctaagaaagaaagaggaggcaagggtaatctgattgtccttctattcctatcctggacagaggagagtggtgagccatggataattcatttctgtgctcaccttgcagcccatggatttggaaacactgaccttaatctaatcccaaattgtagataaacatattttagcaatggtataagctaatgagcatcaataaactgagactcgtctgggattgtgtgcagtcacactctgtaatctgcaagatcaaaacatacatttggcagtgaaatggccattattcagagagacagctttttaaagaaagtaccctatctatagctgaaaataagcttttttatttttaaatgaaaagaggctctcttcttccatttaaggatgcttgacagcttttcttcccgggggggaaatggtagcaataaggaatttgacagagataatacttggaattcagatctggcctttctcagaggaaattttaacaaagggctgtgccctaacatgtccatggaaaactctgtcactgcatctaaactactgacacaagagtggctgaaaaagaaacattcattcaggtttgaatacatgtagctggaccctctaccctcctcacctcccacccatttttcactggcaaagattagatagtctgacactatgtatattttccatataaagtacaaatgctgtaaacttggcggtggggtagggaaagagaaaatgactataggaaacagcagcacaattttaagtaaaagtagaaaagtgtttctggggaagtttccattcaaacgtaataacttagagtttaatattagtctttaatgtaagataatcttttatgttttactttgtatatttcttgtgataattttcttaaaagatatcaattgaggtatttcatattaatttcacaatacagttgatagcttaggtatggcacaatttttagagataatggtgttatcggctgtgatttaataaacgtacattaattttctcagtctcagacaaacctatggctcacagaggacacatgtaataactcagtctttcattaaactgcaagttatactgagatacagatattgttaatttagtttttattgagtacaaaatgcactccaggtagaaatcactgctcatttaatcactgtgtgttaggtttgcattatctggaatgtaaattcctccctttcctcaaaggtgagtcttttttatggaacttgggtttcttactacacctgctccctattccccaaataaaacagaggcaaaggaaatgaaaatgttacctgttcattgaatgttctttccagtgactgctgtcaagttaaggaatgtgcagtcctgtccgatgtgtacactggaggctcacaatcattaattgaattcaagtatcacatactcattaaaaagggaaaacaattcactaaacagcaaaaacctttgtcctcaaaggtattattctgtggaatatccagaggaaaaataagactgtcctcaataccagagtctcatgatataagccaaatggcaaacgagtctaacaagggtaattatactataaacatacatttaaaaaatcattgatatagccacagaatacagaatcacatgtcatttgaataattttcattaattgctatactttgcatagttatattttgtaaattcaaaaattcatgccttgttgcatgcttcatataaataaaataaaaagagtacataaggtagaggtctagaaaggaatattggtccccacaaggattttctaagatgcaggagggatcaagaaaacctacagccagagtgaggcacagatctggctttggcaaagaatattttgtgagttgccactttgcctgcatctatgcccccagctgaaagcaaactggacctggtattagatgtgcaaaatgtatatccttttaggaatgcatggaggagatagagttggagaggagattacatatatttgaaaaattccgcttacgtgagagctttgacaggttattttcaggaactattttgttcgagatctttttaaatgcctgggatattggttataatttattaacttaatttttaataagtcatcattctgttacttttttattggtctgattgaacaaactcattttaatgttatttttaaaagaatattaaatatatgtggatagaattatgagttgtaagaggcacagtgtttgaaacagtacgtattttattaggaaaatagtcttgttttcgcaagtttaagacctctatttgttcctcagaggatgccttattgccacttgaaaacatggccaatgctgtggggagtagactccatcaactcacattcagcattgttttgagaatagaaaaaaattctttactgtgacagtgagagattagaaatttgttagaaccattttatttaaattgctgatgactttgtgttgtgatcattggagatttcttaatgtgatcagcaaaacctggaaagaaaaaacctgagcatttatgtacagaaataaataagtttacacttaagataatgccacaactcaaaataaaatcacagtccttatatcctttcagattttcatccaaattcaaagaaaactcagtccatgcatcttttcagactcatcagtttgcatgcatgtcacagatttgaagggttttggttatttttgcagagatatgattaggatgtaaaaattcatcatataaacattcttaatgatcaaggaagaacgttttagacgagtaattttctatgtctatgtaaaactttagatgggtttaatagtaactctcgaagtaagaggaattaagtatttttttttgtatttgagttaaaagataaagacaaaagaaaataagacccacaatattttctcctatttggttatgaagagaacaactggagtctaaaaatgccacttgcagtatctaaatgtctataaggtgctggcacattctgttacaaaacacttgtcacctctttttccatatagaggtaggaactgcagtgggaaagtcttcagctgtacaaatttaaaaatgaatttttacaacccagatgatggactggtatactttaaaagtgagctcatgagttttataaacacatttctcttgctctctctctctctttttcttgactagcttacatcataatggaggaataacattttaaaaattttgaataggcacttactggaattacagttaatcctgatacaatctagatggggaagaatagatgaaaaatgaaaattcatccttcaaggtaatagctgcagacatccaataaaattacagtccacccttccggggacagacacatgcaaatatggccactccatatcattattctttacatacttataaagcccagatgttttgttataaaagtttaccattggaaacaacaatagaaggttttaaaaatggccaattcaaacaaagctacatggtgacaaatctaagtgaagtaaagaattgttaaatgtcaaagatgtttggcttagactggctgcaactttctccccatctgtgaaagaacatatcattgttttccgcaaaatgtaaaagtgctccgtcacaatggggtacagtgcaggttcagctaggctcagacatcttggacctccgaaatctaatatcccacaaaggccaacagaatccttcagaattgcagtggtcaaatggaaagcaagttaaaattattcttatcttaccctaagggtttttgttttgtttttaaattttatttgcttgggcataaaaaggtaactgccagatgttggctggattccataccttgcgttaattggaggaggaaagaaacaactgtatgtttcctttagaaactccagtggctaaggagcagtcattattcaaggcacacaagcctatgcctctcttaggagctaacagtgttatctctgtgtaataagtgtcgtggttcccttgattttcctttcttgattttccctttcttatatttgctttatataaaagtagctactataagaacagaacgtcttgtatgggtaacacaaactgtaattatagtggttatttttaaaagactgtaggatgtttcatatttattttatatgtatttgttggtttgggttttattatttaatgcctttggagaacataaaaaaataaacctagattctgtttccatatagctgagtttgtcatgtgtcgtcaaccgcatcagaaaagtggttgcaaacagccaaggaccagcacctacacacctctttctacagaatgctttgctgttcgaaaattctcatgagtgtttccactttgactaacagcagctttactgcatgcaattaggcgatttgttttgattggcttgtaataacctgtcatcgtcactagagggtactctaacagaacagtaaaggagagtgctctgtgttcttaaagtagtatttttttaaccttaatatttaacttaatttcactaatattaattaaatatgattatatgcaataagataccaatgggataattttatattttatgagttatcgttctgcccagcacaatttgaaaatgtaggtggggtttccacaaatgccttgcctcatcacattttattactccttttttggggtaaatctatgtagtttcaaatttcatttttccctctctgtttattcatttctatatacgtgtgtttaacactgtcaaaaatacagtaaaacctcattaattttgactcctcttattttgaaataatgataacactgaaaatttgggcagagtatttattcttcctttgatatgagcaaagatctcttaagaaaaaaaattaaactcataaacaaacaagactttgaaaagccaagcgtgggaagaaaactgatttccaatacttcatgttgatggcatagtttgcatgaaacgatgtgctaattataattaatttttatccaaccattaaaatcagcctagagagccctttccgtgataagactttccaaactattatgtttttgagtataatttataaaaataaaaactgcttaaacaaattttaaaatctgcaattcagactttttcctaattcagcctggtttttccccataattcatctagattggtgaggttttactgtaatgggtctttcttaatgctacaattaagcaggaaagcattatctttctgtagaagagcctgtgtctctagtgttctcatggctgtttgctaagggccgcagactttgggcattgaagggctgtggatcgctgtttgatagcaaaataccaccacacagtactccgaaacagaaaagacagggtaccacaaaggtgattattcaaaggagaagcccatggagtagagtaagaacagctcttgatctagataacaaagcagaaatttgatattttgtgcaaatcctttctaagaagacatgcttttatttatctgcaaggatgtcacctacaaccgatccaaatgtcagtgaatatatcaacagaaaattcagcttgaggcaacctcaggcttaataatttatattttcaattaacctcactgacagacatggcctctcttttaagaaccctcagtggtagaaatcacaaaacagtaagttatgttaaacataaaaaataaaataaaaaataaaaagatgcccccgaaaacctcaaattactttaaatgatggaaataagaccattaagtgttttaattttccatggcaaacaggctacttgatcaatgtttgcaggcaaattgaacaaaaagtaaaaaagtgttagttcaatgggggaaggcaggttgttacctagattgaccgtcagtttcacacgtcctgcgtctagctccaggcggagggtgtcagcagagtctctagaagtggttgccatcagaatgccatatgcacgctgggatcggaaccgtaaggaaacatcctcagcctccgtatgcatgactacggggagctgaattttcataaacatgctcccatcatagctcaaaaccgttgcctctagagatggaaaatgaatatgataagttcttggatggtatagcgcattaatactttaaagaggaaaaggatcatttattatcatttatttaagacttccagaacacaatactacaaaatcaattcatcttcttcagaaataaacaaaactgtgagctggaaagagaagtcacagtagaggacttcccttgtgagatatttgctaaagcccagaaacagagatatcagcagttcctttttttttgttcccagagcactttctacctatagcattaatcatgttgaattttgagtgtttgattatatgccccccttctcaagagcaaagatcacgttcttttgtacagccacagtgtgagcctagtttgaaacaccagcgaagttgtggatttttttgttgttgtttttgtttgggttttgttgttgtttgtttgtttgagacaaggtctgtatcccctaggctggagtgcagtgacaggatctcagctcactgcagccatgacctcctgagctcaagcaatctttccacctcaacctcctgagtagctgggaccacaggcgcatgacaccatgccaggctagcttattattaatacttttttctagagatgggtctccctttgttgccaaggctggtctcaaactcctggactccagtgaccctctcgcccaggttcccaaaaggaacctgtgcccagcctccagcaacttttcaatgcatgtttatgtatggtaagcccactgactagttctgtgaaattagtcaaccttgccttggctctgaattattcatctgcacaatgagagggtactgccagaaggtttctcagggctttgatctgttctgaaaacctgtagttctaggagaagttactgtcatcatttttttttcataatctctgccctgatagaattatttttaaaagaaaaaaaaaagaaatatagcttaactataggaactaggccaatactttaccaaaggtgatgttcaaaaagaaaaaagaaaaactgatattaccaaacaacagataatacttcttttgagccattatgtttagcaaggtaatttttacaaaggcttccttttaaggaactgttacttccttttaagattaatttatagaaggggagtaactttaaatattatctataagcacagccctggtgtcctgaataagttctcatgcaaagcagtaatgatgtgcttttgctacactaaataagcatgggggtgggactggggagcttgtgaggatgtttgttactaaactaaggcagatggcatcagtagggaagttgcttagtactgtcttaaacacacaaagaaatgaataaaaaaaaaactgttgatgacaacctgacggctttaagaaatagtcaggactccttaatgttaagcaccatatggtagtggaatattgcaaaacaagcgtgaatcagtttgctttctcattggttccgataactcaggatgctacttaataaagaaaaactacctggaattaaaatgaaccaggaaattttcattattttgcctacttacacagcatagcaattaagtgtactgatacaactgtgttcaatattaggactatatttagagttgtggttttgtaagtttatttttcagaaagtcaagtactgtttctataagactttaatcactatttgttgtcatgatgggattaagtgagaaccagaacctctctaagcactgagtgttccaggtctccctgcttaggttagctcccttctcttttccatctacctcttgacttaagagatctcagtcaactcatatgctcactcctctaatatttattaagcgttctgacttctctcctgagctgtagcattcattgcctattggaaattttcaattggaatatgaaatttcaattggaatatttcaattggaatattattaaactcttgatttactcccttcaaaaatgaacaaactcaaaacatgctccttcttcagtcttctccatctcagtaaacatgataatctcattgctcagacctaaagctttctgatttctcttactctctctgccatgtccaatccatttgcaagtctgcaagtcctaaaggctctaattccaatccacattctgaattgattgctgttcacctctgccactaatgtccctcagactttgctctcatctctcacctacaccactgtagtagctccctcaaccgtgttcctacttttttaaacctacaaagatcagtgtgaccctggccccagtccatctctctggcctcagctttaagtatgtcccgcttcttgttcagtgagctccagatacaccaatttcatgatctcactgaagtgtttgcacttttagatccctctgtttaaaaatgtttcaccccagatctttaaatagctggttctttcagcatttaggtctctgctcaaatgttactccagagagacctgctacccactccagttattcaatatatattcatcatttcactttgttgaaatgaccatttcttgtttgtagagtattatctgtatatgccctttagaatacaagtaccttgagggcagagatcagtctctcatatgcattgctctatcagcagcaagtgcccccacaatgccaggcccacagcagagcctccataaatattaattgaatcaataattgcacacacacacacacacacacacacacacatacacacacagtgagctaatttcaatttgaataccaagcttacataaaagcttaccaaagaaattaagtatttattctgcttattgcaagtgaaatctaatttcagtactgtgcatgaacgaaatatgtaataaggtccactttgaaggccaaaattgggctgcagaagataggctagggaagtgtctatttatcaaaacaggggcctcatggttaggcaatgccctaagcactgataaaacaaaatatggtctttcaaaaatatagtggttctatataatatcatatttttttccaattagacaaaaagtttcccaaatgggagtaaaatcccagtggtcaaagaccagtgcaaataatcaaattgctgttgctcaaaaaataatgaaaacctgagtgtaaagttatagtgaattctagagagaaaaatgcttgtggtataattttaaaagaaatttgatctttacttttgtttttcctaaactagacaatcatgacccatatctgtaaagcaacaagcacccgaataaaagtgtaaaagtcattatcatgtgttcagttactttggtttcatatagataaaaggatcaaaacagtgtttgttttctcttctttatttaatctctataactaggctctattattcaataatcacatttttgaaataatcatattcttctgggaaaagtagcttgatttgattgaaaactaaatagggggcacctcctttaagaaatacagatgactgacaatggatcataaatatagtgtgaaatacaacccagagaaaaaaataatcagaatcattagcctttaacattctccagaaagctgcaggactgaaataacatagtaaagtaataaaactagagtgcccccgagtgtcatgttaaataattctcaatgtgaaaataacttgttgataaatgacaaatgaaagcctaaacgattcctcacaattagagttaatgtttaattagacaagaaatggaaaatgcacagggttgtagtctagagttgccaaataaatggtaaacaacattctgacatttgaaggttatgctatttggcagcatccttgaacactagtaaaattatttcatcatttagaatatacaataattctttaaaaggctaattccaatacaatacttcccactgggggagaaaaccagtttcaactttgtcttctatatctccttctcccttgtcattaagtttgataaatttccttttctacattattctttgttgcagtctaaagtgtacacctgtgctcagttttgccgaaaggcagtcacatattgtgatcaacgatgaaaatcagacagggagccaaattatattgctctgacatctgtccctccatctgttagaatttaacaaacagtataaagcagatctctgattatatcaatgctcttattcttacatataacagaataatttttatatgatcaagtctccacaaattctcagttttattaaaaataaagcagaagggaaggcgctaaatttaacttttattcattgaacattatttctgtactactccttcttataggatcaatacatgtaaaacaaaatactctcttcttgtctgcctaagttagcaagtatcttattctttcttataaactcctttgcttccttaggcatgataaacatctcctataatgcaattgcaacataatttttccatgttgaactttctaaatccaaggagctgaacatgttttttaattactttgaataattattttcataaattataaattatcaatttttgctcaaagttaataagaaaacaactttaaaagttctcttaaaaaaagaaacttcaagagttgtcaactcttatttgatcaacaacagccttaagtgaccaatgtgtgtctggagaagaaactctgtcaaagccccctgttttaaattggaaattcggaggttcaggcacaatcttgtgttaactgaactagggcataatagccacgaactgggcagaagccaaattttgtggtattgagcatgacaaccatcacacatttcctttgctttcaggaggcaccctaacgtgagcaagaaaattacttctgaaaagcaaaggactcacgcaatacacatgggtagtccagtaacaagaaccacccaaaaatgcatacagccaacctggagacaaagaaatctgcagaaacctgcagcctcctatcagataaagacgtatgctgaatcccaatgatgaagtttgctattaaattctcatttacaaatctacatatgcttgctgcccctttttctaatcattgcaatatataaatatttcttctctcatcctggctctgaaagatctacaatttctattttcatttttgccataggtagtagcggaatattgccacagggtggtacaccacgcatagttaacagaaagcttccgtaattcatgtgacagttgagttatacccttttttcagcttcacttaaccaagaggcatcagaacaactggcagctctctgggtgattaaaattaaaacaaaaccttaaatcgtgcaagtccgctaatctcatattatgcgtaactgtattataccttgcaagctttgttacattgttcatccttttggcaatttccaaaaacaaaactaaacaaacaaactaaaattaggaagcaaaatgcaaagaggaaacttataaagaatatacaccatactaactaaactatatagaaatagctaagttgtattgacaattcacagaaatgccggttaggtactatcataaagagaatgaatatatctgtatctatgtgataacatacccgtctactgacccatctaattgcatgacctacaataataacagcatatggtaagtggtttaatatatgatttctatgttactattaaatatttatattgttaatattaatctcagaactaataagttgatgtacctcctttttaagataaataaccaaaatcaggtttcaattttgggtttcacaaaacaacccctctttttcctaggaggttttcggcaaactgaactgaactatttcaggaataaaaaagggaaacaataaatattcatagcttaaaaatagatgccaggtaattttaggctaaatatgtaataaagcaatgttatttgtagcaggtgaggacaatggaacaactcatcaatattttttcatattgatttttagttccattgttgaaaataagtggcaataggtgtagtgactaaagcatttatctgaaacactgggtcgatggaagaataaacttagaactatttgttctgctatttattcctttagcctgttctgcagatcaactgggatggctattgcccttcagttttctttgaatcctcattccttttattgtatagggtgaaaaaaaagaaaaataaaatgtgggtttgcctcctgttagaaaaagagaggcagcacctgctcagaacttcaataggcacagctaagtcttaacagcaaattggtaaatgaatcctctgcagttggttaggtcctagccaaaggtaagtactttttctattagggtacacttccagaaatgttggtgcaccttagatgattgaaagtcagcttacttttcagagaggatattgcctcttttgtaagttgactgaagtgaaatgagcaggctaacttaagtctcacccagttgtgtcagggaagttgcaactcatagcttagcttgcctcaaatgctatttcttagcatgggtattagcactagaagccataggtatgtataattcatgcctcttttactgtctaatgttctgaagttaaaaactgggcaaaaaagacagcagttactgtctataatacatcttaggctcatactctagaggatactaaagattcaagtttctattcctgcaatatacttaagaactgtgtcctttcagaatcaagctctttgaaaaacattaagagctcattagtaatccatgtcaggtatggctgctcagcttgcaaacagagtttacttcagtagagtatacattacgtttcaatggtcagtgcaggtttgaggtcaacatttaataaacttttcatctcagggagttggctgctggggttttagaatcctacctctctcacaggacctgccaagatagcctgttccggaacaatcacagacatatctgttccacccatccctgcacatgccattgtttttgcaagggttgctaaggcacggttttgctgtttcctttgagcaggaaggcttcactccagcagtactttgaacttcagccatttgccggatatctttgctttggccatcgatgaacaaatccctgatgcagcccacgtagccatagttgagcagagcagtccacacctcggtggggaagacaaggccagctttattttctggcagcccccccaggtacaactcatcatccaggtccagaatctcactctcaccaggagcagtgtagggagtacgcaacgtgttgacagaaatggtacctatttcaaagagaggagaatgcacaggtctttaaaaagcaccaacgtgttataattatctttctctctttcgtctgcttgatggttaactccttggaggcagacaattattattattctttctgtcctcactttttggtatttcctagagaaattaagatatctgtggtattaagaaactttagaaataaaacagactaaatggttccatttgaactcgagaatggaaacctaagtgtacagccaacaaatagtgtttgagagcctcaaacagttcagtcaatgcatgtatacatacattaaaaataaagaaactgtaattctgtatcagtctctagaagaaagtcagattcccctgggttagtgcttgttttcaaagccaatattcaattgcaatccaaagaaagatttcatgttcctattttaactgacttgattactttgattgagcacaatagtttcacagattacctatgtcaaaacctgacttcatcactcctagctgtataaacctattgattaacttacatagttttgtttcccttactcataatatgcgcataataatattacctaccttatagagttgctcttagtgttaaacaaaataatactagtaatgtacatggtttataataatcactgtataaatgtttgtgattatatttcagtgaaagaatcaagtaaaaccaattgcttccttatttgtaaaccaagctagttatttatttaaattaacaaggctttctttttctcactccaaatgttaaggagaaaaatctattggtttataaatacaagggctctaagtcctaagtatggaataaccaggtattcatctacatgggatcatttgagggtcacagaaaaatattagtggaatctatgaaaaaaaaagaaagatataaagcatattcctgatcaaaacgtgcatacacactgtcagattaccaaaattccactgatactttatcttcagaaagacctttgtacaaatgcaaccatgatacctgaacagaacaccacaaggacccacaaccacattatcccagatttatttctcagctccagattataagaaaggataggaagagtctgatgagagagagaggatgagaaaaggtctgatagcatgctggggcatgggtatagaacctcaggtatttagggaagagacacaagagagacctggagatgggaggtgtgatacagaagtaaggacaaaaagaagaagtggagggtaggtcaggtgtgtgtagggagacacattttagttgctacacagaataccaaaagcccgccccaagtgaaaacacatatctaactaaggatgtaaggctgtgggccctgatgtgcccaggagtattccaaatcccagcagaagggcccccttcaatctaggcagtctaatgggatctgtctttgtcagggagaagggcatggaagccactgacaaagactgctcaggtggccgagtcattaagaggatatttggctctctagactttcagagaaagaaaagggaaaagctcctaggggagaaacactcaaaggcattgctattttggccttccaatgaggggagcaaaatagagatttcctagggaagcagctaaaagagaaaaggacaaagtattcatttttactgttcacatttgtacaagtgtctagaagaaaactctcatttaggaacatatgggaaccataaaatcctatttagaaaaatataaagcatggcattttggggaaataaaatttataatattgaaagagaatggtggctcttttctatttcaaatggaacgatcattacacgcattttaaagcatcattttttatatagccctattcaaaatacctaagaagcgaataaacagatggtccctatcctctgcagtagctaatgaaagttagaatatgatgagaaagagtgtcttttaatgacaaaaggaaaggtggacactttaaaaagcacatattatcatggaaagcaaagagttacatgcaatgaacaaagtgccatgttctttttttttttctttctgagacagagtcttactctgtcacacaagctggagtgcagtggcaggatcttggctcactacaacctctgccacctgctttaagcaactctcatgccgcagcctcccaagtagctgggattacaggtgtacgccatcacagccaactaatttttgtattttcagtagagatggagttttgcaatgttggccaggttggtcttgaattcatggcctcaagtgatccacccaccttggcctcccaaagtgctgggattacaggcgtgagccaccacacccagccaaagtgacatgttcttaaataaaagagagaaggattctactctattttccaattagttcaataaggcctcctaaaagccgtagaatttttgaggatttgacgaaatgaatatccactattgagaaattgagaagaaatgttaggagacacggaacttagcaaaggaacaatgacaaattattccaagtgtggtgatatattcaaatatacatatatataaacatatatgtatgtatgtattcccatatgctctttttattcagctcagatggggaaaaaagccctgggaaaggctgtactgtccttgctcagggtatcgtaattctgacactaagaggactcctggaggactcctgagtcgaggaaattcattggcttccacaacccactttctccctctattccatgtagtttccataccttggtgcactgtgtctgcactcactctaaggggcaaaacggctgccaggtggtttagacaatcattcattacagtttgtctgacagtaaggatggagtaactgtgtctcttgatttttatttatggtgtgttagtgcttgctttgagcaaagtattgtaagagagttcaaataagttattttaagaatgtgcttgatgatatggacagggtaagattcttactacaaatttatcattagacttgagttttctgaacacggtcatagagaccacaattttcaaatatcccagtgcacacttaaacacacatccacccacccacccacacccacacacacactctgaaacaaatgtttaaaagaaaaaaaaaatattcaactctacagcctctgaagcactttgatattttctctctcatcatatcattttattaaaacaaatgctggaccatcaatggattttagcaccagctaaaatgttgtaacccatggtacaaaaaaataaataaaaaacaaaaacagatttaagggttactatcataaagagtaagtttctcccatagttccctattgtccctttgagagacaattgtagagttctcatagaaagaacaagcaggccaggcgtggtggctcatgcctgtaatcccagcactttgggagaccaaggcgggtggatcacctgaggtcaggagttcgagaccagcctgaccaacatggagaaaccccatctctactaaaaatacaaaattagccgggcacggtggtgcatgcctgtaatctcagctactcgggaggctgaggcaggagaatcgcttgaacctgggaggcagaggttgcggtgagccgagatcacgccattgcactccagcctgggcaaccagagcaaaactccatcagaaagaaagaaagagagagagagagagatagagaacaagcaacaaaacatgagacagaaagaaaaagggatataatcctacctttaattcaaatttaatccaagaaagactagaacttaaattgagctctggattcaaagttaaggagacacatcaggcaaatggatggatcagatatcagtcattggaatattatgcaaacagacatcataggatgaagaaaatagggctgaaaatcaagtactactttatctatatgctttgctaattcgtatgaacttgtattttagaaaatctttgtaaaagagatggcaaataatcagaaagtaaagaatttagttcaagtgggatggaaacaattatttttatattttgaaaattcatggagtaaaaatggttagaattaataattaaattttattactgagacaaatgcaaatagaagtttatattttagcctaaacatgtgtcctgaaatagacacatttccaataagggatttgaatcccagacctccttaatgacttttactatggatatgaatcaaagaacatattcacctagcaaaagagtcatcacagaatccgaattagtttaaaccaatttaactcatagatatgagcatagtgaaatttaaatattaaggttcccgtgtgcttattttattaaaattgagttataaaatcagtggttacaaagaacacatcaaattaatatttaaacctggttcattgataattgaagacaattgagtagttgccaaactctatatatcaatggaaaaggagaattttcaaaggctgaggtacataaatgttataaatacatttttaagagaaaacaaaaatctaaatatattaatgggtcatccctctatctttttccaggaaccacaaatactgacatgttcttttttaaatagtttgattccttcatacattctaccccttctactgaatttatatttgcagtttctggtaaattaacaaaatattttatgtaaacattgttacattaaggctcctaaaattggggaaaagttcatatttgagaaattatctagatcagggtttcatgcttcactatttaagaatctgaagcaccctgctatgctattttattttttaaaggaatgagatcgcaactaaaaataaattatttgtggacatacaacttttataattttaatgtagaaacgacattacattatattcttacatgtaaagctgttttttcacgacacatgtaagaggtaaaatgaaggtgataagcagacaaggtaatatttaagaatattcataaacaagtaataaatttatgtttcttgtaaaactgtatgcaaaggttcaaaaaactttttaaaacagctcttagttataaaagtggaaatgaaatttacaacgtagtgaggtagtttttcattacctattagtttccattaacttttctatcctatttttattgtctgttctacttccataagattagtttacagggtgagaagaaacacagagtgaaggtgagatttaaaataagttaagttgatgtcaagagttaaattacttcacaagtttaaattactaggaaatgaggagtagaaaatagtgtgctgtaatagggaaccctttttcctggtgagaaaatccgatgttccagctcttcaactaactagctagcaagtttagccaaaggatagatctgttaggcttcaatgtggctcttatgaaaaataaagaaattcagtagatggattattaagattcatttttgaataaacaatctttaaattactgcttaaatgaattgtttaaattaatgtcaattttatctatacttaattctgctccacctgtccctacacaaatgaatcagatttcacaaagttacaaatttacttgtcaaattcctagtctaataacaaattcaaacttgatgaaatatgcacaacataagtaataaaaacagaatacaacattgacaatagggtataatgtaaaatgtaaaatatataattatcataaaataattttaaaaaagaaccaacatattaagagtgggtatttggtgacagtgtaattatgagtgttatttaaaaaatttctgtatcttttttaaaaccaatgttatctatgaggtttttaaagaaataaaattaactgtatttgaaaacaaaacaaaaataccatcttaatattccactctctgcttattaccatctgttttctgcttacttgattcatctgtgagctgggaacttcaggaattaaatcaatatatgaaaacagaactctaatgacaaaaatttaaaagtttaataatgtctggtattggcaagaataagggggaaagggcacttcaataactgtagataagaatgtaaattgaaacagcagttagtaaactaacctgtcattgtctttcaaaattaaaattacaattaatccagcaatcccaattctcacattcaatcctagagatattctgaccaatatacacaaagatttcatgtatgaaggaattatctataaactagtttaaaacagtgaaggtttaaaaaagtaaaaattcaaatgttcttccatagagaaatgcctaaatatcagtatgttcaaactaaggtatgtatggtgtcactacaaagaatggcacagaaaaagctatctttaagtttttttgttacacagtaattggtaaactataatcttgactatagaaaaaaggctgtataagtattttatgtgtgtgaacatatttatagatatattgatgcctagaagaagaactgggaatttttcaacgccaaattattttagtggttatctatggagaacagagtaaattgatgagggaatgtatggtaaggggaaacgcttcacttagctagtttttgaattgcctgaacgtgttcaccaaaagtatgtatttatatattaaatacatcatgcattacaaaaatgcacatatataaacacacatacacattcacagcaatgtatagacacatatacattttaaacatgatcatacacaatggaaggttgtaaatatcaatcaaataacattctgcagcaattgaaatattattttgcagaagttccacagatttccactcagcattccacagtaagggtcactaggtccgcgtgtggtcagtaaactgcctatcttcttagggtgctactgatgccatagtccagagtctgccccttagctaggcaagcccaatgaagagatttggtagattttcagagggcggtttcatttcccaggtttgactgatatttactaactccataacagcaatgtataaaacaagaatgccaagttattgatttcctctgaggaattacctattacaggacatgaaatacttcccatgtagctctgccaatatggatgtcaattataatcaaatattacttattcatttatgatgagaaatttacttgttacaggaatgtgaatactcatatgcattcctcagtatctgtggaaattggttccaggatctcctggagacaccaaaatctgtggatacttgagttcctgatacaaaatggcttagtatttgcatataacctatgcacatcctcccatgtactttaaatcatctctaaactacttatatctaatacaatgtaaatgctacatagttattatactgcattgtttaagaaacaatgacaagaaaaaatgtctgtatatattcagagcagactcaatttttttccaattattttcaatccatagttgattgaatccacagatgcaaaacccacaaaaaatggggggccgggccgactgtatacataactggtctattttctccctccactctaatcagacttacaatgggaactaaatcttaatcaaaagagtgcatggggaacatggattctgaacaagaagaatgcatgagataaggaaatgtatagtaatattggcctgggaaggcttgacacccttatctcagttaaatgacctgcctccatctttacagtggggatgaagttgtcaagttcgctaagcagtgttcagaagattactgctaatatttgcccctgtgagtttcttttctttagatatgttaatacatttaagttctacaagcccaggggcctagctcaggtacttctgaaaagctctgctctgaatctttgcttatgattccataattcccagaaaataaattttgctacttagatgatcttgagcaaaagagtacataacaccatattaaacagatagcctgaaaaattatgtttatactctaactgcaactatataaaatatatataatgttaacaaaaactgaaggaaaatgtacaaatataaaaaatactttgagtgtggagaaacaataaatgatttttttctataaacttcttcagaataaataaatataaacattttaataaaacttaacattacaattttaagcaaaattgaccccatctggtcatatgatcaaagaactagtaaattattggtaaggtatttcggtgtttcctctgatgaatagtggtttatgggtgtggatatgaaacaaaatataaatgcacttaaaattacttcaatgtatataacaggctactaggcagaggcatgggaggaacatttacagtcagagggcaagttcaaacaagacctaagcagagaaattgtctaatggttgctcaagtagaaatgtttaagtgtggtgattcatgaatggtgtacacagaaatcagtgctggtaatagatagctagaaagtgctgttcacatcaaacagtgattactataaacctctaattatgtgctcttgagagagccttgtacctttcccactgtaatatctagttcttaaactggaactctacgacttcaattcaaatctcaatggcttcttagctgttaaatgtaggcttacccatgaataaccgctgacacaatcagctgtaccctgctgtatacaagccaactttgacaagaataatgagttttctctttgatttcaatgtgtaatgatggtttacaaaataaataaataaataaataaaataagactggcagtttgctataaaaatacttgagagggtactttgactgagccagagtttaacacaaatttaaacaatatttgtgccccaagaaaacaatcattaacctcatcctaattgtagctccattcacagtttagctaaatacctgggcagctgttttgtgttgagggtgggaccagagaagaggcaaaggggaagtctggaaagagagagactggtttaaaaacaacaacaacaacaaaaacgctcagctgtaagtcctgcaaaaattgcaaagtaatgggcctcttcaatcatatttattaagtccactgacttaggggttttgccctgttagtagctaagttatccacagaggttatttacattttgcagcactgaagtcatccactctgattcactaaatcatgcctgcacttggtatggtttctcctttgctagcttactgcaggatctggaagtgccatttacggctcagcccacttggctttccatgtccctgaccctttagtgagcaggcagtggaagaaagctgcactgcacataaagaacagctatagccaagcagaattagtcaaactgtggaaattagagtgaattttccccatgtctcagattggaagaaggaacatatgttagaaataaccagttacaatcagttttgccaaaatgagaaagttttagaaaattacacataaaggtgttatttctcattgaataaggggttcatatacccctttcagtgaactaaagaccaaagaaccaaagggaaggccaccaaaaagatggacatcctaggttcttgtcaagagcacacttactgtggttgcatatcccagtcctcagaaaggagttaccaccttccttcttgatggattttcctgctccctaaatgtctgcaaaatgatatagggacctcaagaccaagaagggacagaagtcctgttctcataaaaacttgtcatttttgtaccaggtttacacattcgctaacaattatttaactttctcagtggcttatttcaaacatctgggcttggaggatggtgttgcattcacaagagaacaccagtttttatcctatatcatataaactgctttcagaaagtaatgtaatttaaataaatgcttacagttaaaaaagttgcatttacaattaaaagagtgccattattctccaaatgtaaaaaatgatgctgctaatttattttattttatttttttttagagtatcaggggttgtttggcactgtactacttacatgtttttaatctttagtttttcttataccaaatatatactgaacaactgctatacccaggaatgtactagaaactgtggataaaaaaataaatacaattttctctatctgggatggaaattatgaaccttataaagtgggtaatattaaaattaaatcatttgtgtccaccaaatatgattttaaccctctctctatccaaaaataaccactacttagattggcagcaaattaatgaccataatggtctcattatatttctatttactttagtatggccaacagcagaaagaattgctcttaggcgtgggttccctctactttaataacagagataataaggcttttaaaatactgagctaaggaatattccaggcaaatcaacagatatggcctcattatctgtatgtcagaaaggagcccatgttaccctcttgtcatagcagtacactttctccacattatatgaaaaataatattcatatagcccctgaatataactgatataaaaaatgggtaaaataaattatttcatgaaatttccatgtttcttagttgtaagtgacctctgaatcttactgtttcaccagccaaatcagaaatatcctttaagtaaaataaaagcaagtatagccattcattcaatttttaaaaggctactccataccaaaccaatgcagtgtgcaaatatggaacttaattaaaatactatatataaaatattaacagctgctattaaaattacattaaacacccttgagctaggctaacctaatatgagctctattttttttcaatttaataaaggacagaacttggcttagtgaatgaactttggtttttatattgtttgtaccaattcactaatctgaaattttaatcacataaaagtactttaccatcacaacagcaccaagcatagtaatctgatctttccactggattcaaagaaaaatctcatgcttcgtttattttctttcttagatgcaaacaacacttccttagaacgtgtttctgttcttcccatacagaattgagctttgtaaattaaagtagatatcatctaattttgaccttctccaatgagggtacaaatagagtaattaataaactcttggtaatttggatgaattaaagagcttaaacagaaaaagtagattttattctgcttgaagattaaagtatttatctgataattaattagattgcatcaatactttctccttataataagaaacctcataaaatattcaaaataattttgttctctgtgagtatgtgtatatgtgcatgtgtggcatgtatgtacatatgcatatatatacatacatatacacatatacatgtagagagagacatgcacacatatatagacacacacacaatttacatagaagaaagactggaaagaaatacccaaaaatataaatcattattttcaaatgaataatgaatactttcctttttcttttatattattttgtatttactagtattttgaattaatcgtgtattacattcatatagttagaaaattcctcatttctaagtgaatgaaaagcaattgatttgatgtttggtgttttttttctcctctgaactttcagaagataaccgtctaatctgatatgggttgttttgtgttgttttgttgttttgagacaaggtcttgctctgttgcccaggctggagtgcaatggtatgatcacggctcactgcagcctggaactcttgggctcaagtgatcctaagtgtggggattacaggtgtgaaccactatttttggcatgttttgttttaaagtgctataaaatctgacttaaaatatctcttcttgaaagtaattttcaaaattttattctagatctatcttaagtcaaattataacatccacaagctaatatttcaaagcactacataagcccatgcccacgccacttcaaaattcttctgcttgaaagttcatatgtaccaaattaactgctatctctggcagagataggctggaggaagtcagaggggaacactctattattattgttatatttttgcattcccatcaatgaactcttctcagcttatttttatttttattttttatttttttttatttttgagacagtctcactctatctcccaggctggagtgccgcggcccgatctcggctcactgcaaaatccgcctcccagcttcatgccattctcctgcctcagcctcccgagtggctgggactacaggcaccgccaccacgcccgactaatttttttgtatttttagtagagacggggtttcaccatgttagccaggatggtctggatctcctgacctcgtgatctgcctgccttggcctcccaaagtgctgggattacgggcgtgagccaccgcgcccagcctcttctcagcttaaatcagaaagaagaggaggaggaagaggaagaggaagaggaagaggaagaggaagaggaagaagaagaagaagaagaagaagaggaggaggaggaggaggaggaggaggagggagggggagggggagggggagggggaggaagaaaaaatggtaattcaattccttgtagacttctttaggaaagtgagaatatttagggagacaaagtttccagagaggaatgaatcagaaacacagtctccaatatatctgggaatcagagtaatgggttctgaccttccttctctccacactcactcccaactccttctcaatttccatatattctatttctttattttgttaggtaaaaaacatatttccaaacaggcaaacacaatcttcttgatctataaacagcagaataaaaaaggaaggataagagggaagtagaaaatagttcagctgggagttaacaagtactgagggagcccatgcaaggagggtatgagcaagagagttcagccccaggtcttcaacagggcccttctgaaagaccatggttatcacagattactgagtctaaaagaagcactcagcttagttggttgggggtgggtgaagtaaagaaggagagtagataggtctaaatttagttatcttctattataagatcatttgatttatgtatgagtaggacaatcagagcatgggagcccggggtgaagggaattaaataaatgtagttgtatacttaaaacagatttctctctccttatctctccctgtctgtctgcctctttctccctctcttctctctctctctcttcctccctccttccctctctttctcaggattcctacaaatgtcatctctgcttcctggatgattatttcccctcaaagctcatattagtcaacatcctaagccccctaaaacactcccaaatttcagtgtaaatgtgatttcttcggagaaactttacctgccacctttacccctcctctcttagagaaataaaatgcagcaacaggaagcagaatgtttgctggtggaattccaaatacctttcatcagaaagggaagcagtttggaagggcagcagagctttgccactgtccttgaaatgctactgtattgattaaagtgtttttaatgccatagactcatcctaaagtgtgacgtgccaaactaaggattttatgtttggatcattctaatttttttttcatattttatatttgccacttcgggtacctccaaacatccaataacataagagaaaactgggaatagaaaaactttgaattttttcacttgcaaattcaagacaaaattttctgcaagatttggcacttgattacccaataaaagttcatttaagaagctattttagaagacatttgagcatttggggtttgatgcccaactatgataattaattagctctttctttcatggtgtgaaacagaagcaatatcaggcaatttcttttaggctaaagaaacaaatgcaggaagtctttaatatgtcttggttttcacttttaggaatggcatgggtgggtggggtgctccagcagataaacagcatagaaaaatgataagattacctgaccgtccgtctctctggaagtccacatgataccattctccatcattcactttcttcaacagggcttttatttttatagtacctgaccccatgtccaggaggaggtagaggtggccatctagcatctcaatagcaaagaagtccacctttatcatctgtgggtgcttggcatctttctgatgtcttggcttgccatggctaaataagatgaggccatttggctctgttgtacggaaatcaaatgatatggagccagttttctttgcattccatttaggcaaagagatgaaagactctggggtttcaaaggtgattgggtctaaagttgcaacattctcacatttaaatgccaccactccatggatcttcatcttaggatctccttgcttggcaagtcgagataattccagcctcacatcattatttttatatacaacctgtgggcagaggatagcagtgagaaactagcctccatattttaatatctgaaacttgtgaacagctcatgtaactttcaacgacatcataaaaaggcacacgatatttagttaattttgttgtataaaggcaacatttctcaggcaaataaaattcaagtgtcaattcatagaacaataaccataacaacttaacttgattcaaataatgtgtgtgcagatgcacccgcgcatgtgcatatacacacaaactgcttgtatttaactcaaataatttaaaaatctgcatatatctttaatttcatgtctacattaccatgctaagacttgaacttataaaagctacttgtttcatagttgtctatgatatttttaaaattaaatataagcactgaggttattcagttttcccatcattaaagcatttgaaattggataccattatataccagtcccctaaaatattggatctcttctattatctatatatctgctgtggatattgactttgcaagacagtcacaacaagttaaagcacaaaacagcctgacatttctcagaaaaaaaatatataactaagatacagaagatccctgacctgcatcaatacctttgaatactgttaagtaatgtggcactgccacatgtagaatatggtgcttcccctcaatttattcaacctgtgttactggtgatccatttcacttttaatttacacaaatgctgcgcaagggttgtcttgtactctcattttccaaggcacttcagtgaaagaggctaggcacttctgagtgcttactgatggtcctaaggctttttggattccaattaacacatttgataattcactgacagggttcacggtatcatacatttgctatcccttcacgctaataaattcaaaggtattttgacataaggataaagagagaaggacaccttttctctacaaaatgcatacagtggataatcacatttctaaaatacatagaccatacttacttgagggtgaattagttatctaggtccacatagctgtctaggctctttcaagaagggactctatagatttcaaagctcccaacattgctagactctagatttatttatccacatgtaaaaatgtacatatatatatatgtatatgtatacacacatgtatgttttgtttttcatttttcaggaatggcatgggtgttttatataatatatgtaacaggaaaaataagacagcctgtatctgattagcgctatgaagtcaaccaagacaacgcagcagttattccaaacccatggccaactgaaccaagagatggctgatgagtttcctgataggatttgttaatgaatactttatttttcagagtaattaagagtacatgctctggtattggacttcctgagttcaaattctggctccagcattaccgaactgggaaatctctgtaagcctgtttcactccctgaaaggaaaataatacttcacataatggttataacaattaaataagaaaatacacataagtgggaaaatctacataaaggcattcattccaatgccaatcacattgtaagatttcaataaatattaactacgtaaaatacatgataataaaaatcaatgctttatcatctaatagacacagattttaattctaaatttatccataggaaaacatttagaaataaagcccacacatataattggtttttatacatgatttgtgccaactaaataagtcacatctttccaatgctgggcctggtgtttcagtttacctttatcttggagaaggattataataaagaacatgatatcccttattctttgaacaaatatgtacaatggtttaacaagcatctattgacaacaaaagaagagaaaatgaacttgagcaataacaaaaaggaattacattaattcttaagaatacttttttgaaaagagaaagatctattaagtcttagaaaaatttatttaggattgcctttctttggagatctttagaggcagggaaaatgcttttcaaggatgattttccaagttttatcgcttctctctatgactttcatgctacttaaacctatattatttttcctttttcctattgatttatattccagcatgtggacattcttttgacatagatattgatcaagaataagtattttcagacccaaatgatgcttctcttgatcaatgctaacactcattcttataatagaaccactgtaaaagaattgagtgtttctgacatgaacaagtgggttttagccctggtatattgtctcttgaatctgacatcagccaccacaaagttgaagaatgaggggcagtctaagtctgggcaaggatttcaatgagacataatcttataactgaatcaggtgacttggtgatgaaaaggttcaggaagatgtaaaaaaaatagaagtagggataattccctgggcaaaatttcttaaggttagccatgcatctctcataaaaaaaagtatctccaccagaatcaatgctttatatgctttacactggcaagaaccttgctcaccacagcgcagcaccaagatcagtggctggcacagagtagatgctcaataaatatttgtttatagttgaacaaaattcttccttcacctttttaaacctagtttctagattataggcttttgtaaataacaatatttagacctataattaaaatacagcagaatatggtattgcggaccaatctcataaactaattactattttgccctatttctctagaaaaaagcataaacttatgtgcatatccagttcataattgacaagttggcccatgcattgggaaatttcatcttcacacacattttgtggggtataaattccttttagaacgaagaatgcctgagttaaaactctccagaggtttatacacaaaaatatacactgtgcttctcctcaacatagttcttgtaggtaagaactatctccagatacaagaactctttcctacaagaactatcttgagaagaagcacactatgtatttttttcttcccattttgtactctttgaaaggctactccagaaaacagaaaagcaattttgcattggtaggcttacggctctcagatttacactactatttcatctgacccagattttataattaccctatttttctaaagttagacctactcttaaaatgaactgaatctagttcaattagaataatgagtagctagtaagtattctaactcctctaaaaattcatgtgtaagctatttttgcttctttctgaaacaatgtggcactcaatcatgggaacaccttataattattcatatatttttaattcttatgtcaaaagttgcaatttacatgtttcacttttgaacaagtttctatatgctttatcatcataacaattgatgatatttgtgcacactcatttggatctgtttatagaaccaaggtttctttggggacattgattttttttttttttttaaagagtgattcaaaatgttgaattttacttcctcgcttcatgggcttctttcccatttcttcaaatatttgttagaatttttagtgtccctctcatgttaatatgcaagaatagggcgtaatatgtttgtgttttcacattcctagggtttacctttgaggaaaacaatcactgagtattatctttgatcttaatgataatcctgaaaacatgacagcaatgcagagaaaataaataacttaaagaataggagcttagtagtctgcatattaacttggttcaatctcaaagctattactaagccaagtccctaacctctctctgtctcagtttcttaattttggaaactgacatctataaaggaaaggcgtgccataactataaattcttgagctttttttacccttaatatgtgtgatttgggacagacataaaagatggtcgattgttcctgacccctttctggctttctcctgttgcaatttttgatgccaggatattgttctctactttcagatacactgaaacactaatccattagtaaagagagtgttcactgcatcttctcgtacacagacatgcctcgaggattatatctacctaagttttgtacagatggtgctaaagcactggtagctgatagataaggctctttcaacagagcgggagtatgtgaaattcagtgtgaaaatatttgccactcagataatgactttttaaaataaatatgtgcttcagcttggaaattacaatgggggtcttaacttcactaacatgcatgattaagacttttcattacttaactatggtagtatgcaggatggtgaaataagcgaccaaagttagtgttgtttagatatttagactttgttatgaccctccctgagagaacatgaatgactcatattttaatctatcttggttttatctttcatacttgtggctaataaggagtgaggcctaagaatttggttctcaagtcagatttcagagagaattccagctcactcattttcaaacctgtgaccttgtgcaagttcctcaaccttgccaagtctcaagagttttattcgtaaaggacaatggtatctaccacattaaggttactgtaaataataaattgtattttagttaaagtgctaataatgggtcctagcatggagtaagtgatcaagtaaatactcattgtttttattaacattattataaataacatttcttattcttacattgaattgatggagctacacaatttaattgtcataacaaaggtaacagctaagaaggtagatagcaattgattggtcacatatttaagggaattaaatagtgctgagaccagcaggatcaaaggtattcagcagactggggcttcctttttcatgctgatatttacgttgcagttggatgtacacatcaggctttctctgtaaaattccttaactagaaaatatacacagcaggctagctaacctaggagttgtattttcacccatgaaagggtttctgtggtatctaacaacagcggctaccactatcaccaaagccaccacaacaatcagttaagatttaccagttcactttctggcaggccctcttataagagttttatatatagtaatgtgtttaattcccatatgcatcctagaaaataggtataattatttcctattaccataagttacctagaaaataggtaacattattctactttatcaataaatatctggaggcacagagtgactgcatgtctttcttcatgatcatgtctaatcctgtttgaatacctaatgaccttaacctcaaactttatctttgtttcagtaggaaatttgtcttcgtttttgatagcagttgctaagtagattcacaatcaaacagctgtttgtcattaggcaaaatgataacctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttcccccaatgatagcatttagaaagacactgaacaagttaactagaatcaataaacttgcaatgttcactactattttaaaaggaagtgatgaagatactttccgcatcagtctttcatgatcttgccgaaagttatctcaccataacttggggttaagagtttctacttcaagccagcagatgctgctaagaaaggcaatgcatgtctgctttatccaaaaaacttttcaatctcctgctagtttcaatgggggaaaagtagcactattattattattttattaggggaacctatcttcccatataccaagaaaatatctttgaactgataataacaaaatagtgacactaaatgatgtgtctagattaatcaatgcatcttcttttgtgtctccagcctcataagctcagtgaagtttcctccaccacttaattttacatttttctaaggaggcagacattagtataagtatataatataccatttagtatatgtatatgcatgtattatagatagattagacaaatatatgatagatatacgatagatagatagatagatagatagatagatagatgatttcctacagtctgtcctttcctcattgatctgcattgacatactatctattgttttggatataccaatgttcactattttaatatattattactttttgatcatgctcatcaattttaagctttgaaaaaaatttctccaagagagatgggataaccaaacaatttcatgtaaaatatttattacttgattatatttatgtgtgtgtgtatgatatatgtattatttttaatccactgaaaatatgttgtcttctgtttaaggtgaaaatccaaattgacttgctccacaaagagttagttatttgaaccagcacatttttttgtccttctttttcttacttcaacactcaggggaacacaatttttaaataattatttttccgacttgtaaggcctaccacatattaaattattacatatatgagattctatggctgagcacgctgttctgttttattgatgtttattttttcttgatctagttccatgtcacctaactgtcacagctttataatatattctaatgtgtgttaggctccttccaatcaaccaacccattaacattaattagcttacaatgtttatacgttataaacattataaacatctcatgtaatttcgcacgttttttccttatgaagatccgttaataaattaccaaaagatataatcagtttattcacttcaataaaaaaaagcaatcactgaatatttttaaatgaccataacttataaatttttttgtcttctgtattgacaaaataaatatacatcacaagttgctttgatctagctttctaaaacatagcaagttatacattcaaatttacttaaggggactttagaatagcccaaggaaattatatcttgctttgaattacattcctattattacaattatttgcaaagttataacgcataaatgagtttgacaattttatcatatcagagaatctggcctcatgccacaacaataatttattagttggaggatagatatacaactatagagatagattaaatcaggaagaaaacaacaacagtgaatgtagttgtaagtgcgctaattctattccaataaacacaggccctggtagagttccttgtaataaaataccaggagtaggtggccagtatataggagttatctggtaaatgagatgaattattctcagtgaagaagaaagtggagtgacctcagactccactttaatggtggctcttttctagaggtgagggtacttgcctgaggtcacactgctattgttcagagggagtcaacagtggacaagatggaatctgaatgtttgcctccagagcctgaaatggactgtttaatttattggttttctttgtatggacagtttttatgatggttaattttcctaaagcaataaaaaaccataggacttctatgcttcctcaacctgatgtttcaagagctggttatccagttggtggattatccaaactgcatgaatcccctttctttccctggctgcctgcctttactgctcaactgcacatccacctaagagcctgcaaacgaaacaggaaaaggtggcatttaagacagccaatgctgatgatgtttttagcaactgcaatgagaacatttttccaagtagacttgttcctgagaagttgtataagtttgttctgtaattttaatataatttgataaaaacaatgtgttataagatttatatttacatatattcaaacagtctcaggtttacattcctgcattgctacttaactacttttactgccttggccaagttgcttattcttactgaaataatttccctctttatcaaatgagattatgaaaacttattttgcaatgttatttaagcacataagtacttgatcctgggtacctaaataaagggtagtcattactgttgctattatgatcttaactgtgtaaggtcttaagggttaagatcttaaatgggtaagaggggagtgttcattatttaaattagtaagtgactactattgaaagcaaagatgcattctgtaaagtaatcacactcaaatcttgatgttgacaaaaatacttctcaaatttcgtaattttatctcatctctctggaactctacattttgactttatctgctaaacaaatagtatttttaaagtaatattttttattttaaatttattaaaggcatataaatgacagaatgagacagtctgtataatgatattaaattgatggaattatagctggatgcaaatacttgttttatttagcttatactgggtggactaaatatatggccttttctaggtttgctaaaatattgaacacatgtaactgttgttcatttctaactaaaagggccctaaaaagtatagagaccccaggttgagaactgttatttttcaattataactgctaagcagtagggtatttctttttaatctattctttaattatttctttggaaagtcccacatgattcagatgtcagatgggttgtgccttttgccaggggttgcttagttaactgtttatttaatgaatggggttttatgtgctactgaatttctcatggcacacgttagaaaatttttggcagcatttaaattggagaactgagaaacatattggctctacggaagctcaatcagctcccaggcaggtgcagagtttttgccaacaaaaattcagtaaaataaaaaatgcaaagcccaaattctcacacaacccaaagaaaactgactttggtgtccaagattaaatgaatgctagatccaggcagctcaggtagctcaagaatggaaggggaaaatgcgtcataactttaggagagaagcaggaatgggaccttcttgttttggtggatgacagtatgcatacatttttggattgctgagaaaattcaactaactcctaaaaaaaaaagaaaagaaagaaaatagtctcatgtaatttcgcacgtcttttccttatgaagatgtgttaataaattaccaaaagatataatcggtttattcacttcaataaaaaaaaaatcattgaatatttttaaatgaccatagcagtcactgagcatcctagaccaagtatccagatggctatgttttttaaatgatttggccagatatatagacattgtataagcattggttaccagatttatttactctgactgggaaccaaaaaatatcctgacatgtcttctgagttctgaaaagtcctaaatgcacatatatataaaattttactcagtagtacaataggatgagaaaaaacaatggaaaatatttttttttaattaaacactagtttgagaaaataaagatgagaatgtatctttcagcaattaaagtgaatagtaccagcctacttatcattactacatgactctccaaactgtgtggaataaaagccatttgcagtcatctcctcccaagtataactgtcatcaactcctcccgtcaatactctgcccttggccagaccatgtcccagcccttctccctgtctggaagggcaatgtcccgagtcaggcttgttcttgatttctcctctcctagatgtagtttctggcaatactggcttattgaagactcctgcattcttgggacaccagtggatattctttagtatcattttcctgctgtattcagaaatggggagggctgtgctcattagcacagcgatgctgacccgacactaggttggccacctcttggtggctacataaacacacgttcctcacttcaggcctagccaacttggctgtcttctatttcggttgtatgttgaacaagtccccagtagacagttcattagagttggccagctacatccactttgcccctaattgcctttgattagcttctacgttgcctggtataattatttttttttaattgagatggagtctcactctgcacccaggctggagtacagtggcatgatctcagctcactgcaacctccgctgcctgggttcaagagattctcatgcctcagcctcccaagtagctgcaactacaggcacgtgccaccacgcccagctatttttttttttttttttgtatttttaatagatacagggtttcgctatgttggccaggctggtctgaaatgcatgacctctggtgatccgcctgcctcagcctcccaaagtgttgggattacaggcgtgagccaccgtgcccagccatcatgttaatatgaatcattacagcacccaacagcaactgtcaagcaccttctctgtgtcccatgcttgttgaacaacaaacttctacgtctcatgacagtcttatgaagtagacatttttatctccatactaaagctcagagaatttaagtattttgtccaaattacacagtaactaggtgactgagcagggatccaactcagcttttatctagcttgattccaaaatcacagatgcgattctagtgcatgctccccaccccatgggatagtagctgagttcctatttacttattcagccctggttctgggcacactttctcaatctcatcatcatgcctttcgtgtatagaagtaaagggactccttatcccttttctctttttcgaccaagtgcctcattaactagctgtggttctcttaacactgctggtaaaaaataatattaataataataatcccccttaggtttcatcctactctctttctctcttgatgtcaggataattgtttttctcctttctgtcctatgcactctgatttagtgtcacacttgttttgtgctcacttcactcttaggaccaaattaccagactacattttaagaaggtacaaacgttgttttgaatgttaagaattctttaagattttctaagttgccttgtaactggagaataaagaatgaggtttaacactaggatgaataacattcaacacatcagttttcaggggtctagagttagatttgatgattacagcctcctgtagtcaataagagaagagagatgtactaaccacacgtagactgggaccatttttttcattgtaactgatgaagcccaaaacagcagggccagaacttgggtgaggggtcaggtaagtgagatactcactttggaacaaaatataaaggaggatgttaaatctcatatcacgacaaatatttcaatgaaatatttttaaaacttaataagaaaaagtccacaatgaacaaggtattcaaattttaaataaagatatagaatctgatttttccttttgcctcaagctccacaatgctttggtagagccctgcaatacaatattattctaagattaatgaactccatttaatacgttggaaacatatttattaaaacaagtgcaagtaactagaatagtgtgggggtaaatttcatcattagatatcattaaaattagaactagaatgcactactaatttttaaggtgtaattagtcattaaaatcacttttattcaaaaataatgacgaacacagagtgtttagtcagacattcttttaaccactttactcatataatcctcatgacaacctgctgatatagtagaaaaggcccactgctacagaattcccaatgtaatattcattaaaatacaatgtctgtggagctgtgcagcacagtgcctctcataaaattagggtccccatttttcagaagaaactgagctcacatagtaagtaccagaatgaaatttagacccagacagtccagatacagagtgcttgttcctaaccatattatagaaacaaaccaagcctctcaaagatcaagtaatgtagcctatttctacctcaacctctgtgtcactagacctcaaattgcaattaacttttaataataatgatcctaagaaactctccaggacactggactagacaaagatttcttgaataataccccataaacgtaggcaaccaaagcaaaaatggacaaatgggatcacattaagttacaaagcttctgcacagcaaaggaaacaataaacaaagtgaagagacaacccacagaatgggagacgatatctgcaaactatccatctgacaagggattaataccagaacatgcagaagtccaaacaactaaataggaaaaagtctaataatctgattttaaaatgggcaaaagatctgaaaagacatttctcaaaaaaggcatacaaatgtcaaagaggtatatgacaagctgctcaacatcactgatcatcagagcaatgcaaatcaaaactgcaatgagatatcaactcattccagttaaaatgccttttatccaaacacaagcaataacaagtgatggtgagaatgtggtgaaaagggaaacccttgtacactgtttgtgggaatgtaaattagtacaaccactacagagaacagtttggagtttcctcaaaaaaactaaaaatagaactaccatatgatccagcaacccactagtatatatatacctcaaagaaaggaaatcaatatatcaagaatatatctgcattcccatgtttattgaaacactagtcacaatagccaagatttggaagcaacctaagtgtccaccaacagacaaatcaataaggaaaatgtagtatatatacacaatgaataattatttatccataaaaaagaatgggattctgtcatttgtaacaacatggctgaaactggaggtcatattgttaagtgaaataagccaggcatagaaaggcaaacgttgcatgttttcacctatttctgggagctaaaagttaaaacaattgaattcatagagactaaaaggatggataccggggcctgggaagggtagtgggggttgggagaagtggggatggttaatgggaacaaaaatataattagacagaatgaataagttctagtatttgatatcacaacagtgtgactgtagtcaacaataatatattgtacattttaaaataactaaaagagtgtaattggattatctgtaacacaggaaaggataaatgcttgaggtgatgtataccccagttaccttcatgtgatcattaggcattgcatacctgtatcaaaatatcttatgtactccataaacacttagtatgtactcagaaaaattaaaaataaaagaaaataatgaccccaagagtagattctgccataaattttacagaaaccagtcaaaatttgttatatatattatatgtaatataaacacatatgtatgtgtgtataatacatatataatacatatgatgactcgccattgaaataaccttgagagtcactcatactaacttaagaactgcaatccatctctgatattcacccgtctacaggccaaatacagaaactagactaaatacctaaggtatttttataaaattgtgatggatactaattctgcagctcacaggcattgaaaggccaattgaattcagacccctggccctgtcattaacttctgcaggtgtataactggtattcttgtatcagacagccaatgtcatcaaaatggaatacaacaaattgttatataaaacattttagctctccacattaagtagcattataattatatgatgaaaccagagcactgtgaaggattataaaaaagattaaagaattcagaataaacacttgagaccttgtctaatacggatgctctcaagtaactactgttgccaattaacgctgctcatatacatgtggatttctgattatctggtttactactaaattaaagagcaaaaaataaaaaataaaatctctaatgcctctactgtagaatatttctattgatattttggagggatctataagaagccaatatcaaagcaggaatgtcttttagaaacaagatagatcaagcttgtctcttgagaacatgttattctagagaggaagaaggagtaagacatgggctggcagcagagtactgggggcggggggaagaatcaaagacagagaaatccagtggaagtaaagtatacgaggcctttatgctacacaaaatggtgggcatttccatagcactggtacacaggttggtgctgttaatcataccttattaattgctattagtaatctcatttagaattaatttcttataagtatcgtaaatccaataatctgctccttcctccttatgctaacatatcacaagagaaaaattttaccctttgtgaatttagaggtgttttcatgactagatgacttattcaagttagcactttgtgtgaatctttgctttgctgtgtggttgagtggcagaaagcaactgtaagcccaggagctatgttgacatgtgtctcactggtcaaataaggaattagatatgaatgtgtataaattatattaaacccatccagactggaggaaaacaacctatttgataacaaatttataacatggcagtcatgttatatatatataacatagcaatgctcatataatcctgagtcttgttaaaataaagactcaaagtgctgctacagactgtaggatatgatttattttgatatcaaagtgttttccgcagcttggttacctttgtgatttggatcagggaaaggtgtgtaccctatcaccttaccctatgctagatagatgtaaattttccacagaaagaagtggtttgggtagtcactcagttactagattcagctgtttttgaccaagccacaagaaataactcagtaaacaaaaactctttgagaagcaggtctaagtttaaatcccaaatcagaatgcctacactggaggaaaaaatcagtttttactggccatggctttagctataggcccaaggatctgtttcttggagagtctagttgataccaggaaggagatagtagttaaaattaatgcaatataaaatgtttcccacagtgatgcttaagtgaacacaagaacaaccctaatagctgattgcttcagaaaagtaaaatataaatggtcattcagaacaacaggtttgcacaggagaagaaactcagtaagtcacgagtttgaagaattgtattaagtttcctgggtcttaagaagaagtggcttctacattcttagacacaatgaggatgaaaagtttgaggttaaacctgtgtattttcattctctgtcaccttaattactcaaggtctcagtgtatttttgtctagtgtactatctctgtccttgttgtttcttgattctcctacccactgaatctatggctgagcacatttgataagtgtgtagttctgttcagtttcggatctgctaagatatttttaaagtacatagtgagatcataaaatgagatttttttttttggtttgaaaaattttgggggacaaataatatttaaaaactgtcaatgtttccacatttcaacattagatgggaggtgcctaggaaccatagagtatattgcagaaaagcaaataactaaaatgcctcaagggaagttcctgcaacacagagaaaagaaaaccattcagatgcttgggggaaaagcttagaaaaagggaaaaacaaaaagaggcagctggggtggccttcctccccaacagagctgaacctaagaacatccagataaaaccagagtcagaaaatactggtgttggttccacattcatggggaactctgaaagcctctcagagtaatctcgatttttggcagggtactctatcagtcaaggcctaggagtagatgtggtaattgcagaagggagttatattagagaagccccaaagactctggcgggttgcagagaagtcctttgtattttcaggtggacccagagaaaacaggaggactaaggggtcagcagaggtctggagctcacgcaaggagtcttccagaatcttgagcctgaaggcaaccacaaaaccccatgtcctgaagggcatgcacatactgtgcccaaacaaccagccaggtcattttctaatgcttaaaacatgaggtcaataccagacaggtgataaatatgatgctataccaaattctgctgccagaaatcctctccaatgcgctctggataaaaagatatattaataattatactgttttgttttttaatgtctgatctagctccttctgtttttgcaagcatacttcttagtggtttctttcataagaatagacttatttagcccatctaatatatgaatgatttcaaagttaatgttaacaataatagccatcactgattatttccaatatgtaccagtcagtatgcattgcagccattatcattaattgttatatcaattctctgatgtaggctttttctatccccattttcagatatcaaaagttaggtaactttcctgaagctgcacagctagtaataactcattccactgtatcacaccaaattacaacaaatgatttctaacaagtgataaaccctgacaacctctgagaacgaaaaggccagagaattagaagttaataaaacttactttatttttccctattcaacatttgtattcaagattatttattttcttagtggtcaaaacctactaggtactagaatgagggtcaaggtattgagacattttgtttctagtttcagctctttcattaattgtgtgaatttgagcaagtatctttattgctttttcatctgttcagtcaggataacaactgcctcattttactctcagtattatatgtatttctagccttgtcttaattgaaatacaattggataatatgcaatgtacttttacggtgagttaaaaatgcattattatattcacatataaaattatatcagtccaggcatggtggctcatacctgtaatcctagtactttgggaggttggggcaggaggattgcttgagctcaggagttcgagaccagcctaggcaacatagcaaaacctcatctctattaaaaaaatagttggacatggtgatgtgcatctgcagtcccagctactcaggaggctgaggcagaaggatcgcttgagcttgtggggttaaggctgcaatgaaccgtaactgcaccactgcactccagcctgggtgacagagagacactctgtctttaaaaaaaaaaaacggaatctaaagtcaaacacatggatctctgcctaggtctcagatgaaggacctggatgggaaaacatctcatttctaagtctatgtgggagtggtaacttttaaattaatttataagaaatataaatgtattagaaggtataaggttaactattagatagttaattattagaacatttcagatgctaacaatcaaatatgatatttttatccatattacaaccaagttaaggtaagaaatgaaacagcatctcattggggtggaatcccaaagagatgtaaacctgagtagtttcaaaatatgtgatggagaatttgaaaatctgcgcttatagattctgccaacagcggatggaagatatttgaaaataataataataataataataaatacaataataaaatgatacaaataaacaatgcactgtaacaactatttacatggtatttacattgtattaggtattataagtaatctagagatgatttaaagtatacaagagaatgtgcctaggttatatgaaaatactacacctatttaacataagggacctgagtaactacaaattttgccatgtggatgaggaggggtcatggaaccaatccccctcagatggttatatcatataacaaacatatgtcttgttatttgtgttgttgcatatttaagaagtctccaacagtttttcccaggactgggttttaaaaggccttaatctactgataaaagctttgtgcttaccctaaaaagtagtcctcctttacttcttttctagcatgtcaagaaagaaacacccaggaagacattagacaccctatgcatataaaaatggcaataaaagaaagccccaaatgccatctaaccaatagaagtagaataaattggtgggcattttacattcacttaaatatccaaatgatttaagaggatgtcgctaaaaattggctgatatattggcttttgtaaaaaaaaaaaatctgaattgaaatttggatatgaaccaaaagcttccgtcttcaaggacttttcaatttcctccagtttgcacgtttggaaactgaacggttcagcatatctctaataaaaaaatcatctcccaaggctcctttcctatgcaggcaaaatcaaattaacttcaaacagaagaggtgagatgcatacatagaggaagtatcaaactctaacatcactttgctccagctctctaaggtctcctaacgtctacctaggagagaaatccaaatgttaacttcacccaagatcactctgaaaaatctaaagagaagtgtggcttccaaaagagaatcatactaaattaattattcccctatgctgtcaggatttgcattgacaacaccatacggtagtattctggacttttacttaagaagtgatgacagccaacaagattccaggctccattcaaaggctacaaattgtgcggcacccttgccttgctagctgggcagccatttgaatcaggggattcttgtgctttggctgcagaagttgaaatgatgctctgtatcgtttgagacatgaactgctgcgtgcacaccacacaacgtcccccagcaatgatgcattgcactaatatgctctcagagcatactcactgggatgtattagagcaatgtatcaccaaaacacttaacttacaggatgtattgccacgtgaggtggaaatggttgccaatgaggtgttttaaagataatttctaaagttgtgtattaaatgatgtttatgtcacctttctggtgatttggaagataacattttgagattctgttatgcttgatctttggtattcagtgccttttccccctcacaaaagcactcttattgcagatcatttttaatcggaaaactcagtaattgagcttcacctaagtgtgacacaaaatgaatgaagtttgtgtgcattgctgtgcaatcagccctgaaattcagttgtgggcataagccctggtgctgggctgcatcttccccagggtgggcgacatatgggctagcagtaggccctgggcagaaaacatgagagccaggtagggatgctccctagaggcagaaagctctctctgcaggcacctacttcctctgttccaatcccgcataccgtttaatgacaggctctgtattgctatagttatgtgtgccaaagaattctgatctctctttttattgcctaattttattagataaaaggatggagtaacattagaaaactagcaatttacaaattctaaaaatagatattagagtttctcttattatatatatttttcagattggctaaaatatgttgctggatacccatttcataaggacagagtccacatctgttttgcttaccatttttccccagtacaccatgtctgacttgtagaaagtgttcaataaatgtttattcaatgcattaatagtcatgcttcccttttacagtagagctatttcatcacaactttttctttggaggcaaagcatgacttctttcaagcagaattgccctctctcgtaaccagaaatcaaattgcatctaataatgttacatcatggcagttacttttgaaagagttgttctaacctctagaccttgcttaaagccaacctaggatctttataaatatttatttataaaaacatgtgaaaaagacagcagggagggggagaaagaaagaaacaatgtgattattactagtatttaccagtgcatttaaacttcactagattcatttgaaaatatgtttccatacacatattttcagaaaagtctttattttgtaaagagatatccacacatatgcacatagttaaagctgcagcagtgactacaaatagatcagaaaaaatcatatatggcttatacaattagtgttctcatgtcataatcatattttgtatactgcagttttttagttatggtagtgacaaatttcctggtatatttcctcctcagtaatagattttttttggcatttttgacagtgtcatatattctagtgtccaatataaaacaaaacaaaaccctataattcctttttatagttgcatttcaaactaataccagtgcattcctgattctcttcctattaaatcatgtttttactcttttttccccctcatttcattgtacatcataggtctccaaaatagctttgattttaagctacctaaagaaaaacatttttttacttgtaaattcaatagcctctctttcattaattaccagacacacacaaacacatacatacccctcttgaaaatgcttccagttctcttttatacattctatataaaatagatgtaagacttgcattgccaaggctgaatttgttcgtatccagctgggtcagggtataatatgatggcagctccttttttaaagcattgtcaatttatatttctcctaaaagatggctttcctgacctcccttttaactttctcattctcatccctctggctttttccctctttacctattctcttcccccaacctcctctgtggttaagtagctcttctttggggctttaattagtaaatactgcacctctatgatgtaatttattatattcttgctaatcttttctgacattttaatgataagctcctggtcatcagcagccatattctcatccaaaacttgtatctatattcccactatggcaagtgatagactgctactatttggttgtgaattttctgaaccattattacgttttcaaatctcagcattttttcacctaaagatgattcttggtgagacgcttcacatgcagaaatcaatgaataagtaatgtaagctgagagacaactctgaaactattatggggacgtaaaagattaaattagaacattcattttttgtcctgttactggcacaaataaaatatttgaaatccaaaagaaaatgttgttaatctgtaaatataaaataagtctcatcaactgtaatagataaatgttagctgcatatacactagttgtctaaaaaaaaaaaacaaagattactggcaaaagtatctaattctatgtctcattagacctttatgattgatttcccgcagtatcactgcacggcagcattccatattttagttcctaagatcacattatatatggaattccagtttttctttgtttcacttatgtgtttagctgaagaacattactaagtactttttcaacctgcggccaaggttaacaccgtgtaaaaatgccaataaaggagaatatactccattatatctattgttatgatcaacaacttgggacatatataaagaaaattctgccataatacatttagtcacggtaatagtacctgactgaaacacacacacacacacacacacacacacacactaaatggtatgtcttttgaaaggaaataactaaattaaagtcatagcaatccagaatagtgatatatgtgttgggaagcccaagtttttaggagatggaataaattgttaaaacagttactaaccaataattttagctataatatgcaataatgtcatctaattatctttttgttggagcacttgtgcatagatagatactataaagtctgacgtgagttccttaaattatatttaaatgtagattaaaagctaggaaaattgacattcagatttagcaaagaaagaatagtattttcctactataatgttacaaaaccattaaagactacaatttggtactgctcattccacaacaagttgttgcagaatattatgaggacacaacggccctgaaaatcttcatttccaatattaaatccaatgctctagactttcttgtgctttttgtttttagagcccttgaacaaaactaaacaaactttcaatttctcttaaatcactctttttgatttgttcatagcaagagcatagtgtcttggactccggaaaggctcagttccagaaagtccacataggaagggttaataaaacaacgtttgataggggtacttaggaggattcttttgaagctgcatttgtacagcaagcccataactttttaaaaaatttgttttgaggtcatgggagattcatatagaattgtaataaatagtgcagagagatcctgtgtgatcattactcactttccctgaatggtaacgtctttcaaaactatagtacaatatcacaaccagggtatttacataaacacagtctacctatcttaattcagatcctttacttttatactcatgtgaatgtgtgtagctgtgcatgtgtgtatttaatttcatatcattttatcacatgtataggcttgtatatccaccatcaccatccctcatttttaacagtgtatgttataataaattaaaaaaaatgctaaagctttttaatttatattctagatctagatagataaaaagctaaagctttttaatttatattctagatctagatctagacaggcatgagatataaatcattcatattattattattttgattggggtcactggaaaggcattgatgagaatattacatgaacgaaatccacgcctccccctacaacttgctctcaacactgagggcatctggggttagacttcaattagataccatgtaaccatcacttcttacctgcagcacacatttcattttcagatttattttcccttaagctgcatttcctattttgacatgcttctctacagaaatcatccaagatattaatattttcttaagtcatatgatcctaatcttaatgtcataaaccccatccacaaactgtgggtagagcgaaatgaggcgtcttgttttgcaccagtttttaaagcagagcaagtgctttttgggctacaggaccaggaggaaaactgattattagctattgttttctgatactaagtctaggatgggattgattacattttgtacttttattctagaggtgatgtgactaaataggaaagcctgtattagactcctaaggagacaaaaaagccacaaagaaccctaatctaatttagagtgtgatgcagggcatggtggctgatgcccgttatcctggtacttcggaaggccgaggcaggaggattgcttgaacccagtttgagatcagcctgggcaacacagtctctaccaaaaacaagcaaaattagtcaggtgtggtggcatgtgcctatagtcctagctatttgggaacctgaggtgggaggatcgcttaactctgggagattgaggctatagtgagccaagatcacaccactgcacttaagcctaggaagaccctgtcttaaaacaaatacaaaaataaaaaaatatatatattttggagtgtgagtgtagaggaagtgagttgggagttcactgtataatgaatacagcaagattcacaaggttgcattattgtcatccagctttttcataaatatgcatgtaatatgaaggtgaatctagtaggagaatatgacaatcctaccactggaaaaagcaattgaacatcaggtgcatccttgtccgagatctacataagaaagatggcaatgtcactaaagttatcatgaaagggttatattttctgatgggggattcttcagaagaatgttttcaagcagcaaggagatttttctgattgaaattatttatttgctttatttcccttcttgcacaatcttttcccatgaggtttgagaacaggtcttattcttctttatatttccctcagattttagactggctagttacatgaaataactattcaataaatatttacagaattatatcatgcctaaatttcatatttcctgaagaaaatgcacacccatattttaaaagaaaacagaagttggaaaacagacctgcaaattataaactcagaaatcgatgtcatccaatgtatgatgctgggtctattttttaattttagctccgttgtttattgcaagcatccatccttcctataaatccccacacctacatccataaacaaagctagctgaaacccacagcgatctgggtttcaacgtgtttcaaaataaaatcatttaaaaatgatcagacattaattcaacacattggtgttaattaactaaggtctgaaaatgtctataattatttttagttgttacttgattaacatagagaagtatatcactattattttctctagaaataaaactgagtgggacagattatgagacacttctgactcacctagttctccaaaagatgctggaacagagagctacgtatgaacaagaaatgtgtcaagtgaaggaaggttggaagaaagtagaggggtatatgctggacaaaagactactcaacccagtagtcaacacattctagatatctgaaaactgagttttccctctcctttgtggcagtctggttcaagagggtattgttctctctccactgcttgtctcctcataaatcatctgagcagaagggcttatttccatgctatgttcacagctactataccgtctagaacactactgggtctaaatacatactaatgaaaataatggagagaaattaaatataagttgctatagtcccaaaagaactcttagaatatggccatacacatgagtaaattaccttaatcgaaggtaatataaccttgaaaatgtaacaattcctttaaaagtattaaaaaatacttttttggaggacaatatactatgctgagacaaatcaacagaattatgagttttggatttgacattcagcattctcatttacatttgacacctataaaacagaaatatataaatttatgaatacacagaagttccctaaggacagtgatttttgtctatctgctgtatttcttgaattctattgtctggcactcaaacatatatgctgaatggatttataattaaaaataaaaatgtttggctagtgaaaatatcctttcttggcctacagttttcaggttaatgtggcagcacctcgtatctatgcatgccaaaaccctaataatgataatccaaataataacactcatattgctattcccactttattggatagcttatgtttctctcttcaaataattaaaactcaaataaattaaactggccatatttcaccatccctcagattcataggtaatataaaggataaatcagtagcccagtaagagacaactaaaaggttgaatttattattctttgcaaccaataagtatgggctgagttcttaaacaagagttttctgtgataatttttattaggtgcaaagggaactaatgaggagaaataggtttaaattgaaggtgagaatttggagggatcatgagaaagaatgtcatgatgatgacagaatggtactagcaagagtctttggagtcttttgagagtgtcaaggacagagtgggcagctacctgttctggacaataagacatctagctagaaatgatggagccaaaccaggttatctttaagagctcaaataaagtaactgatttatccaagagcatacagttacttagaggcagatccaagactatatgccatgtatataaactaggtgcgcttggaaccatgggctaggtcatggtggagagtgacatcttaaaaatgttaaaaaagctatgccgtatacatagtaatatttcactctagtacatcatcacagagagaatatggcttttctgacataaatagtcataaattagtgaaatctgtttgagaacatacaagccccctgttcgcaccaatttagttttgttaataaccgggaagatttggttgatcttcagaaagttttcttagctgcaggattagcaaaaggattcctcgctataaattgcagctttgatttgaaatattagtttaatagatggctaacatctttcagatcctaaaaataagtaataaaaaattactttgcagggcacaagggctcacgcttataatcccagcactttgagaggtggaggactgctagagctcaggagttcaaaaccagcctgggcagcatgccaaatcctctcacctgtggtcccagctacttggcaggctgatgtgggaggttcgcttgagccagggaggcagaggttgcagtgagccgcgactgtgccactgcacaccagcctgggtaagagtgagactcgtctccaaaaaaaaaaaaaaaaaaaaaaaaaattatttaccaggtgaaagaaagaaaacagaagagaataaaacaaaaatagcaaagaggaaacaactacgaacagagacaggggaagccactagcaaaactagcacataaacataggctacgtagcatctctgttctttattaaccacactttgggatctgccagaaaaaaaaaaaaaatcaaagtaccttatatatttaggtttgtgtttatttctaaaatacttatatgacaaaagtactacctcatatcaaaatattaaaacagctttgatggcttccagttcccccgctgaaccatatggtttcagttgggtttcagttgcccatcaacccccgcaatagctatcagaaccagtcccacgtaccttacttcacagctgtcactcacttgcaaaaattctaatgtctaatcacagtacacttgggttatttccctaaggaacccacactttgtatatattgtctctctccctctctttcttctctcttttctctctgatcccattattcattctattcattcaatactttcacctcccacctagttttttttttttcttttagagacaagttctgccgctgttacccaggctgcaattcagcggcatgatctcagctcactgcagcctcaaactcctaggttcaagcaagcctcccatttcagcctcccaagtagctgggactacagacacctggctaattttgtttttaattttagtagagacaagttctcactatgttgcctaggctggtctcaaacttgtgagctcaagagatcctcttgcctcagcctcccaaactgctggaattacaggtgtgagccaccacacctagcgcctctaccttttaacctgattaacctactcacctttcagaactcaggtacatcaaagctaaaaaccgttccctaaaatcctcctctgggattcttacagcaccaagggtgtactcctatcatagaatgacaatgaactgttgcatttgtctccatacctgccagtttccacaaggaatgttacatttactgaggttagagactacatcatgttaatttttgtatcttactgcctagcacaacactcgatatataggggtactcatctaatgtttgaagactgagtaaatagccaagatttattgagcaccttctgtacccgaagtggtacaggcattgtactaaggatattatattcaaggttcacagaatctatcaattccttctcccaatctagaattttctttgaagaccccgaccagatgtcctagccctcaccatcttccaactatcaataattagttagccatgcctctggcacatgcaaaaagtaagatgatgatacacaaaatattaacataaaattattacaagtatctcttccactgtatcatgtgcttaaaatccctgatttctattcctcaccttgaccccaagtgactagtgatgagctggacatttggttggagcccaataaatgtttgttgaatcacaaccatggaattgacaagagtctagtgatctttttcctcttctaaccatacagaaagaaaaagtctacccagtatactgcattaatacgtccttgaaaaattctgatttctagtttgggcctcaggatacttttgaaggagagtgaagaggttatgtctttgaattaggagagaaataatttcaccataaatccccaaagataatgggttcaaaggtatgttgccctaagaaagttattttatttttgtttgaggcaagccgaaaactatcccttcaactcaatatgctaaaaagatatccttcaactcaatatgctaagttgtttgtgtggccatatgttcctatatttctaggtcagtcttgatcaaatacttttcttccatgcaccccataaatacacttgtactcatcagcccatctgtcctgctttccttggcttggaaactgtggtcattgaaaaagttctatttattccctaccaaccatctatctttttttatgtttaacaattttaaaattatttacactccctttctgaacaaaaggaataaatgggcagctattggcaaagaagataaatatgatgagctattctatgttgacatcaaatgacttagcaaagtgcaagtggtggagcaaagaagagcaggttttctcctcatagtttaagggttctgttaccttaggttggtaaaccaaaatgaactggtcttggaatgttcaaggtcagtattgatgctgccactatagtttggtatgctggtttaaaatgctgcaaccacagtatatctacatgaatgtgatggaaatatgagagttcacagtatatctatatgaatgtgatggaaatatgagaatctcagccccatgtagaaatgagaaggtaaatgtatcccatacacaaaataaaatagatgaataattctgggatgttctcgagtgtggcatatagtcactgacatggtcactgcagtttgatgctgtttctcaaacttgagtcgtgcacacaaagttttttttcataaaaataaaagttttaggtccctaagaataaatttacatacctcaccctcttcccacagatcctgagcattctgatttgaaaaataatgtagtagtagtttagcccatgaattctagtatcagatctggattcggtgttcggtgtgcttagtaaccgcaaaacgttaggcaagttaacctttctaaacctcagtttcttcacatgtaagaccgggacaaaaaaaccactacccttaagtaaaataagccagacacaaaaatacaaatattgtatgattccacctatatgcagtatctaaagtagtcaactccagagaaacagaaagtagaatgatggttaccaggggcttgtgggagaagaatatgtggtgttgtttaatgggtgtagattatcagttttgcaagatgaaaaagttttggatatctgttgctcaacaatgtgaatatacttaacgctaatgaattatatactaaaaaatggtcaagatagtaaattttatgtaatttgttttttatgattaaaaataatacatgcccaacaggattacaagaaaactaaattttaaaatatgaatataaagtactttacctaatacttggcaaagtcaatgcactttataaatagaggctattgaaaataaagcaatcaaaattttcaaaagtaataagcacacagaaatttctactgattccagtaaacaattttcattccctagtcactatttttaattggtttttgatggggcctcagtcaagaagagcagtgtactcattcagatgattcattcatattgccaacttcagtgattgccatgaaccctgttctttcagtgaagcagtaagtggtaacttgagaagtgccagcctcctaagaggggtcactgagttacatttggtcacatctactcaggcattctggtaggcaacaaccatttcaaaaaacctactgagcagagccacacagattttctttcttctggagaaaatgggctggtgacatgtctgttatttgaagcaagaagccaaagtccttctcaaattgactcccactcttacctcgctgatacatcctttctcacttaatttgctccatctacattagcctttttcagtatgtctgaaatgccccaaacctacttaccctccagggtgtttgcacttgctgttctttctacccagaacgttcttcctcaatatagccaaagggatcaccctcataccttcttcaagtttttgctcacatgccactttttcagtgtagctctctgtgaacatcttataaaaataattgccaccatcttcttcttctggcccagggacatgtacttaattatttccacagtaataacagccacagataaattatatattttaaaaatttatctagtgtctgtctccttccagtatagtacaagctctataaaggtaggagtcattttcccttttgttccctattgtataccgacctataatagtgtctggtataaagtatgcacatattaaattttttaatgagtgaatgtattggtgcaagccttattcaatatattaaaaaaaaaagtagactaatcaaaagtattctccccacaaaagaaacatctaagaaaaattagtggcttcacaagcatacccttattaagttattttccattaaactcaagcccttttccagttcagtgagaggtcttctgtttctctaccattaccctaagtggaaggggttggaaaacatagaagctaacacctcaacagttgttgaaaccaatttgggaatgtagaggtacaggtagataaatgtagttaataatgtattcatttacaataatacaaatttcctgttatagtaattagctttatgaaaatattccttagattcctggtttatgctagaaaataaaatgtctataaatattattatatttgccattggtgtcaatacatggcttctgttttgtattaggaaagataatttccaaagaaagaaaatactagaaagaattcacaacagtgagacacaaatcctgagttccaatgcaatcttgtctctacccagctccctgaccttgggcgagacacaatcttttggtgtgtctggctgtaacagttgggttttgctgcaaacctacttaactccagtgagcctcgatttcctcattggtgaagcgagcataagaatccctgttttggccaggcatggtggctcacacctgtaatcccaactctttgggaggctgatgtgggcagatcacttgagaacaggagtttgagaccaacctgggcaacatggtgaaacaccgtctccactaaaaatacaaaaattagccaggcatggtggtgtacacctgtggtcctagctactcaggaggctgaggagggaggctcacttgagcccaggatggggaggttgcagtgagccatgttcaggtcactgcactatagcctgggtgacaaagcaagaccctgtcttaaaaaaagaatccctgttttccctattgcagaaagttgccttgtaactgaaaaccaagactcataccatcggtgatatgctaggtgaagttaagtggttcaaaaactgtatttaatttctgaattatagttatttggatgtgtacttggagggaaaaaagtataactagcatattaaaattgtaaatatatgaataatatttaggatgagattaatttcaaaagtaaattgtttaaatgtaaaatattaattaaatgataagatagagaatacatatatatgtctcaattatgaaagtgatatacatataaatggggtttgtgaaaaaaagcttgaagaatcaatgttgatggtttgtgaattttctttccaaagttaacagtacaagccagggtaagatggtatttatatattaagacaaatgcaaacaaaataagatgaaaataaatgtaaataatatgaagtattatgattattttagtaagaaatgatcttctttgtgagtgcctattatattctaggcactcaataagactaggcattttatctgttagctaaatgcttgctagcaaactgactgcaattgagttagagcaagttgattgtttcctacatcatacatccaggccataaatccagttttgctgattctagcctatgttctaggagagttaaaattttagaaacagcatccagaattcaataaatatatgtttttaaaaaaccaaaaggcaaattccgcaaatgaataagctgctttttttaacatgctcctgatggctccctatggcaatactgtggaaaaatagaatctgagccttatgaacaggaaataataaaaaataacattaaactaaatagtaactgtgacactgggtctttgacagagctcaaagattctgcacctcatgaaatcatatattttaatgggaagtgtgtagaacatatacagtgtgtataaacattgtgacagtataggaagtaactaacaggaactctagagtgctgaatgtctgactcctccgacttcatccattactgaaaaatttgtaatggtaaaaacgtgccttcagtaagttatagtatttctgttctagtctgttcttgtctatttattggctttttggagtttacctagttacctattttctctgagtcttaattttctcagattaattagaaattagttatatttcatcattagatatctaatgatgagtttgctagtacaatgccggttagactacccacagtgaagaggaagatgaaccctacggctcagagtaccgcggcagatcatttgatgttacttctgtgaagcgtagcaagtcaactaaatactttgacgccagtggaaatggcgataattatagtagcggaggtgaagtaggctcgtgtatccacgtctatccctactgtgaatatatgatgagctcatacaataaatcctaggaaaccaattgatttcatagctcagactatgcccatatacccgaatggttctttttttccagaatagtatgttacgatatgggaaattatcccgaagcccggtaggatgagaatatagactttggggtgaccgaagaatcaaaataggtgttggtacaggatagggtctccccctccgactggatcaaagaaggtggtatcaaggttgtggtctgttaataatatagtaatgccagcggccaggactggaagggagaggaggagtaggactgctgtgattaggacggatcagacaaagaggggtgtttggtattgagatatggcagggggtttatgttaataattgtcacaatgaagttaatagcccctagaatggaggagatacctgctagatgcagggagaaaatggtcaggtctacagaggctcctgggtgggagtagtttcctgctaaggaaggatcaactgtccagcccgttccaggtggacatggctcactgcaacctccccatcctgggctcaagtgagcctctctcctcagcctcctgagtagctaggaccacaggtgtgaaccaccatgcctggctaatttttgtattcttagtggagacgtttcaccatgttgcccaggttggtctcaaactcctgttctcaagtgatctgcccacatcagactcccaaagagttgggattacaggtgtgagccaccatgcctggccaaaacagggattcttatgctcactttaccaatgaggaaatcaaggctcactggagttaagtaggtttgcagcaaaacccaactgttatagccagacacaccaaaagactgtgtcttgcccaaggtcagggagctgggtagagacaagattggcactggaactgcaaatgcctatgatttgcctgaaaatagaagggagggatctaactattgtctgtttcctaggcacgtgcaccctcattagactgtaagcaccacatgaagtcagaaaccattaggttttattcactattatatccttaatacctggaatacagcagatttttcataagtatctgaatgaatgtatacacaaatgaatagaatgtatttatggaacacctgtcatgtgacaataactgtgtaaggttcattgctcaagtatgaagcatagtaaaataaatgaagacaatatgtaagttttaaaacaccttgtaaatgtaaaatgctacaaaagcatttttagagttttaaaaaatcatttacttacatgcagttttaaatcacagccctcaaataagttccaagtcagagattttatcaagattgtatttacttttttaaaaaatggagttttatgctgctgtggttatggaatgtgcttgtacaatatatatatacatatacatactgtttgatgtagctctatacaatgctgcttctttataatattgcttatgaactattttgtttaatgccactgcgtctatgaaacattatagactattctgttagtatgcacagcttttcccatgaccttaatacctttatatacctaagcaatgagagtgtgggagaatgtattgcattcccctggacaactaacattaactcactgttacagacctaatatgtgtgccccctctccacccatattcagatattgaaatcctaactcccagtgtgatggggcctttaggaagtgatgagctcatgagggtgaagactcatgaatgtgattagttacttccctcataaaagagagcccagagagctcccttacttctgctatgtgaggatacagcaagaagatggacgatcatgaatcagaaaatgggccctcaccagacactgaatcttccagagccttcatcttggagttcccagactctagaactgtgagaaaccaatatttgttgtttgagctgcccagtctatggtatttttgttatagcagtcagaatggactaagatctcaacatactctaaatactctcagcaattggctcaccatactctaaataatataactccctgccctgattgaaaatgttatgttccaaacacagtctcccccactgaggtctctgtcttttattaagtgttttaacgtagtggttgacaaaatatatacaaataatattgatcaacatgctgcaaagaaaaaagaaagtgcccacagcactccaggggttcaactaacaaaccagtggggagatgaaatagaatagagctggttctttgaggtcagggactgaggcttattcaacattttatctgagcttgttgtttattcaacattttatccgaacttggtttctagcatgtagtaaaatgtctgatgactcgacaaaggaaaaaaaaaaatagatacctaacataagaagagctattagtataaagactctgaagctgactgcctcttcataattaggacagtcaaggaaaattctaccatacactatatatcagatagatagatagatagatagatagatagatagatagatagatagatagatagatagatgtatactagtcaggcctttaaaaaaggacagataatgacctacagaaaggaaaaagtaagccaaacaatgatagtgatgtaaaaaaatgtgggtcccaggaagttctgagttatctatttttatttatcataatgcctatgatttccttcttctttgaagtttcctcacatcttattccagttctcttctctgctattgtgattctgtccggtttcagtggctcttcccaagggggctgacgacagcgaggcctctgtgctgtgctggggaggagggtgacccctatctgggacagcacatggttctcttccctcagtggatgctgccaaagccgagcagggaaatgcgccccagtgtgcatgctaaatacaagttaggcgcccttcagcgaagatttcggcttggcttccttcccttggctattaagctacattcccacaaaattactacatgtctgaggtttctaaaaccttttgtgtggatctcaaacagttactgtgttggatccaaatttcgaccttggttaagcaagcctcaaatccgttccaagctgctccaggcagtgatgctccaaggacacccgatgcaaggaggagataagaataacctctacagcttggtgatcacctactgtgtgtcagtcatcgtgcttcactctttgcatgcggcatctcatttaatcctcactataaactgtgcttgctagctactacgactactctaattaccactaatttacagatggcgaaatgacagtttaaggaaattaagaaacttgttcaagttttacaaccaataattattaaaggattaaaagtattgaaaccctagcagtagacttccacagttggcaagggccagggcaaatgacaccagagtgatctaaacagcctgagtaataataaaagccatcaatccagcacataaactgcctgcactctgtgcatcccaaaagacaaagagaaaagtagtaggccatgtttctttatgcatctaggtggcaagtctatgagctgagagacagtccctctgtgaggagaaacagaagttcacaaaacagagggcagggaggttctcttagcttgtggcaggcaatgagtcaggagaggtaacttttggaacagagcttgctcttggcttagggagtaaaaagtgaaaagacttccaaggactaacaggttctctccttacacagggtaatgaaggctatcacactcagggcttagactttgttgatttatagactttgtaatctattgcagtgagcttgactgttttgattctttttttgatacaggtatctagttcaggggaaaagatgctcagagttagaacccttgtgtatagtttgagtatgtggttagcgaaagcctagagaaaaaaattttgggaaaacaattttgtccaagtgcagagaacaaaacttgcattacagcaccagcagcagaaagcttgtcataaagatggggaagtggagcagtttcccagagcactttatttaggaaggcctcgtagccaaatggaccataatcaaggtggtgatcaataattactactctaaaaagcccctggcataggccaaatgaacctctctttcctctcccttcaccttgatgctctgctctcaatcactacaaaatgaaattctcccagatcagagtctgtagtttttgtgaacaaagtcattgatctctgatcgtgtgttattttttgtgaaacttataaacttaagcatgattaggtgaatgaatactgtggcgggataaataaggttacccaatcttatgtaaatgcacaagaatatgtttggagcatattttcttcattccagtcagcccagctccacctcagtacttctgcattgacaaatgaattgaaaatgaacacatggagtctgtcatctagtcccagcagggaactagtatgatatacttaaagggcactgaatttacaagcatgtatatttctctcatatttttctatctttagaataatataaactgtgaggtataaaaatatggtaattcaacttgtctctttgatactatcaattttaaaagccatcaaataagaagatttagatgaagaaaaggaaaacactttatgaatcaaatagactgaaatgcaatattatatttggggttctatctgatccctgcagttagtgttcttacagagtagattttgtggattaattgtgtgatgctattttatttgttgcttgcaaaggggaaggtgatcaaaattcttttgacttatttaaaaacatctatatattttggccacgttttaaagattaaacaagtgttttaaatggcacatgatagttgttattacatccaacatatctaggctgttaaaaacatcttattgtatgacatatattgtaaatgttaaagaaaagtaactatcaccatatgcttacagttgcatgaggatgatacccttgataccttagcctctgaaaaggtataaaaaaaggtaaaaattgtaaaaaagaaatatattaataaacattgatacattattttgaaattgacaatctgaaacaatgatataaacaaatttgattttgcttggcacttctccttcctgctgccatgcaaatgaagaaagacttatttgcttcgccttccaccatgattgtaagtttcctgaagtctctccagccatgctgaactgtgagtcaattaaacctctttccttcataaattacccagcctcgggcagttctttagagcagtgtaagaacagactattacagatataatttactacatatcacaactatagatattcccatacggaaaatgtatatttgcatttttaaatgtatgctcgcatttccttggttttgtggttcatatttggtagtgaggtatatcagtcatatggtcatatttatgtaaactgaaacctaattcatatgtttctaagttcctgtgccctaaaaaaatcaacatgcacatcagcactgtcggggaacctttaacacctgtaggcgtaagtatgggtgagtcatagaggaagtcatttgctccagattattaaacatggaagaaagacctcctgataactttattacacatgataacgtgtgctaggctaagagagagtcattaaaccaaaaagcaaagccttctaataaagagctgaagctgaagggaaggactaagaaatgtctctttctaaggcccatagaaatagtataaatgtgttgtgtgctacctaatcattgaagaaataagatacatttaaattttagttattgattctattcacgctaacagcattttgaatcctataaagagaggacaatcctggggacttccttgttttccctttttgccatctttcaccacagcgtgtttttacctcttgtcttactccatcctatctcaacaccaggggtgactctcatactgctcagggctaatcactccacgatgctttaaatccaactcatttattcattattcatattgtgtcttttgtccacggtaccctctgagcactgagaggaattctaaaatgaataagagttgacctctcttcttaaaaaaaaaaaaaaacaagcaaaacaatagtgaaacaccagagcggagatcttatctgcacatccagattgggaaagctggtatgttggggtgcacaaacatggggtgtgtattgttatgaggacatgtggccacctggaataaaatagtaaggagggcttttgaaatgatggtgagacctcagtgtgctgagtataagacactcgcccaagaaagaggagtttttcttaggctgtgacctgatttgacagaaaacatattctgggttttggaagaaagaaagaatttgttctctggttattattattatttagatatgagatgccttgatgttatgcaatttttctctgtactacttttttgcaagaagtggggcatgctccaaatcccttgattatgatttatgggccagggtaaaaaaaggaaaaaaaaaaaaaatacccacctctcctcctactccagtttgacccttcccctctacctttgctccaggtgagagaagcactaaatcacagataagagccagagtaacatttatagcattgcaaagatgccacggtcagcatttgaggctatgagtgtggcaagtcctcccggacagatagacctgagattaatagaaacggatcaaagacaagtacccaggaagaatgattccaggaagattggaagggctgcctcagaaaatgcatatcacttgtaattctgccatagaaagggagaatttgaaggcataagtctctcaggtgttttttgactaaagtcaattatgactttagtttctactgccattattatctatgttccttaataattctccaccagttctgctgtagcaaggagaagtgagaaccaaaatgctaaaacaatgcaaaaaataagcaaaagctttaatgtaagaataaacactgtgttatagaggctcttatctttccatcagtttcaacttctctctcctaatggcttcccaacaatgtcttggttatttcctctaagaacactaactttgcataagcatatatattcctagctagagtagactggtttcatgtttgttttgatggcactgttatgatcaggcatcagaagcttctcctcagccttttacttcttccagcaacagtccttctctctctttttgctcatggccaactttctaagaaaaacaaccaaataaaaatacattgcttctttctcttcttcacccactcttcataacctcttacaatctgagttctttggataaatatttttttcaaagatgcttccactaccttccactaccttttctcagatcgttgtcctttctcagatcttctcttttataatagttgtctacatcattcacgatctatcccatgttattaaaaattgctgtgttttggagcatcttctatgtggttctttgttgatgtacaccatttcaaaatgccaaaataaccctttgttatcctactcccctttcacagataaatcacattaaaagaaattatgcaatttgccaaaactgctggacttacgtttggaatagaaatgtctaattccagatctctgactctctccactattccactgtgtctagacagtgatactgtgtagttcacagtaattttattacaactactagaagaaagggctcagccaggtcaaaactacgaaaagctttgtatatagcagaacagatggtgaggtttgcccgttctcccttggagaagggacccatctgtctatctggcttgacagccttcaggagccccacctgacatggacattcagtagggatttccctagtctgcctggaaaataaaatctatttggattgctcctcaggtgcctatgaggaacgtgggaaaattcctaggactttttttttttttttttttttttgacccagtctcgctctgttacccaggctggattactgtggcacgatcacagtgcggtataacctctgctcctggactcaagcaatcctcctgagtagctgggacaacaggcacacgccaccatccagttaatatttttgtattttttgtagggatggggtttcaccaggctgatctctaactcctgggctcaagctatctgcctgcctcagcactcccaaagtgctaggatttcaggaacgagtcaccgtgcccggtgggacatgcttcttaatgaacaaagtcatatggagggtcttgtcttgaggagggacatggctctgtcttaggctttagttgggtctctgttatagctagctcagaagagactgaccctctagccatatcacaataccccaaacctttgaatgatgtgtcagcagggatacagtctctcttatctactactacagcagcctgaggatctactttcaaggttctatctcaccctctccagccataaggccccctctcaagctgtttcctcttgtgttaactgtcattcagctagtgccctaccctgggatacattcctttcctctgatctcttctcttccctgtcttatcttcataccttcattctctaaagtgggtgcatctcaatgtcctgatggttctggttttctcccacgtctcctcattaaacttcccagaatgagcatggcatatccaaatgttcaacacctcctccatgtgaatggctcctcatctctcttctgagaacctgttctgcattcctctttaactgcatgtttctgaagcactgcaaaaataggttttcttgtttgctgctcggcagccaacacacattcagaatgctgctcagtgttcaataaatgtttgttaagcaaataaatgagtgagtctaaaaaaatgatttgagtctccccctgtctgtcttcattaccttttctgataaaatgcccattcccagcggggcacagtggctcacggctgtaatcccagcactttgggaagctgaggcaggccaattacctgaggtcaggagttcaagactggcctggccaatatggtgaaacgtcatctttaccaaaaatacaaaaattacccgggcatggtggcaggcacctgtaatcccagctactcgggaggctgaggcaggagaattgcttgaacccgggaggaggaggttgcagtgagccaagatgtgccattgcactccagcctgggcaacagggcaaaactgcgtctcaaagaaaaaaaaaaaaatcccaaaagcctcaatacctctacccggtgaatttacagaacaaataaatgaatgagtccaaatcaaaactaaattttgcctgcccttatccagtactcttcctgccactgcactgacatcacagcacagaggagggaaacagcccttagaatcacattgatttagtttgcatctttgttcagtctcttaacaggatgcagccttggaaaagttacttagcttccttgagcctcctctataaaaaattaaaaaaataaaaaataaaataaaataaacttttttaaatcagaaataattactcttcaagtttaaagactaaatagcatgtgtaaaatgccccaaagccatttatacacatacttataagctgtaatcctaactctcctatatatgtgtgtatatatatatgtgtgtgtgtgtgtgtatatatatgtatatatgcgcgtgtatatatacatatatatacatgtatatatgtatatatgtgtgtgtatctatatacatatatattcatatatatgtgtatgtatatacatatctatatatatatacatatatatgtatatatacacatatatatgtatatatatatattttatttttgttttgtttcgttttttgagacagagtctctctgtgttgcccaggctggagtgcagtgctgtgatcttggctcactgcaacctccgcctcccaggttcaagtgattctcctgcctcagctgcccaagtagctgggattacaagtgcccgccaccacacttggctaattttgttttgttttgttttgtacttttagcagagacagggtttcaccatgttggccaggctgctctcgaactcctgacctaaagtgatccactcgcctcagcctcccaaagtgctaggattacaggtgtgagccaccatgtctggccaactctcctatttcttttaaagatacatcaactacctcatttaacactcacaaaaaccgtatctgtagatacttttatgtctccaccttacagatgaggaatcagagggactgagaaaatgacttatttgcccaaggtcacaccaaaataaaatcctaggcagtattactacagagttcatgtaagaaatattcttagattgcaagctcactaagaaagccttataaaaattcagcccttacaaaaatgggcaagccacaccgctccaaataaattgtgcctttagaaggtggtcactacttactgaagtaataaagaaatatgtttacctgttgaaatctgacttctcggttcaatgctcaactattttagaagaaaatttgtatctctaacaatgccaaatgcagaataaatattcttgccttgaaaattatgatataataaagaaaacatacttgggaatgtttttccaaagacataatgagtattgcatgaaagaggacttttaagttaaagtgagaaacagaaataattcaagggaaacatgctttactgaaaattatataagtcaatatcccagaaaccaagtaacaatttattcgtcagaataaggaatacatgatcaggaaatttgtctggctaattgaagttgaagaggttgcacttgatgaaaaggaaatcatcagaaacgcctggatgtttcctataagaagctaaaatatgcattataattccagctgtggatagaaatttaatgcatttttacaaggtacaaagggtgaataattgttttgtcagttgatggggtggattttagttattttaataactataacctaattgaaggaaagcagaatggcatatcagaaaatgggggatacaaaaccaaatggtggaaagcaaattgattgcttatattagaaattaattatatattaaactacccagagttctagataaaattaggaacaaaaataatattttagaagagatgtgtctgactagccaaaagcaaggagaaatgcagaatgtcactgaaaatctaaaaataaaagcctgaggtaaagtgattatttcctcaaagaataaggatgcacataatgtatcataatttcttaattagagttctatgacaattgtagttacatccttccagggatagatatattatgacttgcaaagtttgctaatggctgaaaataaacaaaaaaaaatagaaaaatttctaggtaaaagtagttaagactagctttttttttttttttttttttgagacagagtctcactctgttacccaggctggagtgcagtggtgccatcttggctcactgcaacctccacctcccgggttcaagtaattctcctgcctcagcttcccgagtagctgggattacaggcgtgtgccaccatgtccggctaatttttgtgtttttaatagagacggggtttcaccatgttgaccaggctggtctcaaattcctgacctcaagtgatccacctgcctcagcctcccaaagtgctgggattacaggcataagccatcacgcccagccaagtcttgctttttgggggcaaggaatagtaataaatgtaaaagacctgttttatggaccctggaacagctcatgactttacttagaagtttctacagaaataactaaagaatgacatttctccaaaaccagttgaagaactttttagttagatgatgacagacaagaaagtcaaggttaatttgagatatgctggtagaatcctaagatcattaaagctctggtatgaataagaaaagagaaaatgacatgaaggattctgacatttagaaaactagcaatgggaaaatgcctttcacattctaagtttatttgtgaattaaaaaaaaatgaaaaaagaagtattgggttatgttgtagatgcttctaccaatatggttattattttattaagttgaagatcttagtgaattcatcaaggatacctgactgatgagacatcttggcaaaaaaaaaataataataatttggaagaagtcacttaatctcactgtgccttaatttattcacctatttaactacagggtttatttccctaaacagtatgatatatactctttatattttttctagtgttaacattttaagcttatggaaaaacatgactacctacgagaaaaataaaagtaaattaaatcagtgtgttgtgaagatcccatgtgtttcagcattcatcagactgaaggcagtctccaaaacatccaaacagggtttttgagaatttaactcttggatctgttcttcaagtagtataatacgtggtttgacatgcatgctagacacctgtttttcaggatggtaccaaaacaacagaaattctgatgaattatgtcattcgagttatcacaattgattattcaaataactctccgtaattatgatcttgacttctacaatgtaattataagaaagtcagttgttcaaagatatccaaaatgttcacccttggcaagcgatggatgggaagagtggtgacaagaatctgaaatttgaaattaacctgatgtatttgtaagtttttcctaacaatgttgccgtccattaaggactgtttttagtggactttcttaagcttgtatagagttgacctgaaggatttaaaaaccatttcagtttattcagtgtttgccatgtatgccatacacatcatacactggagtacatttaaatatcattaaaatgtaccactgcataagacaggtctgctccttccttgttctaaggtaattctgtttcatgggttagtcagacacaaaccggtgttatcacacagaactgtcacgtatttgatctgcaatgttcaccggttacatggagctaagaaatatacagaagctaatagagttataaagagtctggaccaagaatcataagacccagttatgagttgttaaaagtgagggtgaaacatgtcccttcagttttctcattttaaataagactaaatgatctcatcttttttattttctttaaaattttaaggccttatgcaaaaggctgaaaatctaaatggctaagatttaatggaatccataggatttcaatgagatttggaaaattcatcaactatgtggcacagaaaatacagacagcacacatgtactatattctgtatgggatatcaggaccaaaacaaaacaaaaaaaatcaccatccaggttgataaatggaaaaaagagggtagagatctcttcctgatacatcctcagagaagattttggcctccctaaaaattccactgaaagttaggtgtctctaatgttcatttttcttttttttttctctcaagcttcatagagatcctctatatttaagtttcagttttgtttatctttaaagatctcttcactgttcagaatttcttttccagaatcaacaatcactttccaaaaattgctcttatttttaaattttgtacattattttttccatcaagaaagatgattatcaaaaggaagtttccttccttccttccttcctttttctctccctttctgccccctttgctcccttcttcccttcctttcttttaaaattactgatggctcagatacactttctattcttcatagaataaaagggaacatgtattctggcaaaaaaggaaacagactttactgacccagaaaagaaagcatgttttgaatctcatccatctcttccactggcattttaatgtcctcccataattacacactgcttgcttagcatgtgtgatcataggaccaactacagggatggcttctcactctttgatttatattctttaatggactccagccctggggccagcagagctagaacagaagacgcagtctgcccctgatatttcctggtctttgccaagagtttgcagtcaaaaactctcctagaaatcatttcctagagataatcattcttaacatctatcctctggaagagatctctcacctgttcacaagcaccatacctctcagagaatcaaacaattatttaaaaatggactatgaggcaactgcacacagagcttatccatctacctttgctagaatacagagaggcatggagcagtggaagcatatccagtattttgaatttttaaaaacatcatgtgttttgatcatataccctatgactggactatgggaccagcttcaggtttaaagcagtgaagctgtttgatggaaacctgtaaaacttaatgagaatgctgagctctagcatcaaagccgttggctggctcagaaaggctgtggggacgtgggcagaggcagacttttacatcttgtgctgcttcttgataatctgattcttggatgctttgcccaactttacttaaaaggggaaaaagaaagaaagaaaaactaagcaggcagataggaatctctttcaacacacttttttcttaaatttgaagaggatttggtttgttagtttgcttttgatcaaggagatggtagtggtagaaaattcttgtctctcttacctttttggaataactaaggtcacttagtgtgatatgctgggacccctttggctagatgacttttcagtaagaactttaagaaatttatataaaaatgttttctgtgtttgcaaccacagaacttaaatattattgtagagagggaccttaaggtacacagagattaatgctttcacttgaaagatgaaaaccctagtgctcatagaagttgaataaaatgcattgcgttgcactccacatagactggtcaaccttgatcactgggtagtctaaacgattaaagactgcatctcatgaagccagttttgttagttccttcatgcttccgaccactcaagctccccactccttttcactttaatctgaagcatatctggtttgattgctttgtttgggcagaaatatgtaaattttgcttgtgtttgtattttgtattcttctttctccaaaactgtaaaaagtcaccttaattctacctttgaagaatctctacactgtatctcccactggatctgtttcagtatatttacatggaggcttaggctcttttgatcatttattcctataaaatgctgattctatgcagagttttctagaaatatccatggcagtgaataataaacagcagccttgattagggtgaagttgtttcccttgcatcatttgcttctgtatcaccttatatttctgttaaaaatgcgggtctactgttgaatcagaagcaagggggacatgaagctgcagtttaataagctctcagatgatgcttatgcacaaaactctgaaccactgacctacagggtaaaacccaattcctttcctgcagcagtcacatcctgtcattactttatccatttcaacatcatttatccaaacttttatccagcacaattattgacctcttttccccatgcatcttttctccagacacactaattccagatataccctaaacacatcatttattattttacacctgcaccttttctccaacttttcctgtctcgactcttatctctatttttgtttacttggtgacatactacttttcgttcagtgccatactacttttctcaaatgttacctccttgggaaagccttttcctaaatatttctcagtcaccatccctatactgcgttgcaatagaatgtagcataaatctctcttatagaacctgtttcatttgaatgtaattacaatgaatctacacaaaggttatagaatacctactatgccccaaattataccattaaagaaataaaagtcacaatctctaccatcacaaaaattactatccagcttttttcaacccaaatcctcatctgaaacagagaaaacagaaaggtatttgagtatttcctcaattctcccaaggaggatacataactagcaccattacatacaacagatgtcttagggctttagggtttcatctacttgggaaaccccagttgatcaaatactggtaaaattacattacagtagcaataaatgctatgatagagataattcaaaggtgagatgaaaaagcagaaatatctaattgagtatgtgtttatctctcctcaaccatgtcttaatcctgtttctatgcttatttagcatctagatcagtgccaattatgttgtggtcattgaatacattttattattgaattaaaggcattgtaattcatttttattagtgtgactctttggaatctggccgaggcaatgtgaattatccatatttgtaaatccagcatctagtcagtgcttaagatactgttggcactcagtgagggcttgtagaataaatgaacacatttggaggagttgccctattctccagtagaaactcaatagcaatgacaacaataacccaattaaaaatgggctacggacttgaataaacatttcttcaaagaagaaatacaaatggccaacaggtatgtaaaaagatacccaacgtcagtaatcaccagagaaatgcaaattaaaactacagtgagatatcacctcatgcctgttaggctggctattattaaaaaagacaaaaaagaaaaaaacaacaactgttggagaggatgtggataaactggaagctgtgtacactgttagtgaacatgcaaaatggtgcagctgctctagaaaacagtatggaagttcctcaagaaaataaaaatagaattattatatcatgcagcaatcccacttctgaatattcagccaaaaaaaaaatgaagtcagaatttttaagagatatttgtactcctatgatcactgtagtagtcttcacaatagccaggatgagcacacaacctaaatatccattgatggatgactggattttttaaaatgtggtatatacatacaagggaaaattattccgccttaaaaaagagaatcagccaggagcctgtaatcctagcactttgggaggccaaggcaggcagatcgcttgaagtcaggagttcaagaccagcctggtcaacatggtgaaaccccatctctaccaaaaaatacaaaaattagccaggcatggtggcataggcctataatcccagctacctggcaggctgaggcagaagaatggttgaacccgggaggtggagggtgcagtgagctaagattacgccactgcactcctgcctggccaacagagtgagactctgtttcagaaaaaaaaaaaaaaaaaaaaagaaggaaatcctgcaatatatgtcaacaagaatgagcctgaggacattatgccaagtgaataagccagtcacagaaagataaatactgcatgattccacttacaagaaatatctaaaacagtctatgtcatagaagcaaagaatagaattgtggttgccagggcctggggcaagggagaaatggggagttgccaatcaataattataaaatttcattatgcaagaagaataaattctagagatctgctgtataacattgtgcctctacataacaatactatattgcacatttacatatttgctaagtgggtagatcctatgtgagctgctcatacaataataataataataataataataaaataaaacttctttcatatattagaatatattcatttggctagatgacatagttatcttttcccaagccacccatcaattttacagtcagttcttccctctcagtaagattgaaaattaaagaataataaagttttagaattgaaaaaagtgatagttttaatttgaggatcagaagtaatacttaaagaaaaactactaggaatgcaaaattcttcctttgtggttaatctacatttataactattccacttgacatttaattgcttcgcgtgttatgtgtatttcaaagacaaaaagaaagagtttattaagactgcaaatgaagtgaaaaaatgctgcatttttctgggtggacagtaggggtggtggtggtattttcagtgttattgtcatctaacgaagcctaatttagtttgaatatatattttggaacaaatagcctccaaacacaaattcagtttaggggaagatagtgtgaaaagggataaaatgccataaaattctgatgtcctaaagaaaatgtgagagtctgggacacctccttgttctctgcaaagcctgccgccagctcacttcagacaaagttgtctttttataaacatgatgtaagcatacactcacaagctctctggaaataatgatgtttctacttgtgtcagttaaaggcatccctttgttcatctaatcaccaagaaaatttcaaggcaggtgtgcttcagtttagagaggtgccgtacttcatgggtgcctctaagggactctttacaaaattcatgctgcagaagcagcattcccctaaatggttgcttaagactgcaaatccccaactgtccaatttatatccaaggaagagtttactttctttagggcataagccattatattacaaagtcattaaaatggaaataaatacataagttagcaaattgtggtaaggtaaaataatcttatataaaccatggcctaaaaataaagaatatatacagaattcagcatgaggatattaccatacagaaatgataattaaccaaagtaaacctgcacacagtgattttctgcattttggcaagtgaaaaatttttgctatgaaagcaggactctaaaaatcaaaaaaaaaaaaaaagtaaaggagacctagttttgaattgatattaaaacacacaggcattttactttaatggtcatgggcttaggtccaactatttcagaatccaaagcttattacttagatagtcaacgcacatcattccaagactgcagctgctcctaatttggattgttaggggattatccctataagagtcctcatggctcatctgccctcagtgtaatcagatgagaagatcctgacttccatctccagaaagaaggccaagcccacctggggcctgggggtaaatgagaagcccacatgggtaaatgagagcttctgtgggatcttgacaccgagatgctgagactccaactgtaagcctcagagtcactactgagctacaaatcagcagttttacatttattatttctaaaatctggatttgagttgcaatcaaggtatatcctgatttagattaattggcagtgtttcgtgatccataaaataattgtgcaccaatactgccaatgatgacaatataatatggtggttgacgtactctagctcagtgattttcaaactttaatatgtatattaaatcacttggggatcttactaaaatgtagactctttcagtagatcatgggaaggggcatgagtcttttcatctttaacaagctcttaggtgatgcacatgctgctggttcacatccacagcttgtttagtaaatctctaggtatgctatgagttgttcatgggctttatttccttttaaactacctaaaaactacagcttttagttacatgtccttgtttaaaaattgttcctatatcttctatgtagctttatatgcacatattgttaaacagataataaaccaaataattattaaataataactaaaggtaatgttaatgaaagattggtttcaatccttgatgatcacaccttatagcctggataccttggggaagaaaatgttactgaataaggtcaatttactctttcaaacaaacatttcagacgctcatatgagactctgcttggtttacaggtagtgaacacaggcagggaagactaattgcttctgaaaaataatgcgaaatgaaatctgatgatgacaatgataacattcttaagaactaaaataattacttgtatttgaactataaaaattaactgactattcccaattcagttcctttacaaggtacccatatttaaaaaaaaatccagtttcttatttatctctaccaatttttgatacattagatagtggatgtcatcatttaggatagcaaaatggaaagcacactgggcttggagtcaataaacagaggtttccttctgacttttttcacatattagggatatggctctgataatattatgtatgatttgtggtctccaagttaattcaattttctcacaaagctcttagaacaattaaatgaaacaacttttaatatgagacaatgtgtgcaaaatctcataaattcatctgcaaccaggacaattcacatatttgtaggggtcagtgtaaaatgaaaatgagaagccctctgttcaaaagttattaagaatttcaagatgacaagaagaagatattaaatgaagagcagggcccttctatgtgtggagccccatgtgactgcataggttataagtccatgagaaggccctgtctgcaagataattgtagctaatcctcactatattaatagagtattaataaagtttatacttgattgagatattacaatataccaggcactactctcagagcctcaattacatagtctcacttaatcctttacaggggaaagaaactgaagcacagaaacatcaactatcttacctcaggtgatacaactaccaagtttaagggagccaagattggaatctgggagtgtctgattctaaagccattcatcttaactaatttaatgcaatgagttatctataaaaagttattgttattcctgtttaattcaaatttagaaacctaggctcacaaaaatacgtccatatttcaagggcaattcacttactatgaccttgattaaatgacctatgtcaacctaattgtcttatatccctagtactccacagagagcctggtacatagtccattgtcatgtactatatataaaactaaacactcagtcaccaatttttctgtgcacagaatatttactccacaaagataaaaatctcattttcctattattcaaaatcacatgcttcggaataagagtattattttcatttaaaagcaattaatttgttttaaatgtgtttcaagagtgatgattttcctggggaaaaaaagacaccaattaacatgcacagaaataatttccttccaaacataaggactttgatccaaagatctaaagacaagagtatatcatctcataatagaaattaagaggaactccaaaatactcattttgttttggatgaacttcagatttttaaaaaatatggctcaaacttagttaagtaacaaacttaaatttatatgaaggtgtttttctttttcttagcaatgtgttttctgatccttcatctcattttatctttcctattcttttccaattgtgatagtggaactaattcactgagcttcagtcccatacaatatcatgcccagtatacaactgagcagagagacaaactcagattacttgattaccttgtctttgaaattattactaatgtcctctgcaaagctaattacagcttccattgtattattagagaaatttttcatacctcacttaggaagcttgtattgtaaatctatacttatttgcccaactctctctccagattcctgagtgcattatcttactcatctatgtgccccagtgtctagcacagagcctggcacatactataaatagatacatatatatatatatatatatatatatatatatatatctgtacaaaacagaatagccagatcacttagcccatatactatagtcattactagaacatagcttgtaattatatttatatatatatatatatgtatatatatacacacacacatacatttatatatattttttgagacagtctcgctttgtcatccacgctggagtgtaattgcacgatttcggctcactgcaacctctgcctcctaggtttaagcaagcacgtttcactaattttttgtatttttaatagagatgggatttcaccatgttggccaggctggtcttgaactcctgatttcaagtcatctacctgacttggcctcctgcagtgctgggactacaggcatgagccactccacacctggcccatactagatagttttaatgttgattaacataatgcacacatgcaagtgttaatgcataagcaaatggagcaatttaaacaagatgctctggtaggtgctgaaattaagagaaaatgttcagtctcagacattgttcattgctgctttctactgggctgaaaaatgtcatattctataaaatgtatcaagtcctcagaattaaaatgtcactgaaccccctgacagaccatgctatgctagcttgatatttgaaagcactacaattcattatgccaactgctgatactgttccaggctatggggcatctgctgaaaatgatgggaaataaaaatctgtgggtcccctggaaaggaaagattctatgtttgaaaagctgaattccagacaagaactcaccagatgctttgtggactgaagagctgggttccatttccttggggacctgagcagatgggactccctgaatccactttcaaagaggagtgtctatggcaaggtgcctggtttctgccccaattgtttatttcccttgcctccaaggctacaatgcacagaagtgaacttatccttagcaatgtatagagccaatactttagaaaatctaaaaatctagaaagtacttccaaatgtgttttctgtgcattcctgtttgtatggctggctacacagtatggaaaataaagcaagcattatcttagtttgccttaagaggaggaaaagtgtgcaggctgccagagtagggaagaggttcacagaggtaacagctccagaccaattcaacccggggagtgggaaagattccactgaaagctcatatataactaactgggcatctgagaaatatttcctgctgcttcttctccccaatcagatcttcccttctctgacatcccagcaatctaggctgcatttttctgttttcttttccctaaaggttcctacgaagctcatttcgtctaattttatctttataaaaatactgagaatgagagaagtgaagtgagattgtaatatgatacggggagcaacacagagtggcagttacgggcaaggatttcgctctcagattatttgggtgggagcttagttttgttacttactaattattttcccctaggtcagttacttcacttttcctatctccatgtcttcatttgccaaatagggatagtatttatgtgtacctcttttcatgcttagagtattacctttgcaattatgaagctctgagaaactggtggtgcatccctctctgcaatataataatcataatgtattcaaaaaagggctagtaaagacaaaataccagaaatccaccaaaaacttgttttttttcttcttcttccattactccctttctgataggtttgaaataccaagtatcaaattatttcacacagtttcatggatttgtttttgcaaagttgttgttttactgtgttcctgatgcccccaggcacatgcctcttgggtaactcactggatgttgttgaaattttatgagaaataaaaaatgcttaatatgttattattatgctttctctggaatatgctgactcccttaccccttcagcaaaagctcctacttttcatgtacatttgtatagagcctagtacaatcataggcacattgaggcactacagtgtttatgccatgggggtttgtttgaatgatctgatgcaggtaaagtgctctactaacaggactatcaactcagggatggcactcacagccatgtgttctgttgaggtctcatgagttctcatttgcataagggaatgattattattaacctgcgtgcgttattgtgaagacttttaaaaggaaaggaggatttttgcagtctactattctacacatgaaaggaggcaagggtaatcgacctctgcatttaagtactgacactattacagtagaaggactgaaatacatttcaatatttccgagatctagaagaaactaggctgggcctataacaaactgggttaatgacacataagaatttgtcaaagcctttgacatttccacaaaccccatctagctttcttgttaaagttttcaaagcaaaactatcatcttccatgttttaaatcaggtagaaaaaaaatttctttctatacctgaacttctgccaaaaacattaagcccatttgcctattctagatgggctaaaccagcctctctctgagtcactaaaccaagaccttgcctctaggaatacagcacagagaagctagaaaattgtcattcagccccaagccatcatctctagtgctcactaggctgtacagaatagaacagtcagagcacttagctcaaatatatactattgttattattagaacatggctactttgtgagtcagcccattccagctgacacaacaaaatgacatactgtatagtgcatactgatcctacatgaaacacttttaatataaaagttagcctgtagccacagtcagtccactggtcaaaaattgagcatctgctgcgtatcagcctggccaatgcatgagtacttgagtgaagggacttctttgcattttctcataggctattaatcttgcgggcattagcaaaatctatcttaaaatgattcatacaggccaggtgtggtggctcacgcctgtaatcccagcactttgggaggcccaggtgggtggatcacaaggtcaggacatccagaccatactggctaacatggtgaaaccctgtctctactaaaaatacaaaaaattacccgggcatggtgacgggcacttgtagtcccagctactcgggaggctgaggcaggagaatggcgtgaacccaggtggcggagcttgcagtaagccaagatcatgccactgcactccagcctgggttcatataagtgaagatgtatcaccacataaaatcaaggtagtattatccatagttctataatgatatggtaagtaaaaatatgtggatctgtatggaaaatgtttaggaaaaagtgaagtgggaaagcaaaaagcaactgtcttcccgaaagagtgagggatgaggcatatgggaaggtcaatgtaagtaaattgtaaaatggtaccaaccagtatatggaccatgacaaaataataagagaagagaggcaataagtcagggacctcaacaaggaaaagtctagaggaaatgaaaacctggggataaattgtttaatcatgactttggaatccatgtgagttctctgccaactaaagtagccctccctcctctcatctggcatgatttccagacatcactgaagatctctttttcctccaagttcctgctaggttaatttatccatcaggtccaaagccttttatcccaaaattggaataaattggaatgcaaattctgccatgagattttgttcttacgtgtaaatgacagatactctattcctctctgagcaaacaggaaaataagcaaaaaaggggaggagcggggagggatagcattaggagatatacctaatgtaaatgacgagttaatgggtgcagcacaccaacatgacacatgtatacatatgtaacaaacctgcacgttgtacacacgtaccctagaacttaaagtataataaaaatatatatatatatatataaaataaaaaaaaaacagaatatccccttttggaagtagaagtagattaacctattaaactaatatcagccattcaaaaaaaaaaaaaaaaaaaaaacttgaggaaccaaatttgatgaggatggtcaaccacagaagtgcataaattgagaagccttcaaaactttctaaaactttctctgttgtccaaaagaagaaagatagggattaaggggcatttgcaggaaggaaatatttcatctctttcccagtgttgatgctggtacactgtgatgtgggcacttcatatggcagaggagatcacacagatttcattaaggaatcaatcattttttcctcaaggaaaggaatcaagcattttcaccaataaggtgagggaaaatgcttacaaaagataggatattttccaaacctcatctacctcagtagcatcttccagatttgtggcaataaatgtttctaagtgtaattaaaggctgagccgatctaattaggttgatgaaattttcagtgggacttcattccccttagcatttcactcattttttttctctctctctagaatacttccttaggcttaatctgagcaatttttagtggcagcattctaagttacctcacacaggcagtgtctccactctgattgtaaaacctccagcaggtacatatgactaaaaacaaacttcaaataaaggattctaggttgttttatttaacacacagtcctttcctacctcttcagtttcatttccttactaacaaactacgttaaataatgttcactctgcaggagggaaataagcatttcagagcatttcgggggcacaaagagaccaggaaatgcataataattgcaggaacaggttctgagggggagattaatgagggagcgccatgacccttcctgataggtcagtgactacagaaacacttatacgatgaaaatattgggatagaaacacatactagtgagattttcatctatctttaaagattcttaaaatatatctagtgagcacctgaagaattaactgtaagacttttctacaggaaaatgctttccaagtggtctaaggtaaatgggcaagatgtcctcatagagtctgagcatctcagacaccatgatttctctttctgcaagattttctaacctcctctccttttgtagcagtcactcaaaaactgcttgttagaaaatttaattaaatataaaatgatcgaaaattcttaagcaacatatatttcagctcttactcagtgttatcaaaatgcaaataatataaacaagtatttctgtcaaaacagtgttgcctttgcaaaaatcagatttagaaagcatatttttttaaagacctattatcttctaagaatttcataggtatgggctgcatataatggcaatttattatttataatttttctttaactcttttttttcaaatttaaacctgtgagtcatttttcaatgagtacagatattttcccagactttgatttacttgtgatgaaaatatgaattatttaaaaaaaactactttgatctctatttgaattcccggccattcaaagttccttgtcattttaaacaaagcaccatatgaagttcaggttaggttttaccaaattattttgagctaatcttattttattttgaaatttgataatcacatacacaaaagtaactttccaattgagggttagttgttctacgtgcaagcaaagtctcatttcaaatagacattattaaatgccatatagggaaagacctaagttgcttctaaggaatatgagattataggttgtttcaatatgttgagtgatttccttttttttctttaatctgtaaagaataaatgtgtaaattcgtgagagtgatatttttatgccttgaatgccattgtttacaatgaaatagaatcggccatttaaatattatattttccttgatagggttctgtattctaatcctgctggacccccttattactcttggtcaagtaacttctctaggtctgtttccccaaaggaagaaagttgaacttagaaaatgatttccaggatcctttccattctaacactccaaaatttcttccatgacttcagacaaggtgttattagaatctccttcaagactggttatgctaagaggcactacatactagactgaaaataaaaatgccatcagccaataaatgaagtcataattaagggtttacacatgcagtgtgctatcgaccaggaagtccaagctagagttcaggaaaatttacatagattttactgttaagagagattctgtgagaatgaacatgggtatatccctctcttttcagtaacttcacaaagctgacctatttgaagtagggtgatttaactcacaatccatgatactttgtcactatttcatttcagaagtaacaagagcagggccttctaaatagataatggttcagacaggatggaaactatcaacaactaaaaagccctccaaagtgctgggattacaggcatgaaccacgacacccagcacgttgggaggccaaggcgggcagatcacttgaggtcagtagttcaagaccaccctggccaacatagagtgaaacccgtcactactataaatacaaaaattagctgggtgtggtggtgcatgcctgtagtcccagctaacttgggaagctaaggcaggagaattgcttgaacccaggaggtggaggttgcagagagctgagatcatgccactacactcccctggggaacagagcaagactccatctcttaaaaaaaaaaaaagccctccaagtgaggtatgttttgatttatagattaattgtgctgatatccttccaaactccagtgcatcagaagaagtaaaatgaaaaagattacacaagtcaagaaaaaagtgaccgtgcttcctcagacacacaccccagatggggaagacagagttggaaagtgtccaatcaataaagaagagtgaattgtatccaaaccctatagtgacaacagcacaagtgaatcctccttttatgagtttagccactgtgaactaacatgtcacttggaagaccacctaacttattttttggtattgtggtttttctggttaaaaggccaatataaaaaaaaatgaatactaaggtaaggaatctttatttatcaattcataaattagaggtgttaatctgaagcacggtttaatttgaaactgttattttagattaaggcaattaactacagttttatacacacacagaaaaaaactgcctcacttatgcagaattatcagaagattatgtgtctcagctgaactcaaggattccctgcaggaattactattattattatttggatgcccaagagttctttagttagattcccatttctgctagagttccctcgattccccttcctttttccaatctaagcaggattactcttctctgtataaagcaggatgtagggactgattatacctggcctggctcacagtgaaaatgaggaagttggtacaggtgattggggatgcggctctgccctccactttccatccctagaatggagtttcagaaatcttctaaaaatatctaattattcttttaccatacctgatatgctttctccatccctgcctgtctaaattagtcactgtttgagatgctcatattctgactcttctgtgtttctctccttgtcttctagaactctcactcatctcaccctctttttaaatcaaataactgtgttaaataatttaataattcattcctcacagtctattattcatttgtaaacattgttttagtttgtaacaaatttgagagtttgtacaatcttttaggaactctaacaaacatttctcttgcaaaagggctcttaactatggtagttaagagcacaaggacactgaaatcagacttcctcgattaagatttagactttcatacttgttagttgtgtgaccttcctcaagaaacttacctgcctcaaacctcagtttctttgtctgaaacatgcagataataaaatgtctacctattttgtgaggattcctgtaaagctcttataatagcacaaaataacagctctggaaatattagtactataataataataataataaataataataataataattagattatcatcctctacagagcttaacacaaacctggatcatactacatatttgtaaccagtaaaagttactttctgaaaggcaatctatcactcctactacaaagcatgggtaggtttggcctttcagaactgcacctcttcatgtttgttaaaactattgcacctttaaatctcccttaggattattctatatacatccacatactgggcaacaaatcaaccagtatgttcacataaagagaagacagggaaggataattcagtagtaattgtttttccctaatgcttaactgaatcaagtttatatgattaaattatttacttcagaataaaccaagtacatcactgcttaccaacagcacctatggctaacagtgaattcaaagttatttaactttgatgtttagaaatctacaccattaaattgtaggcatacaatgtaagaggaacctctggttccagtagcccaaagaaattggattgtgtctgaatgaatttttttaaagacagcttttatggaaaatattcattaaaaaatgaaattcagggacttcttcatctttctctccccaaaacccaacaaattccaatcttatacaaagttacaatacacaactacagctgataatgagggatgaaattattgatgtcatttagtttgatgatcttgctcagataaatatcaagtaaattcaccagataacatttacttcctccagaatgtgttgaaaataagggaagaaaattatgtcattatatagacttattttgttttagttttgttttgaattacatagtcgttgcttctcctataggctaattgctttttcttcttttttcttttaatactcaaaaaagtcatcactgtatgcataacacctatggcatttaagtagaaataagcaagtaaaccatttagctcaactttagacccagtatctctttttgtttgactttcttttatagctaatatcaactgtccacacaaatctcaaatgtaaattacttacagactaataaagaagaggaacctaattccttcataatgatctatgagctgtttccctcccccaatcctacataaacaatagtagaatattgaatttaaagttgtgccgtttgactctggaacatcgggtcttcagcaaaggtgctttcatgctggatctgaaatgatgagaccatgaattaggaatgattctgatggcaacgatatttacctctttgagacagcccataaagttgttactgactggtgaccctggaaggtcggctgtgctgggactgcctccaacatagaaaaagtcatcagaccccagcatggtataatcttcttgcgtgtagcccgttgtggtaagaatcccatccactgatattgtcacctagataacaaagcacagggaaaggacacgctatactcagacctagatactgtaatcctgggatatgcctgttttgtgttttgcttttgtttttttgttttgttttgttttgcttttttctttttttctgtttgtttggtttttgtttttagacctatgacggaacccattttcatgtctgtttgaggtttattcttagattctattcaactagccctaagagatctaaactagttagagagttaactgattattgaactagtgtcagcatcatccctactgcaactcaaaagttattgagcagacacaaaaatggtgttagtaaaatgcttcctaggttagttttgctggtgtacatattagtaaggtttagttgtctgttattaactaatcacaacgtgcaccttgttaacataaaaggcgcaagctatttccagcaacatcactatttgcactattgagcagcaattgttcagcatgcaagtgcctaagtccatgccaaagggagagaaaaggcaaaacaaccagtagaagcggcacacgctgatgtgcacatgcaggaggtacagtacagttcagaaaaggaaagaaagaaaacagggagaaccaaaggaaaaacataaaaataaaaacaactgctttgtgatgacgtaaagatgagtgggtgtggcatctccagcattcccaaatcaagtttccatgccatgcatcatgaatggttagagactggctgagctgcggtcactcgggccagccaccattttgtcttatcccgtgttaaccacagctggatgcaaaacgttcgaaacgttaacgatgcccctacaggtgagttggaaaacagaagttgacaggaacaggtaaaaaataagaaggtcaacaacagatgaaaagaaggaggtcaaagtaagcagaagagtaccaaccgcagttcctcttttgttaatgatgtctacagttaaaagaaagaaagaaaacacacggcaaacccaaaataagaaacaattagaatgatatctaccgaacaatgtagtttgtttaccatagcgtgtccaatgcctgagtgctttgtggagaaggggggagaaaggaaattaaaaactgtgaacagaataacgatcgttacttaaaaaatatgatggtctctaccatgttagtacattttttgattcaggtaacggttagtagaatgaaacattccatgaatgacatgttagttattaagcatgttagtaacatagaaaaagggcaaaaaaattttacaagaaaaaagcagactaacaagtaggcctcccacagaggtaatatttttcctgctattattgttcataatttgctactagacagaaacagacacatgacaatgttccctttgtcttcctgagtacatctgagagacattggaaaagtctaaaagggattcaaaggcctaaagcgtttcagctgaccactgcagccctatgcccatacttgacccctcctccaccctggcccaccccagccccaggaaattagtaggaatcagttggcattgccctactactcaattttacagcatacaaggactcctcctcaacttcaaaacttccttcggtcatattgatggactttagggtcacagtttactgcaatgaaacaaagcaaagatcctgacacatagaatgagtagaatggatttgtgtttaatctgtcctgctacacatgcaccccggctgtataactacagtttcctttgagctaccaattcgcagtttggtttgtaacctgagcaaaggcaaatctagaaagtggactccttgagcccccacccttccttctgtgcttctctcaaatgagcctctggtttctttgtgcatatctgagagaaaaaattaaaaaaggaaaaccaaagagacagacttataggaaatccatggtctacagttatactgatggtggccaatcctctccaaaggcaggtggaagcatgcagggcccctcccatgtcaatgagggatctggaaggtctggggttctcaagaatctttcagttttatttgtttgccttagctagactaaatctacactcctaaagctcctttttctttctctagctcagatagtataaacctttcagaacaggaaagaaaaggttagacagttaacagctctgaaagagagggctgttttggtaaaggaaaaccagagacaatccggtcattctgcaactgttcagagaaacaacaaatatgttaaggatattagtttaagatcagcatgtacggcaataaaattagtcactgtcaacacttaacaaaatgatacactgtaatataaagtttcacataatacccaaaacttataatgttcaatataaaaggacaatctattcattttcattcgtatatatactgtaatcacgtattcattaaaaacatacagtatatgtagacccacagatttagtaaatagttgatattttcctagtatatagcatcttgaaaaagtttttttaaaaaaatacaattaaatagaaatgggcacctagaagattaactggcctttccagagtcatttggggtttaacttaaagcatctatgctaaaaataaaagtatcttcaaaaacagacccttcaggagatatgtaagcccctaaagaaatttttcccctcagggacttctcttgtccccattttggggttgggaggaggagggagtagggactgatacaatcccaaatcacaaacactattttttcgactacaaaaaaggaactgtgacttaatgaccccaatgtgcatgcttccaaatgatcaccatgaaaactacaatttaaaattaaacaaacaaaaaaaccaaaaacacaacaaaatcacacacatcacaggaagggcaggtcgcagggatatccttgcagcccttttggaaattttcatatggccctgtatcaaaatagcctttgggctcccagaactttctagatatgcccctgctcaagtatggcaggaagattcatctcagaagaagaaaaagctaatttgcaagtgactctgaggagccctgtatcatgttgttagagtatttaagtaccacacacacagctatagcgagaaacaaagccagttactctcttatccactgcgctgttacctgacgcagattcctggtgactttcacatcatgccaggcattatcattaaactttccattcacaggctccactagtgcttcaaaggcccctgatcccaaattaatgaccagagagacagctccatttttcagggcaagattgacataatcagccgatttcccagtgtgaagcatcagtccattcctctgaagggttttaaatgacagagttatttcatcactgctgctttgaatggggttttgagacaagtcgtagcagaagtattcagatcctttgaacgtggcaatatattcttcttttcctagaggaaaacagatgatacatacataagtaaacaaatacactatgcaaatcagcaggtcttaacagaaacaatagctaatcactccccaaattaacctgcttaattagatttcatgacatgaactctgtctcagtcaaacagtactgtacagggcagtattttttaaaaaattttattattattatactttaagttttagggtacatgtgcacaatgtgcaggtttgttacatatgtatacatgtgccatgttggtgtgctgcacccattaactcgtcatttagcataactcatcctaatgctatccctctcccctcccccaaccccacaacagtccccggtgtgtgtgatgttccccttcctgtgttcatgtgttctcattgttcaattcccacctatgagtgagaacatgtggtgtttggttttttgtccttgagatagtttgctgagaatgatggtttccagcttcatcacacgtatgtttattgccgcactattcacaatagcaaagacttggaaccaacccaaatgtccaacaatgatagactggattaagaaaatgtggcacatatacaccatggaatactaggtggcagtatgtttttaataaatctcaactattgggccatcaactgcagtagctaaagctgacattcttgaaaattcaattaatttttcagtatcactgcaagagctctgatcagagaaagtagttctgtgatatctccagggcatgaatcaggtaccataaatgcatattggatggttccactctgctgacaacaatggattccaagatgttttcaacattctctccatccaactgaggcattattttaattttcagtgaaacatttatgttcaaagatctttttcaatgaagagacaaacagttttatcattgagagaccatagaaaattatctggtaaggagaaagggaagaaaaaaagatagaatctggtctgggagtaaacagacctcctacagagcatgtgcattttttatctctggatggagggagtagtgatagaaagtctaatggagtcagctggattactgatctattccctggtgtagttaagcagatggtagggctggctgttatgacactggtaagaattctagcacatcgtcatggggatagcatgtaaatgaagtctcaacattttctacgtatcttattctttaccagatttaggagtaacaaggcggctctcacgagatgctagacagatcaaacagaaaggtggatatttggaaggaacagtcttctcccactgatgaggtgagttgaaccaaaggaagaatgtaagccataagaccccttgactttctaggcagtaatgatgctgtgccaagaaaaatgagacagcatggttgggaatcagcttctgataaactataaacatataattataaacggtactggagaaacttaatctgtcccactggcgacatactatcactattatgcccccgagagggttgatacatcagcaggtgttgcattctcccctgtaataggtttttaatctcaggactattttcatttgattgtcaaataactcacgtcctggaatcagagctcaaatcgctttcaacgcatcagtgccagatgatctgccttcctggatgtagaaaatggccatcagtggctacaggtagtcaaaccatagcaataaatatcacggtgagcacctacaggtattcaccaggaattgagccctggaatattagtcattgactactagcaaattattagccaagactatcagtcagaccaaataattctgagtaagtcataggaaagacctcccaatctgtaatagtgaatccctcccattcaaacgctcagaatattggctgagcacctcccaagtgttaagcccagtaccagttattagagataatgaagtgaacacaatggacttaattcctgtctcggaaagttatagtccaggtgtctgctcccctggtcagtccaacatggcaagtggttcaatattgggcacaagtacaactatatattactattatactgagaggaaaatgtgggtcaaaatatgagtttggattgtaggttggccactagctgtcactagaacaattatttgcttttcaaattttggtttctgaaaatggttagagataccaatctttcagaatgaatgtgaagatacaatgagataatgtctgtgcagacatctggtaaagttgatacgctggtgataaatagtcaatgtcttcctgcttgcctaattaatgtgataaatgtgataaatcatctaaaacaaacaacataaatcgtatgttattatgaaatctagaattttctctttaagataaaaaacaggacaaggattcccactgtcaacatttatattcaatgctacacttgacattgtagctaatgcaggaagacaagaaaagtatatgaacattgtaaagattataaatgaagaaaatcatgtgatataagcaaatatattgcacaaattgaaacactaaaataatctacagaaattatttggcttaataagagactttggaaagaatttagagttctgtgtactagagacaatcaatgtttcaacatatgtaaatagattcatagattcaatgaaatcctaatcaaaatctcaaaaaatttaaaaaaacaggtaaaaagctgattcttcacaatctatgagaaaaaaaaagagtcccaaatagccatgatatgccagagaaagaagatgaagtaagttgcctgcgtaaagatggacatttattacaaaattatagtgctgaagaaaatgcattaggataggtaaaatgaggagaataacgataatcaaacttaaaatattcttaagcatatatgaaaacaatttacactgtcaagcatttcagataagtgtgcaaaagatagattagtcaataaaggttactgggacaatcagttattcataagaaaaaagtgaaattggatctttacatcctttgttcacaaaaatcaattctacatggatgcccgatttaatttagagaggcaatctgtgaaaacttgtcagacaataaagtttgatatggaagaatggaaggacttctaaaattagcataaaggcactaataaatattgatacactcatctacattaaaattaacaatgctgggtcatcaataataccatagagtaagaagttaaataacaattttggagaaaatattttcacttcctattaatcaacaaaggattataatccagaatatgccaagcacctcagcgaatcaatacaaaaataaagacaaccaatgaagaacacacacaaaagaaatgtaatttcatggaaaaacagatatgtattgcttatgaataatgaacagatattcattcctattagtattcaggaaatggtaaaaatcaaactacattcagataccatttcatagccatgaaattgacataaaacgaaaagaaaagagaataattccacattttgccaaggctaccgaaagtcattcttatatactgctgatgctgataagataaaaattgaccaactgtaataagtttcttttggcattatgcaatcccatgggaatttcacatattacaaagaacttgggtctcagtccttagaaaatagttaaccaggatcagttaactaaacatttgccaattccttcaactcatttgtcattgcttattgttctgctcatttgatgataggtagtcaagtgggttctggttcatgtatgtgtgtgtgtgtgtgtgtgtgtgtgtgtgtgtgtgtgcgcatactaataattatatatgaaaacaatttatattgtctggcattgcaggtaagttagcaaaagatacagaggtcactaaaggttgctgggactattggttatctataagagaaaaatgaaattggatctttacatccttttgtttcccagaatcaattctacatgatgaaggatttaatttagagaggcaatctatgaaagcttttgtcagacacagacacacacacacacacacacacgagagatccacttatctgaatatggtatttgcaaaattttacattcccactgaataagtagatctctgagtcagcaggagccttaaagacaatcctgcagcccaacccattaatttacattattaagaaagcgaggctcatggagtttatatgaccctcaaattcataaaatgtgacagtaacagaagtgggactaggattcagactactaatccagatactgtctaacatgccacaacacctgtgtgtcagacagaagtgatatatagcattgtgaaagaaagaaaaaaagagaaaaaaaactgtttgtgaagatatgtcttagtaagaaaataataactgtgttttagtctacttagtttaaaagagcaggtaatatattaagaaagattccacttagataactaaattataaagttttggagcttgaagagttttggtccagtaagaaggctgtagaattttatccaagatatcttgtatcattccaaatctgcataactcagaataaatctcaacaaaggttttgtttgccagataatgtggcatacccaaggggttaaataataaacagtttgcaattcactatgtaataaactttgaagttatatgggtgttgatgtatttttaacactatgatattccccttacttaaaaatgaaaatatatcatttcttttgtattgtttaattccaaatttaagtaattcaaatttacattaaaggcaaccacatagttttggaaaaaattcagtctgtggaatatgcaattaccttaaaatgccataaatgggacataaatctaagcagggaaaatatttcttcctatgttctttttcatgaaagaacatatatactacatgaaaatacaaaaatcactttttcacaatatataagaatattatgtttcatctaatcatttgctaccttacaatctttgtaagtaagctttgtgctattctataaacaaatactaagcagcagagtgtttacatatgtgtttctgctgaacacttaaagaataagtctacgtccatttttaaatacaagtcccaaataacttttgcatttctactatgtgctaaaacaacgaaaatgaaaaagaaattagacccaaagccacgtaaatgtcaataaatacttatatctaggatacaaagagacctcttacaaatcaataacaacaacaacaaaaaacaaaaacgcaacacaagccaatgggaaaaaaatgataaagtagttgaacagacattaaagtataaaaggctatcttcaaagaaatgcaaagtaaaccataatgaaataacagcacactccacagaatgaataaaatgaaaaatacaaaaaaatccagtgtcagtgaggatgtggggcaactagaactctcatacattattggtaggaactattttgtgaaattgtttggcattctcttttaaagctgaacttgggcctaccctatgatccaccaattccactcataagcatatatccaacaaaaaatacacatatcatcagaatagcatactagaatgtttacagtgttaccctgcataaattatctaaaacttaacactactgaaataacaaccaataatagaatggataaatttcagtatagtcacacaatagaatattaaataacaatgtgaatctatgagctgcaactgcaacagaaatacagataaatctcacaataataatgtttagctaaaaaaaatgcctgacacaaaagagaacatagttctgattccatttatataaaaaatttaaaaacatgcataactagcctctgttgttgtaaatcaagacagtggctatgcttggtagagatggagaggggatagtagtgaggagaactcttggggtacaattaatgttgttcttgatttaagggttgcctatgggtgtgctaagcgtgtgaaaaattaatttacctggacatttatgctacatttatcagcataaatactatatttcaataaaatgtttgaataatctggatgattaagcataaaatgaatttgtctgatgaagtattttcttcctgattaataagatgatatgagaagacactattcctattaatgctactattaatagtaaaagctaaaataaagccaatagtaataatttcaattgtcactttttaaaacttttcaatgaatattaatatcctttaattaccatttgctcttaagagtaatctctcaagatttaaaaaatatatatatacgctgcttggtagtaattgtttgaagatccatatcttaaatgtgttgattaatggattgattcaagatgaaaagagcctctatttctagccacagcaatgttatgataaaattgggaaaaagtaatatttaaaaatttgaagcatctttccaatagtctacaacaattgattttatgttgccacacagttggaggaaaatatttaagagtctgccatgggatttcagtcccattccatatccgacacactataacttagaagaaaattcacagttcttgctcatctaattttctgagagtaagctcaactttaagatttttttgatataaaaacaaacttcttatagaaaaaaaagttaaccattactgaaccacttcattggatgttgtagaaggtgttcaatccttagatggtagattgaacaaatggattggtttcaacaccaagaatcactgatttctactttacgggaaaaaaaatgttaaacaaagataggttaaatgacttcctaagttcacacaaaaattgattctcaggacaatgctcctttgcattaccagtgcatagaatataatctcattaatttgacccaatgcctctgtatcttctaacttcactgaacttcttcaccaaataaataatctgcaaggaaattaccgtacatcttaaagacaaggatgcctgcgggcagaacgaagtcccactgtccccagttacatgaagaatgtcaagtcatttttgtatgccaaaaaactagccaatattattattcttgattatattgcttttcatacatataatcccaaatcacacaggttggaaggttttactatagttatatgattcaaagattatgttcaacataaaccagaaactaaaatcaatatatgaaaaaacaaatgaatgaaaaaagatatttgggtgagagccctgcttcatttatttttctattctagaagtcaaatacacaaaaatattgtgccaaaaacatccttgaccaagcagatgtacacattagaagtctgcattattaaaacaaataagccaggctgtctctgctataagataaaacaactttagaaaagcagaaaaggaatgtctgcttattgaaattcatatcaaattaaatcctcagtccttaagaaatttactattatcttatttgccacgaactgtgtaactgagaaattaaaacaataaattgattattacaagtaaaaatcacattactttcaagggagagtagttcactcattagattttctacgtaatatatgttgtaaaatattctaaaattaccaactatttttcaacatatgtaaattctgagtctaacttctcttgttctgcagcgagtaatcaagatttataaaatattcactcttcaagacttatctcacttaggtaaacctcgagaccaatccagaaataaattgccaagcttctatcaaataattcaaaaggagacccaggactcttgatgatacacttgaagtcactaaatatgaaaggtaagttagacttagacattatttagtccagtgccttcatttattagatgaacagtgtcagggcccaacagacaaaactatggtcacataactaactgaggaaaagtcagaatataatccttgccctcttgataacagtctcaggttcttcctaatttctagatattgccataaaatgagcttctaattcattaccaaaaactaaatgcagcttaaatttgaggatatttctgcaaaagaaaataggacatgttccaaaactctagtacgataattttccaatcttattgtgcaattgatttgcatttgttaaaataaccaaaggtgctgagaaccaaacaggccattctgtgtctggctggactgactagtcagttctacatataaaatgagacacacagggaaaggaatgaacaaatgatcctggaattcattaggtgtgcaacatttcaatttctgggactgactcagattcaagtacctacaatgtaatctataagaactagatgctgtatcttttaacctgaagaaaatcattaacacaatcaaaattaaaagtagcttcatgaatatggactttataaagattctctgcaagaaatttgaaaatttctgggtgccaattaatgattacttaataaataagtaaattataataatgttattatattcaaggagatgtataggtattttgtatttataaacagtcctcatttatgaaatggatatgaagtaaataaatttaactatgaaatcatcttattaccgacttggtcaaggcaatatattctgagcaatttatctatttaaccaaaccccaaagaatagccaattgcttctttctccctagaatcagactggggtggtctgtaactctaaaaatctataatttaatttatgcaaatattgtggccatcttgtaagctgttctaaattatagaatgtatttttttaatatacacagatgatagcatcttggaaggcaagagcagaggaaaggagaattttcacagggaagaagaaagagttggtgaaagtgaaattgctttaacaaaataatgatctctatacctccttctcgaactgtggtttgaaggacagtatcatcagcattacttggagcttgtgagaaatttagaatttcaaggccccctcgaccccaacttactggtgcaaactctgtattgtaacccgatccccaaggtgattctagtgtacattaaagtgtgagagtcttgttatgaatggattcttatagtgctgcaatttagaacatcttttaagaattataaagacaattttgtgtctcttgtatctgaaataagtattaaaggcaaaatatatattgatatcatggcactgttcttaaggaattaacatccagatgaattattttgcatcttttcattggaaataaaaagcccggggctgggtggcgggcgaaagaatcagagagctctgatcagtgtgtagatgtatcaatatctatttaatatgtactccagcagagagtccaggctttaaatcattggaagcaatctctcaatttttattctcaacatgtttcacctttaggcaatattacaataaaattctctgtgggtttgtaaacttagtgccactcttctggataaatgtaaagggtgtataactcctggtatattctaacaagtcatcattattggtgaatatacttaacaagtttcatgcaactgcatttacggttctccctagaaatgtctttgttcatacactgctgcaactgaaaactatcatgcattctggatgtaaactgattcaatgaaaacaaatgggcctgggctgtcacatttccacttactatagtcaagtgaacttggaacattttaaagttagtaacacttagaaatgcaagaaatatatactgctaactcaaagtatcctatgttttaaaaaagaatgacagttttttaaaagaaagaaaaaaaactaaaattatcttgatatccccagcacattaagtagaggagagggtaataaatatgtgataagtgtaatgagaaatcatgctggatgggaagaaatgtacttttgtaactccatccattcgtgtgcttcatagaaggcttgaccaaggctttttggtttattttgttttgttttttttttcagatggaatgctactttgttattaaaataatgcaaagaagtaggtcagtatacactaaaatcagtataaaataagaacacttgaattgttgcataccattcttcacagtaggagcacaagagaaggaacactgaaaacctatggcatatctttgatttcaacacagaaagagcatagaatccaaaggtttaacacatgcaaatcccctattctagatattagaaatacaacagtaaataaggctctcagggtctccactctcatcaaaccagtgatggagagataaccataagtgagtcaagtataagtgagttatatgtgaaactgagcaagcaaaagagtgcaatgagggtgtgcaataactgagcagggaagttgttttagatgattggggaagctttatgagacaatgatgattaaattgagatcttaatgctgaggaaccacttgtgggaagatctggacaaagaatagaaagaataggaaaaaatccagtgagcattgagcacagtgacactggggcaatgtgggaatacaatgaaatcagagctgtgggatggggctatgtcatgtaagtccttctaaattttgggcaaactctttgattttattcgatgcacaatgggaagctactagagttttatagttaggggaatgacatggtttgatttacatctcaaaaatataactctgtctattgtgtggaaaataaactctgcgtaggcatggaagtgacagcagtgagtccaacatttatgaagttatagaacataggagtacgggctatgaaattatacatatctgggttcaaatcccactcacatgagcagttgggtaaataatcaccttaaagtcttagttttcttgtcagtaaatgaagacaataatactaggatctattttatagggtagttgtaaggattaaacaatatatgcataataagctttttaaagactgtcaatccatgggatatatttgtggaatataaacagaatatttatgtatatatgttatatttcttcatctactgcttttaaccattaagttacttcttttccccatctcttaatatcttgggcagaatcactgaatttgtggtcacttttggtttttaaaagtttgggctaatttataagttaatcatgtcatcatttttagttgaagtggaggaggaagatgtagtatgcctctaggtgtcttaccatcaccgccccctcaagacctggcccttccagtttattgggaaggagctgatgaggggaagagaaaagagcagtggttattcatatagtcctctttctgtgggctgtacctgcttctctggttcacccttactgacctctgctgcccttcatgcagtagactcatgagtgctccatgtgacttcccaacagcagtcaacaacatgagagaaattcatctgtctcatcccccagctcatctcccagctctaaccttcacacaacaccccatagcatctggctgctctaatcccctggcccagctagtggccttcttgtgagtaataccggctaggtggctcaagccaaagactcaaagggatatctcctttactgatgcctgtgggcattctggctgcaccgaatgttgctggtacagattaaattcttcttttttttttttgatagagtctcgctctgtcacccaggctggagtgcagtggcgcgatctcagctcactgcaacctccacctcccgggttcacgccattctcctgcctcagcctcccaagtagctgggattacaggtgcccgccaccatgcctagctttttttttttttttctgtatttttagtagagacggggtttcaccatgttagccaggatggtctcgatctcctgagctcccgaccttgtgatctgcccgcctcggcctcccaatgtgctgggattacaggcgtgagccactgcgccgagccagattaaattcttcttgtcccctctttctaccctgccagtcctcttcttccctcctcagaaaggcatagggcaggccagcaagtctgatgcatacaaagtcatgcattgggaatgcagaacaccagctttcatttctttcccagcatacacaggctctacatgtgattctatagtttcttccctcaattacttttggtaaaaaaagctaacctcttcattaacaatatgttttacagagcctatgccttaaagactctgtgctgacctatccgtcactgcttaggtagataagggaggtgggaagtggggagttagaagtagttgaagggtcagtctttcggtcctgtagtaaatgctgaggaaggttaactggccagtttagggaggttccatttacaatgaaggctacttaaattcttttctttcagaaggttctaatcaacaattctatgagaaaaatttccattcaacatatggtggacaatcaattaatgttagatattatgatcattattattaaagtaaccactacatttaaaatcactactcagcaattttaaaaaatcagctttttaccaaatgttttattgcccagaatatcacgatgcccaacaccctcattctaggagcacttggttaattaaggctcattacataagaacgagattgaagtattgtaaatagaaaaaaaatacatgtttctattgatggtttattcttttaaacaagtttgtgcctgagtaacttacaaaataattttataaaatatttgctatttatttatttttttatttgctcagggaaacgcatcaggctaagaattacgagagtgaaacactggtttcttcttggacacttttcagctctgccctttaccaccctacttagcctcactgggcctcattttccctcctggcaaagtgacacagtcagactaagtgatctccaatgtttctttccattctaaaactctatggttctataacattctcgatttattgagccactgtttcactgattcattcaataaacatttattgaagcccaattctgtgccaaactcaattgctctcctgctgtcaaaatcaggcaacatgctagagttaaaatgtctttaaagatttctgatggctgctgcttttaaaaggaacttcccatagcaacccctacctctttgtgcttctagagctagctctcctattattctgtgaggacttacaaattcagaaagacaaaggaatatggaaaggcctggtattcacaacctactagatgtaaatttcctattcctaatcacctttcttccacaacccagaaaacaataccttcaatggatttgctagtgttacagattgtgtttgattatttgtccccaaatttaaagtacttcttcatataattgcaaatatacgcatagaaaataaaatattttaaaagaaagctaatattatatactataagtcttaatttgagattatacatatttatccaataaaagtatagaaggatcaatcaatactgactagtgtttccctatgggctccatggatagagcccataatttgaaattaggagccctaggttcaattcctcactttatggttggtgctatatgtccaagagcagtaaatgtagctgagtctgactttatttcaatataatgaacatagatattctgttatgctgcattttcagatttttaaaaaattaagatctttaatataaattatgaaactgttcttattaattatatactgggtcttccataacttcccgttaccccatctatcatacctgtattgaaaacatcattaatcaacattctctagctcagtatttttcatcccagattccctatctggtttgagtactgttttctcaagtatctgaagggtagtataaaaccagcatcattccagatgcataggagataagttatttcattaaataagacagactccttagggttttattcccgtcccaagttcaacagagttacagattaagtgcaaacacacagaatttatgagaaagacttgaggtaactcacagaatagaaggaattgctaaaccacgaattcttggagaggaagatactctgggtaaacccaaactcttgaactcacagttcctggtctcctctaggtttgcaccactcatataattgagctccagtgaacttgaggtaattcttttcaggttctgaattccccaaatcagaaaacttggatagctctacttgtgttagaagccaattcccagatcagtctttgtggctggaatagggatgaggggacaagattataaagcagggacatgccagagaatggctgtgaggggacagcctaatcattcattaacacctggtatggtccacaagttagtatttagatctagtatttaaaaaaaaaaattttcctaggatgatgaaattattaccatctcttttttagttttacctttgacataaatttagatcttaggatccaaggtaaataatgaatttcagctgaattgtgacaagctttatttcaattgtgcatctttatcagagatctaagctaaacacagaattataaactttatagttggaagagggagatccataacatttacgagactttctctggtgcacaggcgaagttgggatgaaaaactgggtctctagatcagttgactcaaaacagagatgatcatcagaatcacctggaaaactttctacaagagtatatttccaggaaccctacccacttccactttaacaatattggggtggatctcttgctaacatattattatttttttagtttctagttagttccaatgaccagtttattttaaaactcaatgttttgcagtttttgcttttaatttttgttaaagaaatgggccttctctcaccttattctccatgaaaataattcacatcccaacaaatagcacaaaatacacaataaaatagacacattataagagaagcaatcaaaaagcagagcacattgtcactacttagtttggaagcaatttcattggttagagaacattctggccaaactgaataacactacctcttgaatatgtagttataattcacaatacttccattcacttctcagagtgagcgttctctggtctcatggataggacgcattccacattcacaggctccaattgctttttttgttgttgttttcttttctacttgtgggtaaaccaaataccatattaaaacaaattatttctccttttaaagatcattttccttgacagtatatggcaaaaatatttgatatattttatagcccatgcttgaaataagttgtctcctccaccattaaccatatgatatgccttccctaccaacaattcacaaaactatacaagttaaagagatcttccattcaagggctttgaaaaatttcttcccagttacccaggacacatatacaatacctcagctttctaccctcaatacactcttctacttgtgataggaatagaaattcttctaaattgatttcataatccaccaatggttcaccatccaaactttggaaaacacaaacgttattcaacctttccattttatacattaaaaaaatgaaggtccagggaagttaatagacttggcaaagaccactcagcttatgaatgcattggactagaatttggctttatgaccctatatcctgtgttctttctatcacacttttatgcatttatcatttttttctttctttctttctttcttttttttttttttttgagacagattcttgctctgtcacccaggctggagtgcagtggcatgatctcagctcattgcaatctccgcctcctgggttcaagcgattctcctgcctcaggctcccaagtagctaggattacagactcccaccactaggcccagctagtttttgtattttcagtagagacagggtcttaccatgttggccaggctggtctcgaatgcctgacctcaagtgatctgcctgtctcagcctcccaaagtgctaagattataggtgtaagccaccatgcccggacacttttctgcatttttaatgccattttggatagatttaaatggacatctttacagtttcaggatggaaatattcattctgtaaaatacatgacagtctattttttcatcatgacattccatcctaatttgatccctatcctagatacctaattttataactccttgagaaaatatataaaattataccttcataactttcatataatcaaacaatattatcatttttctgttacaatatcaaagtgaagtaatcatcccaactacctcaccatatttgcactaattatgttagcctctcaacatcaaattttgttttttgcagtttcttttcatatgtattattataaaattctttgactcaaatgttcgaatattcctacttaaaaacagataatggattttattttgatagaattcccacaataggaatagactctatatcattttgtaataaaaattacattaaatacacatcacaatcttgacgagaagttaattattagcaaatgctaacaattaccaggcatctcaggctaaggtgatgtgagaaaatgtctagtattcataagttgtcaaattaacatcaaagcaatatcaactaaagagcattaaaaaatagcaatgccttggccccagaccccacctcaatgttctcttttaattatcaccataagacttgggcactgggagttttagaagcttctcaggtgattctaatatgtggaaatggtaaaaacgcagagtttagagagatatgacctaggcattcaatgtgtaatatctgtggctctataactgtataaactttgtgtaataatatcacaaaaccttatggttctttaaactaaaattatactttagatatgatctatgtataatattgccttaaatttgcatactgcttatgtaacttatcaggaaactggcatattttctcttataaaggagaaacacttaaatgcatttcttcctcccctttcccaattaatatatgcttagatgttacattatcagactgacctttgtaagcatctgattttaactctcaagctttctttgtaagggccaatatttatgtaaaaccacacaaatgaatatgcaatcccagaagaataaataactatgccaatattacatactgcctttgcaaaggaaatatcatctgagagtaatataggattgtatcttgcgactgacttagacaatcacatttgcccagatacagagaaatccctaattagctaaattcagttgttttcaattttttctaaatttatgatcgtagcctatctctaaaactcattgtacaaatatatatgctttaagtatttctggtgaaaccttatgtaaccattcaaagaaggcaactgtcgatattatattctaaagagaaggtcatggaagaaagtcttgggataaaataagtagataaagaaataaagacaaagaacaagagctagtcctgaaacagtttaagagaaaagtagacactccatccatcagtagcttttcctggataggctcatctttctttaacaagttgacacatttgcaaactgcaggctgaaattttaaacgtctaagctgcttttccttcttctaatagaaaaggtacaaaaaatggtttttgcttcctttactgctgtgccttaataaacatttggctcaaggttttaaccaagccaaatgttgactaaaagcctcctcataaaaggctttaatacatttttgcttgtgttttctttacatgtatttcaatttgatgacaaataatttcttccccatttccctcatttgctgctgcatgttggactaattaaaaagcaggctctttggaagctggaatgagagaaaatggaagagtgggcaggtgggtcaagattgaatgtccctggctctggcaatacataggattctcttcagtgaaacattctccatctagctcagattcaaggaaggcaccgaagaagcccttcagcctttcctacttcaggtcagagttctttttatatttggcatacaaccgagagacatcagaattctatacaaaatggaaagttttattcttcccagcaattccactgcattctgtggcctcttggtgctgtgggcagccttagcagatttgaggcatctcttagggcaaagcggttttgaggtattcttggcgactgggaagaataatttaacttctcttggaataatatcacattcagcagaaaagatctgctgtgctcaaggtcataaatcttggctctgtgaatattcagttattcagcagaacagccactccaagccttcagagcacttttggatgctgctgcaggtgtttcctgtagagaactccctgacatccactgagttcttgcatctgcctttacccttcttgatgctgtccattctgctctctgaacaaacatattctcttacacttatgcacatgtatgaaatcctagagatttccctgaatcaacatatgcatatagatatatgatggacagaataaagtatcaagggataaaatatatttttaattttgtatttcacttgaaaattgtaaggaccattttataatgtattgcttgcaaaataagtcatggaagccctgaaaaattaatcaattcactaatcaaagaaacatatattaaagacctactatgcatgaggcaccatgctaattgctttgaagaagacaaagttgaattagacagggatccagtttacaagatatttacaatgcaaagggggatacaagacatataaaaggctatggaacttaaaaagaagaaaaaacaattctaaagtattgagatacatttcattacaaggcaaatcttagataacatcttgaaagaggacacatttaaaatttaggagatttgaggaaaagatcctccagagtatgatataaaaatgagtgaaggttttgaggtgagaaataaaattaatgaaatttgactcgatctaaggtgacatcatgaagaataatggcaaatgaagttaataagtttgtttcaggccagcttgtaaaaagtccttgaaaaaagaaaaaggaattccttatatttttattagaatatccatcttaaagtgaatggtgaattattgattggcatggatttagggacaattgcatgtcatctttttctgttattagtattactgttttgaagaatgcaatctaccaaaattgaaggtaatagtttcaatgtaaaaatatgcagagttaagcgtttggaaagcactattcaggtttagtatataggaggaaatagggatgggaatggtctattactagacatttttattcttcctacttatcaaatagaccaatatgtgtggaggaaaagccttcttctaaaaagggtttgttttacactacctgtcaaagaggatattggttcactcaaggaaactaagttatattctatttaactgtgagatatattccaataaattgcagtaaacataatcttaaaatattataaagaggcctcagattgtttaaaaatactatattgaatatatgagaaataaaagctcaagatattctttaaagtatatcctatgtaaatgccaatttttctttacagaataaatctaactacaaatgcatacagggcctaaatatatttttatcttgattttgttccttttcttgtgtttaagagccctgactccagaatcacaagagacaaactgccacttcatcacttattagcgctgtttgtgtgggcaggctatttaaacattccaatcctttattttctcctcaataaattgtaaaaaaaagtaatgtttactcagaggttaatgagttgacacttataaaattattagcatggagcctggcctcagatatcattctcttctgtatacaatttttatgtgtttgttctttaaacttataaatcagttccatcagactttttacttcatggcaagctgcttttatttctaattaagaaaacattcctgactccaaaatttataaagactttttctctcttttcttcaagtatttctataacattgtaatgcatttagtgtttatccatatgaacggtatgatattggaatctaattttacttttccacatgtataatcagttcttccgatactgttaagtattgtatcctttatgtaattattaaatatcatatataacagataaaaaactctgtatgtacttacatcgatttctagactccattttctctaaacatcccttgtctgtttctgtgccagaactagactgttttaattatagttgtttcatagtaccttttggtatcatgctggtaacttccctaaactgttacttttctcaaaaaatttaggcttttataaacatttagcttgcatatcaattttacagtttgtcaagtccctaacctcctccccaaattgagactgtgaattgaattgccctcagtctataatttaaagtttgaatcatcctattcagaggcacaaagttgttggttttttttgtttgtttgttttttacttattttggttgtgctttgtacccttccctaaagtgttattattttctttatgtaaatcttacataaaaccagtattttttaacgttcaggtaagatttttatattcctaggatcttcatgtggaaaaaaaaaacttaatgatttaaacagctatattaacttgatatatgtaattatttgagagaaaatctagtcaataacttttgccttcccactccagacttctaccctgattatgttaggtaactgaattggaaagaaaaatatttattctttatattattttttctgatctgaaaaagatagcttgtttccaccagatacattcatattaatagccatcaagctatactactttcaaattatatttatgacaataaatgattcctacaaattttagagaagactatcaaaagcaaaagaaataaatacaaaaattaactgggaacaaataagcaacccctggaggattcatctctatgaccctacagtccgaaactaaagaataatacatcctgatggacggctatggaatgaaataaaattctctattaccagttcactagaagaatttttttcccccaggtttgatctctttatttagtttatcctccaggttaaaagaaaattattcactattactcaccaataactcagtaaataaaaattttgcaaattcagccatttcaacatgccagggaatatctaaaggtgtatatatacaaatatttatatataaattttgcatatgtatataaaagaaatatatatataatatatatgaatataaacattcaggtaggatatttatatttatatataaggatatataaataaaaaatgtatttatatttctttttcaaatgcacagctcttatatacatatttctttttcaaaagcatggctacataaatttcttcattttgatgttctgcttctcttcagtttgatcttgcatatcacagtgcatttataaaatctggaaagccatctaaagaatttcaaactttctgaatacaaaatgtctttttccaccagacaagagtcaccccagtcactaaacaaattgaccaatttcagagtatttcctgcttctacttgttactgatgcagcatctggctggaacagagtgcgactggatgcagaaaagttcatgattgcttgattgactgattttgatgttgaaaatcatgtaaaattcatatatattcaaaatgtgattcaaaatagatatccaaagacacatcccagaaaatcagtgtttttctataagctacattaaaagtttttctaaatcttcatttctaagaaaaaataaataatacaagaatgtatataaataagaatgctacctctggaattaatagcacctgcatctgtctacctctttagcaggctttagttttctttctataaatactcgtcatcacataaactataacgtatttatttatttctacatctcccatgaaaacgtgagctccatgaaggcagggacttttgttgttatggtagtcgtcatggtgattgtttaccactgcatcccagggactgggagagtgcctgtcatgtactaagcattcaacagatatctgttgaattaattattcataattacttaattcacaattttaacatgagcataagaactaagatcagaccaaataagccttttcaaaatattaatgaaattttatattattattatctactacccttttaaactttactgtgcttaaaagaaaaaatccagcttgattacagagctcaaagaatgctattgcctgaatgtaagatcgagaatagcttttctttacatgattcccagtctaaggagagaaagcagatagtaaatcacacattaaacaaatcattcaattacattcgtttaaagtgctgctacctaggaaggaaactgaaatgtgccttgagaacagatactcaactggcatgctggaagggcttccctagaaagggatggtttggtttctaggacttgaagaataaggtctaaatcaggtagaaaaggcagggaacattccaggcatccacaaagatatatagagaggctgagtccaggaagatcttgacaaactctagaaactgtgagactggtaatatactattaggttggtgcaaaagtaattgcagtttttgccatttcttttgcaccaacctaatagaaaagaatcagtacaaaacaaaaggccgctattctggtgtcagattttcttctcacactgaagccagctggagtccttagaactttcctgaacttttctgcatccagcagcactctgttccaggcagatgctgcatcagtaacaagtggaagcaggaaatactctgaaattggtcaatttgtttagtgactggggtgactcttgcctggtggaaaaagacattttgtattcagaaagtttaaaattctttagatagctttccaaattttacaaatgcactgtgatatgcaagatgaaactgaggagaaccagctctttggctgcagatctgagatctttctatgggaggacaaaaaggagctaaatcacattaatctattttccacactagtgacatgaactaggttcaattattcaactacggaaaagtcccctttttatgattcctcaaacggtgtaatttttcctgcctctgtactttcatgttgtctttttttttttttttttttttctctctgagctgttccactaggcacatatttctagaatcagctgaagttccaccatgattctctgtttggactatccttcctctgaactcctccaatattttatgcccattactatacaactcttgattgcatctgagtcccttgaggagacagggaggaacaggacaggagacagggaggaagaaggacagactatgcctgtgaatacagagtattttcctacagagaatatttctaatgaagatgtaaaagatccactcaaaactcaagcattatattgtttgagagggcaattttttttttttcaatttaggtggtctgttttatggtttcttctatggaatatctgtgcaacaggagatcctcttgaataattacccgctgaacaaactgtatctctcaaacacatctcaattttagacttgttgtttaggtcattccctggagagtgtcttgaagaagaaaaaaagcggaaacttacagatagtaggcccagggaaaatataaattattttatatccacttttgagggcctcatattttcttggcttaggtactcaggagacagatataaggcataaaatctttaacattattaaaaccaattcagaaaaatcccttaaccttccaacactaaagcagatagagaacatgaaaactatctatggaactgaaaatcagtgatcaatacatctatgaaaaatgttactattttataagacatccaaagaaatacacaggaaaacaaaatagaaatagcttacaacattcgacactgcttgtgtataatcacacaagcacgtggtatcctaactagtggaaatgcaaagtagcgcatactatggggaatataaattggcaactcatataaagacccaaagaaaagctttactcttgtcctcataattccacttccaagtaatacagcttaggaagaaagtcagggacaagaacaaaaatttgtataccaggatgttcattacagccttaaaattcaggaaagtttgtaaataattaaaatattacactattcaaaaacaagcaatttatgacacaacattaggatggaaaatttgtagtcagtaaaaatcatcttttcacattctaatgacagaagaagaaaaatactccttacattaagctaagcaaaataaatgtagggcatacaaattatactataaattgtactgtacatgtgtgtatatacatatatacacacatacaaataaaggaaacagaccaaaatgatatcatgtatttatttcctttaaacctttgtgtactttcccaattctctacaatgaatatttttatgaccaagaaaaagttaataatattaaataattaatttagactcatttcattatatgcatgaattattccacataaatagctccttgttacaatcaagccaaagaactgtcaaaccatattgggatctacagagactcaatcgccaacaacgacataaggcaaaacctcccacagagaccctcttctctttcacataacactgtattttttaacaatgtttaacagttggaaatgctgagaagccacagatgagatcattaggagaaagtattttccatcatgcttttgtcagggaaaatcccttagtagttctatttctgagttatatttttagccaggctgacaaaatttaaagcaaagtatataaaatgtgtatttgcaagcatctttctctaccaaatggaattcactttaactatcacactgataaagatcatttatcataggcttgtcttctgcatgaccctgtatttggagggtgtgagagactacaagacagaagtggtcaggacctcaaaagatggcacgtgagccgctgcttcaaaaaattaaccagacataccagaaaaatatgatgatgtttatggtctgataggcatctctgtgatctgtaatttatgtatcctatctctgtgcaaccaatggatttaatgggtcagcaagcttcaggaaaaccctaaatggatttgggttcagcaaacagccggtcatcacttctaccccatgcttctaccccacttctacccaccgtgctgaactgcgaagccaaggacttgcttaaactatcaaatccagtttcctcatagaacttttggcccttctatttgtaggtccatctttgcctttggttgctgacatcacattcccagggactgttttctcttgtataaacatatatccatgtaaatccttaaaattcatggcctttgggtttttccttgtcagtcaatctgaatgtccccttcctcagatcctaatagctctgagctggattaggttttccctgatttgcccagcagtgaattcagcttaatttaaaatccactctgcctgagagtttctatttttactttatgaacccataggactgatgaacaatagttagaattgtattcaaattttggatagtttgaattatgtattagttgggaggttcttctttcaaggaaaagaatacaaaattaggtacaagcatgtatacacacatacacacatacacacacacacacacacacacacacacacacacacaaagaaatcacaagtatttactgaatacgccagagctgttttctctgagatttctttaggcagttatctatagacattgtcatagaaatgcttccagattacagtgtggcttcctctccttgtggagaaaactctgtagctcccaaaacttcactaggggaggtgcaaatgagaaaccctagattttaaggtgaagagaatcaaacttacattttccatttgcagaaatgtgttcattagcttagtgagattggttggttttgcttcttattgtctgttaccccctctttgcttgagggtggatgtctgtttctgacaatgatttttgtgaccctgaagccatgtaaaatggaactagtaatacctactgtatcacttgattgttgagaagattaagtgaaatcggagtgaaatggattaatatatcattgtctgaaaattgttacactagaaggcaactccttagagcaagggaattttgttgacaaactagcactcttgctgggacatgatacagagttcaatgattaggggctgatttgcttgaggaatgtgaatgaatcatagatgctataattgcccttgttctgtccctaaatgaagaaaaacgaagcagctgtggtcatctacattctcactgtctaatagccacaagtggtctaaatccagactaaaatacaggggactctggttgcatttatatttatcccccagctgtttctgtctccctattttaccaattccaattcaaaatgctcttagccctgaagaatctgaactgcctcagttgtgcactgtcctctgggtttgcagatgccatagaaatgtctgttctgataataatgtactgagggcatcatgcttatttaacctctggtgaggtagttaggaaaatgcttctgatactgggtaagatcctgaataggaggcccatgctttgtgatgccagacctcttgctttttactgcctttatatacatgataaaacatgatttcagtcagagcaagtggtatatgactcctgacattgtgtgataacacagcacattgtttctgtggagaagtcaacacagttctggaaggatgactcgctttccggttttatgctctcttcccctgaatcctcataagaagctgctctgaagtttaaacatcgaataaaaatgcttccaaacaattaatgcgacagcaaacacaccaataaacctatcggcagcagcctcagtattttacctcagtctttaatgtcagcttgcttttttattccagaggtcagaaaaacaaatgctctgtgagctcattacgtgcatgcctaaacaagcagaaaagtaggtgcttttccaaatgccagacaatgaaatctagatttttctctttgtacttcactgtaattcgggtgatagaatacttgctaatacaagctattaaaacaaaccaacaaacagaaatcagtctctcatagcctattttaaaactccctccctgtgttcttaactgttgacttttaaaccaaaaatgccagtcaagaagtacaaagtgatctttagcactgtctagcttaaaatgttgatagttaatatttgaatataaaaaagtataaaaataaataatagacaactcattttagctaacactttggaattaactttgagtagtagaaaactacacaatataaacctgtttttcagtggtttctgctatcaagtgaattgatggattatagtaacctttgttacctggcactcagaatactacttttaagcacaggttcttttaataagaaactaattgatatccataatgtgacccaaataaattgtaaggtccttgaaattaagttctggaaaaaataagcaaattcttaggcttattttattttttctgtaattctttaaaaatgagtgatctacatgtcatacatgtatatggtaattctctcctgtatagaataccctctggccatcctgaaaaataaaattaactcttgagctttatgagattttctaaagaaaaagtatctctataaagaatgttagactgggcatggtggctcacacctgtaatcccagcactttgggaggccgaggcaagaggatcacttaagctcaggagctcaagaccagcctgggaaatatagtgagacctcatctctaccaaaaataacataacataacgtaacatgacatgacatgacatgacatgacatgacatgacataacatgacataacataacataacataaaatacactgggaggctgaggcaggagggaggattgcttgagcagaggagatggaggctgcagcgagctgtaaacatgcactgcactccggcctgaatgacacagtaaaactctatctcaaaaagaaagaaagaaagaatgttaacttgccgacacacatgctctcttccattctttttcctctccttacaccatcccttcttttttccattactcacaatgatgggattagtacagcttgtactggggctttggaactgtaataaacaaggagcaattttctggtcctaattaactcctgttaaaataagcactgcacaacaatagtctacccagagttgcactgaaaaaaaccacaacaatcctaacactctatgaataatgaaccctatttaaatgagcaggttattgtagggtcttaatgagctgctctgtggccacagggcacatactgcatcccagagtaatggagcattttcctgcagacacttgcaggctgggctagcagcagaacagcttcttccctggtaaaaccagagaggtagcatcaaaggtttgttatgtttccattttactttttcacacacctcttctgcaactgacatcagccatccccatccctttttgaaatgttgtcttccttcttttacctccaggcttctatattcaagcatcctcctcctttatatcttttctgaagtataatttacagaccataaaattcacttcgtttaagtatacaattcaatgagttttggtaaatttccagtgttatgcaaccatcattgcaatctaattttacaacattttcattgcaccaaaaagaaactttgtgcccattcgtagtcattccctcttcccacccccaggccaacctaagcaaacactaatctttttgtctgtataggtttgccttttttggacaattaatagggaaccacataatgtgtggacttttagcataacgtttctgaggctccatgtagcatatagcatgtggaacacaatactattccactgtatagatatactacattttgcttgctcactcatcagttgatgcacatctgtgctatttctacttcttgttattaagaatgctgctgctatgctgtgaacatctgtgaacgaatttttgtatagacacatgttttcatttctcttaggtaggtacctatgagtggaacagctgagtcatatgataaatctatgcttaacagtttaagaaactgccaaaagcttttccagagttttgcattactagcagcaatgtatgaaggttccatttatccatatatttactaacactggttattgttgatgttttccattatagccatcctagctggcgtgaagtgttatcttgtggttttaaccatttccctattggctaatgatgttgagcctctatcatttgtgtctgactgttgtttctgttttattttgttttcattcctcgttttagtattccttgacttttgtaatgtcccctttttcctgtatacctatttcctgatccacatggatcatgttgactcccactcatatgcaattaactaccatatcttaatgaatgctgctcatggctcattctcaatctatttatctccatgaagttactgataccatatgttaaaagaaaaactttagacaaaccaaatctagcagagtttatttgagaaaataaatgatttatgaatagggcagcagtctggaccaaaaatggttcagaatgctccactctaccacatgtgcagtctatattcatgcccatagaaaaggaagtaacatacagaaacaacctgattggctgcagtcaatgtttgccttatatagtcgtatttggcagctttcagtctcttaatggctggaggtttagttgctgtgattgattgagactcagttactttttacaagagtatatacttctagtttaggttatagcttgtaaatacaccaacttaggttacaattcactatgtctagagaaacttttaggcaactcttaaattatttatggaggcagttttggccaaacttaattcaatttcatacatatttctacttggaaaaaaggcaggaaaattgaatttttaatttacacacaaataatgaacagaagttcaaatgtaccttgatttaatgcataatataattgcgtgaagtattagtataccataatcgttcataaatatattgcttttacataagcatactgaccacatgatcagacttgcctgttctcttactgtcttacggacagtgtaggattcactaagctgcggtcatttcctctttagaacctagctgtgatcatcttctctgcctgcctcttactttgtttccttcattttcttttgtgacataatggctgtagctgaagcatacaggtagaatctcactatgccccctactttcttctcttttggccttttcatcttttttttttttttttctggttctccaagtccatttatgcatttattcattctttttctctttttttttatactttaagttttagggtacatgtgtacaacgtgcaggtttgttacatatgtatacatgtgccatgttggtgtgctgcacccattaactcgtcatttaacattaggtatatctcctaatgctatccctcccccctccccccaccccacaacaggccccagtgtgatgttccccttcctgtgtccatgtgttctcattgttcaattcccacctatgagtgagaacatgtggtgtttggtttttttgtccttgccatagtttgctgagaatgatggtttccagcttcatccatgtccctacaaaggacatgaaatcatcattttttagggctgcatagtattccatggtgtatatgtgccacattttcttaatctagtctatcattgttggacatttggcttggttccaagtctttgctatggtgagtagtgctgcaataaacatatgtgtgcatgtgtctttatagcagcatgatttataatcctttgggtacatacccagtaatgggatggctgggtcaaatggtatttctagttctagatccctgaggaatcgccacactgacttccacaatggttgaactagttaacagtcccatcaacagtgtaaaagtgttcctatttctccacatcctctccagcacctgttgtttcttgactttctaatgatcaccattctaactggtgtgagatggtatctcattgtgtttttgatttgcatttctctgatggccagtgatgatgagcattttctcatgtgtctgttggctgcataaatgtcttcttttgagaagtgtctgttcatatccttcaatctaatcagtagccaatatagtgattccattcaaaggttcaaacgatgcttaaaccaaaattattatccatttcacactctccaaccaagtgaacaagaggaaagaggagaacaaagcaaggaacaaaagaataaaaaaggtctaattaatttgcaacctggagaaaacatgtcagatcttgatgtaaaatagaaaagtctggaaaattgggattttccaatatgcagttatgtggccaattttagagatgcaataaactgagtgtgattaaatggtaaattggactgatcaggtgagccatacttttcttgtgaaaagtagcaagcatggaaaaaaaaaagatacagctctatttccctttacttttccatctgtatctttcatatttttcaaaattaaaaaaaacaccaaactatttttcaagtattaataaagaatcaggaagaacttcatttaaaacatttttgcctgcccttcaaaaaactctttcactgtttcaaggccattgcttctggaacccagatttgttctagcttacagcctaggaataagaatatatactttcctgtcaggatggcttttgagaaactctgagaataaaatctgacccagtccaatctgacaaggttgctgtgcttgtttgaatgtaaaatgattcacaaagtgaaccgaaagtttttgttaattgttaaaaagcctcagcgctgtggcttagtttaagagctacatctggcattttggtaggaacaaactacttatgaatgaggaatagttatattttttgtgttgttgtttttatttttcttttggggggggagggaagaaagaggacagaagagaactaggacttagtattttgaaaactgggacatcatcactggcctacccaccacataaacgtaactagtgtatatgattttaactttgtaatcgtgtacattgacacttctttttgatattctagatctatacaaagaaaaatactcaaagagatgcaggaaaataaataagaaaagaaattctctggccagcaattatttagcagtaaattgacatataaatgtggtgtaattaaactcaaatcacttttaaacctaattaccgatacaaagaaatgggaaagcatcgacctctaggcttcagaaagcttaggtaaaatcattacaaatctgtcagttgtaccatcaaaataaatctggaatctaagcacttcttatcattttcattgctgccaccctggtctgagttacccgcattttctgggacttctgaaataacttccaaactattgttcctcagacttaccccacctctcatacaccacttcaccccctgcccccaaacacacaaaagcaaagtgatcttttttaaacttaaagtctaatcatgccccttcttggctcaaaacccacccatgagaaattaaataggcttttaaagttacgtatcaattttaaaagtaacacttataattctatactctaaagagtacctgagtctgtactaggacatttgcttccagaagtcatgaaagtggtctgaagaagtcacaaataggagtttataaagttctagaagtatcaagtttctagattcttttcagtttttgctctgtttaaacattcacaccaactgaggtctgggggtgaaaggggaagttaatttatcccctaaataatatttattttgtatacaaaagaatggttaaatgtattcagtagtctaacctgctcttcttggctattcattcctgaatgacaggaattccgtttgtaccaccctcatcaccaccattaatttcatgatggactagctacttcacagccctcatgtccccaccactccattcaagctcaagggctactgaagcatagtagcagcttacaaagaaaaaaaaaaagacaaaacaaactcttagcaataatgttatgtcattcacactagagacaaaataacttcattattagagatgctatcattgaaattaattcactggttataaaaggaaggctatccaagaatatctgcagttttgatgccttggaaaataaaattaaatggaagagaaattaacaataataactcagaaataaacactattaatattttatgtaagttttccaccttccttgatatatgacataagcattttcttaactcaataaaaactctaaagaaacatagaaaacaataacaacaacttgtgtggtttctcgtctctctcagagtaaaagccaaaatcctgaggatagcccgtaactctatacaatctggtccaccatttcatctgtgggctcatcttcaatactaccctaaagcctccagttttgctttagccacatccatctccccattgactctttaataagccagacagttccctggattttggcatttcagtggctccttcctctgcctgctaaattcctctccaacatgttattcactgtgtgctctctcacctcttctaagtctttggtccactaccacctacaccttgcctttacatgccttgctttatttttctccataaaacttaactactgagtataccatagttaatcactcatgtttaaatattttttcgtccatctcctacagtagaatatgagtgacagaggacagggatcttcattttttgtttgtttggtatacccagggcccagaatgatgccatactcatgataagcagttccgtaaagagcgttattccctgtgacagaatgtcaggagtgaagttgtcaagtcctttttctagagaagtggtgggtgttcttgcttctcattaactaaggcacagcctggattgaagagtagacatgagataagagttctgtgttctgccatcaaaaagacaaaaaagaagtatacatcttttcaattcttttatgcttgaaattctcaccttcctttaaatcacaaggataatctgttgacccttacaacagctctgagctgttattatccacaactgagaaagaaaggaagaggctgtggtatttactgaggtcctaaatggcagaaccaggactagtaaaccatgttattaggtttctgcttctatatagtcacaatgaactgcagccacatctcccagaacaataaattagcaagtagacagaagtctttctttccaccctcaaaagaggtttttagcctttacaattagcttttcaataaagatacaagaataactatttcattgatgtgctctcagcagatcttagactttccattatttatttcctttgtttagttcaatgtgaaagtgcttggctttaatcttcatttcacttagttttatcaaaatataaaacccctacatttgcataggctatcccagggtccagaaagcattcacactttgtccatctgatacaccctcaaaacaacgctagctgaggtaaaagcaggtgggtgtatctttacctcagaaggatccttgacctgcccaatgcgacatcagtggtgagcctcagaaacagggcaaaaaaaaattgatctctttagtgtaaactcaatgtttttaatttacaggaaatgcattcactggtgtgtgtgtgtgtgtgtgtgtgtgtgtttgaggcaggggagcaattacataataggaagaaattatctaaattattcttatttcacatgtcttctagaaatataattgtcacttttgcactccacttccacttcctggcaatttttctgctgccataattcaaaaacagactctttggccgttccttcacattcctttcccttttgtctttacagcctcatcacttccttctaccgatcttcatttcctgcttttgagactttcccgctgcctcctcctgtcatcttcaggtcccaaatgcagttttgccagattccacatccaaaattaacatcatttcctctttggctacactagtaaaggtgcttccttttatccctccagatccatatgtagcccaagtttgaagaactttcttctccctttttagagttgtataagcttcctgagagctggctctacaatctccatactctccagcccacatcacagtacagcactgaaaacagtgccttttatactttgggtaggcataggtatttgagaaatgagccatgaactcaaaaagatagcttcagggaagtcatgagcaagggtgacggcaggaagcactgcttgcctttcttcaccacccaacttctgccctctggccctttttcagtcctccactttgctccccactggcatgccacacatgtgagacagcatgaggtatgactactgttccatcaagtagggaggatgctgaatgcatcaatgacacattgcctcaaggttccattccactataagtatataagcaattgttctttggccagtgcatgtttttatgcagtaaactagttctcattttgctggacatttattacaacatttacccattacaaagaacctcattatgtttaatatatatgaaaacacgttcatttgataggcctattacttgatccattttatttgggtatacaggataacacaggatattttccttcaataaaatagtgagaaatttttgatctaagaagcttcaatatcacttttttttttagtacgcaacacattggtatactgtctgggggcaatctatataaatggaatgaatcctacttaaaaatcatttgttgacataaattattgagaatttcatattttaaaaatattataaatttctttacatttagaaaccaaatatacttctataaatgccacacttatttggaatatatttctgtacagtgtaagttgaatattcatttatatttttctgcaaaaattagttgttcattctttaattcatatacattttagcttcctttttcttttttttttttcccaaatccacaacttttaaaaattttcaacaggacttccctttctgaaagttaatgccttgattaacatttcacaataaattataactatgatttatacttgatttttctttgatttcattctaaattaagtttctattttaatatgattagaggctttgaagaaacaatgggatctgggaaacatacttccgctttatattaaaaaacagatttatcattacaattgttccaagaggactggcctttttctattttattcattgatttatcccaacatctagaacagtgcttggtgttcagggggcactaaacaaatacatcaaatgcctcctatccactgcactttacccactggggacttggaaggtcaggagaggcccttactgtgccagacattatagtaagcaatgtcacataatctcatttaactatcataaatattctttgtggtaactttcaacatccccatttcacagatgaggaaatagatgcattgagaagttaaggttttcatgtaagataacagaggtaataaattgcaaggttagaataaatgccttgaagtctgtctgtctgcaaagtctaggctcttaacaacaccctaagttgcctgccttcacccaaaagtattgtaactagaaggaacattaattactcttcctctatctccacactgtatatgaatattcagactgactgagataaaattacttgcaaaaagaaatctttgcaagtcagtgccacaattaagtcacgacctagtaccattaatctgttttggtttttagaagggtggcattctcctaccttgaaacatcaaaactcatctaatgagaagagaccttgttcaagggtaatgtgtagcttgcagttagaacaggtgagaggcttgacagtagcaagaccgactgctggtttacagcaatgtgaatgtctggtgcttggactttccaggaagcaggccagtgccatatttctggctggctgtctctgacttgaatttagggtcctccaagatactggagcactacctcccagaacctcacgtagtccattcatcaatatatccaacaaatatatatatggtgtttcaaatatgtggtaggcactgatctcagatttggatatatggagataaagaaaacaaagtttctgaccttagaaaattcacaatcttattgtatgtgtaggtgcatgtctgcatatacatcttaaaatatcattgcaagttctttgtgtagtatgaaattgtaagggaaaggacatatctttcattctcatctaggttcatgactagaatcttacctcaagtatcaagtggttagtgttcattcttgcccatatatatatactagtatgtacttttactattcacattttacagagaaagaaactgagtttcagagacctccaggtgactggattagcttctcacagcaaatggtgacaattcaaggttgaaagaatctctggtctctttgataccaaagacaaagttctaatccaccacggaagaaaaggttcaggaaaaggttcacagaagaactcacgagatatgtctgtggtcctacttttagacgtgcatttttttgtggagattgcttcctcacctgagcctcagtttaacatgaactgttcaagcgtaacaacaaattaggtgcatgaatttctctttactttttcagaagccagttttattccatttagcaaacataaatagtgatttcctctgccacattgctcaactatagcttattaatggcttccacttttccttgcttgtgccttaagggtcctcagtaattacccaacagctgtttagacacatagccccagaggctggtatggtctcctatttgctacattaggaaaattctatggtacagcaacatgagtgacagcatcaatataccttcataaaatgatgaggttctatacagctagggtttccccttccttctaaaataactttactttttcatgtcatttagaacccccaaaaaaggattactacttctgatgcaccatctgaagactatcctggatacttttatattaattagaaactgaaatgcttgacatgcaaacgctgtggtagccgtctctccccaggcaggcctgttgttatattcatgaagtgcttcctgaaagcttcttagacttgcagaggctgggaagggaattgtttggtctgtccatcactgcaattcctcctatttgttatttgtattattccttaaggccttcactccctacagattctgtgacagtattgatattacaatgtacatagcatatatttttcaagagtctgagggtacatgtacaaagtctatttcaattcctctcaacaggcactgaaatgctataaactaaacaaaatgtccttaccacagcttgcataatgtagaaaagtatatcatctgcaaggaaaagctgcagattctattttgctttcagtattttgaacaccacacctgccctgctatattcagggctagatctttgcacagggagttagtggccacctacatggtatgttttgaaacatacagaaatggacatcttgctcaacacatacccccattaggtaccaaatgctccactttcctatcttcaaattctagccaagtatgaatggttaacatttcaagaaaatgatggtattgtccaaaaacaattcctacaaaacctatttcttctctaattaatatattagaagggtttagggtaagcttctccaaccagcaacctgtaggccgcaggaggcccaggacagctttgaatgcagcccaacacaaatttgtaaactttcttaaaacactatgagttttttttcttttgttttgttttgtttttgcgattttttttgttgttgttagtatattctctgtgtggcccaaggcgattcttcttccaatgtggtcaagggaagccaaaagattgggaatcccttgtttagggcatcaagtagtaaatcctgaacctctgggttctgaaacaatgagaattttgatcagggaaatttctgtatcagagagtaaggtccaacctaatggtagcttataaggaataagatgaggacactagcactgaaggtgtagatccaggacttcccaacttgagacagaataaaacttctctagagatgttgtaaaatcattgattcttagactctacccccagtgattctcatttatttgacctggcaagacatccagaaagcctaatttttaacaaacacacagatgattctgataaatcattaggatgcatggagcactatttgagaaatgatgcccagtaataataaaacaagatacaggtgatagaggccagagaagaaaacatgtccaagacatcttcatctgcttcgcagtgtttcccagggctattgtgctctttgacttaaaccgttcatcatgtccttttgctcattgaaacaccatccacatactatacatattttttctgcctccaaagaaattattttctctagaaaatcaccttgttccttccaactttgctgcttgttctcacatctctgtcttttagattcatgagttttgagaggattcttggttcttctgggaaattaaccttcggactctcctttgtgcttcttagacattggtttttgtttgagcttcagctctgttccctctgttttcagtttattgacctcctctccatgatctctggtaacaaactgcctattctaacctgaccctatggaacctttaaattggagactgaagtctaagttatctctttagataaatagaaaaaattagagaaaatgcaaaaacacatgtttggcattgtactggtttagaattggctaattctgtttgggttggactaatttcacaattacttgcatgcctttaggatacatgacaattaatgtagtaaaggtaatttcaattcattctgggttgcagaaaaatgtgaatctggaactttcaaatgcatatgcataattcacatatgaatcatccagaattcacaatctatgtgtgtcacagtatgcactacatccacttattgattctactgcaattttctgtatcccaaatacaattttgagcctaaagatttaagaatatttttattactttaacttttcttattttagttggctgaaaatacctagaacctatttcccaatagctgaaaccctgctttctgattctatgcatctgaatctcaatggcaccatctctaggaaaattgttacttaaatatttcaaatacaatctttataaagctcctactatggtcaggcacttgctcaggggctaggaacataatgctgaacaaacagatcctctaggagcttacagtctattatggcagacagacgacaaatgcacaattaaacaaaccaattatttaaatcatttatgaatgctaaaaggaatattaaaatttattgcagaaaaccttctgcattttccaaacagaatgcgtaactttccttctccctcttacaaaagaaaataattataagacaaactaaggaacaaacagcatgcttctctcttcaaagaaacttggctaagccaagtaattttctgctatagcagaaaatatttatcccaaatctctaacttaaaaataaacttttgagaattcaaagtttaaagcgtgtgtgtgtgtgtgtgtgtgtgtgtgtgtgtgtgtgtgtgtggcgtggcgggggcgggtgggtagaaggataggcattgggtttttttctctacattgatgatttaaaaaaaaaattcttctccaactttggctccagaattaccatgtggaaccaaaggcaaagcccttgattcgcttgaaaaatttagcaggaaagtatctgtagttaattttgggttacacaatgtccttcactgtctgggcatagaaaagctagctagctcatctcatccagaaactctgccatgagtttaaaaaccaaagcacatactttgatattcactctgaaccaagataaagctttaggttgacataataaaagatggagttaacattcctaaaaaaaaaaaaacaaaaactatgaagctgtaggatatatttcagtcttattttgcaataaaaatgacctaatgctatctatcaccttctttgcagaacaatacttcttaataaaaggcatagagatatttatccttcaaattaaaaaaaatcatgtaatttttggttctttcacatgtatgctttcagaagagaaaaaacaaatcatgttaaactttacagtatcaaatgtgataaactaaaagcataattaacttgttctcttaacataatatggttgttttgctagatcccagtatactactttttccacaggccacgtttttcctcagtatgcacaaatgaaaaagagattaaagaatttgtgtgacctacaataaggtcagcttctaattattatgctaattccatgtactagatttaatagatctactacttttctaccagttaataaaatagactctaaaacactatctactatctaagaagggtgccctctcataccttaaaatactctgtttgaatagctgtgaaggatagtaaaatgtcttactattctgttattgatcctgaattttaaacagataaatgccaaccagaattaacttatttcatgcagcaacatctcaactctttatgttttatttttgaaagagccatttttctgaaattcccctactagataaataatctgccgaatcaaataactgatctattggcaatcccctcaactgaccaaataggctacaatgagttaatcacgcaaaatgctcaccacttgaagtcagaaatccaaattttgtgctctcttcaaccgactctgcaaagtatttgagcttgtgacttatttgagaaagtaacaatttattaacaacacagcgtataaaatggtaggttttgctgtggttttggaggtcagtttatcaaagtgaggcccttctctaatcatatgcaagaattgaatcaactaaaaaacacatgtttggatggatcatataatttaaaatctggattatgcagtgtagaactgtgaaaaaaaggtgaaaacctgctttctattcttggttcaattaattaagtgtgtgtacctcccaccttttataagcatcttcttaagacaccgttgacattcagtaaacaacacatgttgaaaatatgtaatataaaatatcatagatgatattttatacatctatgaaactgcaaaataatcaaaggtaacaagcatacctatcaccccatacatttttcgagcctctttgtaacctcttgttcccttccaccgattctcctggtaggaggccaacatttatgtgttttctgtcactacagattagtttacaatttctagaatttaagtaattgagataataaagtaagtagacttttttgcctggtttctgtcactcaacataattattttgagattcatctatgatatgcacatcagttgttcattcgctctcattgctcagtagtatttcttgcatgtatatgccatattagtctatgcaagttctggtggtttccagtttttgtcttttacaattaaagctgtcacaaacattcaaaaacaagtcactacagtgaatttttctttcatttctcttaaacaattactggggagtataatggctagattatagggtaggtatatgtttagctttttagagatatatggtaggtataggtttaacttttttgagaacctcacaaattattttccaaataattattttccaaagaagttgtaccatttcacattcccatgaatggtatgtgagagtttcagttcttccacattttcgccaacacttggtaagggcatgacaataaacagagtgtttgcttcatgggaataaatgattgtattgggatgtttatatggctgcttcttactctgaagttccatcattcagaatagattatgcaggtaaaaaaatagtcaacagctttaaataccaattgtaattgttacaatattttagaactactaacccagtattctgggtcaaaccaggtagacagtatacattagttccaagttccagagcataaaataatgatgatgatgatgatgatgatgatgatgatgatgatgatgtgtgtgtgtgtgtgtgtgtgtgtgtggtgaagctcatttaaaaaactttattgattctaggattagagaacacacgcatggcgtggtgagagtatataaaagagaaatccagtgaaaaataactcattttgcttttaagtagctttacttgaatgaaatttgctttattaccatatacttcttcattcttcaaaagcaattgggatgctttactcatttatgaacttgtgcttttattctaaagatttaaaaaatttataaattgaaatataaagaatttacacaatttctttcatttttacagacttagtcaagtaaactgcacttttctttttctgatgatgcatcttaattgcatattatcaacatagtttgctattcagcagggacaatttcataattgctatcttcagagaagtaaaataatagagggcttcttctattaacatttagtaaagtgttacaaatagcacttggtgaatgaagggcttcaaattattagaaggacataatattggttacacatgttcacagaataagaaagatatttttagttcctttcagtatatcaatttctgtgaaataaatagcattctgcaagtaatgatatgttactgggcaagtaaagctatgttgttaatttataatgaccaggatagaatgtaatataaatgggatgagcaaaggaaattcgttggttcactgctgcatcaaatctgaactctgagttttctccttatatccatcctttaatgctcagctcaaaatagatctctaagaaacgttctctattgtttccctattacaaagtatattttccttctttaacatactgtatcccttcttatctttaccacctatatgtttctgtttttacccctggctttatattcctaagtattattgcatctttgtatctattctaactgcattaaaagttcccagagttttggagccatagtctgaagttggttaagccccagtgacaaagtttactagcatctttctcattacttacatttgtataatgctttatgtatttcagaaaattttcacatttgatattgtctatggcataacaaaatgccttaaaccaagtaagaattctatacatcactcatcaatgatggtttctcttgggttgtctttgtgtaataagatgctttttagaaacaatgggagctgtaaagtatttcgaatggtatttcaattctagcagtgtctaatgtctcaacgtctcctttctttttcaacaaagcctccattttactgctttccagggtcacacttgattatccattcagagcctcagtggcattttcacagatcatacactatatgatatgtgggacaataaaataaaatagtgaaataagagtgattatctcaaggtctccttacttaatcagtgttctttttttcaagcttaagggaatggctcaaagagtgaaaaatatagtcaacatgtgaaaaatttttgtttgcttctttacagtctacaagcttattaaatcattactgcaatatattctccagccaaatattggtatccataagttatatgaaaggaataattgcatatcatgcagcaggaagaagaaaatgcattgattatgggatttaagaagaaatactgctctgtaactatctgtacaattggtacaataggttgtgttttgctttaaactggacagttgtgctgtgatatcaatatttcttctcttggagtagcttagtacaaccagcggcaaacagtctcctcaattacttcaatgtgtcattcaaatatcatcattttggcgggcattctgatgtgtaaaagtttggaacgcatggatagcattaacagcatagggattcctcctcctcctggttacagagcatgtgtatcagttttgtgccttagagatacagcattatggaataggaatttcaggtgggaatttcataatcaaaggttatgattatggggtgagagaaatgaaggaggaggtaaatagaggaaaggtcagattcaaacccagatgcattgtgatatacaaaaagcataggctgtttttcagtgtcgaaataaaaatcgctgaggatggtgctggtcaggggatacaggccctccaggtgatgaagtttatgggatttgtgggaactggagagaagaaaatctacgcaggagaaatgggaggggaggagtggtggccatcaggaaattgagtgtagccagctggtctgaagaaagagtttactcaaagaaataacaaacaatgcatttggggatttaagctctgagcatgtagaaggcaaggctcagtcttactttagttcgaccccggtgacaggcatgggacctggaacatggtggagctcagtttattaagtgaggtagcaaaaaacagttgaaaaaactcggcaggattagggagactgagctttatctttttaagtctttgaaaagtcccagagaggttttggagtagaatataatttttcctgaaatactcattgcaatagaaataaatagcaatatcaaaaatacaaacagaaactatctttttgtataacattttaaactttacaagatgcttctataatcactatttattatcctcacttggagatacagcataactattaactaaccactgaactatttattgctaataaagtagacagtatagctaagcaagtttcaaaacaaattattttgggtgacacatatcacttgaataaaatactatataatattctaataatgatttttaaaaggtcctttttattcccatccatcattaaatttgtcataatcacatcccagattataaacaatgtaaattaatatggtaaccctcatatatatgtagagatctgagacaaaaattgtgatttttttacagaaatgcatgttggcttttccacagctactcaaaataaataaataaataaataaaaatagaaataaaaataaaaataaaaaaagataaatccaaaaacaacaacaaaaaaaacggaattaatcagacctcaaatttagaatagtaatctccaaaaaggctactgctagcataattttcaaggctaatccaaaaggagaacacaacatgaaccagtaattccaacacataatttttgttatagacaaaataaattttaggagtagttttatacatgtatagtccatattgtcacactgtattcaattatttttaatcctagctgcatatatttatctagggaaaatatgaatcttaagagcgttgcactatgtatctaatgaataaatacaggtcttttctcactctgctatattcctaaagattagttcaaggtgaaaaagcatcatacatgttccaaaagtttgccataaaatcagtaagaagctgttcacatttatatattaacaaagtaatcatttatcattaaaaaaaaactagtgaaaacttaacaagtgctcttccatatatttaatgctatttatttttattattttgctgagatataggtatggctttctgtttttattgtaacgtaaacaatattaagtataactttcttttaaaaaataattttagatttacagaagagctgcagtgttagtacagacagttaccatgtatgttcttcacccagtttgtcctaatgctaatctgttacattaccataggatagttattaaaagaaactaacatggattcaatattattcaccaaattacagactttatgtggacttcaccagtttttccatgaatcttcttattctgtacctggatccaatttaggatcgtacctcacatttagttgtcctgtctccctaattcccttggtgggagcactaaggaaacactgactcttttaaagagtatagatcagttattttgtagaatgtgctgctgtttaggtttgtctgatattttctcattattagattgaggttatgcatttatttaaagaatattccagaagcagtaagtccttctcagagcatgatgtctggaggtaaatgatattgcttggtgatctttgatcacttggtttagttggtgtccgctgtgttactccactgtaaaagttactatgtatcactttagagttaataaataccattggaaagacactttaagattatgtaaatatcttttctcttcttaaatttttacccactaattttagcatgtatctgtggagcttatctgctttaatggtatcttttttgtaattcaaaatgtgtaacttacataaatctttaaaaacatgacttctacaaagcttgtatctatttattttcttcttctggtttcctgacaatgcaaacaaatgttagagaatttatcttgagaacaacatttcccaagttgctatagaaaccaagtaatgaagaaaagactaataacttttctattctatatagtatataagaaatttaaaaaattattttagtgtttaatctgtttggctattttcacagaaaatacattttttttctgtgttgatagctaaaattcagattttccagtagctgaatatggcaaaattatatgatataattttatatacttcttgatttattttatattatcaatatcatgttcaaatcatttttctgataattataagtgatacatatacattacaccaaatttatttaatattcatccagtcagataaatcaatttttgcttattgcatgcactttttataactaaatatatactattgataggaaatggttggagtgtaatttgtagtataagaaagcatgctggccttgaggaaaagcttttttgtatttaaatgtaatgacacattttaagtacaacagtaaagaattaattattgaagtagagatttgtaaattcagcagtaaattttaaccatcaatatatattttgctattttgttaagctaacataatttaagcttctagtaagtatataatagttgtaactgcacataaaactttagagaacaatggaaattttccatcagtgtttatgatagggacaaacccaaaaagaaaatagaatgagcttattacgatttaaaattacctttctgtatcttctattgtcattacattttatttgatctttattagttttcaacttttaaataaactttttaaatattcaacttggtacctaacctaatgtaaaaactacatgtaaaaatcaatgagaacaaatttatggtgacccataatatttaacgattgctaaattgattctgaaaatatgtaaccataatttgctataataccattaatctctgttgactatttacagcatttcataggaacttaaataatttgattttttacacagcaattcaaaattttcttactggcttcttcattatgtatcatcagctttcagctataccaatgttaaaaaaaaaaagccacaaatcacagttagtccagggaaaatttcttgtgaattgtttttgtttgttttttaaagtggagtgtaattgctaaagttagtctaaaaccatgatttcattcaaatgtggctatgctttattctacagagaaaacttgccttggtcataaaatttatgtggtcaagaggtaacacatgcttgatgagcttgatttgcaattttaagttgtggttaaatccctagggaagcacagaattctttatagaggtcttagaacaacaaggctggaaatagtgttacaatcatccactctgatgttatggtcctccacccccatttcagttttcttatgagtaaaatgtgagtatcaatattttgcttagcaaggtttaaaaaaaagaggctaaatgaagacaaaatgatgttcagttgaatttcccagctctgttatagataaaatattatacacattttatgatacttaaagaaaactgattattttgaaatttattaaatatattttaaatggcaacattcagtgaaacttttccatgaggtccctgcaatgggagatctcttatgaaacattagttattaaatcaaacatgcttttgtgtgcaccactatgcatttataattcaaacatatctttacatttgcaaaacactatattgagatcacatctaatgttattcaaccatcattttgttctagcttactaaactggaaaataaactgtttacttaactggtatttatttaacctgaacatatctgcatatattacaaagcagacaataacagtgggcaatgtgatatttgaaaggagtggagaaaatgaagacggtggcaataattaaaactaaaagtagtttagagaagatgccagctctcagatttgcttatttatctctaaggatatatgtgtaaaaatgtatttctattttagcccaaaaattatctagcacaattttaattacaatttattatgtgagaaattatgatgcctttgatactatttaaaaagacatgtttagatctaattattttttctaccaatactagcaaaaagtgcttatttgctaaattatatatgtatttgaatgaaaataatatgaagccagagtcattaaagttataatttacagcaatgcctacagtacagtatttaaattgcttaattttttcctttcaggtagaaacaaatgtaaaaacccaatgattcccccattctatgcagaatacaagagaaaggtaatcttcagtactgctcataaaagatgtttacatttagcagtgtaggaatcatggctgggtgtgcaagattattaggatgcttcagggtggttgctttattttgttttattttgcaggaaattatgtaaccagcaaacagacagaaaaagtaatttgttgggaatatactagcatatgaaaaaaaggacccattcactaattcatccatctatctagccattcagcactgattaaacactttttatttatcagggtctattttacttagtaggaaaacaatgacatgtaagacatagactaccatcttcaaaagcttccaactacaccatggaatactatgcagccataaaaaaggatgacttcatgtcctttgcagggacacggatgaagctggaaaccatcattctcatcaaactcatcacccgcctgtcagggggtggggtgctgggggaggcatagcataatgagaaatacctaatgtaggtaactggttgatgggtgcagcaaaccaccatggcacgtgtatacctatgtaacaaacctgcacattctgcacatgtaccccagaacttaaagtataataaaaaaaaggaaagtaactcattaaaataatgtgtaataacagccttaggaaaagtgtttacaaggtatcatggcatttacagaagagtatggaactcttggtgatattgcctggaagggtaaagttagaatgaaagaaaagtcattctcgttagataacagagcctaaataagggcataagaaacataagttaaaaacaaactaacaaacaaaaactccaagtagtctggacatcagaagcatggaacagaagtggagcacggacagtagaggaaagcacaaccaatgactcaggcaggcagaaaccaaatcaaggaggccttctctccattcattcttaggccgtggagacctgggagtgatttttagacaggaatagcataatctcattggaagcttacagtattaagtatggaaaatagaaaggaagcaaataggaaacagagaggtgagttgagaggctactgcgatagttcaggtggaaaatggtatgtctaaaacagtagtagtgacatagagaagacgggtgacacctgagagtgtttgggagtagaaagggcagaactttgtgatcacttacacatggagatgagacagtggtaaaagttgaaaatgactcccaggtttttagcttgggtgaataatggtgtagtcaacacagggtgaaaataaaggaagaagaatatgttttggagcaaagataataagtttaattttaaatacatttaatttgaaatgaaaatagactagctatggaagaactaaatgaaaatagcccagtgatatggtttggatgtgtgtcccctccaaatctcaccttgaaatgtgacccctcaatgtaggagatggggcctagtgggaggtgcttgggtcatgagggcagatgatccctcagaaatggcttggtgttgttctctgtggcttaaaaagagcccgacacctcttccctctcgctcctgctctcaccatgtggcacactggctccccctgccttctgccatgagaaaaacctttctgaggcctcaccagaagccaagcagatgctggcatcatgcttcctgtacagcctgctgaagtgtgagccaaataaatctctttactttataaattacccagtctcaggtattgacttacagcaagacagaagagactaagaagcccagaaattctacagactataaatgctatttgtgaatcaatagattttaaattaattggcgatactgcttgcgtctaacgtgctcctcaagtattttgggctgctagtcaataatagaaacatagacagatttcgagaatgacttaattcattgtgttagactacaactgcttggaaagcatagtttaaattcatgctgtatcaggaaatcaactagacttggcttgctgtataaataagcagcacaattaggaagaaagaagcatttgcatttggccagtggagtgatgataaactagaagattccttttgggacaacagtgaaatatgttaaatcaagctattccaatgcaatgtaaacaaacaatatatatcatctcagaaattcaattaaaccatgaatcatcttgtcattaccgttactccagtttactgttaacatggcataaatgtattttaagctgttaaacaggggcatgctattctttgaggaatctgaattttatgaactgtcacaagagcaataataaagatggagagtatcagctaagaatatccataattaacaaatcaatatgttctagttatctgcagtgtggttagctccatcaagagcaagataaaggatcaagaatgagaataaagagtgaattaagcagcttaagatccagtcaaaaagacaaaatattcattaataataaaaaaatcagagtcaagtcctgttgcaatttgactcatgtaaaagttgaactcatgttcaaacgtaacctccaaagttgtaggtgggcctagtggtaggtgtttgggtcatgggggtggatccttcacgaataacttggtgccctcccagagctaatgattttacaggatatcttgttttttaaaagagtctgggacctcacccttctctctcttgctccctctctcaccatgtgacatgctgactcctcattcaccttctgtcatgattgtaagcttcctgaggcctcactagaagcagatgctggcaccatgcttgtataacctatagaaccacgagcaaaataaacctcttttatttataaataacccacccttaggtattcctttatagcaatgcaaacagactaacacaagtcccgaagaagaaggttagatagattagaagacagattagtggttaagaggataggttttagcgtagaatgtctgggattgattttcatttctcctccatactagctatgtgaaattgggatgactacttattctcttggaggctcaattttcttgtctgtacaatgtaatatttgtgtccacttaactagttgttatgaaaatataaaacgataatacatacaaactgcttcaggcagcaccatgcatatgctaaccattcagtaaatgttagctctaatgataacagtaattggtattattattataaaaatcaagaaccaaatcatcagaatatatataagcactaaagagttccaaagaaaggaaaggtcaattggtcctgagctctttgttgaggcttgaaaagccagataagctttctgaagtaaagagaaaataagctattttaagtctctgttacaattcattcattcattcagcattcattcatttattttaaaattacacataaaacattgattaatcatttgatggcaggtgctcaaggccatgaaggtggtaagtgtgaataaaataaaggtttgtttttgagaacagtgagatataaagtatatgggcattcacagataacagggcagagggtagatctaccattgttctcatcctactccttctttgctgccaagtaagtatgaactatataagccacaaaggggcatgacagcttgtgcatatccttcagtctttactcttttgaaacattattgttaaaaatctctgcctttagaaatagtaaattataggcaaagaaaaacacggagagcagccaatttgggacattcccaaagtgttttttgttctagctctgtgaagagtctctggtcagattttaatgagttttcaatggccaacataattgatattctcttccagaatttaactttggcatgtctgtgtgcaggctattgaaagactctgggataagtcagtggtattttaacgtgaggatacaaatttcttaagttggctttcctatttcttgacactgtctaagaaactctactgtatttcaatctcttttgccaactagagggatatttttgttagcactcagtttaaaaagcctaccattttgactaaatttactggcctaattcagttacacagctaatcaatttagttaattcagttggtttgtggacctttcattgaattaattgattttttttttacctcaactggctgagagactagactggacttctgggaatgtattctctaagcacatataaaagacaattgttttgtgttaaaccctagtatgtaggccatgacaattttcattaaagaagtccagatataaaacaaaattgtaaatggatattccctttctcaggtcagtatttggaaaagcaggtttcccacccctccatttccaaacccattcctacttcttcgtgcatgtggagagaaccacaagaggcatattagtgcttcctgcagtacaaatcaccacctacttttaaacgacatctcagaaattattttaaagtatgacaaatagaaacatgtattctagaaatcatatttctaaatattaaattttccttcattaaaaaaattctatcatcttagcattcaaaatatattttttaaaaaatatcaattgggtaagggtctgagatattacaagaataattttcttccatcctcccaatagttagtgacatttatttagaacattccactttcttttctgcccaatgcgtctgattttatcaagtcaccattctaaactaagcactgcatctggtgttttgtttggtaagacagatttgtggggcaagttcaccaacacattatgatcaagcattgtttagattaatataacacgaatacacaaggctgtattacaatttaaattttatttcacatgcaaaaaacttcccctttacagaatttagattaatcccatggtttgttattgactatctttagaaagaatcctattattccaaatgacaactttgtaaaaatgcagtgcagctataatggaaagtacaaaagttatattaagataactcctttctgagtacgtgtatattcattttacatgtttcaactagaatcaactcttacaagtctgccttcagccatctgtatcactgaccagcattggaaaaacctcattttcaatttctcggcaccgttgacatttggacctttaatgactcattaaccctttacagcctccttctccagatcttttcaatcacatatgatcatgtcgccaaactgagatatttttgactgttcgttgctagtgcagataatattctctcctcttccattctcccagctcagtgccagactggactgtatatgtatgagatgaggatgataaatgggagaggagagagaaagccaggcaagaggtgggggagtagagcaagatgattgagcagagcaaattagaacccataagttatattttactggttttagaccctaaagagatagagcttagaatgactcaaaagggaatttatgagactatggactgcacagtgaagcattagaaattctagggacagatgtacggtcagagttgggaaggaaggaattgtctacttgttacaaggtgcagtgccactctagagaccacagattggtagctcttggggcatgtacaggcacatgcttaacatggatcgggctacattgagattttcttcttggaagaagaagatgttactgtcagaagagtatgtggaaaagtagattcccaaggagaagattagtaatggggtagatactaaacaatgagatagataccaagtagggactccaggtgatgggataggttttgagcatggggagacatccctctggaaggattcttggagtatgggacaaaggctgaggtcctcccttattttgatgggcacaatcaagccagcagacaaacaggctactcagaatcaaagaagaacaccaagaagtaatgttgtctgtctttagcaaggagcaaggaagagagcataggcaaagaaaaatatctgaaaatgttttagctctcccagaatcaagattttagtgtggtttcattgcttccaaaaattacaaactttccaaacacactagagtaaagctcacacaccacatattaaaatcaatgagagatgatctgtgattactcactattgacatggatcattgatgacagtaagaccctgcaaaataaattcccttactggacttacaaaaacctcacaaaaatataaaagtaaataaaattatctttattctattaataaagaaaatgtatatgaagaaaatgcactttacaaagtataagtaatttgccctgaatgacatggttactgttagaaccatgacttggattcttaaaggtttaatatcctgtcctatatgctatgctacctctaaacatcacctcaagaattcagtagaggccaggtgcagtggctcacacctgtaatcccagcactttgggaggccaagatgggcagatcacttgagcccaggagttccagaccagcctgggaaacatggcaaaacctcgtctctacaaaaatacaaaaattagctgggcatagtggtgtgcgcctgtagtcctagcttggtgggggttggggtggggggatgtgctaaggtgggaggattgtttgagcctaggaggttgagcctgcagtgagctgtgattgcacctctgcactctagcctgggcaacagagcaaagaccctgtctcaaaaattgaatttaggaaaaacaacattacatctattactttttttaaatatacagatcactcactgaatatataattataatatatctgatgcctgtatgaattaacctaagtaaaaaataacactgtttcttctgaatttattttgatttttctttgaatcgaatttattacccaagccactctcaagcatcctacagagacctatgaaggatgagttcttatgtgacttagctttaaaattaaaaaagaaaaaagattttaaaatagcaagcaagcttttgcttttcttaagaagtcaagaaaatggactatagatataggtaaaatacagttaaagagcaacattgttataatgttgatacaaagtcaaacatatgaataaaaaaaatgtcaatcaactggatcctttcaaatatctccccaaacacctggaagatgacaaattttttagattgataacctttataatgtaaccaagaatattacacagcctttgtgagatagaaattgttttaatataggatagaaatgagcagatatcacaatggtttgccacaagtaaacgaatttccttctttggataactttaagtaaagctaagttcaagtgaaaaaaaaaaaagctaagcatgcagtggaaaaaaaggataatctgtttggattcaaggttatgctattcaattctcaaatcactgagcagcatttacagtaaaatgacactctcatttatctcccaggcaagcattgagacctgccttaagatgcaggaggttagtagacttcatagcacttaattttctaacactacaataataatagttaacttagtaaaaaaaaaattctgtgtcttcacataaagtgaatcaaaatatatctttgcatcactgcctactgtaacctcaaggaacttattcatctaccaacagccaagacattaaaaaacagagaagttggtctctcaggatagataccctattcacttaaggtggggcagataatgcacagactctaatgttggatctgtacactattggccccaccttaggtgaattaaaccaacaacatcaacagggaaaaatgtgcaaaaactgtgttgttctcactttatcagtctttccaatgtttaagaagcacagattatttgctcagaagactagaccaactggaaattgaatgatcttgatctcttttaagaaaaaaccatttgatctaaatcttcaaataaacaaaataatttgcaatctgtgtcttatgcttctattttgggagtcagaccaggcatgagctgagtagcccattctgtcttggaggacaggagcaaaagggactgaaatataaagtcacatgtgggcattaaagaacatcctggagtcccaggccatataaaagggcttgtaattagtattttagtaaatactaatgagaatgcatgtatcaacccacattagtaaatattaatctgaagtaatattctaggactatttattaattactttcaactcttcccccaaggtctagtaacccacaaaaagcttgaggaagaaaggaaatagaagctttgctttgttgaactatttgatactaataaatatactgggcagccatgccatttttataactaatcaaagcaagtggtttgatgttaaatcaataatgtttatacaaatttgacttattagatacagtgatagttacctcatggctggaaatcagcatagtaattaaaattgtgttctgatatttattagttctatgatctttggcatggcacttatctttctaagcctcatgctgtctcatctataaaacagaaactgataacaaaatccacctatcaaggattctgaggctcaaatgagatggtacagaaaacataaatgtgcctggcacagggtgacagccaataaatggcagctgttggccattaaagacaaggcccattaatttgtaagttagtgcctactacaaagagcatagattagaattcacacctggattaattaattttcatcttctatgtcctaaaactcattcctccttgcaaactgggtgagactatgtagatgccccagcaaattacccagacggaagatgatgagcaagtagcatctctttacttaaaaagaatcatattttctttccaagaaaatcttcataaaccttagcccatttacataaccaagccatctctcaattggtcttgtttgagtttactatcccatgtcttcttacttttttaaaagaggtaagaataggctttgaacacagaatctggtaatagtctcaaaattatggtgctaaatttccttggcttatcaacattaaataagggaaaggaaaatctactaggagcatcgtgacttggttgacacacatatgagcacgaaaggtagggtaatatttttaactatatttagcgatgttatagcttggggtcagttcagaagcagaaagggtaaaaacaaagcgagtaatggtgacatgcaatattgtcctcattatcagaagataaaaccatcatactctaatgggctgatacagattgcaatttttagtagctgatatttccaagggcctagcaagacagagtgcaacagtacgtgtcacattctaaagtctaggagggaaaccaaagtgatctcagtaacataggaaaaattttaaagatatagcttatatatacattctttagtggactcaatagctgtattaattatgagacatggggggaattatctcaatacagccttgcacataacacatttgtatgcaagttttacacatacatctatacctatatatgcatataggtctatacacaaatattctgtaactacacatatacttgttcattaatcaaccattgagggcctacaaagtacagtgagtgaaaatatatagaggaagcaacactgagctgctgtggacacagaccatacttatcttgaaggtctctatcctgcaatcctaacttcccagagcagactactaatatattacaaagtaatctactttgtaatctgttagttttattgctgacggtattttaattttctgctatttggcatgacgaaccacagaggatcagaggcaaactgttgctctcgcatggaagtggctcctatatgaagacacagtgatgatgacaagaagcaattgctctcttaataagggagaaggatttaaaatattagttacaggccaggcgcagtggcttaagcctgtaattccagcactttgggaggccgaggtgggcggatcacgaggtcaggagatcgagaccatcctggctaacacggtcaaaccccgtctctactaaaaatacaaaaaattagccgggcacagtggcgggctcctgtagtcctagctactcaggaggctgagacaggataatggtgtgaacccgggaggcagactgtgcagtgaaccaagatcaagccactgcactccagcctgggtgacagagcaagactccgtctcaaaaaaaaaaaaaaaatatatatatatatatatatgttataaatggtagatctaggaacttagaaagtacagtagtttagtgtgagggcaaacagctttacatacttcagctgccccaaaggactgactgtattacagcacagtacagtgactgatgttcacaatgatggctttgggttatcaaaaagaagttaactcacgttagcaagttcaatttaacaaggtacgatgtgtgtattattttcaaaatggtaaaaggagcaagaaaagttttcttgcataaaacagaaggcattagttatatggaatgctcacttctgtaaatacatcttccctaatggtatgagatagttagtatacatacccatccatccatctatgcatttcatctttggcaattttctgttcttttagttaagataggttaccgactactcctaccactgcaaatatcaccaaactacaatacagtatactaattactaaactagattaacactgatggctaactttattatttataattgtaatttcagatttcatatgaatgataaagaattctgtaaaattacattattaacatcttagagccaggtggctcatgcctgtaatcccagaagtttgggaggccaagtcagaggcaggtggattgcttgagtctaggagttccagacaagcctggacaacaagttgaaaccccgtcactacaaaaaaatacaaaaatagccgggcatggtggtgtatgcctgtagtcccagctactaggaggctaaggtgggaagatctcttgagtccaggaggtcaaaactgcagtaagctgtgatggtgtcactacactgcagcctgggtgacagagcaagatcctgtctcaaaaaatggaaaatacaataaatttaaaaaataaaatttgagaaaaattgaatgaagaaatatgtaataatgggtggtggtatctgtcttactgcaggtaagttgttcctcaactaactctttctgcctcgaaggtggccataaattgacacatactgataatcgctaagcaactgcatggattatttaatacccgtcaattgtagattatgacaaacataaagagatagtctttgccaaggtccccagtttagattgttaaggtaaaaccctgaaatcttactttccctttcaagtttcctatactttattttagataaagctaaattgacatgtttagttttcataaaattgtaagtttctttgcttacatattactaatacttgaagagtactgggaatatcatcctgtccttgttaacaaaagtgaacagaacatgaaccagagaatttgaacttggagatctagatgatagctacatcattaagaaataaaagtagtcaaatggaatattcagttgtttttcataatatgactttccaaacattattataaattcaattttggcttgtttctctcctaaagaggcatgagccagtttatatactaaaactacacatctcacttaaacaaaattattatttttattattatttcaattaactttctttcatcctaacttctaagatgctattttggttgttctctttgatccgcctgtttttcttttgctctgtaattgccatcacatagcaagatctagcccttagccttctacagtctctctaaaaattaagcatatcactaggtggatttaaagccaacacactcaggaatattcagtagttttgcatgtcactagtttcctgatctgaccttactgccatatcatctggatatcccacccttttcaaatgtaagacccaaattacaactattttttctcccacaaactagtttattgacatcaccattatctccattgctaaggcttgaaaacgagtcatctgtttctttccagtctttattttcatttggattcatcacttttttctttggaatctataatttctatccctttacctctcttctcaatatcctccaatgagtataggatcccttaagttcaggcacaaataacttcagcagtctctagtctcttctctcctcaaatccattttacaattaatttgtctaattttgtttcatcctgtcagtatcgtattgaaaatactaactgaataacttgtaccatgttcttattttgaacctaaaaggtgatgcatcatctttgcatcatcaaaccccaatgtctcatttgcacctggaaaatcatagcaaactggttttaatgtccctgtttccaatatcatcagagcctgcatacttgttgtagtttactttttttcctacactcaagtttaaccgcatcaaaaatatagatcttgcttctaaaggtaatcttgaaactagacaggctttctctaaagtataatttcaggggcttggagctacttacttcctctccctcctgaactgattctctttctgctgtctatggtgccacaactagaaatacatttctccaggtttaaagctgaaccctcataactttccaagtagccttctagcaaaaaacaaacaaagaaacaaacaaacaaaaaactagagttttcttttttttaatatatttaagttggcttttagaaactggatggcagagtgttttatttggcaaacatagtacatttttaaaaatgaagttattatccacatttacacgttaggtttcaaacaaaaacttagatttccagtttctcataaaaaacagttgacgttgcaaccagaaattgcagcaaattcctctcacactcctgagtctttctaaaaggggctactttggagggaaataataatattttagacagttgaaagggaactatgtcactagatacaagaccatgtcagcctctcttaggagaaaatcacctttcttgtttcaggccttctgcccatctgcaaaaacactactgcttgtcttctttaataaatggaagcaatttaaagaaaacaatctataaaatgctacataagaccacattaaaactacaagtaaaaattgacatccaacaaaaccctgctttcaaatacaatttcttagaaagaaccttgattctgctgtatccaccacatctcgagtctatctccagggaaagtacaatagcgttaaaggtaacgggtagagactgttgccaagtcaatgaagcaaagactttctctctagatgcatggaaatgcacggtgatgggttgattaggtcaaggcatcttttgtattatgcatgtaaatgggaattaatgtcctcagagtgccagtagctattttgttgaatttggtaaaaatgaaaccctgtgtttaagcttcaattctctaaagtttatgttgggaggaagatgcaaaactctttatacttccataattaggtattcctttgctgacttatcaattgcctcaacttaggactcaaagtgcttagcgtcaaattgaaagagaacacatcttttattagaattgcttttggtttgtttcctctgataacaaggtaatatctgcaaaccagtgaatattgacactatttacaaccaaattataggaaaaagtcagtagggtatttaaagatgggattagtaatacctcatttacctaggcatttcctgggaaggagcaattctggataactgaattttctctgtacctgaagcttatgcccatttaaacctaaatattagatagaaatcttcataaaatatattaactgctacattcctgtcttcctacatagatacttctaaacataatactatcttttttttctcctgatgattcaggggtcatctctgtgagcattcattactgtaccatgtggttatatatttctatgcatgctttatcatttttttctctcctccctcaacgtcaggctttcagctgtcactttggctgtcactgtgtctcttctcagcttcccctttgctgtttctaatctgtcgtgggctgggaaaccagataaccaagtttattaagaatgacatgctgaataaaagtcagtaagactcagagtgggcactaagaaataaaatgcatgactttaatgtgcagtttttgtgaaaactattttgaatatgcagaggctttttaaatttaattttagattgggcaaccgcgttagggttgaggttgttgtgagaatttgtagaatatgtccccattcagtttcaaagtatttctctgcaggagaccaaggcagttttgacaaacacgggcaagagaagctaagttttccctttggaagcagaggaatctggtagggaaacactcaaggacactcatgtgaggctttaggcaactgtggagatcaaactcttctctctgatcaccagatatcctcttcttcatatcgagatggagggcattgcctgaaagaacgaaaatttagcactaataggtaaaatgtatggattcctgttagaatctctcagaattttaccttctcctttatagtagaatgttggctaggtgagatagaggtaatctgggaagggaaaagtccagaagtcactgtttttcccatgtattaatctacccacttcacttccatctctttctggacaatgcacaaatcagaaccctaacccaacgtttcttttcctgagactaatgctgtccctgaggatagtctatggggtccccaagtgcttgtggcatcctgggcctccccatatcaatacatcaccaccacctgttgttaaaacataggctcatgtattcacttgcttttattcgaatgacttaatcttcatggcctagcaacaaatagaaccctccctacagagccctccttatataccttattattgcatactcactctttttatgtcctctctcagtgcttctctcagtgctcattttaaaagaatttcacctctctaaaacagagtggtgcaggactgggtgggtagaagaaattgatttgttttgcctgcccctgtagccacagaatccagttacagccaggtttttgctgcaatcagtaaggatttctcatgttctaacaaagatgaaagcaataggagatagcatccgttatcttctcagggactttcttttcagtatgacaatgggcattttttgttgttgtttttgtttaaagccaacttacatgctgtacagcaagggcctccatcttccaaacactctaaagagtaaaattagtctgaaatccagtagaagaatactgattataccatcagtccaaaatcttcagggccaccagaaagtgccatgggcttgcggctgctaatcacttagtttggtgctttctaacaaggtgttgtctttcaggttttttgttgcatcacactaagctatgcttgcttcctccgaacacatttaagtggattctttttccaatctggagacttataaaaataaatatacatacccctttactactaatagtagggttttctgcaattggatctaagttctgggagcatgagtcaggggaatcaatttattctattttaggatatgcattgagatccacctcaaaaccttttaaatcaagattcaattaaatttaatatatgtaagtttgttatattaaaaaaacaaattgaaacaaaatatcactggagagacacaagaaaactgtacagtcctgtggtccttattttatctcttctttcagaaatgttggaagccaaactaaaattacaggcttgaaaagaaaaccagttttagaattccatcgccctcaaagatttcaacaatcaaaacaaaaccagttttataattccatcaccctcaaagatttcaattatcaccactacaaatcaatataggtaatcacttgcatacaccaagacaattttactctaaatgccatgtctatatacataactggactccatcctttaaattctctgtataaaaagacccagctcaaagttacattctctttgaagctatctggatttcccagatagaagtctttggtctatatttttaatctaagtttagcatggttgcttggtcttgcactgtcatgtgttgtaccacatgatcactcaataagctttaggtagcaaaagagggagttctttccatctctgtgttctccaaaagtgtctagaagatagtccaatgtaggaaacaaattatatttaagactgtcatacactgctttgtctaaaaaaggagttattttgaaatgagaaaacaaaagctaacaacttccaactttataagcccatttgaggcttcccatcagcttgtttttttttgcttatttgtgtgtgtgtgtgtgtgtgtgtgtgtgtgtgtgtgtgtgtgtgtgtttgagacggagtctcgctcttgtcacccaggctgcagtgcaatggtgcgatctcggctcactgcaacctctgcctctggggctcaagcaattctcttacctcagccctgggagtaggtgggattacaggtgcccgccactatgcttggctaatttttgtatttttagtagagagaaagtttcatcatgttagcaaggctggtctagacctcttgacatcaggtgatccgcctgccttagcttgtattttgaataacaactctaaacagaatgccgtgatgtcaacatttcattttcacatcaaattttaattcaaacccaactttccaacctgtaaaatttgctggtaggctggccaataatatgtacataacctgaaatgcaaaatatgatgaaaagcatagtgttataaaatagaatattccagacattcataaatatggatttgatggcccatactatgaatgattcagcacgcagacctttgaaattgtgatagtcctctttatgtacagaatgaaaaccatccagaggcaacaaaatgtcgaattctctaatccatcatatcatgaagccatcacagccttgcacatgagatttggttggtgggaatagaaaaacatttgcaagtctctggatttctctggctctttactcagagatgtcacatgcatccatgggtttgagaataagtgtaattgaagtgaactgcaatgtgtctctaataagtggctttgagaacatatatttgtgtaggcatatagtacatatctgtactgaagcactcttatcctaagtgtcatcttgtagcacagacctgatcaaactccgggattcaaaatgataatttatttggtataaatgacacaagccaaagaagataaaatatgttaagtacttctcttgattttctcttctccaaacacacacagatattaaataaaccactcccctcccggttcttttcctttaaccatgagaatcactgacccactgtgctctcagtattatccatgtgaaatatctgccccctcatcgggtacaacagattaaatgatgattaagctgagtgttaaatttaggatgttgtttcacaaaacctccctaccttgtagtgacatttttttctaaagacattttcttgtaatactccaaaagttaatgactgaattttagatggaggcatgacgtgaatctcaaatgaccataatttctttataggcaaattatatacagagttttcaaagacgtgaagagagttatgcatcgttgattttataccctaagtgatgattagaagtaaaatttcttagcttaaaagtaaacagaaaaataaaggaggtatctgacatggggaaagaaaatctcaggaacatagaactgggcttgcatactgtatagtacttgaaaaaccgttaagtggaaatgtatgatctcagaatagtgtttttaggcttaactctctgcgataacaggttcagactgacctggtatctcataagacattttgatagcaattcaaataaatgagattttttaaacattgaagttaaagaaatttttaaaactcttcaaatgcttatttttttaggaaggataaaatggtcttattttcatctgtggaaacaatacacatgagcagctttattctgaaatgccattgcaaagatttgtaatgcttttctattgttttacgatcagagttgctgcttttgcagtgcagaacaatgctgcattatatagaatcggcagattgaaccaagaaaacaaaagggagcactgggcaaccatccgttccttttaggactcttgccctcgccacatatcaccagatctctttagttagtcagtcttcttgtggccataacaaccccgagggctgactcggggatgcttccatagaaaatctctcattcactttctctctctgaactaaaactgtagcccaacagctcccattccctattctaagatgaatactaagactcatctgtgaagtcctttcaaatatacacaatttagcttatacgtatatacattaaagccaactccatggtagttatattcatctgaaaatcctttagtttatatcctgcactgattcaggctgtcttggggagatacgtctgtgtgtgaaaacaaaaaaatggcaaatgaattgacttgaggttataaacaaagatccgattctatctaatccttgctaatttcccctccttcttttattttccaagtaagcctagttaacaaagaaattttacagaaaaaaaaatgccttggtaaatattatctgaataatcctctataagaaaagcaggctctatttcataaatggaataaaatgcctttgaatatgattagagattgcatcattatgtcatcctgttttgagcatcattccttttttattttctagtggtttctattttattgttactttgtgataacacactaacatgctatgtgttgtatgttagcagtaatattatgtgcttgtttttagattgttctggatttatcttttcaaggtcaaaacatttcagtctgcttaagaagctactctgtggagatttttttttcataacttctatttctttttaattcccagacatgtttaaaattctaatcagagtgtgaaagccacattcaaatatgatataacacagagaatcaaaatcaatcatctaccacaactttatccctattttatgatccatcaacaaaaagctatttttgtaatctcgttagatttgccagcaataatgacctaagattaaaaattggggagggcttttttttcattttctctttttccccttgggtagtatgattcactctgtgggtactgcacttaaacaagtattcacaccccctctgatctgttcttgtcagctttttcatgttagtacaacaggaaagcaccccatcaatcattgtttcttcatctatcagtcaaaatgttcattttgtgactattggtcctgcatcccaatctgtgacaatctatgagtgtatatttaatttaaaaagagcaatgtgggaagacacaacactttaagtgaagtttgtaaatgagaagagctaaattatcagttactgtgtcaatgttattgatgggtggactagaaaaatacctactggatgcaaagtcgagaaacttactgtaagccctaccccagtcccctaaacccattttgctgctgaatgctgacacttgaatagtttctgataggccaaggtttttcgtatcacaaggagaaagtagatttaaaaggcaaaaatccaaaggagagaatacaaaaggaaaaatatagatcctgtgggcagattttggtagagtaattaacagaaacagagtgcttaatgccaatatgctaaatactaaatgctaaccgaataactataggaggtagactgaggtgccaagattggagactggtgtggtaaaggccagctccacttgacagtaagagtcggatgttaaacaacttgccatagctgcctcctgacttcttggaggtgtttttttagaatataactgtggtcctttggtccactatacctagggacttttggacttcctcctgcctacaattgcgtgcaaaggtcaaataaactggcaaggaacaaaatgtgagaccacaaatgcaaaaatggcacaactgcactactgaaataaatacgttgaatcaatgaactctgatatttctgcattaaaatgcagcttgcaaccactaactgcaaaggaaaatatgaagggaaaataaagagatggtaactaggacctaatatctatattactaactcaacttcagaaagttggtatattttcaaaattgcagatatgtctgcaacctaaagtatacttcatagcatttaattaattaattaattttgaagtttattttagaggcagaatctcactctgttgtccaggctgaagtgcagtggtgcaaccgtagcttattgcagcctgaaactcctggcatcatgtcccccttttacctcagcctcctgagtatctggaactataggtatccactaccatggtcggctaattgtttttattttttgtagaaatagggtcttcctatgctgtccaggatggtctcaaactcccggcctcaagggattctcttgccttggcctgccaaagcactgggattataagtgtgagctaccacgtccagcccatagcattttattttgaggtttagggactaacgtgtgtatgatttagcaagtgatgtttaatggcattttaaaataatgggtaccaaatagaaacgtatgaattgttacttgaatataattaaactttgtaaattaatggattagactagaaagaaaagattccagaaatttgaggggaaaaggtaggttctagcactgtctcttacatttacatattctgtctgtttgggcatgttattttatctttttgcatcggtttccctcttaatgtatgggtgaatatataatagttggaattaaaccataaatcagtcaacttctaagctgtatactataaaaaacatttgatgtaaataataaaactccttggaatctgtccctctttgtgtctccataaccttctatatttgttagttgaaataattatttctaagtctgaggattgtccattcaaggttgaacactcaagaaaactgatttatctctgttcatctctacaaagtcagaatcgaagaagcatcatatcctttggttaaattcaaggtagggaaaagaaaatcaaaccaattctaccaaagaacaaatcaattgatttgattatgagtaggtggaggttacattctttatcttactgaatttgaggtaaaatcggttaatccttttatccccaatattcatatttaatccagaaaatgctctctggaacaaaagtaatcattacaaaataaaggctttattctacattttagcaatagtctttccttggcttataaaaaattaattgcggggtattctcttgattgggtactttagatcctggtgactgttctaactgatggggctgaaagacagttcccttatctcatagccaaatcacctccatgcaaattgatctgggagtgcctttagaataaacacagctggattctctgcagccatttatgggtccagtttcctaggcttaattttgatttataactactgaaattaaattagccatcttcactgcttaagggtggctttgatttcaccagtgcagtagggagactatttaccaacatattttatcagtaacatttcaacctgggtaagggggtggcggtggggggaaggcatcttatctttggtatttgtacttgagattccttcagaatattttaattgtattatttaccgacaaatgtgaggattagattgtcaaatcagactcacatgaattaaagatcttgcccagcatcaagctttgctaaataatttcaaggatataagctatcaagttcagataaggtgcatcatataacataaagtggtgtaccttatgtcatatgctccaggtagccctgcctcatagatcctgggttctattaactatgggtaatcccttagccagagacatcttgctagggacagagatatagtctcttattcatagtaagtaacattagtctatttccatttgacaaagagattagactaagtctttgctttcctctaggagcacaaattattgtacaaaacgagaaacaaaatttgagagattaaaatatgtgaaatatgttaatagttctaagaaggcttttatctagaacacggtaataaatgtcgacgtgctatagtaggaagagttgaagataaatggttagatatcgctttttatccatatgactttgtgcattagttttttgagcctcagttttactaatattccaaaggattagggaaataagcctaaccagagtgactctgatttttttttttttttttttgagatggagcttcgctctttcactcaggctggagtgcagtggcacaatcttggctcactgcaacctctgccctccagcttcaagcgattcttctgtctcagcctcccaagcagctgggattacaggcgcccaccaccatgcttggctaatttttgtatttttagcagagatggggtttcaccatgttgggcaggctggtcttgaactcctgacctcaggtgatccatccgcctcagcctccgaaagtgctaggattacaggcaagagccaccacacccagtcgactatggaaattttaaaagacagtacatatacgtgtgtgtgtgtgtgtgtgtgtgtgtgtgtgtgtgtgtatgtatacacatatgctatatacacacacacacacacgtatatcacagaactgaagaccataaaatgttctatacatatgaaaaaatgagaatttgaaatgtacataattcttcacacagatagctgacagtgttataaatctcctttcttataaataagaaaaacagtctcagaagtaagtaatattctgatggagagttagaaaagaaaacctgtcttacaactctttaaacatgcttctcctctaagctaaatcatagtttgctaaagaaggtcgtgataaggtagaagaaagacaagaaaagccaaggcaatggggtgaagcaggcggagaaaactgtttatgcctcttcttccaatgtctatttattttctttgtggttctgagcaactatttcttcttttatcttgcaactgtcaaagcagctctctgtagagaaaccagcaagcacacccattaaaaccaaagcatgaattttcgggtgaggatcagtgaggctctcttaagaatacctgaattttcacagagataaacatatttatttgatttaaatggtagaaagtgttaattactaagtttcatatactaccaggagtcatagagaagtcattttggagaccaagagtatattcctagaccatgtaatcacatcatttgagtagctgcttactgagtttattcacaatgaaagcctgatacataaattctttaaacagaaaccagtggcattgttaatttccacttttgtttccaaattgttgcttttgtctcattgagagcatattacttacttcaagcaccttaacaaacaaagctgggtcatacacaaacgtcctactgtaccagcaataagacaatatgaataccctgcaacctctcaacaaccagaagacaaagatgtatttggaaggggcagatgggaagtgaaaaagagaaataaaatatactttacagggaatattttgcacacgtaattctgagtgttatatttttagcttgtataaataaacttcattagtcttcattttgaatatacaggaaaagtttttttagaaaagactcattgtcacaagctgataaggtaagttaggacagtatatgattaatatgctacaatgatgtctaagagagaggatgctcattaaatttgtgtgtgacaaaagttggaaagagtgttaagaccttgaaatactggagcatctttcaaagtgaaacttgacaagttagagaaatggtcagatagagaaatggattttaatcagactgaaaggaaaattaatgtattggttttgtcagttgtaccttcatcttgaacgtaatgactgcctgttacttcctctgtggtttcatccgaacctaacgcgacactcccctgaaaggtctcctctctcccttccttgctcttctgtagcccatgcttcacttctcaactatggtgatgttttgaagatgtgaattagattacatcattcttttcttcaaatcctcaaataatatttagaatataattcaaatcctgggttgccatggtctacaaggcctcaaataaaataggttctgcccacatctttgtttcattttctttcttttctctgcctccaggttggcacttttgttcctttaactcttcaatttaccttggtgctttgtaccagctgttcccccaaagtagacagctctccatagctcttcacacggctgcacttcctgctactctcacttaaagtcactgccttgagccaatttcgttaatctggctctaaataacaacacaaccccatctacactacagttcatcctaataccagtctaattttcttcataacacctatcattatctgaaatcatcttagttgtttcactttagaatcctccttctctcatgagaaagtaaacattgtgcgggcagggtcatggtcttgtttgtcctgtacttcccacccgtacagcagtgctggcacttagtaggtgctcagtagatattcgttgacagtataagacagaagtcctcaaatgttgtccaaggacatttggtagtccctgagactttcgggagggccaagggccaaaatctttttcatcatctcacaaatatacaacggtgctgtctagaggccaaaggatatatgctatcacaaaagattgcctgcagaagtagttgtgagaatctagctctcttaagccaaacatcaaagagattgtcaataatgtaaaataagtcactcttctcacaaaattatcttagtgttggaatataattatttttcataaaagtacacaatttattttaacatgcaacatgcaatgtggtggctattttaaaatgaattaataaatatataaatgttttctcagtcaattctcaatagagtaaacactaatacatatacataacctatacaacaaacataaacttctcagaggttttcaatacatttaaaaagtaaaaagggatcttgaatccaaaaatgtgaaaaccactgaaacagaatctcatcaactagtctccattattccctagaaaacatccagtagaactttcttctccagttaaaattgccctcaaagaaggttttctctttcctgatatccatgcttttgctattcattgtttatgaaatgtctgtctgtttctctctttctcatttctccatgtttgaagtacactttaaagctgtccaaagtagtcttttccatgaaatttgactcatagctctaccacaaaaagttctctctatatatacctttagagcattaagaacctatactaccaattgacaatagtattgttaattatcttctcaaagtgcctgtaaatctctctaaaggcagaaacctctctaaagacagagactgtcagacagtcatggtgcagcctgtatgtaccatgcaggaaacacaaaatgatagcaggatctagcctccaacaaactcttttctcttaaaacctagtatgggatgataaagattaaatggaaacaaaagcattggttagctatccacccaaaaattaatattctggcaatattcacaccttataacttttgggattcaccacccaaggtagacagaatcctcaccaccaccagcaaagaagtccaaatcctaatttccagatcctgtgaatatgtccttaagacgtaattaatgttatagatctagaaacagaggaatgatccaggattatctgagtggatcaactcattgcatgagttcttcaaagcaggagctttgtttggagcaggagagaagtggcagaaggggaagtcagagacatctgaagcatgagagggacttcacttcccactgcttgaagacagaggaaggggcacctggaaagcatgaaatggaatgagggcagcctccaaccaaaatccaggccccctgctgacagccaacaaggaaactggaccttaggcccacaaccagaagggagtgaatttagtcaaaaaacccgaatggcttgaagcagacttagcctcagaacttccagaaaggaacatggccctgccaacaccttgcctttggcccaagcagaggacctaccctagacacatgatactcagacttctgacctacagaagtgtgaaataataaatgtagtctgttataagccattgttggctatttttacagcaaccataggaaagtaataaagcactcatggcatgttcaattccaatagcccttgcagcagacacacaaaaccaccaacttcctctaagctccaagtactgcactctgtccactcaccctgctgccttctttaacttacaaattatgcacacagtaggtatgtttgcataattaaaagataagtagaagaactaatagtctttaaaaaaaattgttcctttagttgttctgaatatatgtttgtcctttgataaaggactctttgcaaggtttccgtatgacactttattcttaaaatttttgagcagttaatttaaaagtgaatccaaatggatatccaaatctaaagtcatctaaactgttagtagtgtcaaatgagattgctccaccacaagctccatttggaaaagtaaccagcacctgacctacagctgagttccatgtaatttagttgtcaaagtgatggagcacaactcttccatttaatttctatgacatctgtatcaacttgactgtatcctttgctgggccaatggcaatttttctggacaagatatggtgtaaatggcagggccaaaacacaggagaaaaaaaatgtaggtgaaattttaaaaataagataaaagatcacatgtttcctaggcatccaaaatttaaaccatctatttgatgatattaaactcaaagttgctgtgaccttattgtattagtaataatagcaccaaggtaacaagtccttggaatctttctatagcatagactattaactaggctctaataaaataccctattttgttcccactgcatgtcacttttgtagggcatatcttggagttaagaaataaagattgaccatatttattgatttgctcattctctttagagaaaaatgtgaggataagttttttatttgatacctagaccaatagatttccaaagagctgggatcaagatttttttttttttttgagacgcccggctaatttttgtatttttagtagagacggggtttcaccgtgttagccaggatggtctcagtctcctgacctcgtgatctgcccgcctcggcctccgaaagtgctgggattacaggcgtgagcaactgcgcccggccagggatcaagatttttaaaatctcttaaattgtccgaagggtgcttcttccactacatcatagacagaaataaaatttagttctagttagacaccctgctctttgaaattaaaaaataactacattaaagtaggcctttccttccactgataaaatgttccaaagttatttatcacaccttgtctattacatttttgaacagataatatttctactatctaattttttaaagcataaaaatatacagagaaaagtttcaatctcatcatctctgtctcttatctgtccagttacctgcactcccacaaacccgtctaaaacaactattgtcattattattattatattgactcttccagagttgcttttggcatatacaaacagtattattattactgtattttatctcacacttttggtaacatactttacagacaattcttttcacagaaggctagcaagtcttacggccatttgacagattaaagcatcaaggctcaggaaaattaaaccttttgcctacatatatactgacacttgagagtcttgcatttttctgaatggtattctatttctatcataccttattacctctgttagcacatgattacctaccatcatttattattctctgtcagcgtcctgcatataaatccccatcacaagggactgaaaggatcttagaattcatttaatcttctactcattcagtatttgcatcacatggtaactcccattcctcttcaatgcttggatacctccagtaagttgtaagccctttaaggatgggagacattttctgctattgttttccctctgttataatttatcatctactcttttctctcttctatcaggataattataatggcataatcccttttatgtgacttcccagtcacagttagttttttactataagaataatttgtaaccagtccctcataggatctcagtgcttgtccattgttgctttttcgtatatttgataaatattcaatttagaataatcattggtaataacttctgtatctttacaaactaatgactgaaaataatcattataatgtaagactcctttaattgggtttccaaaaagattgtttcataggaaataagacctacaggtattcgaaggaaaaaataaaagcattacatggtcaggtaagtaggattattagatattcttagaaattcaccgtgtccattattatgtacaaagctcagagaagtggatataactttgtttaaaccagagttttctaaacatattttcacattgaactccttttccagataacatagatgagcatcctacaggccattttcatgaaccatactatggggaaaaacgttgcaaaagaccatttgtttttaaaaatgttgtaatgaaaaaaaaaaacaaaacaaaacctcatttgtattcagcatatgtaaaacacagaagagaaagcatatctgaaagaatgacaaatagctcagttctcttttccaagcttcacaaagctacatagttcatcttctcaatataactcaaagaagaacagagaaaattttctgtatgcacataaatgtattcatagcatttttttgaatttataatgccttggccgccacatctcagactgaagaattaaaaacaacagtatttcatacttttcttgatttttttaaacttctcttagccaaagaaatcatacattgctgtacttacattgtatgattatttgttattttagataactcctcagataaattcactaaattaaaacactgtatcgaatatgttttgcttttttgtctggacagtctttttattgcaacatataatgtaaaaagtaatatttattcattgtcactgttataattatttctctgattttaaaaacagtaacagacaagttttttttcccccaggattctccattatatctaactgaattcccctatcaggatgccctttttgttttgttctgcttccccctttataataggatataaacaagagacagaagttaaatctccagtgagagaaaagtaacacctaacgaacagacaaacaaacacaaaaactggtgacagtctcaacattctcaaatgttttgctcaagcactctattactgttagtattgctcatttcatttaattgtaaataaggtagattttgctgctaagcaaaatgatagaagctagatcttcctaaggacaaacagttataagaacatctgtacctgagggcaaaccaccagaaaaagcaagaaaaactcctaatagtgagacagaatgagggaaaggggagaaagactaaaatgtacctgccaagaaaatggcatatgtttaacagatccaggtaactcttttttgatgattgcagtaacagataaatgcagactgacctctgcaccaggtatttctagatatccagatggcactcaagggaagggagcaaccttagcttaaaagttttatttcagaaggtggtggagggttaagaagaaggaaaggtaaagatgtgtcaacatcatcttctacaaggcttgttcatatgttatagtccatttgagaaaggttcatttaaagtatgttttggtgatcaatggttgcccaaataggccctgcctcagtagagaaacccatggagtgccataaagggcatcaaggatagacccaacataaaagactacttacagtaatttaatagcaacttaattcagatcagagctgtgcaataatgaggaacggttaactatgaattgatgtttattgtatgttagaatttgagctaagaatttaacatggattatagattacccacttaattaatcctatagacaatcctgtgagattcattatactaactcattttccaggttagaaaattgaaacagactgaataagaaacttgcctaaagtcatatcgtttctacgtggtaaaggcaagattcatatccagagctgggcattttaagtttactgtagaataaaataaaataaaagcacaattcaaaatatattaaaatatatctaggggagccagctctgagtttaacttacatcacttctggtggattgaatggatttcagtggtcactcagctatattatatataagtaggaaattttctaggtatggaaatatataaactggatcagattctagaagacagctggtggccaatattatctttattattctctactgatagaatagtatgcatcctcttatatcaacagagaagaaagattataaaagattgatactaatccaaatatagtttttttaaattgtttccaagcttgtcctcttgctggttcacaattgggtcaagcacaatttttaaaaatatatattattcatctttaggcaaagtttccttacaattcttaaatcaaagggagtaggaagtttgcattacctaagaaaatagaaataaaagaaaaaatgaacatggaacagattactatttcaatatgctgcaggatatttgcaaaaatatttaaaagagagttacttttctaaagcattaatttagaagctaaaaatctgaaaattgaattgataaataatggtttcattttaagaaagatcttaaaatgttatatgagaaaattaggtcatatcactttttttttttaacattgttagtcttcaggatttttggcataatttatatgtgtaaatttatgtttttgtcttatattaatattttagggctctgtgtttcatttctttcattttactgctttccttgatctcattacttatgattaattagaatttttcaaaacctaacctggcacaaataaataccaatgaaagaaataagaaaatattggcccttctatcacaattaatgtagcatattaataatatataatattacaatttacaatagtttctaaatataaatttcctcatatttttctcacgaaaacctgtgagttaaataaggcaggaattattattgtcattttactgataaataaactgatctttcaagaagtaaaattacttgcctaaagttatgcagcttaataacttacgaataaaacatttgtttacaatatatacacagaaacacaaacacacacacacacacacacacacacacccatccccaggaactgccgatttctagcataaatctactgtaactcagaactgaattaataattatctagtttgctgataagttgacattttgacaaatgtgtctcagtataagaggaaaccatacaaagatgaatgtatttacaagtttatttgaatcataatacgaatgggcttaacttccaattctttattcaattggtccatattttatcaattttatttaaacaaataaatgggtacgattctattgctttcaatagataaaactgaatcagactgatggtatcaataattatgttaaacctatcaaagtatttgagggctttgtggtagaagttaaatgtgataatccacggaagcacttagcaagtgcctggtatacagtaagtgctccacaattatgtgagtaacatgctgctttataactaatcacaaagaagtgatctggcactatgaataagatatatcttgactttcataattttagattactggataatctcctgaccaatgcagttggattatttccaacctcccacatacaatgtttttcttgaataattcagtgggaaataaaggagataaatgaagtctcagaaaatcagttgcagcttcaacctcattttgacatttccttctaagtacttccatccacacaagtgaaatgctgttgctgcccccagagacaccgctgatgagcccatgcttgtcacctaattcaggaattgcccttatgttgattggcctatggcccatagtgcgaccacacataaaagatctgcacagacaggaatagtggtaataaacaaaaacaatcagaggctctcctacaaattctaattagagataaaggagtcagtaagtagtacaaagaaaagcacaaaaatcacatatggagaaaagaggcaaactgagtaaagttactcagcagtagactagtagaacagtgattcacaaactctgccatggatccccgtcaagcttccaagtgctaaacttcattctggtgtctactagacattgctatcatgaggttcttgttctctcttgagctcttaatcatgtagctattttacaaaaactatggttactgccttctttacatctttgtcaatccttcaaaagcatttccattatttaagtaatgtaagtgaactctcaacaaaacagtctactaactccagggtactttttgatacatatacctgctgggttatatagtcattgcctgttctgagtttgagaagacggttaagacaataatcacatcacgcatgagatacattctagtatattttatacaacaggttagcaaatacttctgttaatggcagggagactgttactttagtaaataacctgagcttattgataagggaaacttgatagcaattggagaattagaattagaattagaatctctaattctccaactggtaaatgactcctctaaatagtttattcaagatgaacattggctttacaagaaatcttcacagccaataaagtagacactagctgtggtttataaaagctgaaaacactattaaatatttcagttctctctgatagtgttatatttgactctacttagccaaacatgtcaatttcataagaaatctataaaatgttattgttaaatgggaatcttatcaatgaccggtgcatttttaatttcaatatgatagcagaaggcaaccaatataagtcatatgaaaagacatatttggattttttttttttttttgctacaaggcaagggtcatctgaaacatttcccatttcatattttgacaatttatccttcattgtttaacataaagccttctagttttccttgtttcataaaatttgaacaatcatgaggtggtagtagcccatttatctcatggtaaatttcaaatgaacttacacatggtttagatgggtttaaagtggcagctgtaatttttgttgggtatatgcagctgtctgtaatgattctggtcatacattttcattcaccttattgtctgaatattttctaaaggaaaataggtgtgtatgtatttgcttggcccaactttgatatgtcttgctggctttcatcacctttggaagaaattgcatttcccagtaagctgttccacagtggaatgataagtgatgaccatcctgtggattttcacagctgtacaaaagacattcaggtgcacttgtcttttgaatcagaacccagttagcccctcgcacatttacaaaattgcttttgggagagtcaaacctggatgacttccaagctagttaaaaataattctgaagaaaagtgcagtgctggttcttggcggtagaaatgtgagttatgttcagctgcagtagattcctttcaggcagttctgatacccatttcaacttccaaatttctggcagacgttatcttgtactttcagcttttttgtgataaacatattgaaaattcagtcaaacagctttttatcatttcaaaacttgagctcaaatttaatcctgctgccctgatgaagcctgggaagctgctagggcattttcattatatccagactggactgcagaactccttgccattcttcaggactctgacagcatcattcatttagaacaatgtgatcgatccagaagaagccagcagcaacaaactctgggtactcatacggaagagcatatcctatctagttgaaaaatgtttccgtcttcattcttagcctagagataaaatatcccatcatttggactttagatcctagaagatcttacagattttcctacagtatattaacagtgtttacatttaaatctcaatcgttagctacagatggataatctccaaccaacaatgttagagttgtctatcattaatacatttcctatttgtaaaaatgtggattgctaactgaacattttgtttcttataaagatttcaggtattatatagaagtaacctactaatctttgatatatgtaggaatagaatactcattagtgttttaggactaacctaagaaaattacgagttcctaagctggccaacactcaagattagaactgatataaatgaatctgaaagttaaagaacaatggagttgaaaaaagatttagaaattatctcatgtaacgattcctgatctaggttcttcaggcactcaaaaataaatggataagcaagtactagtggttcatgaactattttcaatacttataaaattatcatagaaactgtaactaaagagaatgcacaggttaactgaattgtcaattttagcagcatttgattggaattatatcacctctgtggcaaagcttggcatttcttcttattggccaattaactttctatgtaataagatttgttgttgctgctgggaacagggcttgagttttcactgctagagcctcgttagtaagataaaggacttaaagtacctggtaaaaggcaagctgcacagtttaagagaagtttcttgaccttgaattgttgtcctcaacaacaggcagggtacctaagttacacagagggaagacttattttcccataaaacagggtacccttacctaagacaacccaataaagtgtgatgggaaataggacctcacacaggaggagaaagcaaatctaaggtgtaaagtatcggtgggatctagtctgcttctctccattcctcattctagctgtgcatccttttcccactttttcttttcttgaaactactcatgtaaggagccagagcagggatccagggtgacagtgaagaaaccctaggctacagaagcctgaatcaagaccactgtgtgagcttccagccatagctcaatccaggcactcagatcaggaacaagcctgttggtgctttggccattggcattcactgaggagaacagggttctatgcagacatttgattgcctgctgatttctaacagggactgtcctctgttcatggctttccaagagccagcctttatgggagcctctcagaggtgacaaggtcagtatgggcccctcctcacagcactgatgcctcacagatggcatcagctcgtaccacaggcaaccacatgagcttacttgttgaggaatgagcttggtattggtggatggcacgtgatatttgcacacatttattcaacaaatacttattgaacacctgttatatgcttgctaggtactgagatgaaacccggaaccatacattgactctatctttatggggtttacattctagcaggaaaaatatattaagtgtacagttaccaaaaattaccaacaattatgataagtacagtgaaatagaaatacacagtgttatgagacattatagcaggaggatctaatctactctggagcatcagaaacggcttctcagaggaagtagcttgtgaagtttgacaagggtggccatataacctatcatccaaactgaatcacttcagagaaggtaccactttagaaagagggtgccattaacaagtacccacaggataacaggcaccaagaaggatttggttacctgagatatgacctgaaggaataaaatcaggaagaccaagaggaatctgaaaatacccgaaatctgcttctcatggctgggactgttgttttgaactgatcctggcagacttttggcccactgagtgaggactgttgttctatgcttaaggaatgaactattcattggttcaagtctaaaatgttagaactttggctcatattaaattacttgaccattcttagaaggaggccaacacttgacatatcagaacattcctctaagatcacaaggctatcaagaattcaattagaatgaaggtcctttattggcccagttccccagaaatgcattccagaagatatattttgagttgatacatgtaagactctactattactgctcaatgagtgagaaaagagatctagaggtatctgaattgttgactagaaagcatccaccagaacatgtgcaatgaataaacaagattttcctatataaagaaaggttgagagcagataaaattgttcgcttgcaactttacattgtgggtgaacagggagctttcaaaggagctgcagacttgtattaccactgaaggtaattcaactgtcgaccacacgccaggaaagaacctcttaaacagataataagtattcctgataactgccaaagggccttgatatttcagcaagctgcaaaagaaaataaatttaaaaactcacatcttactcaggtaatgcattaactccagatcactacagagaacatttcaattcccacttctataaatatacacctgttcttcatttgtgaggcacccctaacaacacacatacccacctctatgcacagagaggatcttataaacattattcttgctttccttgtacttgggtttgatttctctatttttcagcaagctattagatgtcattaatactccctataatttcaatagtttgttcttttggactaggttcaggcattgaagttaatgtcaaattgacattttttagcctaaacatacttttcccatctttgaataagttaagaataagcattaaaaagtgtcaaaaataaatgaactcgacatttagcttacatatagtaaaaaggtatatcaattatttgctggtaagtgagcacacagggcagagctgataaacatctaactttaagtttgcttctctgctttttttggcaaggaaagagaaaatctttatttgactacagttactttggttttcaacttttaaactagttttttgatatgccaaattcaacacatctttagaccttattaactacctttctgtttgcaactgtatctaacatgttaaattacaaccaggtgcagtaaaaccttaaaaaaatttacctctgtggcccccataatagaaaagaatatttactgactcttctgaacattggaataatgacaacaagcaaacagaattaatataaaatagaaacttctgtgtacttactggtcaagtcagcttaaaattaagctcttgcactcttaacccttaacccttaacaaccctgcgtagcaaacactagtctctactgcaaggctctatctaaaccagtggctgtcagttttggtaagtttaagcattggatggaatgtttattgaaaaaccacattcccaggacccacacccttaaggtctgaaacagccctcaggaatctgcactttcatctgtttaggtgactttgaaatgatagttcaggtactggactttttttttttttttttttttttgagacagagttttgctcttgttgtccaggctggagtgcaatggcacaatcttggctcactgcaacctccgcctcccaggttcaagtgattctcctgtctcagcctcctgagtagctgggattacaggcacatgttaccacacctgactaatttatgtatttttagtagagacaggttttcatcatattggtcagggtggtcttgaactcctgacctcagatgatccagtcacctcggcctcccaaagtgctgggattacaggcataagccaccgcacctgggctcaggtaatggactttgagtatcactgactgctatggttttaatatgtctccaaaactcatgcattagaaacttaaccccgaatgcaacagtgttgggaggtggggcatactgggaggtatttaggttatgaaggtggaactctcataaaggaattagtgcctctttataacgggcctctggaagtggtttctctcttttttgctcttctgccatgttgagtacataacattcatgcccttccactgccactgagtgaggcaagaagcccatcaccagacaccagacgccggcaccttgatcttggacgtgccagtccccagagctgtgagaaataattttctgttcatataaattacccagtttataatattttgtcacagcagcacaaaacagaccaggatcctgacctacattatttcaagtaggaaagataattgtattcttcttaatacttacatctagacacatgctaagtgctatatattatgttaaatcatttaatcttcacaaagatgccatttatgaaatattattgattacattttacagattcagagagtttaataaactgttcaacacattataaacatcaggttccaagtaagaggtgtcagttagattctaaagtcttccctttcctttccaatgctgtatctccgtatatcaaagcaacataattaattgctattttttaaaaaaaattgttcaagcacaaacttacattacaaaacctttcagattcttcagatttaataaataaaatcattcctttcaccaagctctcctgtatcagtgtaatagcagctcagactcttgcccagtggtcaacttctcagctaatcaaagatcttggtttaatgtaggccaaaccaggtcccctgtgtccttatatatccttttgcacttttcaggctttttagatacgttatctcattttattcttctaacggcactaatagatcacacaaaatagatgccatctttgtctgttaataccaaaaatcacaacagggttctcactttgctcctaattcagaagcatcatcatctcagccctttaactctcatatgcagaatttatttgagctgctcccctgccctgtgagcttggcagctttgtgtccctgtgtaacctcatgactgcagccttcatcccagggtgccaacctactcagccaaagatgacattaacagaggatctggctgaaatgccttgacattatttttctctgggaaaggtgtgtaattgcagaaaaactgctccccaattattcaaatttaaacattttatctgatggaaatgatatcatttacatattttgtttcccagtttaaaattgtggtttcatatcttttgtgcttgtatatctgagagttatattaaatttaaaatagctgagtgtattggctcactcctgtaatctcagcagtttgaaaggccaaggcaggaagatcacttgaggccaggattttgagaccagcctggtcaaaatgacaaaaccccatctctactaaaaatacaaaaaattattcaggcgtggtggcgcatgcctgtaatctcagctgcttgtgaggctgaagcactggaatgacttgaacctgggaagcagaggttgcagtgagccgagatagtacccctacactccagcctgagtgacagagtgagactctgtctcaaaaaaaaaaaagaaaaaaaaattacaatggctagccctggatccatttggtaacaatctcattctaatgtatatctttacacagggcaaattttaccagaagccttttaacgataacattttacgaattcaaaagagcctagatctggcaagtgcttggctggcagaagtgaaatgtatggtgtgttcaagaagcatcaattatggctgactgactggaccctgagttaaaagtcagcatggagagagaaaaaaataaatcatcctacgcctttcaaatacacattgtaatgtcccttctacttccacttgacaaatctataaggaaatataggttggggagcatgtgtatgtgtccaaatgtacttcgcaaacaaaaaaaaacagataaattattacatcattaattaacagtggtatttaccaaaacacataacatcttatgtcaatttaaagacctgttggtctattgaggagtagtttgtaactagctaagttcattgataagctaaaatcaaatgtcataggatcctggtcttctttgaaagattgcaatagaaatacaatgtgatgggatttttatatgtttattataacccagatgtacagtaaatcagagcattgctgaatttaaattataccatcacatcctcaacaacgatataaatattgaaggaacagagagataagcaagctatatgaccaatatctaacaataaataggtattaggcttttactttaaaaattaagggcaaattatttaaaatattagaaaaggtagcaagatacttgataaagaatagtgtgaactgacgtctgtcttccacatccctgcccattaccattcccagtagctaaatcaactttagtcaaggttaactaactcctttatatggccacacaggagtcccttggctatacaatttgcactttaatcctctggaagttgcaagaggccaaatgaaatcctcacattcagccagagggaggagagaagaaagccataattcagacctccctgtaatatattaagagaaatctgtcttttttttcagtgtcattgccttggaaggtaaccccttcttgaccctagcatttaaaagctaggttggtgcatgtccaacatcagggtcacagccatttttctgctactcagttcatcttggaactgaaagatagtttcttcccgccatcaatcattacccaaggtaagtgtcacagtatatgggtgcataaggtaaaaacagatgaatattaattggttcattttatagcaccaagtacaatgaacaaaaggcctggagctcagagttggaaactgaaagtttccaggaagaatcaaaatataccaaattctcaatagctatttccttatcttctgacgtgtgctaaattgtactaccaaatgtcaaatatgctgagtagccttggaaacaggctgcaattgtgaactgttagtctaccagagagtcaggatccctagctccatcaccagtatgagcaggataatgggcagatcattctgtttgctttcatctgttaaacataggtagtaacacctagtatatttacagcacagatacattagaataattcagtataaaaagtgtaaaatcagctggaaaaagttaaaagtgctatttaattataatgttatgatgacaaagaatgtgacccataacatccccaaagaaatttaggttaaatttaatatgtggactgtttactggtaaacatggtagaatcatgaataagccattattctatggaaaacaatgcaaaaatttatattaacttcttttactcaaagggtactctttctgtcatccactcaaatagtactgtctagccagaaatgagtttatttttaacactatacaggaaatagcacctcacatatatgtcagtttcagtcatgtggtcatgattaatagtcatcatctgataggcagggtggaatggtgatgtgaacatgggatttcgggttatccctggatccacatctgtattctggtgctttctagttgtgtgacattggggaaccttccactacttgaccttcagtttctattgcctgtgattgtaataaaaatgcttctcacagggttgctgtaaagattaaataagaaactggatgtaaaagtgatttgtaaactgtaaattgtttataaatattgttattatttctatatggatatagagggctcataaatatgccgtctatttctggaaatttaaataacttgtgtaagtttttgtctccaacctaatttcccagatatctttaaatacttctcacaatgaatttccattctactcactgaaagtgaagtcatcgtcccccatcttgtgcattcttgcctttttgcttagtttgcatgcaacactctctcttcctatatctacatgaaaaattcttgatgatcttctctatccatcctttaagtcccaactcaaatgccacttcctctctgaagccctcgctgattattagtttccatatattaatctccatatattgatctcttttctaatccttttgttgcttgaactctcaacgcacttctttttgctgccactcatttaccatttaccatatacacattctttttcacagttatcttttcaaacaaagtttatacatcttatctctaccattagaatacaaggtccttgagattaaagaacatgagttagacctttctagtcccaacaaatctagggaggtgtcttataagcagtagtaaatgtgtgtgatgactgatataaatgaagtaaatgaaaatgtaatgactaatataaaaattggcacaaacatctattccatgcaacaggaagatgttttcaaaaataatattacattccaaaatgattttccagtggcaatttgcatagtgtgccatttcagtgcacatgtttaacagaattagcagaagagagactgatataagacaacccattttaggatttagaaggctaccacagattaaaaactaaaccaatttctgttcacaggggagaaacatttaggaagccgcaatctacagtaactttgggaggaatctgtccattattgactaaattaaaacatgagtcattgaagaaaaagaataaactcaagcaactggctaagtaataatgaaaaataaaataataaaacttggctgaaaaaagataattacagtccacatttcaaataagaaattataaaataaaaacaaataaaacaaattaccttacataagcaagtgatccccatctgccagctcatttgctatgataatgagaacttgttgcattctagttacctaaattatcatatctacttccatctacatataaatatacatctcaatgtaatggaaaagaaatggtttattcaattactggatttccggagctaacaattgttacaatttagttaagtgtcagacaccatgctaggcatctttacaaacaatttatttttaatcctttcaatagtaatcttttgaactccttaactgcttatctcctttatcattaatttaacaataattcctataatattttatgatgtctcttctattagttgctagaactactattctgctctctttctgccatttgttcattcatttattcattatggctaaatacttatttattggctattacatgcaaagtaccatttttagctctaaacaaagagtagtggaaaaagtccattacccaatggagccttcatgttgttactcaattctgtgcactgtgtagtcaaactagattgttagtttcttggaagctatttatttaatttgatttctttgtatcctctggtgtctagtacagtaagtacttaattcaaattggcatgcaatacatatatgttacttcattttaacatgttttaaatattattggattaaatgacatttattcctctactttaaacattataataacactacatcaaattctaattatcaagggaggactcagaggaaagtctaataagccattattcatcacactacatgtacttcctggtaccccaaaagcttgtccccattgaaacacaattattaatgcagattgccaggttgggtttctgttctagttggaacaacatctgtgtttgtaatggccataatgtagctaactgtgaatttttaccatgattttcagtaacagaataaacattctcttgacatttctacacgacaagactatgaaggctatttttaaagtattttgataagatttggcatttgaaaatacgaactcaatttaatatgaaatggacgaatttcacttacaattatagttttaatctgagctgctataacaaaagtagctcaaactgggtgacttaaaccacaaacatttacttctcacagtacaggatgctgaagggtccaaggtcaaggtgccagcagatttcacatctggtgaaggcccacttccaggttcacaggtggcactctttttactgtgccattgcatggcagcagtgacaagggagacctctggggtctcttttgtaagagacccttttgtaaagggactcttttgtaagggaatcacattcatgagggtttcactctcatgatcgaatcacctactaaaggtctcacctgaatatacattgagggttaggatttccacaaatgaattgggaaggcggaataaacatttagtgcactacaacagtttatatgcccactgttctcttcacttttctcagccagacagaagctagggtaatatttttaattcctggtgtccataacgtcagcaattacccgatgttgttttcttcatcacgctttgaaaggcagcacagcataggttaaatgcatggtttttgagccatggtttcagataaaaaataggttcctctctttgggacttttatgagacttattttatacaaacacatataaacatgggtatgttgttatataaatcttgggcataagtgcatgagtatgggagcacaaaaaaaatttggcttagccacattaccgttaaagaaagttggatgtggatcgacacaaataacatgaaggctgggagctgggaagggaaggcatgtttgcagagtaaagaaagatgaagccattctgttctcaaaaatcaaacatgtaaactgtttacagttatatttaatcccccaaaacaacatagttattaatctgtatctgtttatatcacacataaagaaaccagaaacagaaagttttactaatgtactcaagttcatatgatgatttaattcaggatttgacaatgagtacaaagctagatggccaaccaaggacgctcactaattgcagtatgaggaaaataagagcccttctgcagagtttccagctcaaaagcttttaagagacaagccctttgtatgtgtataaagatgtgtgtttgcattcatgtgcctgcgtgtgtgtgaaataaaaatttcatacttgagagaactatggaaaatagcacagtaactcaacagagccattgacatttgatattcttccttccctcccttcctctctccctctcatcctccatctcttctcccttctttctttctttatcactaagctgattagataaaacagaccatttcaaacctctgctttaggatgcgttgcaaatatgttagtttgcatatataaaactaatatataaaagtaaatataaaaatatatttataaatatattcataaatacataatataaaagtaaatattaaaatcctacaacttccaccattgtgaatgcactaaaacacattcaaagaattaaaaatttggaggcttggaggtgtaagattagagacttgtaatctttatccttcaactatcacacatgtttgactatcatatttgagttgtcttcatccctcaactattattattttctgttcattaaacctcttaccataattccagtttaataatccatgcaatggtttgaatgtgggggaaaataatattgtttggtcagtatcatcagtatattcaagcaaaaaattaaaaaaaaaaacaagtatttctatttcaaaataaatatcttatttaaaataagtttcgttttccggctgggtgcggtggctcatggaacctgtaatcccagcactttgggaggccgaggcaagtggatcatgaggtcaggagttcgagaccagcctggccaacatagtgaaatcctgcctctactaaaaatacaaaaaattagccatgcatggtggcatacgcctgtaatcccagctacttgggaggctgaggcaggagaatcgcttgaaccggggaggcggaggttgcagtgagccaagatcacaccattgcactccagcccaggcgacagtgcaagactctgtctaaaaaaaacaaaaacaacaacaacaacaataacaacaatcatttttcattggatttattcttgattgggattattagcataaaagtatctgagaaattgcacataactcaatttctaggtctttatctctctcatcctgaaaggcttccttaggccaactttgcctacttaaatgctttccttatttcaagaccctgttcattcagtggctttcctgaagtctctctgtcatcccaaatacactgcttggagcaacagaaaaggtaaagctgagagagccatcaactatgcccacagtagccctcagacgtgtacaaatacacacagatacatgtttaaagaacaaattacaaaactggtcaatcattaaactcagggtaacacattttcagcctgcacaagatacctagatgtttggctcatgcctttgctgtagatctgtccagcaagtggtctgatttttggatcagaacatgcaatttctgtataactgacacacagatatatatattgtctttcaactttttttttttaaccacatcttgaaccttggaggagttacaatgggaaacttcattttcgaaactcccacaagtaaaatagtgcaaaattcatataaaaccagttacaacatgtctctttcagggtacctccctccctccaatgtaagctacaaatcagccacattaacaaaggtcgcgctgcatcttccagttaatttgaactctttccctatttgcttccatctgtgagcaaacaaaacatctccagtccttaaggggcgcctccccagcattagctgctacttttatgccatactgttggtatggtagctaggaaaaaaatgcagtgcctgaaacaggtatttgcattcctatctacatcaaagggctgaatttttctttcatgggacttagtgttttccagaacacaaaagatccatgcttagccacaatattacattttgcatttataaaccactcttcccagtttctctgagatctcctgcatgtccaaagacactcaagcacttcaccaaagagattctctgttcctgttatcaagtattttaatacaagataacaattacagtttagagaaatgctagaaaaatgcacggaaagctcccaggtgccacttaactctccttccttgctgcattccctctcccaccccatcactgaaacctgagccagccaattagatgaacagcttgtcactcctagatgcagtgcaatgtctgcatcttactgcagctgttaggactgacaattcaattccagtctgcaatcctacaacaaagactctctcgtctggttcctgggagtcagagattctccttgttcatctttgaacctcaaaaatatggatttatcctggagcactcagaaggcttaaatctgtataaatagatagaaacatggaaattgtgaccctagtttagccactagatgactcagctggagtggactcttcggcttccaaggacagctcacatagctgctctctcagaatataccttaaattcccaatcacagagcagggtgccctaagaaccattcaatttccctaggcctgtgaacagcagatttttgccttggcaggttggataatctacaacactctttcatatgtctgtcctgttataaaatcagctctagtttgtactgggctctagaaagcattagagctaagaacaggatcctgaagcatgtatttcagagataactaccctttactaacaacaaatatgtagcatacagattcctctgaggtgcagtaaccacttttgtatttatagttattaaaagaagggaaaacaagaaatcaagggccacctcatttctcatataatgtgttctcctttgtgcctgacagacagacgaggactacatgaagcatgaatcctcaggatacccagtcactaattttttaaagtggaatgagtcctaagtgtcaaggggttttaagtaaagtgaaaattaaagcagttaaaaggaagttatacttaccacttgctatttactggaccttgtggtatgttttttttcatacattattttattttacttcataaaacccaattaattttttcctcataaacatttgggatagatatttttactcatattttacaggtagagaaagttgatatacattaatatgggtgttagtatctgagagaggttaaacaacttcccgaaactagtgagtagcagagctgaaattaaaaacctcaactactacacaccagaattatttaacagagttgaattgtgatttttgcatttctcgggaaatgtcccttggtgaaaactctgagaagagaaaaatgtctgaatttcttctgcaggaggtctctaggctcccactgctctttaaaaatggtgatcataatataagggatatacgtccaatgaatctagtattccatagactctatcaatcttttgcccaatctttgctattcttcaaaattttctgaagctataatttgggcatctccctatcatttactgcattatttctaggctagatgttagtggcaaaataattaaaaaatatggaaccccaaaattgagggtcttcacagcaaaaggaggtgataaacatacaattccccataatacaattaattctgatatatcagcactatgagcagagtactaagagatcataaaggaagaagtaatagcaaattgaaaacaatctaaatcagcaataaaatattggtcaggttaattatgatatatccacacaatggaataccacatagccattaaaatcatattgcagcagaatatttaatgatttggggatacgtttcatatacattgtttagtagacaagcaggctgtaaaataaaagcaatataatttcatttaaaaatatattggaagagtgagaacactttagcaaatgttaataatggttatattaatataaaaaggttaccattattgcttctgctttttgcttttttatgttttgtatagtgaatatgcttttcttttgtaattagaaaaacattcaatacagtttaaaactcaaatcatgttaacaaagacttaacaacaacaaaaatcaatttgaaattctttcgaattggggaaagtaaaattcctaacacacttaagatttatttccacagatggcctcatgagctacaaatacctcactcataaatcgtcttgccttgaatttccactcagtgttctgatatcatgccagatgtgggatcttgccttggtccaactcctcctttgtaattttaaaggcctctcacacttgggatgctgagctagagtcattctcctgcttggtagcttttgagagtgaacagatcacttcgctgtgtattgtcattcagttagtagatgtttctggctgcttcttcaacccatacaatatacctttcctaccaagaaatgtgtgacttctattctctcagccttggtgtaaatccctgaaagtgttaaggagaaaaaaagagcaagaatcctccaagatctataattgcacaggccccaggaaagaagcataaagaaaacagtaactaaaaacaaatgcagaataagacctgaaatacaatatttgaccacagtctaaaagtaaaagcttagaaactggtcaaggatgtcatgtgtcttgtcggttttgaagaactattattcaaagctttccatttaattatggccaaaatgcccaggtctgtttttcttcaaaatccagtgttctgatgactagctacattacccatgcatcttgagatatgctactgggaaaagaggaagaacagtttaaattattgttatgtggaaagtcgggattattaacaaccaacgaatctaggaggaaagccaaaatctgtgaagaaggctttcaatgcctctgggccagctcatctgaattcaagaactggagaaagattttcacttataaagttacccagagggcctggggaagaggtgagtgtcttccagcagctgagcatagatcagtacctgagatcatttacaacctgcatggctgtggtcagaccctaatgcagcctgggctgcagacacaacgtggtcagggtaccaacaggagactcagtgaaaaaggagactgtttctggagaggcctctgaatgatcagctgcataccaaccactgtgttttcgggtttgtttgtgtgcgtgtgtgtgtttcctagtgtgcactgaaaaacatcctaatttatacatgctcatatatcaccagcttgttaattcaacactaaagcaaaaagatgacaggaatacaagttcttgcttcattttttctgttttctctctaatttgtttggtagatgaatggagcatgcacaacatttcagatgtttactcaaatacaagatccattgtgatgatctttattacttttgtaatactaaaacccacagttgtgcttaatcataagatcctctagggtgacactctctaaattaaactaccaagaatttatattttaagtcaagctgtctcctgggtcttaatagtatctgatccagaaaagaaaaaatgagtgttaatagcagggcatacagtactatataaggtgctttaatcatcctaatgaaggaaatgaagatgatgaaatattcctgggaaactttttcatatgcaatgaagcctgtgatgagaaggaacctttagaaatagttttattatttgggtaaatatttctagacttatattcccttattgatatactcaatatcagaaacttagatttattattagagatttttaatccatgattcaaaattgtaataattattttagttgtagctctttatataatgaaattaaactacctgatgcatattaatgaataaataaatgcacttagtcaatctgactagaaaaagatattaatcacgttgtatggctttatatggtaaaacattagctggctagctaaatattacatttttaacttggctgggagattatatataatatacaaaaaagaaaccaaaactatctagacagctaaagaagcaaacaatacacatgaacactattttaaaattgaggtaattaagaaaaaaagaatacatatgtgtgtgtgtgatgaggtattactcatccattcattcatttattaaaaaatatttattgggcaacctgcttgggtcccctttcatgccgtggaagctttcttcttttgctcttcacaataaatcttgctgctgctcactaaacaaaaaacaaacaaataaacaaaaaaactgttgaacacctgatacagggtaggcacgattctaggtggtaggattagaatagtgagcaaaaaagtcaaagtaactgcctttgtggagcttgcttcctgattatcaggttacgtaataattatccacacttggatttgcacattcagatttagattactgtaaatacaaagccaccatgtgtgtgaattagagtaatagaaagaaaatcagaaaatctggttttcaatattatctcgatgtgaccttggccttgtcatttaatctctgaaaaaccttttttttttaacctattaaatgtgttggttggtattatcaaaaataaagttctgtaattttgtgtttcctgatagaagaaaaatatgtttgggctcatgtttatagtgtttatatgtggaaagttttcaacaacttaaaaaaaaaaacccacaaaactctaattgcaatcaacagcaaactgagacaggtattgcagtacttaagtaaagtgatgggtagctcttggcaaagttcatgagaaaaatcaccacactgattacaggtattgtaaagggttgtcagaaacagcaagtaaattgcagagaaagagatccacaaatcctttccttaaaatcactactattatcacggtgttaactgggtaatttttccagcacaaggggcaaatgcatttttaaaaaacataatcagttaaatggtacacatagaaaatgcccttcttacaacagccaatctgaggttattctattaaataaaataagcaaaaacacaaaaataaaagcccacattacatataactacaaaagttatctgtttagaagatagactttattttttcagctttgtaaaacagacttaagaacagaatacagaaatctcagaaatcaagtctcatacagacctaagcaaacctcattaatattcaagataatatttgtaaaaataaactttgaattaatcatgtttgcattatctggtattttcattaaagaacaagagagcatggagttgactataaaatgaaatttgtttctagttgcttatgatttaaacaaaccagcgtcagattaaagagcttttactctcagtaccatagaagctttgtcttggggtgtcctgggcacagtttatgatctagagtcagtgtggatcatatttcccataaattacaatccatttgaggaaactgcttctttaacactgtgtcactgcttgtatacctagcgaggacctgttaatgtgattattctttgtactcttttactcgatcccttaacaacttttatttgtgctgtgattcatgttttcaaagtgctttgatttccattacgtggtttaatcctcaaacacttccttgaagtagataaggcagccatcaagttctctgagcctcagtttccttatttattatatggaaataatagtaataaccttagctgcgcgtggtggcgcccgcctgcaatcccagctacttggaggctgaggcacacataccttatcataaggtttttgtgaagattaaatgagataataatgataaggaggatgatagttacatttcttggtcatttgctatgtgctaaaaactattttaattgtgctacactgttaacttatttaattcttcattgtgaccctaaaaaacaggtgctattatttcctcattttatatttgagaaaactgagtcacagaaaggcaaaacaatttgcccaacgttacaaaaaagtgaccgatctagttaaataatgacagaagccacctagaattatattaacacttgaaataatattacttccctccattagtaaacacaatttcacatcaactaatgatttctacaagactccaatatagtcattttaaatccctaatggaaataagggtaacaaaaattattcagcatacattctatctattctaaataagttgctttgatcctgtacttaaagaaaaataaacaagtaactgaatcttaattcatcaatatcctatatatagtcataaatatcatttgttcaatttaaaagaaattagaatatggccagaaagagtcaggcaagaggactaaataaataagaagtattctaagtattttaaaatgccttttggagctcatggatttggaaggggttagaaaaagagagctgacatttgggaacctttataaaaaaaggtcttaaaaaaaatctatgaagcaagaattatcaagtatcttttaaaagatattgtttgtcaaaaacccttatacttaaagagatataattccttattggattatatttaattttttttccaaaagcaaaactgctacttatgaagtcatctgttaaacaatttatattttattctaagcaaaattccagttacaacatacatgctttgtgaagacacagtcaatgtgttaacactaaagtatcaatgcctaggctataattagtattcaataaatgcttcaattatgaaatatggaaacaagctcctgctagtctatcaacagttataaaatgcatcattacacacacacacacctacacatccttccgtatggctaaaaacaaattttaagttgtttttcttctgccaaaaactatcaaaaaatagatcatgatgatccccaaaagatcaatcactctttatattttaaaaatacatcttaaaaaaacctaacacctagatagtgattttcaagtacagggtacacatattgattaacataatgggaaaattaaagcatttataaagtgctctaaggactaatctactaagaagatttatgtttttaattaaacattttaccatggcaatatataagaagaagatcttggctccactgtcagacttaataaagctagcattgcatgaatcagaagaggagacaggggttttgaatagagaaaggtgggtagatgaggggaaagaatattgagttgggctgaaatcctcatcctgttaacaagtccctgaattactgtcagcgttattgttaagccacagggtatctctttacaaattagagaaaggttacactttatcaagacccattatttctatctgtggaaaactgtcacaacatacttattatggaaacagaatctgtatcattatttaactcccttaaacttaataatcaacagatcaacaatatccatgatgcaaatagcatactgttagatgtagtgacattgtgcactgtacaaacaagcatgcatgcctgattgtcatgtttgagacagagacttcttcatcttattatagacacttatatgactcataatgtccttctgctactaaaaaagagcctgaaaatttggcctacattgtttcagaaaactgagtcccagtcttctcagcatttccacttatcctaataagttaacttataataaggtaataatttgctttacctacttataagatagtctacttctgaggatgacaaaatttaaggactggctttctgagtttgaattgcacacaaagtattcaattgcttttccctacagatgcagaaaaccatcaaccatgtctatgtgtgtgtatgtgtatgtaaataaatttatggcttgttttcccttccatcttttcttgaaataatgttttgacattagtgtaccttaatacatcaatatgtttttggtttgattatgtttttcctgttactgaatgtcctttttggatatatgttagttcttagaaaggctggctatcacctagtgtctataacgttaagaaaatgcctgcctgttaaatatagagacataaagcaaaacaacagctgagcacttgcatcattgttctggagggcaacactgattacccactttagttctgactccaataatacaacttctatctattaactaaataagcagtattttatttaaatgaagactggtatgttttagaaaagtcatctcaggattatagagctagtgtatttaccaaattatccttttctctgacccaaagagtcttgagtgcatggtttatgacagtttgttgaacacactgtgctggaagtaattattatccattatttttagaagggtctaatatgctactgtgaaacctttttttcccctgcatcaaaagaataatattattttactactagtcatatattaaatttcaaaacttgataaagcattatgatccctctaaaatataatgatttataacttgttttcccctcaattttaagttgcattcttatattctatttcttttaatttctaataatcatattttcattgaaacgatctttgttttgattataaattctctaagaactggatgatctctataattgaattattatttccgaaattaggttgaatagctagagtttattctgtgtccctcaataaggtatacactttacaaagtttttctcatttgatccacagagcattttagtttgggtaaaataattatgctcattttgcagatgcaaagttaaaatctgcatagtaagttgtgcagtttcttaaaagatgagggaagtgtcacaatctgtagagctaggatgtgaacccaggaagcctaacttcagacctggggtcttagccacagtgcaagactatgctaaacggcttcagcaagggagcttttacgcatggtcttctgagggtagttgatatggcaattccaaatgatatgaaaaataatgaatcagtgctttccagctgtcctcaatgatttgctccacctgtcttcaggcctttcttttatccatcagcactcttcaccctctcagcacaaagaacagcctccctcggggactgggtagagttgctatctgacacccaaaattcacaccttgcttctttgcattctccctgacatctctattcatcagctcatctgtctgcttcagagtcacaattctcttcaggtttggtttcgaaagcgaggctcaaaatttctgttgttctctgaggctgtggatccctcacactcacaggatgcctcttttcgcatgacagagatgcctaagttcattatccacaggctgcttctgagtgagagagatttcatcctttctaaagaccttcttgactaaagtagttctctttacctttgtcatcttgcagccactctctcgacagatgaggcacccagcatgttctatttccatagcatttacatattattaatagaagcaggccagtatctaaaggatgacattgaagaagagttttttttcacattttaccacagggctctacaagaagatgatcttgccagtgttctcttgaaacaagtttcctttttctcaactcagagaaatgctttttatgtaacatttgtgaaagattcttatggtctactatttttttaaatttcctattgtcggcctgactggcactgtgaaatgacatcaatattgtcagattcaaccaagagtcattatagccacaataaaataccatgtctccagaaactatttatttaagtataaaaaggaatcaagcataactttaatgagatttctcagactgtgtgtctgcctgaaagaaatgtgttccctctgtccagtcaatgagaggatcagagctctttccagctttctctcattacctgcttgttgactagtgcagccttcaaaaagataaccaaagactccctacatctctcagatgctatgtaatttattgtgatgtaatgtattggtctataattatgtcttcattttttcgtccactttgactacaaaatcttcctttatctttcttgttttcttttttttttttttttttgagacggagtcttgctctgtcgcacaggctggagtgcagtggcgcgatctgggctaactgcaagctccgcctcccgggttcacgccattctcctgcctcagcctcccaagtagctgggactacaggcgcccgccaccacacccagctaatttttttgtatttttagtagagacagggtttcaccgcgttagccaggatggtctggatctcctgaccttgtcatccgcctgcctccgcctcccaaagtgctgggattacaggcgtgagccaccgcgcccggccttcccttatctttcttactgtgattgcatttactctgagacttttagctttatccttgactgtaactcaggcaaattactaattacaatcttctttaaacttctgatattgatttctggctttatttttctaatccatgctgtactctgatttaatagaaatttttaagaaacaccaatgaaattaaagtttggctattactttcacataatacatattattcttcttctataaaaacaaacataacaactcataaaaaatgacaagaaatggaaataaaacatagggatcaaactggaatgacttctaaaaatagctagagttactgatttactataaaaactaaacagaaagtttgcaagtcaaaaataagtttattctgattattcttttgtaagttcgctgttcgaaattttaaatgcacttatattcactaccacataccaggaaacatcttggtaaacagagatttttaaatcagagtcagaaaaaaatgttatccggcagatacagaaataaagtgagggatggagaggttgagttaccttattgagaccttggcaagaccaaaagcaccaatgatctagaatggtggctggtggttctcaaggtatagttaagggataatgtgcattagcatcaccataaatgtttattaaaactgcacaccctagaactcatctctgatctattgtgtcagactaagagtgaaacctggaaacctgcatttcaaagatacttcccaggtgactgtgcaacaaaattagagaatttttcatagctatcaatttatagataagcaatacagaattagaaagtgaaaataaagacgcaacccagtttgtacatttaaaattcttctcatccagttgcatgatttgcattaggcatgccttgttttcgtttggctgttgggataacgggcccagttatcttatatcttgtctatattctgttactgtcagagaaaaggcaaatttaagtcttatttgaaatgtgtgccttcatctgggtcataaaagttaggtgtgacctttaagtacttcatagagtcttaaaaatatgtcagtttcacatatatatgtacgtgaccaatgaacttaatatatatcacctttcaggctgaacataaaagcacatgtactttcttagtgtaaaatgaggtagaaaggtaaatattttaaaacataatttgttccccatatttttacatgcatgtgcctatacatatgaaaaaaattgtgtgttttcttcctagaataaagaaaaaaactaagtaaaaaggaaagaagtcatcaactgaatgaagggagagaaaataaattcctgggaatgtactgttcccaactcaatgttctcagccaacaattgagaatcataattactattaggataaaaatacttcaggccaggcctgaagttagtgatcagctgctaagaggaatagtagttatcaacatcatgagaataacagtagtaaccaagcaaagcaatgcggtctgtacttttcactgaatgaaacatcaggtatttagatcatgttttctttctataattttgcacttgttttcaattacagataattatgtacttacaatattgttttatatgttttatggaaggaaagaactcctcctagctttaaagtaaaatagagcaaaactgacttgaccccgattttcctttaaatccgtatctcaaagtattttaaatctgaagtaaagactacttgtgtcaatgcaacatatatttttgtagacctttgttccttgttgtccaccacttctatgtactatatccctctcacatctgcttttatatctatagcatccggcttgcttaagatccatgatatctcaaattaaactaagaaatagaggcagtgaagctgaatgtacaaaacagaaagtttgatcttagtagactttcttccagtacactgtgttctgttttgtgattcacacccaatgatttgtgtattgtaacaactagctcagattccaatgtggccaatactttcaaaccagacactattcctaaccaaaaatatggcaagtatcccaagaacagaattattaatgtaactgtcttgtcattcactgactgaaatatctaatgaggaaaaggcttctattaaatatactataaataagcatttaacatttggagctttaaatgacacaacagggaaacatttgtgtagactgaaatctatttttattgttgattgaatcagcagtttgtaaggctgccaggcaatggatcagtacacttatagaaaaattaaatttaattgtatttattcactgatgaatagaaaccaacccaagacaagtaaaaattgggaaatattttttttattgctcacatcatagcctgagccaaaactgtgttaaattatttaatttgtgtttctcttatattatagcaaatgggagaaaacaaaaaacaaccttcctaaggagtgctgcgtttgggatggcaaataagcattaagtgattaatgcccaatagtgaccaataaataatttagttatctctgcagactttctgttttcttgtaatattttgtttctttagatacataatacacttgcccttaataatgaaaaagtaaatacaaccataatttattatttttattgggctaccagaagtaactgttgtataaggacaccaatgtgggtggataattggcatgatcttccaaatttgcagattttagagaagattaatatttgataatacagtcttaataatggtcgaccattgaaaatgaggttaaaagcaatcaattttcaaaaagtttactcaatggtttataaagatatttctaagaaattgaacttaactagcaaagattatagttttaatctgtacgtaaaatgtattttttaaatcttctaactacctaaaaactctatttttttcacattcgtatattagcatgtatatgtgtgggaggtatagttctgagatgtttatgtttcatagttcatttgccttaactattagaagttattcttaaagtacttgaagccagaaggtctaaaccaggggtgattttgccccccaagggacatttgacaacatgtaaagacaattttggttgtcacaactaagggagggctattggcatccagtgagtagacgccaaggatactactaaccatcctataagacaaaggacaggcccctatgtcaaagaattctgaggccccacatgtctaccatgccaatcttcagaaaccccgtcctaaccttttaaatttgaccttattttcaagcaaatttcttagttcagaggaagcactcttttaaggtagcaacagaatggtgcatgctagtagtgcctctcttgcccagtgctgctggattggtactgaatttaaactagttaatgtgaatccaggaaaaacaagggcaggtcatcatttcaagataaaatgactaacatgaaactttaatagccctcagtgttgcaccgctttctttgtctttctatgacaataaacatcatatttatgattactttgtttttgttaggtgtgaagatagaattctaatgaaccatcaaatatcataaaaaggcagtgagaacaagcacctggctcaaaggtccactgcctgctcatataaggtcctaaattcactctggtagtctatataaaacaaatgagctgtagaaaaatgctttttctggcagtgtacctatgtaccttaaaacatttctcactaggaaaaaaaaaaaataaagcaaacatatacacataacccccccaaaacaacaaaaaaactctgtgttggctaaaatggcagacacattttaaagtatgcagagcatacatttcagtactaaattattgcaaataaataaatccagagaatgtaaaatgaaatatacaggacttcaacatatccaaatgtcaacgaacaacaagtagttgaaagaccagccttttaatatgcaccaagaccaattcttgggctacaatatacctgttcaaataaaacaaaatcaacttaatgtgaagcatgtgttgaaggtactctatccctttaactatctccacttggctgttagagtgaaatggtgttagactattctcattaacttttaaaagcttaaagaaaagccagaattttacacttctcagagctaataggcctttcgtttattgccaatcttaagtaaaaattcacaagtagaaagatgccaaaacatatttgtctctctggatacctttataatttttttttaatttcaccaaatcaatatttacatattttatattttaatttatacttttcatatgctaaaattatttttataatgcacttaatggcttacaaagattaacacaaatagcaaataaaaaataaatctaaaaatgtaatgaaacgtaccaagaacacaagaaaaagagaaaataagaacaatgagatggagacagaaagagaggcacacaatttacagtcctagagactcacttgtagaagccactgggaattttgaaaatgtcagattgtatctcaataaataactataaaatatgagctcagaatataccatatcccatatcctaagacactgcagtccctcattttggtaaaactattgtttgtcttttctttgccatgtcctgtctttaaaaataaatatcctattgtaatttaataactctctttatctcagctatgctacgtccctcaattagtcccatacccaaatggctcacaaacacacaacactcttttcttaggtccagatccacatattcacctacctatttgacatcttttgttatataacctcaagatatctccactgttattgatagctccctctgcttcattctataacctatacatctgccgtactgccaactttccatttttactaccttcatccaggtccaagacattatgatagcaactactgcaatagctttttaatgggctctcagacattcactccaaaatcccctaatctgtgaaagcaaatctggtcatattagctcttcataaaatattaaacagtttccctttgcaattttaaaataaaaacaaactctttaatatgaccaaaaagtattgacttggtcttgaaacaaaacaccatttcaatcacatttcaacccccctgcttcccgtatttcagctactatggaacttcatttccattctcccagctccattctaccataggacctttgaacatgctgtgtttcctctacataacatccttttttcctttacattaaacatcttgtcatctggttcaccccattcctctttctgaattcatcacaaatgtcatttctttagaaaagttttctcagatcccttcactaggcccaacctgcctaagggagtctcatagagctctgtggtcctccctcttcttcctgacatagatgcaattttgtgtgtgtttgtggaacgccctagtgagtgtctttacgcttcacaaggatagtgatatggcttggctgtgtccccacccaaatcttatcttgaattgcagctcccataattcccatctgttatagggcggacctggtgagagataattgaatcacgagggcggtttccaccatggaaactggttcttgtggtagtgaataagtctcacaagatctgatggttttataaggggagaaaccccttttgcttggttctcattctctcttgtctgctgccatgtaagacatgcctttcgccttctgccatgattgtgaggcctctccagacatgtggaactgttagtttgttaaactttttctttataaattacccagtcctgggtatgcctttatcaggagcgtgaaaacgaacaaatacagatatcaaagagggcagaaaccatgactttatttttgctcattactagaccctcaagtctaatgcccgttcttgacacttaatgcctgtccaacaaatacttgccaaatgaataaatggatattatagtggtatcttgaattaagaatgataaaagtcaaccaggcatggtggtgcatgcctgtaatcccagcactttgggaggctgaggtgggtgggtcacctgaggtaaggagtttgagaccaacctggccaacatgatgaaaccccatccctactaaaaatacaaaaaattagctgggcatggcagtgcgtgcctgtaatcccagctacttgggaggctgaggcagcctggacaacaagagcaaaactccatttcaaaaaaaaagataaataaaagttaactatttgagatgttggtgctaatttctgaaccagtgatatacactgtgtagaaaggcacataatggcataaaaggtcagtgtttgaaaattattaaaaggataacataatgccccaagaccaataataaattcttacatatagaactcttatggtactgtttatacacattgttttattactccagatactctatgggacagaggatattattctcctttttatcaagagaaaactgagcttaaaaaagttaagtaactttctcaaagtgttttaaaatgtaaatgatagagctgggatgtgaacccaggttgtagtcatttcaaagtccgtgacctctatgctgcatagcattagtagtgtctaaatttaggtgactatttgggggaggaggtcatgaattttttttaatgttaataatcttcattcatttaataattttggatgatcgccctctataacagagacttctacatttcatgtaaatataccagggtaaaactttgcaatttttaaaatcacagcattaactatacaatggggtcactcaatgaaaatcgtttatgaatatgaccgaagatttcattataaaaacacccaccaccagtagcccaaaaacattacaacaaggctcttgtgtggaaaaaaaagtatttctctttaagaaagacttttcttctttttttttaatcactggcacaaaaattttctcagaaaacactaaggaatatcaaccaatcaaagacacaaaggtttatcaaggaaggtttatggaaagcaaatgttctccaaatatgcaaatccaaaaaggaaggacaaggctgggtgaaccctgtctgcagatagcacagagtaactgagtaatcacagagtaattgtgactgtttcaagaactgtgtttcagatcatgttaacttgaggaacaataaataaatcttgctaattcagtgaaactgctggttttatgaagaacctattgtgggccaatattttataattcaatattagtgatacactgggcaaattttctcattaatgacactgcatcatcaaactgcataaatgctccactgaccctaactatttgctactgacctccacagtttgctggaagtagcagttgtgtatgtattccaaatttaaaaagcaaatttctatttcaaaggacagatctgtgactgcctttaaacaatacagactcatttaatatctaatttattcagaactgaaataatgtcacacaaaaagctctacttttgtttttcagtaacagtatggaagctgtgatttctgagcaataatagaagaatacttcagcctctcagccattacagtaagcagagaatgcaagagaatgcatgagttcttttgtggaaattggcagataatggcagcttttctgaaatctcccacttttttaaattggcaatccgataaaacctttaaatttggggagtgggaggaggaaatgtttcaataaccacatattaaaaataacttgctaaagaaaggccttgaggctctcggatatactaagaacaaacaatcaaatgtatcctgtacctgggaagacaaaagcctcacaatcacgatgttaaaaggcaagaaccttgggctccagaggttaaagggtagcatcctgatgccataattaggcaactggatgcatagcaagaagagttctggaggggcaattagaattgtcaccagatccatcctggatacatcactaagtgtctctaagccttagttttctgtctttggaacacttggtttggctcagtgctctattaggcctagcctggaattcaagattctaaactctcagcaggaattttacctacaaagaaatataaaactagactccacatttttgagtcctaattcagagacaatgttgataatttttatatcattgtatgtcacaaatctgtagatgtcaaaaattcttacaaatccttatgattatggattttctgacagtacagtagaaatcgaccaagggcactgggttcattgaggatattttattaatgagacttactttttgattaaaaagtatgtattaatattgatttcaacatacctccattatgcaatgtgactgaaaacagaaaatactagtcacaaagtgaaatgtaattctatttcttttaaatacttctgcacctatccatttaaaaatatttggatgaaccacaaaaaatgtctattatgcatcaattttttacctaagcaaacctgcaattttatacgttttaaactgaatgaacttgtttgtatgtgtgtataacatgaattaaaatgctaggtaattccaataatcaacaggatatcctgcattatcagaccttactaaataaaacaagcttttatcggctacttactctattgcattggtcttaactctattccataatggcacagtttaaatcaatgttttatttttatattatcattttcctaaatgcacatagcaggaggggaattttaacattgtcttcattattttataggaagtatcacagattatgtaagtatcttgtccaatggggataatatgaagataggctaaagtcttttggggcttaaaaacttagtacatcaaaaggaaatatgtggagttattcaggcatatgtcttttattgtcattgaaacataatagaatttggttacctttatggttattcaaatgctgaaaaaattatctgtgatttaaaaaaatcaactggcagcataagcactgtcatcagttgatgctgatttctctaagctccttagcctttatatcacttctactcgtacaagggatgctttgtatatttctcaggcaagtttctcattttattttgttttgtttttaaattctaagtagctttaaaaattgtgctattgttccatctattcttctttccaattttgttaggcatttagtgacagtgggctttggtggaaacttatccattgctcagaccagggacatgagtcttgattagccaagacattcctggtagaacccttctaatgcctgtgactggctcagaaaagggccaatgacactggaggaaaactgctggggaacttatgggaaaggttctcatttgaaacatacacccacccagcatcctagtttatctaaggatgcagttatatgaggatgcaatgaatgaaactactgcacccattttgtgatcacagtgcgacataactaagggcaaaagccaatatgctgaagatggcagagtgaagatgtccaggttctaaagaacctggagttgtcaaactacctgagctttggattttttgttgtgtgacctaataaactggtgtattttctccttaaagagaaagatcacatttctgtatgtgtgtttgactgtgtgaatatgtgtgcctgtgtacgtatataaaatggtcaataaaatgttaatgctgattttttaaatgagtttttttccagtatttctttactggcagaattaaagttggttataatctcccccactttttatgcatgttcctatatttagtgtaggagagttaaaaggacaaggaggaaggatgaggcaaaaagatggaataaaattttattttggaatcagaaattgattactaagaacagtgacttgaagcaattcacttttggagtatctgtcataatcaataactacccacagcttggttaatgaacgttatttttagttgaattactaacaaaggaaacaattagatatgatcaccaacattttcatgcattaatgccagtgcaaattaactcctaccactaaaattactccttctgtctgtcaaaatctgtgacggctatgacttactgcacgcagagcataattgtgtctccctgcctgcataaagctgacacataaaatcaatattaattaaaaaaagatcaaaattgtcctcattatcttatttggctgtctctccaaaatagggttaccatttatgacagaataaaacagagtctggacttaaatgattcctcctgccaaataataaatgatccttttattggttggatctattaataaatatctatttctctatggatgaagttatgcatagtgtaactttgaaaaaggacccaatgtctaactataaattcatctagactatctatgacactttgccatggatatatttttgttctacacatctgtattctctattctctcctctgcccaaatgctcctaatacaagaaaagaataatcatttatatcagaagttgaggatcactgtgccctgcagaatgtatataatttatttgacattttatcttttctattataatgaatacaattttaagttttattattattacacatttattttaatgaaaaatttgtgggttcctaaaatactgagagaaatatgtgagctcaggagatttctcatgttcatcaggaggttttgcaaatttgtgcctcagtttatgaggtttcatgatacttcttttcctttccactccattttcttcatgctggctttccacacagcaccttaatgaataaaatgacaattccagagaatgttaccatcactaggatgacttagtatggaaccctaaccctaatcatctcaaatcgattgacccccagaaacaaaaatcacagggttagtttcttctgttctttcctgctcccagtgatgccttacagacatctctgagaactgggagtctacatgatgtgagatattttcttattaccatcaaaactcattcaaacaatattcgctttaataagttggtgtttacttgccaacaaatatcaataactcacaaccacaaaaaataattaaaaaggaaaagaaaataaaagaaatataggtggtttatgaatattcaatcaatcactttaaaccacaggtaattttatcacttattttgtcccattttaacaatttatgctcaagatatagtaaaatgaagtaaagcttaaacctttgactaaatgtttcaaagagaaagaaatttaactttgagaattgcaatatttacatatatataaatgcaatatttacatatatatatatatactcttttttcttttctgcccttaaattgccacttatacatagagtacatcacttctgctatccaaatgatttggtttgctttacagaaacccaagtttggcactttgggaggccgaggcaggtggatcacaaagtcaggggctcaagaccatcaccctgtctctactaaaaataacaaaaattagcggggcatggtggcgggtgcctgtaattccagctacttgggaggctgaggcaggagaatcgtttgagcccgggaggcggaggttgcagtgagccaagatcacgccactacacttcagcctgggtgacagacggagactccgtctcaaaaaaaaaaaaaaaagaaaaaagaaacccaagtctatatgattataggcaaattatttaatttccatatctcaacgttctaattcatgaaataagcatcataatactactcacctaataggtcccttgagaggattgagtcctcaataaatggtaactgctactattaataaataataacatcggcagattctaacactcagtcatatagacaataacttcaggaaatattctccacaacattacttacttccacattttcacattaaaggtgaggaaaattgatttctgaagttcagtagatagacccaaaatcatcctccaattagctggtggcatagactgaacaagtgaagagacaatgttcaaggtcactagaacttgctgtagcacatgtgaaaattgtagcagaaataaaagtataagaaaagacagtggtttccaaaataacactgacattttcactatagagagatgacaacaaaattagaacatttaaatatttttaaaggatttgttttctcttctatgacaaaaatttgattttacttttgcattagtgaagcgatatgctttttgaacttgaggttaggtgggtccctacctcgtgtctttgttgctatcagtttgtacaactaaaatctaaatgcctcggtttccttctaggaattatgagctatgcacttaaaattcactgaaattttaaagtgggtatgctctactaacaaaattaataagaagatgttaattgagggtggcaaactaaatacaggaaactgctcagcatttttttgtcagaaaatatttcaaatgagacaattttgtgcctcaagagtttatgttagctgggaaatggagaagggaagttgggagaatatctgaagaaagggaacatttaatgaacattaaataataagacttaatgttaagcacttcccacatcaattttgttttccagaaatccaatgagaaaggtaatttgcagatgaaaagaaaatggaatgtcagttaatttgacaaatgtcaaagacatgtttaaaactttgaaacttatctaacagatttaaccatcacgtgatcttttaaaccctcactacagtcccatcttctccttttccttacttataaaacaaccctagatttccttttcagtgttaaatagtattctaccttgaaaagaagtaagacatgactactttatactgaatttattcaataaagaaagaatttgatcacacatttctgaataattactgctttgtgacaaaatgaaaattaatggaaacagaaagtttcctccttcatagaatcaccatttactcactagctttgaaactaattctagcccaagattgccctcaaaccaggtccaaacacaaactgtaatccttataaacaccataactatgcagggtggaattatcacccacactgagccttttctttcaagtgttatttctgatttcacatgtgttgagaacatttatatacaagacctgagctacacaattttaaatgttattacttgtaaaatataagctgtgtctttatagtcacatatctttataatgttacaagaaggaataataatataaacaccatcacagttaatttataataatttggtaaaaacaataatattttaataatgaagctaaggtaatatttgtaagcaaaggaaatccccaatgtggaacaaaaaagaatgaacagcaaagaggccatcaagacctcacaagtgctcatctccccagatataagtacttggtcaatatatgtaagaaaatattttctctctaatgataagaataaaaacattaattataacaagatataattaataatcagttactacttatcgagaatctattaaatctgaattattccattcatatttttaaagggcttgtatatatacatagtttttcatatgcgggtatatggacccatatacatataaatggtccttcatttattctattgaccttcggaaacttgttttccccattttatagatgatcaaattgaggtccaggctacttaagtgacttcactgaagcaaaatccaagtagagagatattacctgtttaattagttgacatgcactgagctttagattgtgaatatgtatattcataataataagattatggttacatgaaactgtaaaaaatgctgttcttttctagggaaataaacacatgtttagcacagaatgttaaaagtagcatggagtagtatgagataaaattaaacatttgctttcaaggttatggcaacaaatgaccacaaagagaaaaaatgataactgaatcataattttctgacaatctcttggtgtttctgtattcctcctttgtgcttcacatgctgccctctcagtgaaaagcaactataagcacatagtctccaactgagcatgcggctggaaggcatgcaccatcatggttaattaggcaggcttcagaattcagcaagtagggtgaatcttagctatatcacttcctagctaggcaaccttgggcaagcatttaatctctccaaatctctgttactcatctatacaataaagttgataatagtatctacatgaaatgactatagctagaattaaataaggccagggctatcacaatacttggtccatagtaagtgctcagtaaatcatgcttatttttatatttatatctgcccccccccaggactgaaaaaaaaccactttaactttttcctctagaggtattactgctaataagtgcctcccctcccctcccttcccttcctctcccttcccctcccctccccttccctccctttttctctttccattgagaaaaccaaatctaacatgaacatggcattttcctttctgtcttggtatagcctatcatttctggattcaccatatggttaatagatggtggtgagacatagtgtggtatattagttcattcccatgctgctgataaagacataagcaagactgggtaatttataaaggaaagaggtttaattgattcacagatcagcatgcctggggaggcctcagaaaacttacaatcatggtcgaaggggaagcaaacatgtccttcctcacatggcagcaggagacagaagaacgagaaccgattaaagggggaagccccttgtaaaatcatcagatctcatgagaacttactcaccatcatgagaatagcatgggggaactacccccatgattcaattacatcccactgggtccctttcatcacacgtggggattatgggaactacaattcaagatgaaatttgggtggggacatagctaaaccatatcaggtggaaattttaaaacagtaatcaagaagacagaacccttcctctcactgccaatgggacaactagcccagcctcttctgtgttcagatcatagcagcatctagcagtgacttgaagctagggaagctccatttcaatttctgagctaaaactttttctcctggcacccaaatttatatttctgaatcagttttgccgtagaaaaattgttatgcatggtggggaagttctaaagttgttgtacattattacctacctcaagaacattaaggattaaggaggcttccaagagctcactggtgtgaggggctggtgagcaagcgtactactgtatcaatgaaaagatgagggatgggcacaggggctcatgcctgtaatcctaaaactttgggagactcaggcaggaggactgcttgaggtcaggagtttgagaccagcctgggcaacataatgaaacctcatatctacaaaaaattttaaaaattggccaggcatagtggtgtctgcctgtggtcccagctacatggaagctgaggcagaaggatggcttaagcccaggagcttgaggctgcagtgagccatgattatgatactacactgcagcctgggcaacagagcaagaccctgtctcaaaacaacaacaacaacaacaacaacaacaacaacaacaaaaatgtggtctgattttcaagtacaattcacaaaggcacatttgaaacacaatccactcagagactgggggctgcttttccctttcttttcattggccactggccactagagggctgctgtgagtcatcccccttgtcagaggctcttaaggctcatagttctgaaattaggatgcatttcaagggcgggaccaaattctcctccacttctacagtatctgcagagtgtctagaaatgagaaggaccgtttcaagagctcataaatatcctgttgtggaagacagatgaatgctctgggttggaagcaaatttttttttaacacatacctagggaacttatgaacactctagttagcttcttcaatgtgtctgaagactgctcacactcctgttgacaagtaaagagggtgaactctaagaagtatatttaaatgcaaaaatgaacccagttcatgtgcttttcttgtactctctgtgttttagggtagattatcatgagtggtaaagaagatagagaccggcattagagggtggggcttagatacacactcatatacaacgggtcatttaggttgcacaaaaatcagaaagatggccacagatcagaagtggttttccactcaaaccactgacctctgggttgtctttctgaagaacttctttcctgttggttagagtttacttggtatgttcttgacccgtgagacaggaatgaggagatcagacaaatgggaggtcagaaaggaggaagagattattcccatgtggaatgaggtttcctaatttatagattcctctgtggatgtttggtggaaacaaacctctccccatttgcttaattttctcttgctcttcacacaacacagtcaaccatatgttagactcttgaaggttccatctctttccctggttttcttttaattctatttcctctcaccccaagccaatccagagggtggaattccaacttcgattcagacatcaaagccagtgtggccacacttgatctatctcatcttctttaatagacttaattcttctcaaggcaggtcaagattctattatctttggtaattttatctaattcattaatcaagaacaggattttctacatgagtaatatgagtaataataatatccatctatgtgctaatcttctaattattttacacatattacttcgtttcttctatgaacagcctatcaggaaaattgctggcaacattttagagatgaagatactgaagcacactgtggttgagcaacttgcccaaggctcgcaaccaggagaaggtgtatatgggatgtgatcaccaaaagtctgttttccatatcatcaacactgtcctagctgtggctaaacacctctacctctgctatgaccagcagtctctatttttgagctgcacctagcatgcaccagacatgataatgataatctcacaagcatcacttcccttagtattcaaaacaacatcatcagctgggtactgtccccacgtatagacgaagaaacagaggcttggcagagtttagtgcgatatcagaggtcacacctctagtaataacccaaccaagactgctgaatgtttctctgactgcaaaggctgtacttttacccagcaaatcatgttgctcctatagaaagactgcacccaaccgtccctggaaataccataggcctgttttagcacactgcgcagcactgataaggttaaatagaaactgtgattatgcatcactgcattgctaatatctctatgaataaaatgtcgatttgattttcatttaacctcaaaagaatctgattaccaaataaccattgaagaattattggcaattatgttctgtaattatggtgcctgttaatgtcattagcgtacagcctttcatatttagtactattaattaatccccataagcatagaaatttataatcaatataacaaaggctccatggtaaattataaatactcccgaaatccctccaacagtttacagggctccgtgggcttccttggttgggacacatttagtttgggggctgcaagaatctgtggtaattgatagcttttcacccggaatcggctatctcactaatgtgcctaattaggcaaatgcttaaaactggagtcccaactgccactgacaactataaattcctgtagggcaatcaaaataattaactgcttgagtcaagagacccacaaatcagatatacaacttttcaattctctgagcaatatactgcttcagataacaactactgtcagtgagtgtctggtttcggttttggaggagttgaatacagtaagtatgtctaatgttaaaagtccaaaaaagattcatgatagctctatctcacagatatgcaagataaacatgcatgctcacagtgatgctaggaatggatgctttgtaaagcactggtctaagaatatcatgtttttcaaaatctcccaatccatcctcagattttcttttacacattttctcaaactgaaacgtataagtctgttttatagaaaacctattttgtttttgtaattttaaacatctacattaatatacatcagattttttaaatggttacattcacatattttatctgaaacaactactgctataattgtctaaagatgcagcaagctgcctcagaagtggtacattctaataagatgtggcatgataatctattctgcattgttcagaattggactagttggtttctgaggccctgctctatgttagaatctaaaagtccgtgaatcccattcttttttcccacagagaaaagggattagaacttgctccctgttggcatcccacgccctttcctgattccattcttgttctggacaatttcccaggaattagtgcataaccctctacagctgctgggcctcagaaacaatttgggaggagaaaatagaggctcagaataaagaaaatatctattaaagcattattgcatcaaatataatggagaacatgttcatcttttaaaaattcaaaaggaagaatatgacacatttaggaggcatccaaaaatcacctttttcagataaataactgttagtggagaaataaaattaacttgcaatttggaagaattagtaggcagaattataatatttaagatctgaaaataacctcaaaggtcatttgaatccaatattccattttacaaatgagtaaggtgaaattcagaaagggtaaataacttatccaaggtcccaagtacattgatggctgaaatggaactggaaatggagatatcttaactaccccatcttccaccacccctaaactaaatggttaattaaatttaaaagcttattacagggtatgcttaaaggcacaacttcagattcgtggttttaaaataaaagattgtatcctaacatcgctgacaaccacagttagcatggattctcagtcttgtcaagatgcagaagtaagatatgcatagacattgggatgggagatcttatcaggtcctgtagttctattctacgagctttcagtaagttttatacaaactaaaacaataataataataatggatgataacgacaggagcctatactattttgaggctgaaacaactacatctcacataatttgtcacatagcattcagagccctcatctgacctgtagtcatttttttcatttctgttttggtggcttctatagctttttatttatttgtgtttgtatttttttgaattagttgtcagtagtcaaaaattaaaaaatgtcacagaaaacctgactacaattttcttacatgtagctcactagttgttaaaaagcagagaaataaaaaaggaagagaagagaaaagaagagaagaggaaagaaagaaaaccaaagaaagaacctaatgcaaatgatgagataatggatgcagcaaaccaacatgacacatgtatacatatgtaacaaacctgcatgttgtgcgcatgtaccctagagctgaaagtataataataataaaaaaagaaaaccaaagaattccttctgtgcttggctcagcagcgttggagttcctgactccactttaatgtttccttagtctagcaccaccaccaaagttcttatacaaatcattttaaccaccaccgaagtactgacacaagcattactagccgaagtggttgtagatttccttgaaattaaaaatatgtttcacctttgtagtttcaatgagaataagaaatgaatgtgcagaacgtcattcttaataactatgcttattataagaaaacataaagaatgcataatggagaatgcatatttcttcatgcatgatggttatgggaccagcccttctctgttttatttcctcttccttaataggtagctatgcaataagaacaaattttgaaaaaataagacaaaagaagatattctgatttaaaaggaggtggaggaagaggaggtagtgtcagtggcacaggtagtacctaaagtctacctgaagattctctccaggacatgggttacatgcataaattgggcctctgaaagccttaaactttatctagagatggcatataggctttggatttaacactttctgtgctctatttcatcacatttatagaactgttttcatagctttgaataagtatgagcttattacatgaatatttagtttattacatactactatatacagctgtgattgtgaacagatacacttctgctttttgttgaagataggactgagttagcaatgtctactgtattaaacagaaaaataattctctctggccacttccatattctcccagatcaggacctatacaaacactggggaaaacaaacttccaagtgatggcagcacaatcaagctgttttgtggaaggtataactgctttgcatggttataagcctgccagaaaacatgcaggaattcccaattcccagagcagaaacattgccagcatgtaactctggattccaccccatatgccatatttccagcccatcttcggtcagcacatagtctgtgctcctggggcgtgcaagactgtgaaaaggcctgcataactagctttcatgatgattcctgcattaaagagtaaaagcatctctgttcagctttcaaacagcctacttacccatggccaggaagaaggggaaattaatcatttaattaaattagtcattttccagactaaagataaacttggaatatgactcacttaagcaaaactttccacaggtgtcacttctccaggaagattaagagaagggcccaggtctcctattccagaaaactatttgagggttgaaacctcctccactgtgtatcacctagcacagtgcctagtgaacagtaagaatcaggaaagagttattggattgagtagctattgaattgaaatggaacccagtctgcccactctaaaacagtcactttgaacacagaatgtattaaggtgttatttcacgtgcaggctgttacaaatgttgactcaggctcaaacaaaccttttagcatttttacttttaatccaattgaatgattttacaaaatagggcaaggatataaattcaaataaattaacagtgggtaaaagagcatctagtcctcaaaaaaaaattctttggcctgcctatcatttatatttgtacaattattcctcttctctaaggttcacaacacttaggcttctgaagatggaaatacactgcacagggtattaacttctgccaatggaaataaaactgtaaatgatttggttttgtgattatttaacatataaacatgtgctcattgagaaaaatgatgtctggacaactgacattgtatttctgccaagtaccaagctaatgttcataaaattttactggagggaacccaatgctaactataggatttcaaactgctgatctggagagatgaatcgtgaagcaatctacgttgtatggctaatcagaattcccatccttacccatgctctgaaaagaacctaaaatttctatttggaggcaacttcagaaagctttcattaatttaaattttaaagcagatttcttcccattatgtgtattcaactgaaagcctatttaacacaacaccatgataaaagtgaaaaaaaaaaaaatgtcaggtttttccaaggcatccattttactttattccagaatccagaggcattgaaaatccagggctttctgcatttcttaggatgttttgaaaactaaaaagaactggtgataatttggtgatttcccgttctctgcaatttattttaaacatgtgaaatgaatgactctatgttccttaaagctgcccccaaattaagcaatgtaatagttgataattagatgcatttaattctaatttaatagccatctttatttggcatgctctttatataaatactactcaactgaatcctattaacacttacatggtttattacatttcatctgaggaaaaatgtacatattctaaaagctgcattatttaatcttggtgttaatttactggtatgcttaatgagtttacaggtttagtattatttaaactttgtgaaatatatgtaacttttctttattttacctttaatatttggagaaaaaaaggttctattagggttttcaatatggttataattgtagaatgaaaataagataaaattaaaattaaaaagcagaagtggtacagttctcataattttctacatgcactggagaggaacaggttttcaggaaatctcaaatgggaagtagatgtgttgagcatgttgaactaggaaggctcctagcaaaaacaaatgagatgctgtactgcctctccattacggccaacacagaaggagaaaagaaaatggcatcgtcatggcagtctacaaataactaatcactcccatgcacggttgattttcagtatggagtctggcaggaaaacctcagggactctgtcacccacttgcaggccagcttcacatgacacagtattattattagcagcaatattttgaccatttctagttatcttttctcttcttatctctcccctgaagttgatacaagaaaagattatctgaaaataaagaaaataaataccagaaaaggtttaagtaggaaaaactgcatgtttttaggaaatattctgagtgattagataggggaataaaaagtatgaaacgattatatcatgttctatgtagcctgacaaggtaatccctaagtgagagaattttttactgctgcaaatttgtgtgtgtaaagtgtgactgacaagccacaaacataaattggtaaaaccaaaaggaagtcatttagcagctcattattttacaattttctacatttcaataaattcatcatgacgatttttttttgggggggggcggaattcccaatggcattaatgtactagtttaatagaacaataaaataatattgcaggaaaacatatggctctgccaaaaatattaaactaatataccataaaaggaaaatgaataggtgattcattcactatccatttacaattatttaaattataaaaatgaaagcagcctcttcattttaaaagacaaaagaaaagtcatttagtagtttagtaatcaaacctatgtgagagatcagttatctggttagatattgatctcacttataaatgattttatattacactatgctcctagttcatgatacatatacacacatcctcttattatttattgaacataaatttatatcaaactggctttaagactcttgtaaatttgtgggagctccagttttactaaggcaaagtgagatgcagaatcaactccattttttccaaacaattgattccttatcttctaaaatgccacaattttcattatgccatacaaaatattacggaatgtaaattatcagtaaaatttccttagttatctatttcactgtgaaatatgaacacagcctgtattaataaccatgaattcaaagagaaaatgctttaaatatatatcaggctagcttaatctaagcatattgtttgctgtggttctttttcagaactgaatatcaagctacagtccactctgccgaaagcttccagctttccaaaaactgaaaaccttcgccagtaaatcacaactgttttaccatatgcctctctgttctgccaagcattaccagcttgttctacttttaagcaaatttcattatattatagctcagagcaatgctcattaaaaagtattactgaaaaatgtcaagttgtttttatatagaaactagaatttattttctactgaaaagtcagatatttattgaacacaagacatttttaaaacatagctttcatttcacaagttggttcaacttaatgattatctgaagtactttgggtcttgcaccagttaatgttcactagtatctcccattgatgtagattaaccattgcctttctagaatcaacttagactcagattagtggaaaattctcggtttcttcacctatattcatattctcattgatctgcctattctcctggctccccgccagagccttcttgagaactgctccactggacatactttaggggactgtaaacttcattatagcctattcattatagtataaatacagttcaaagaacactagcttagaaatctcaaccccaccgcttctaattgtgtgattctcaattaagtcagtaacctctcagagtcttcatttccttatttgtaaaatggaatgaaaacagcctgctctgctttttgaacctaattattgtgagcaaaaaagtcagcaatgcatgttccaacattatgtatcccatttaccatatgccaaacacaaaaccagaaagcttcattttaaagcaccaagctccttcccaaggaacagtttttccttctcttcagatagtaaaactcactggccataagagcctgtgatccacaaaagacaggatagatttttattacctgctgtaattaagtttagccttggattccaggcccaaagatttataaaatgttaggctttaaaccacaaaaccaaaaaatcaagccattcttgattcctctcaggagaaagaatgttttctaatcccatgaggaaatcccaatcagacatactcaaattggatcacactttacatttaaactaacaataagaacaacaatagaaataacaatcatcactaatccagatccagttgttctttaattgtaggccaaatcattctctgcagatcctgaagcttttcaaaaatgaagaccaatcctgaaggtgagctgaaaagtgttgtgagggttccttcactttaatctactgcatttttatgcagtgaaatcgggataatgtggaaatcaaggtcgcttttgatggaagagaggtgacaaaaagatatctagagggacagaaggaaagggaacaggagtaggatggccaagaacaggcctacttaatttgacttgctaatttcataaagagactctgagcagaattgcaggtggattatccacatacaatcctcaggcctttctctgcactttcctatgctacatggtctttccttcccacagggatctttctctggtattgtctatctccttagcaatgagagaatggaggctgttcaaatcacctgtcatgagactgtcaccctactctctaggtatggcttcacctaaaatacaattataaacatagaaacttccacctcacaagtatagtggtgatagcaaaactcagagcatagcaaagtgcattctagatgccaacatagaaattatgttcattcagtacattaaacagcatttgtttccaaagaactcaaacagaatgacaaagaaaccactaacacttcactagataagcaaatatagcactttcaatattatattaagagatgcttatcaagaacttgcaaatttccttaccctttgttctagcaatttgcatcagggaatctattctgcaaaaagcagcgactgcatttttttgcataaacgtgtgcattgcagaattatttagatggacagagctttagaaacaacctaaatatccaacaatagtaaaagagtaagtatattaagatatttacatacggaataggtggttgatttacaaagggctagtggaatagaaaaaatttctcatgttaagatccacatcaaaattttttttgtttacaatatgcacataaaagattaagttataaaatcaagatttaccaaagttgaaagcatacattttttcactctcttataagagcatatttgcatgttcctaaaagaatcaataaatatactcttataatccatacatgttgggtatttacgtgttaaaactgaaagtctaatcttgtgctgtctttgaaaaacggctgtgttgctgtggctaaagaatgctttacagaaaagaagcatggtatactaatgtgagaaaacgtgctttgtttttaaatgtgatggttttcttggtgacattttgaagtcaatcttttctctcttgaatgacagaatttctatattaagagagtatgtggagacaaatagtgcctctcagttgcgcaaagaagcatatttagtatccaactacagaattccacggaaattatagaatcttcagtccagatttaggtaccagagttaagtagaaatggttatagaaccagtcagtaagagtatagcatatacgcagaccgccacacagagagtgaggcatgtgcaagagaaaaaaagtaagagtgtaggaaacaaagagtgcaggaggaagaagagagcaaattggtaatgattctgtaaccagagaagcactggcatgagtgaataactcaactgtaaagaagtacagaatggatgatagatatcccaattaccctgacttaataattacacattctaatactcatatgaaaatatcccatggatccccaaaatatgtacaactatgatatatgaatacaaattaaaagtaagtacagaataagtcatatctatcatcacacatgcagtatctccctttttaaaaagttctcaataaaataccttaatcaaatgtggctcagtaatagtaacactgaatttagacaactttatcaattatcttatcactagaatggtgtacaagcgtgatagtctttgattgggcatgaccaggaaaaagttgagggttacaagactggtgaccctcaagagaggaggtaacatttgtcggccttacaattctcaatattgatgcatgctgtgaaagtgcaagacataagttattctcaatattgtgagaccatcaaatgttacctcctctcttgagggccaccagtcttgaggctctcttgagaacttccttccaatattagtccataggacctcctgacacattcacaagagaaacagagagcaagctgagtgacattatttttattctcttacttgagggaatatatgtaatttagaatggattagatagctctcctgcattgctttattgaagatatgtctggagtctgcagtcagaaattagtgaagtccttccttatccatctgaaaatttcaagtttctctaaaattaaaacaagaaatagaaatagtttaaccaacgcagagaccagacccaacacactaatgcaaatacccctttcctagactctactatggtcgattcacttttccttatggttcacttcatggcaaagctgtaattataatgcttagaaatgttgacctttacttaatgactgactctctcatgaccaagattaatgatttgaaagcccaaatgcagatgctaacaaaagataaaggtgtatctatcacttaatgcaatgaaattttattcattaaagaacaagaaacaaaggctgattatatcttccttcttataagctatttaaaaacaaacaaacaaacaaacaaacaaaatgatgtttcgctgtgttacgcaggctggacttaaactcctgggctcaagcaatccttctgcttcagcctcccaagtagctgggactaaaagtgcccaccaccattcccagcttataaactacttttaaatagcagtcattctggcttgttttcttgcatccagaaatgaattcgactggtggctcattgtttctttttccagagtaacatggtctcttttcctttggtccacacagatcctgtggatcaacttcatgtcagaaagcaaaaagtaaaaataacaccttggagagctctcactcatctattcgcaccaacctaatcacaatgctactgcttccaggatgaccaggtaatgagtgtggtctatccaacacgaggattctttccaaggcaatttggagcaaatcaactaggctaattggtaattcaagtttttatcccataaaatgactgtggcccaagggaatgtatcagaaacctgtgcacaagagtttgtattagagttgtttattaacatggggattatcttcaaaccaataataaaaagctataattgactctttgcaaatgcataaatatgggagcaacagtgtgcacaggttattactaaactggaaaagaattttaaacatttcttgtaataaataaatcacctttaatagtgacaaattgtagataaattgcataatgccaatgtatatttcaaggtaagaactaataatacatcaattcttttttgttcctttaagattagaactcataaaccccacagtgcactgggtacaaaatcccattgaaaactcagaaatgggactgatgggagaactgaactcagagacttccacaactcggaaatatgttcttaaaaagccatgtatctttttatcttgggcttctaggcaactagcacaggtcaagataactagcataaaaggaatcgggcactaattctgctaccatcttggtgtacgatctgacgcaagtcaatgaatcactatgcatctcaactcttagatctaaaagacagaataatcaagaattttataagactccaatgagacaatttataagaaaaagcattgaaaataatgcatgctgtgagagcgcaagacataagttattaaagggctgatatgtcaggaatatcagtaagtttcagaataaactgttacggtctattcttgatttggttaaggacatgagggtaaatatgcttatgctattccattttatggatagcagtggtgagaaccactgtggccaagaattttgtcaattaatctgcaaacttttctgaccaatgcttagcactatcaatctaactaagctgtgtgtgtgtgtgtgtgtgtgtgtgtgtgtgtgtgtgtgtgtgacttaatcaatacctaacaaagatccctggggtgaagatcactcctatattatacctagtaccaccagttatttggagggacaggtgttatccactgatcaaatcttaggaagctgcccctcggagaattacagctctggcacaagcagatcatagactcagtttacacttcaagaaactctatttagtggtgactgcacatagttcattttttaaaatctcgctgcacacagcctgatcctgtactactcaaacatgtcaattgttatgattcattattcttcaaaggcctcaagttggtactcaatattccactgggagcttggaaaacggatctgtcccttcactgagttattaggcaagtttcaacacatcttttcatcagtataagagtctacagaacctagcctctgtaaattcagagaaggggccttgtattttatggcacatggaaaggcgttagtcacacacaacttgttcccagtcataggcctctgttcaggctcctctcttctctaggttcccttagccttaccagcaaaatccctagacaaatcttatttcttctcagacccagacagagcctcagatcctgtatgaagactcctgcaatgaggggaaccatcttctccactggaatttgtacagctgttgtgaggctcctcttctctctcaatatcgccttttctactgccactcctttcttgttaaggtactagccactctaaccacaccttctctcattcctataaccaatcatttttaaaagtctggcagaatctctgatcccaacaccttcacagaaaaaaaaaagtaaaaacaaacaaagaaacaaacctgttatgcattataggagtgattttcaattgtgtgtatgtggggtgggtgtgtcttgatgggaacatgaaaactccgaggcagatgtggtaagcagatgggcggggcatgtgtaatgtgatgagtccttccagggtggccttatctaccttgcttatagccagcaccacaatctattcacattgtttgtgcctcagctcaggagcttcttattgctcactcaatacctcccaaatgattttctcacctacagtcttgttctctttaaccatgacccaaaccaaccaattaattctctaccttgcttgctgaatgacctgtgtaaatgcaggcctaattctgtcaagcccttcttaaatccttcagtgtctctctatcgccttgaaggctaagtcaaacttcccaacaaggttgagtaggctaccattcccgtttgggctttctagcccctttttgggtttattttattttttatatgcatttttttagagactgggtcttgctatattgtccagtgcagtggctattcacaggtgttatgatttggctgtgttcccacccaaatatcatcttgaattatacctcccataatcctcatgagtggtgggagggaccaggtgggaggtaattgaatcatgggggcgagtttttcctggccgttctcatgatagggaataagtctcatgagatgtgatggttttataaagggcagttcccctgcacacactctcttgcctgctgccatgtaagatgcgcctttgctcctcctttgtcttctgccatgattgtgaggcctcccagccatgtggaattgtgagttcattaagcctctttctctttataaattacccagacttgggtatttcttcatagcagtatgaaaacagactaatcaattttttgtgatggttaatattgagtgtcaacttgactggattgaaggatgtaaagtattgttcctgggtgtgtctgtgaggatgttgccaaaagagattaacatttgagtcagtggactgggaaaggcagactcaccctcaatctggaagggtaccatccagctaatcagctgccagcacagccaggataaaagcaggaagaggaacatgaaagaattagactggctgagtcttctggcctccatctttctcccatgctggatgcttcctgccctcaaacatcaaactccaaattcttcagcttttggactcttggacctacatcattggtttgccaagggctctcaggtcttcagccacagaatgaacgttgcactgttggcttccctgcttttgaggttttgggactcggactggcttccttgctcctcatcttgcagaaggcctattgagggagttcatcttgtgatcatgtgaatcaatactccttaataaactcatatatatatatatgtgtatacacacacacacacacacacacacacacacatctatcctattagtcctgtccatttagagaaccctaatacaacaggcatgatcatagcatgctacacagccttgaacttctggactcaagtgatcctcccatgtcagtctcttgagtagctgagactacaggctcatgccaccatgtccagctctaagaggtcatgtacttttttaaatttttttttcaacttttaatttttaattcaggggtcacatgtaaaggtttgttacttgggtatactttgtgatgctgaggtttagggtatgattgatcctgtcactcaggtagtaagcatagtgcccagtagataattttttcaactcttgccccattccctccctctccctctaatagtgccctgtgtctaccgttgtcatctttatgtccataggtacccaatgtttagcttccacttatgagtgggaacatacggtatttggttcactgttgctgcatttattcacttaggataatggcatccagctgtatcaatgttgctgcaaaaaacatgatttcattcattttcatggctgtgtagtaatccatgatatatatgcaccagattttctttaccaaagatactcttgatgggcacctaggttgcttccctgtctttgcaattgtgaatactgctgtgataaacatgccagttcatatgtctttttggtagaataatttattttcttttggatatatatcctttcctagcccagttttctaagtgtcagccagccctgcacgattacttgaagttctcaaagtggtgcaagcttcttgctttagagcatctatacagttgttgctcctggctgattcctgttgtcccttttataactaaataggctacttaccttttgttctttaagaccctcttcacgtatcacctcctcctccagggctctcttcatctctgaaggctttttaggagcctcccttcattttctttgaacattaatgataccacagtcctatctcaatctctcacacctgtctactctcccaagtttctgtaagaatcgactagttcctgtaattgacagctatatggtgttactattaattagtcccatttgattatatcatttcctgacagtcccaaacactctttggactgtggattttcaacatttgtatcagacagctggtcaggtctacctgctattttaccattgcttgcctgtaatttaatttatcttggcctcaattcctccatctgtaaaacaacaatgactattctactggtttatatggtgactaagtaagataatgcatatacaaaatacagcttaattaatgcctaatactagtaagagcttaattaatagtttctcttcttccccctccttcaaattattattattattattattatgctaggcacttaataaatacttgacacattgaattaattagctgagagctttttatatctaggaaccaaatttccacttctgctctccagccaacttgtggaaggtgaaaggaagatggtcagcatcaaaagattcctctttctagcacgtggcagagtattccacttttgccttgtaactgccattgaaggtgatatttcacctgataaagtcagttatgagatctcccatacagagtaatgaaaaagcctgtaacagctagtgatctgcctcccctgctgttgcctccaccgaataattttgccataaaaaataaaggggacatctccttttagtgaattatgacaaattttaactgacttatccctcttggaacttaggagtgtcctactttctcctccaatgacactcccactgagctgacatgtgacacatcctgggaatgcattagaactaaagagaaagttaagactgtgacacatccgttggccctttttttttttttgctaaaggaggaacatccctcctcccttgtctcctcagtccatagctctctgttctcaggatctttttaattctactggccgggaagacatttataggcaaaagcccctgtagagcaacatatccccctctctatcatatatacttctcaaatacctactacatgccagacactgtggctctggggacacactgatcagcaaacaaagcccctgcccttatatgattatagtggggcatgacataaagcaaatgtgttcctaaaaaattccaagttgaacaaatgacattcataccatactttgcgtatggtgcaaaccatatgtaccaataatacatgacatctaaggctgaattttaaaaataagtattcttgttagaggccagtcatcccttagcaactgactatttcagctctggctacagggaaggtgataatgagtaacacatattgaatacttaatatgtaccagatattctgctatctttttcaggtatttttacttgattatcacacatctaaattccccatgtggttatatgcttatcgttatacccattttgtagatgaggaaacagagcagttaaacaatttgctcagccatattgttagtaagtggccttgaaccctggcaatagagcacacgtgcacagacagagagattatgacacattgtctccaaaggtgcttcagaaaatcctaaggagggagtgaatgagtgaggatcatgaatgtgaaaatcaaatctacccacgcaacaaaggaccactaaattgccaaaatgctcaagagcatgatttactgtattcttcatttctgtgtaaataatgaaaataaatctctcggctcccaagaggagcacatctgtaatagttcctgctgaagatgttaaagatgtgtttatggaatttgcagaatcacttccttcaaagttcaatggtctataagttgctagtgttattgttgttaaaagaaactgaacgcttagtactttctgcttcaatctcaggttgagatttgtaaggaaaaccagatatcagaccagctcctatggaaactactctgtccaatcaaaagatatcctctttccatgaaactaacttaactacctcacaggatattcgaagcacaatacataatgtgaagggggaaaaccttactttccttctcctgttctagtacgctttaccagatgctcctgtggccaaaccctaattgttcacttcaaaacaaaaactacttaagcttctggaatgtaacacatctctaccaggttaaccattaagagacggagaggcagaggcagaggggaaacaggagctcctctcagacatcaggaagacaaatgcgaattgtccctacaaaagaaaaaagatcaccacctacgtgtttctctatcttctctcacttttctctgtttccttgtcatccctctttctgcccaggtaaagtggtggtggagaaggagaggaattccagctaaacagtgcgttggtatgaaccgtaggctagtgagccatgtgcatgctccagggacagggaaactgaagagagtgcactataggacaccaaatgcagatataatcaaggcttctttctacatgccgcaacatagtcaatttgaaaataagcatatccagaatggtaaagcacttgcgcagtaattcagccatgctccttctaagtatgaaaatctgaatatcaaagcacggtaaggagggaagcaggtgaaaaacaataataaaaacagtgagtcagcattttttgaagctatcagaagctcaacagagctgaatctattatgggataagaatggaaagatacaggtggaagaattgacatacagcagcaatatcttaaattaactccttgctattgaacacatgagaaactatagtgaaaagtctcagtgactgattggtttttatgcctagaagagaaagcaaattttgaaagtcctggccctttgcatttaggtccataattagacaattagagctcatgtactacaacaaagctctcaaacaatcatgaaacacagccacactcattttaaaagaagattcttaagagttaaagaagaccttttaaaaaatacattgctttcacatttcttccaagtagcatagaaatcagggaggaagaggaaaaggaggttttctatccatcagaggaacaggaatggattttggcatgcttggctaagcattctccccatgatttatggtctgaggtgtcacttacatggatgggatggggtgggagtggaaaaactgataacatgatctgataaacacctgtatcaaaagcacctgaattgcttgcaaaaatgtgtatttctcactgaattctgaaatactgaatctcagcagaaaactcaaagaatcttctaacaagctcctcagtgattggcaggagctttgagagaggcaagggctgagtaggtaggtggggaggtttgaggctgttgggcaaaacagggttgcatccctttccttagacaacaaacagggctgcaggatttaataaaattccacaatacttccagtgttaacaatggtgtatgctgggattaatcccacatgaaataatcacaaaatgataccagttagtatgatgcactgctatcctaccacagccgtgcaaattttaaggacagtcttttttggataaggtcccaccagtagataaactccacaaagtctggccaccagggagggtcaattaccaggactacattgtttctctagttcagatgtgcagaatataagggcagtgtgaagttcagcattacaaaaacagaaagcaatttagtaattagtgaaagtattacatggacaaaacaatagctgggagatttgtttaaaggaataaactaataactttgttcataccaacccatttcaaatatgggaaaataatttttaaacatttaaataaaactagaattaacgaaataccttggatacactggctagacaaaagattcctggtcctgactaacttgagaatttcggcaaataagtcagttaattacaaggagccccgtatgctgaatgcagttgcccaggaaatttgcttaggtcttgcttagtcaaatttgagagacagctcaactaccatacccatggggaaaattgtggacattcttggagtatatgccttaaataccatagttgaaaatgccttaggttgtgcagtggtagatgttttttaatgtactaatttaattgatttatacaataatatatctttattattgcacttagcaccttatattgcaattaataagttgtatattttctcccccttattgtctataaggtataaatttgactacaattgaattcattaattttaaaatctaaaaatgcccagtattttgtgtgatattatatatatcttttgtaaatgcttaccaaatcaatccgtccttctagatttttatttggtgaaaggaacttgtatcagacagtgaacactaatgtagtgaatcctagatttccgacagtgtgctaagggactgaggatgcaaatatgaatagaaaacagttcctgtccttgagaaggtcatagtcaagttgacctggaaatctctgtaagtattataatgcaatggtaaatacatttgctaaacaatagttctttaaagtacctaatttgctgaatacattcatatttccacatgttgagtttgttcaaattcacctaggcaatttatgttaccaatgcattttaatcctgggttatatagctaataaaaataaggacattattaattattttttaaattacattttaatatttaagtaatcctaattaagggcattaaacatgtaattaatgtttgtttcattataaacttgtctaagcatatagctgtacgctaaaaacaaatacaaattcagatttaccactgtgaatgctaaactttatcaaatagtacaactctggccgataatttatcatattctgcatttgttgatataaagacaaactgcaaaaacactaagtgtatttctaattataaataggatttctactcaggcctagggacagtgagtttttataaatgtgcaaccaaccccttttcccatgagtctgactgcagttctttctccatggctgataccaaggaagaaatgttgagactactctttgggattctctgcagtgtatttgctaaccatgtggaagaagtatgtgggatattttaatgaaaagggcagtaaagttagggataaagagacacaccttggtcaaaccaggtaataactaatatgactttagaaaagaaagcaacttgctctattgtgcaggctggagcgcagtggcatgatcacgactcactggagcctccatcacctgagctctagccatctttaaacctcaacctcctgagtagctaggactacaggtgtgcaccctgatgatttttttttttttaattttagtagagatgaggtctcactatgttgcagaggctggtcctgaactcctgagctcaagtgatctgcccatgtcggcctcccaaagcgctgggattataggctaattagggtttctatttcttttcttacaaaaggaaaacatttgactaggaagtctctcaagtcatttcttgctttaagtctatgattcagtggtcagcagtaatctcagagaagatgctatgtggaagggatagctggttgcagctgggtcaccgaaaatcaccacgaagttcatacccttagtaaaattattttacatattgatagctcacaactccctcaacctcacactctacatccactccccccatcaatttccatacatgcttttgggttatggagtatcagcaggcagtgacaaccaccacgaacaacaacaacaacaacaacacacacacacacacacacatacacacacacactctgaacttgaaaacgaaaacttcttgggattttcagggcatggtctcagctacccagcttcctgggaaataaagaaagtagcaagtgttaacacctcatttttacctatcaacagttacagaaaaacatgtaaattgttccttatacatcaatgtatgagtttttgacaatgctgggggataaagctattatttctgggttctgcttaagacacgctcctttgtcctccctaccactcagatatctatagttcatacagtaccaaaaacacctctttccacctagagggctcttaaaacctgcagttaagcaagagcaagccaaaacaagtctatagcatcacagatgggttatccaactcaatcacagacattcccctaatctccagcaaagaaacctgctgtctctctaatgcactaacatcatttccctagggcaaggtctgatttctctgagtatattattcatagaaatattatacattttgataaatgtaaatagaggataaactcagtcaaaaacaattcacaggttagaggaggtttaaaagagatgggagcgagaaatcactttttcctgtatttgttttcccaaggtttctcacccctctgcagaatgagattctaggtttagagacattaggaaaccagtaaccacgggacccgttgcctggaaacggcctgattacaacgaactcactaggctacaaggaaattctacctgatcctttaggaccatttgccaagcctcattatgatgataaagaaaatttatactttcataaagccttcaaaaattattgccatgaggttctgaaaaatctgagcatctgctttggggaagaaatgggaaattaacatgaccatctagtgtcaaaaactgacagcctagacaaaataaagaaaaattcgttcagcatcaggcgtagaattcagaaatcaaaaatccaaattcaatgctgaacaaataatgtttgggaattgtactgtctgccatgggggtgagaagccaaggcagccggaaaatcactaataaggggcatttgtattctgcagcagtagaacttcacttgtgcttccctgtacatctaagaagaactttcaatccaatgctgccattaacagctgctttgaaacatacgccatttggttttgttgcccttgacaggtgaacaagatttgtcagggaaataacattataataatattgcagaagtttaacaaattctaagaatgtctataaatgtttaagacaattagtaatcactctgagaaaacagagtctattttacactttagtgaaagaaatttttatagctaaatgactgtaggtatatatatttgtgtgtatatttgtacacgtacataattttatattttatatatatatatatgatagatgatagatagattttttcccctttcaagaacaacaggagttaccaaatgcatcagtgaattctggctccattaaaagttttcgttgttgttgttaatgatctacttacagttacattggactaaggtgcgtctcacagggagctcaaatgtgactttggacccatcttaatatggactttgccattaattaggtctatgattaatttttagatcatttatcataatttgctggagcataaaatgcaaatttcagtgaaatctaaccataattgcttacaattaaattttttatatctattgtaggaaataaattcagcatattcttttaaattttttattactatttttcaaacacttttttgaggcatgattcatgagtccattcttcatagataaatgctcaacattccagggccacagggattaatagagactggtagagagagagtaaagtaattagcttaaattttgccatagatgctatgggaagcaagccattttcactttaaagggactatttttccatacttcagatattcaatacatatccacagtactctcaaatatgattccagggtaaaatgtaaggcctctaagccctaggtttcaaggaatgtatcttaattacgtttgaaccctcagtacttatttcaggcctagcacacagtggatactcccaaatctctgctgaactgaaccaggccatagtatcatcagaggaagtgatattctactttagagctaactgagacagacagggaaataaaaaacggactgcagattgtactgaagagagtgcctggaaggatgatggtcatagattacatggagaaacaactaatgtcagaacaagaaatcttatgatcatcatttgacctctaccacccattccccatgccagtcactctatatattaccgtcaggattattctcccaaaacgcaaaatcataacactattcaactgcttgagaacttacaataaaaaaaaataaattattcattgcaattatctttgtcttcaagcaacttaacaatttggttgcctagatagaaataacacatgatactttttataaaataggaattgagagaaaagtcaggacagtgtgagctaaactgtcagtagaagctgcctaatgaaggagggactggaaccaggtctatttatttgaaagaataaatagtagaggaggaccattccaggacaggtaagaaacaagcaaaaacacagaggtgagaatttgaatagtacattagaatagatacaaagatacatttggagatgggttgcgggtaagaataccagttttggctggaatcttggaagtctgaggcattttccgtgaaggaagtatttaaaaggatgctacgagtttccaggaatattcatgaagtgctactggtgaaatagatagcatttgtgatgaacctagggacacactgattcattcatttggtaagtgtttttggaacacctgctatgtcctaaccactagagataaagcagtagacagaattcctgccctaataaaacttatcaggggtgagagtacacaaatgataacaaaacagataagttagtatataataaaaggtcaagtgccatagcaggtaagggtctaaagaatgggagaatgtattctaaaatattaaaactttaccgtctcccaaaatatctagtacagacatgggcatgcaatagaaataccaggtgactggagtactgcctgctgaatacaagtcctggggttatgggatacagattttctcctaataaaacctgaaacaatcaatcagaactctatgaggtctccgatgtgcttgcctaacacataaaaatgcctgggcgcaacccaacctcacctaaaatgggaggatatctgggataggctcctgcagcatacaaagttggatatattgcagggttttcgaaattctttccacattatctaggatgagctgctgataataaacaaaaagttttcattaaatatttgttagataatatgcctatgactgctaggtgctataaagattaaaataataaaagatggtcatggcattgcctttcttaaaaaaaaatcaaacataaaagtaaacttaaaagtcaggaaaagataagtacagtaatgacatcaaaatgagcttggttttacaaaaaaaaaattgtacaaaggagttcaggagctcctgtgatatatgaaacttgaaaaaaggaaggccacttatataaatgcttgtgttttcttgagtctttgagatatttaaattctatgggagcaagcattatgaatgtgattttcaaattacaacacctaatttgttctgacccatccttggtcactggttgaattttttatatctcaaatgccatcctcaaatatgggccaatgtccacacagaggtaactttccatgtaaaaaattggcaggaacaagtgagaaagggaggtgcttacactgccctttctgtaggacgtatttgcactgactgagttaatgtttatgggctgtagatattcattgagacatagtatggggtggctaaactcaatgccctacaaagagaaacaaaaggaggagcctcgtccatcatattgccaataaagagcagtaaaattacttgacaatataaagataatactttgctttcccactgtgcttggttcttgctaaaatgttattaatgaaaggaactattagatcccagtaacaagctgtcatacaactactttacctacctaatttcctttcccactcacccataatatttcctgtttctatacagcagtcatttggactctacaatatttcaatctgtctcatctccattattggtagcactactccccaatccacactcctgctctgtgcaaaactcctgtctcctcattaattctatttattcaactccttcaacctttgtccagagggtctcttttcagatcagacattctgttttgtttgttaatttatagcttttgacatttattattatcttccaatgagacacagaaagaatataagaagttaaatgttttcacaagcaaccctagattcctgtgtccctttgcgggggaggaaaatagaaagaaataaaagctgccagatagaaggcctgaaataaatgacctgcaccacccataggcaaattctacctctttgtaaagaatgtttcataggagggaatcaataagagctgaatatgaaacattggtgcagtgcactagctaagttcagtgaactcccaagctaatcctgtgttctcagaagctataagcgccaatctcttcacctttgctcagggggatgagctcaccacagaaactggcctgttttttgacctcaaaatccagttgggacagggttgggggatggcagaagcaatgaaagggaaggtttccaggccatttgttctaaactgaggtgtgctggcagaagcgaaggacaaggttgagtctccatggccctgagctgggtcacacagctggaatcacactttgctcaacacaaacgtctttcactttttcattcacccacaagcaacacaaggactgcaacagaacactgatgagaagaaacaggcccagcgccactggtcactgtcagtatctaggctacctagtaaagcaacccccacacgacccggatgctaaataaacgtttacatcagctcatgtttccctatgactagctgatcagtatatcgaattgaaatataataaacaccaaaaggaatgctggcaggaggctcagtattttcagtttttgtacaggttttttgaaaatcacatcacatttgttccctttaatgatactgttgtcttacagaaaaatactcattcacgtattaaaatttcatcaccatatctaaagcgacattcctttttaaaacaacaacaacaaaaactaaaccaaacttactaaaaagccccaaatgtctacactgaagcaactcaaatgaaatggtctaatcataaaattaaacacattacagatgagttgatttgagggcatttagtacatttgagtatactcgatatttcagtttctttaacctacattccctaaaagtaacactaaacagtggttctgtgtatatgacacagtaaaaatgcatatatttatttctgaggctgtatattagctgattgtgaatcacccttgaaagtatgttttataaaataatgttcatgcaaattctactaaatgtatggtatactttatacaaatattaaatatgaagggaactggtatataaataatcaattgactagactatgcatttaatatgtatttcatgacataatattagcttttataggaatcactacttgaaaaagcagaccattaaactgaatttgagtttcaatgactcaagttctagttccttttaaatgtgtctggacaatctggttgtatcacttgcttctcatccataaattttttcttaccatttatgaaatgcttgttatgataaaaattattataccacatatacatttctattcccatcccaatcaccaatcgaatttctaaactatatccctatgatctaaaataaaccaattaaacaataacaaacaaaactttatgcatctacttattcatactgattacatatattatttttcttgccttgtctttaccactagtatattaattcttaagcccaagaactttgcattcctactgctctactccatcctttgctttaagcacaaattagaaagaatgtaaaccaacactataatttgtctcatgatagctccaagatggtctgatttactgtgtggtaagaatatctcctatcctgcatttcaatctccatccaggccttcaaataatactgtctatcagttaatatacagcattcccagttgaatatgattctctaacagtagcagacagaattgttctctcggtatcctgtggggcctaagaggacagtcaaaatctcagcaacactgtattttccttgcttctgtgccattctaacaatttcttcccctgggaaagcctcatcttttccttagatttgtgtttctggactcactgatgaatttagattctattcaaatgtgctcgcactgctatgttctattatgatctggaaaataactattattgttagcaagcaaatgttagagtttttattccactaacacatgctttgagaatccctaagttcctgtttatgactttgcagataacaaacaaaactataaagagtgtaactacttattgggcctttaaagacacgagagataatttattagaggacacgctcagtgttctgtccaggtggttgctatcaattacaaacagaagtcttcccaaatattcacttaatgaataaattgaaaggaagatcaaaatgtttttcatccacagaaagacctttgccacagcattgatatgctggtacttttgtcttaacattttggtctcttataatctcttgtttaaaagtcaacttttttatgtaaatgtctctcagtttatccagggtgattcttttctgttggaatgagaagcattatctctaagcatgcatttatgtgttgtttaattgggtgtggtgtggttgttggctctgtgataagaaagcgtcacagtctccgacctctagatgcttaaaatctaagatgaagtaaatatcccaatatattactgtggacccaaagcataatgggccatttaaaatcattctatgaacaaatcgactgtcattttgacagtactgagaacaacatatatcccttcacatttcagcttgtgttggatcattaggcacaagtttgaacaattccagggaaaacttacaaacacattttgaaataaaatttggatgtaaaatatcaagacttaacagaaacattttacagaatgatttacttcacaaaattatgtggtccgtacttctttcaaataacatattttctgctggatttaagtaagcttaattgacatgttatcatttatatagaaaattaacatgtccctgatttgtcaggtacaacaagaatgtacaaaggaagggccacatatactgcaggaattttaagctattctcttatcttttatttcagagcattcataatttttaaatgttgcaataaccttttgaggcaatactggtgacttcttcatttgactaaaacatccttgcatatcaacaattgaacaattgaaacactttaacaaaatctaatgtgtatatatataatattatatgtattatatatgaaaagtatgcatgtcataccatacatatagtgagatatatatatatatatacacatacacacacacacacacacacacatacatacttatgccatcagagaacatttcatttagattagtatgaaaattcaaaaaggagttaagtctcatttttatggagctacacccacaaatcccccaggctacacttagttaaaactctgaaagaaattttattctgagattgagctcctgccacatcacactgtcaatatccaatattctgaagctacaagggccagtgcccaccgatcctagtcccatttaaggaaatgcaatgcaatctaatgccagttctcaaagcacgtaagtacatgctgaaatcaaagatttaagtgaccatttattttgtcttgtatctgcctgagaaaaccctttgccagccaattttctcctattagaattagctttcaaagttagaatgtcatttgcatgcttgcagacaaagctaacaatttcaaatcatgaaaatgtgtattctcagatggtgaatatttgcttttttaagtacagagagtagaaaccgagctagtcttactagattttatatattgcttaaattaacggccaaaaaaagcctccaaggggtaaattgcctttttgtaatattacctttaatttcttttagcaaatgggatatgaggtttaagtgggttgaagaaaatcaagtaaaatatttatggtatacaattttctatggtcatatgcctaaaagcaaacattttgtggttagtttactatgaatgtaccagggctagcaagggagtcttttgcaagacagttgatttttagaaacgcttacaggttgaaactacaagctcctaataacatttaacaatcagaattgctttggagaccagcctatgttggctaacgctggctacttaggctctgcaaagtttttgtaactattttggcaaccaagtaccataaaaccaagcattccattttacatccaatgtgtctgtgctggcattaagtaataccaggagagtattttaaaggttcaaggtcaaatacttgatattccattgagtaaaatataaaagaaaatactgcacatcatctaaatatcctaaaaggctaagttctaaccagtataagtccacaagggacagaaaagtagcatgatgaaataaaaaagaacactggactgagaattaggccttgggcaaatcaaatccattctgagtctagcttctccacttcttcaaagagggtaataatactggcttcactgacctctttggataaaagcctgcatgtagaaatgcttaaaaatgtagacaatttaatacaaatattagataatactatcatttccatttctcctgataatcatgcagcaggtctctgaacaagacctgtgtactgtgttattcataacataacttgagaagaggtggtagtttttacacacctcctcccccccttttttctttacacttgatcagcttcagagatacagtcagttactaaactcctcagacacttttagcagcatcagaagcagctgccacttgcaaacctgtcagattccacagggactaaggatgtaaaaacaatgagtcattacaggtgtgtctgcctttttcattaaaagacaaaatgaaaagaagatgaaattcacccaactcagtgtttttaaggcagaaagtaaagagatcaaccaggaaatactttattcctttaattcatatgacagacattcaaatataacatagtaattgtttttaaatagactgttactgtgctgggtgctcccccagactacgaaaaagagtgctatctaacttcaaggaacacactgttcgagaataacaatatggggcataatggtagcatacaattaattctaattccaggtagaaccttggtgagacaagaggtagtaagaaggccactggaatgaacaaaaggaaggtggcaggatccttaaaaggtttaatgaaagagacagagatgacatttgagataattttgaatgattcctgggatcctggtaggagaaatatcaatgaagacagaaactagaaagagggatatgttcaaaattgagaagtctaagttgtttcaagaatatcctgctacagtttccctgtctacccaaatgtgcatatgtttgtgcaagctgctgatgttcgtttgttacaaaggtgacatgaataacctaaatttataaaacatctttaaaactggcaaataatacagaatctctatggattacaaataaaacatttactatacatgtaatcatgttttagaaattaaaaataaattaaaatatgcaaaacaaagattacatataatcccaccacccagggctattttgatttatgccttgccaagactatgtctctgtacctatatacatctacattttttttcttcttcttttaattatactttaagttctgggatacatgtgcagaacatgcaggtgtgttacctaggcatacttgtgccacagtggtttgctgcacccattaccctgtcatctatattaggtatttctcctaatggtatccctcccctagcacccctcaccctgacaggttctagtgtgtgatgttcccctccctgtgtccatgtgttctcactgtgcaactcccacttatgagaacatgaagtgtctggttttctgttcatgtgttagtttgctgagaatgatggtttttcagtttaatccatgtccctgcaaaatacatgaactcatcttttttatggctgcatagtattccatggtatatatgtgccacattttctttatccagtctaccactgatgggcatttgggttggttacaagtctttgccattgtgaacagtgcagcaataaaaatatgtgtggcagggcgtggtggctcacgcctgtaatcctagcactttgggaggccaaggcgggtggatcaccaggtcaggagaccgagaccatcctggttaacatggtgaaaccccatctctactaaaaatacaaaaaattagctgggcgtggtggcgggtgcctgtagtcccagctacttgggaggctgaggcaggagaatggcgtgaacctgggaggtggagcttgcagtgagctgagatcgcgccactgcactccagcctgggtgacagagccggactccgtcgcaaaaataaaataaaataaaataaaacaaaacaaaataaaataaaataaaataaaataaacatgtgtgcatatgtctttacagtagaatgatttataaacccttgggtatatacccagtaatgggattgctggatcaaatggtatttctgattctagatccctgaggaaccaccacactgtcttccacaatgtttaaaataatttacactcccaccaacagtgtaaaagtgttcctatttctccacatcctctccagcatctgttgtttcctgactttttaatgatctccattctaactggcgtgagatggtatctcattgtggttttgatttgtatttctctaatgaccagcgatgattagctttttttcatatgtttgttggccatataaatgtcttcttttgataagtgtccgtttatatcctacacccacttttcttgtaaatttgtttaagttccttgtagattctaggtattagccctttgtcagatggatagacggcaaaaattttctcctttctatacagattgctttgtaatgtggttttttcacttactagtatgtttgaataacttttcatgacattaaatatacaaaatacaacataaaatttacaatataattttaatggttccctgatgtactattgtatatgttgcccatcagtttattttatgagtctatattatttcttatccagtttacctttattttcttgtataaacaataatggcatggtcatccttttaaattaatcattatttcagctctgaatatttatttaattctaggattccagttactgggctcttctaaactgtcttccaaagagttatactgattttcattcttcactaatgggttagccttggtctactcatgttctttttaatgttgaatatttaagttctaatttttcttactactaatatttgaaaatatttttctttgaatattaattatgttgaacatttaaaaatttgtttattaaccacttttttatatgatatgaaatgactaatctccattaaaatgttacaagtctgttttgtgtgttttgttcatctttgcttttccggtaaccatcctctgggtatctttctcttaattaattgtaacctcctatgcatactacactaggacacattcttaggtttaggtgtttatccacacttagtgccatagactataaagggtctgagattttatactacttaaaaggtaacaagttaacctgctgcagttttatgaatgctagcacaaaattccagaatcctaggccagagatgaagttcattacttgtagcaaaagcagcagccagagtatcagcaattttttgtgctggttccataaacctcattttcctcaaggaaatgcaaagacagccatttggtaactgcacttacactgggttgtgttataagagaactctgagctcagagaacccaaatattttataatgggcagtaaatctgactgccctttgcttcagagagaaacattatatttattatactgaagaatatatgcatggagggaaaccctatatctgtgttccaaggccattcaggatacaaacattccttgaaatgaaagtctggggaaaaaaaaaaaaggacgtcaatgtcttgccaggcaaacatgcagaaatgcaaatgacacataggaaattatctccaagcgcttagccctgaacatgtagaagagaataaaagattttgtgaaggaaggaaggagagtgattcaaaggcattcagcactcaaacttggttccaaacttagccttacctgtgaaacctcacgacaacagtaacacaccagccaaataaaaacgtagcttctggtcaagctgatttctaaaaaccagactttctaaagaggttatataaatagtgacttttcactttataaagcaattctctacagaatctttaaatatcaagttattctggtatgattggaaagtaaattcatctaaaaatatttatgcctttttattcagcatattagttaatagagtatgctcaggatgaaactgcctcaattcggatctggctctgtgtgctggttgagttattcagcatgcttcagttccctctgctgtaaactggggatactgatggctattaactccatcctcacagaactagtaaaaggtgcttttgtcactgcatgatacataggaaacattcaacaaatgttagttgttattaattgtattactatcaccgaaaaataagtcattcagttgatatattttcttctgctcttttcctctatgtttacaattaactacaaaatgttttcttttcttgaatgacagggtagatgctaaacaaaagatttaccaaaatctaactctaataataaatgggttaaggtttcactcaaattataggttatttccaaaattaggagaagggaaaatatttttttaaaaaaaggatgatacactttgggaggccgaggaaggcggatcacttgaggtcaggagtttgagaccatcctggccaacctggtgaaatcccatctctactaaaaatacaaaaaattagccaggtgtggtggctcatgcttgtagtcccagctactcgggaggctgaggcaggagaatcacttgaacctgggaaaaggggttgcagtgagccgagatcatgccactgcactccagcctgggtgacacaacgagactctgtctcaaacaaacaaacaaacaaacagcaaaagaaaaggatgatgaattcctaaagctggattgtagcacctgcgataacttctttatttctatacttttgtatagtgtgctaacaaagaacccaaaaataagaaaaaagaaaaaagttgtataacatttaaaggtctgtaacatactattcacttaacacaaacaacctatgaagctcagggatagagtattcaaatatttgtggggggcagcagagggctgcatggcattcctctccagaatgtaatcattatttctgggttatggctggttctaaacctaacagtagtgactcatccttttccagagattctgaagtagatggaaaatgcatacttgaagaaaaggtggtgaacaaagagagagaaagactaataaatggtggctctattgcaaaggcaaagctgttgaacaaagtgggggaaatgagagaactctgtgcaaactaactcatagcattttttaaagcttcattatgtttctgagacttgcgctctgataatgtgtaaagaaccattttttcccctttcaccaccgccccattctgttatctgttacgtctatttcatatttgagacagatgaattttggaaaagttatgtaatttggtcaagatcatgcatgtagtaaacaatacatttaggattgaattctagtttaaaaaatcagtttttgtgttattttcactgtagtaatatagcatcagctgaacttgaattccagccaagtgcttgttctcctaaagcctacatcgcaatctactgaaataattcttggccaacccaagcatcaaataaagaataacctcaccttctggtgctcagccagcatggggattctgttaaattgtgggtgtagctgatattcttggttacctggggatccttctgctaattttggaacatatttggcttttcttaagctctcggtctgtgactttttaaactattcagctgtatcctggctatgtccatgtcctcagagaataaaacaaaatcatagatcagggtattctttttattttgtcctggacactctcattccccagataaatcacaggcacagtcataaatctatggaaaagaacagtacaatttccactggaaaggcattctctatcttttccacattgtatccactattcacagtgaattgctactaagaacatttttctctctagtactctagctacataaaacacttggtaatatacatactagtttattgttcttcacaggcaaacatagtgctacttttccaagtgtgggaataactcattctgaaccactggtcccccaaaggcatatccatatcccttaccttggctttgacaggaattataggagtaatgtaactattatttggtaagaaagctgatagtaaaccgtgtcttctccttattcctgaccctgcgcttatactttgcctagcctcatatttaaagaataccttccacttttctcaaagctacaagtaacaaatattcaacacttcacagagtcaggtccagcaatcttctgctgaggtctaaaaccttgcaaaattctggaaaatggtatccaggtaatattgtggttttgttagttaaaagtatatctgagtatatgtgtgaatgtgtatgggtgggtatgtatgtgtgagacagattggaagtttcttcaataaatatattactttgagtaatatcaggaattgtgctaggcactagggttataaaatatatcataaatgaatcgagtccttaaggaactttgcttgttacacttttatcaaagggtcagatggagaaaaaatgcttttactatgccatcctgagtactcggatataaatgtgcacagggtcctgtgggagcagagagaagggtgatttggtttccagggacaagttgtcttgaaggagatggcagtagaagcaatgaatgcataggagtgaccctggagaagaagaatgtggaggatgttgcaggtagaggaaaagaaaagcatgaaaaaacatggtgagtatgaaaaaacatgaaaattcattattattaattaaagtttgggaagggagtggtagagttaaggctcgacagatattatgatgaagacattatgtaagaccatatggacataatcggaagcttaaaatttaacctgtaggtaatgaggaatcatcaaaaggctttatggctaagtgtggcaaaacagtttgccattgaggcaagctggtcaaggatgaaatggggttaagatcctaggcagggaacaaattagggagctaatgaaagagacagtttccagaagatatgatgaggacctggacaagggtgatggtaatagtgaggacaggaagatccatagtgggggcactgtatacacaatgagatcctctctccaggggcgtctgaaagggatatccatgtgagggttatagatacgaattggaataaactgtatcctccccaaaactcacttattgaagccctaactcccaatgtgactgtttttggagactgggactttaaagttgtaattagagttaaatgaggttataattatgacaccctaatcccacagaatgtgcctttccaagaagaggaagagacactggagctttctctctctgaggacatacagagaaaagaccatgtgaggacacagtgagaaggtggacatcagtaagccaggaaaagcggcctagccagaaactgaccatgctggtacctcgatcgtggattccaccctctagaactctgagaaaatacactttttttttttttttttttttttgagacggagtctcattctgtcgcccccgctggagtgcagtggcacaatctcagctcactgcaagctccgtctcccaagttcacgccattctcctgcctcagcctcccgagtagctgggactacaggcacctgccaccacgcctgggtaattttttgtattttcagtagagacggggtttcaccctgttagccagaatggtcttgattccctgacctcatggtccgcccgccttggcctcccaaagtgctgggattacaggcatgagccaccgtgcccagccccacacttctgtattttaagccactcagttggtgatactttgttatggcagacccggctgactaatacagagggttttgttgatagaagtaaaccctaaaaaacacataaagagaagcaaaagcactgagagaaagtctgaagaagcagaaagccaggagcagacaggtgagtagagcaggagcttctgcttggtagttttgcaggatgaagcagaagtcacgtgggttccctgtagaagggagttctaaagcatgtaatgatggatttctgtttctgaggaggctattctagagttgtgattggatcagccaaactgttgtccaactactattatatcctgaatctattttcattcctgaagtctgtgtggtagccaagtttgtttcttgtttgccttgcttgccaatgtggtataacagccacgcccccaccctcctctggcatcaactggaataggccttttcacttgcactctaaaactgccaaacatcaagagtgggaggaagagatgtcaggatgagcagaatgcaaataatgactgcagactccagaaatcttgggatgagatgttaactatccaagattttatttaaaaaatatgaactgtaatacatatataaaatatgaatattttagccatccacattataataccagaaaacctcttgtgcacataatgagggccatctatgtacgacaggaagtgtggcatgatgccgtctctaaatgaagaggggctctttttaaaaaggcaccaaaaaatctgtttttattcctctttatagcaaattggcttagtttaaatgccagtctataaaaggcttcatccacactctcagtacctaccagttgtgaagaaaagaatgaaggaaaccactgcgtgcactttttttctcagcacctgccaacacagggcttgggttttcggacggaatttcataaatggaacaaatgaagactaatgatcctttctttatctctaagccattatagcgccatcaagtggaagacaagattataggatttagacagtccttgcagaggaactggtaagtagattattcttctacctgcttaaggatagtttcaattttgatccgagacacatctgtgtgtgtctgtgtgtgacacagagagaaaccgtgtggcagttcctcccttttgtcttctacattaatgcattccacctgtgcttttaacatccagatgctatcatattttaattatactgattaatgcccgcataagaattacaaatggtaaaccaaccttccctcaaattagcttagtcaatctgtttaaaggcagcacagtgaaatagaacaccaagctaataacatataaaaaaatggaaaattcttcatttgtttctgtttgagttcttttaattaaaggtgacaaaacagccctttactatcagtgcagcaaatgcaatatgcaaagatgaatgcatttacagctgtagcttgcattgctgttttagcattactaacactgttgggaaaacatctgtgaaaaataagatgacagggaattctcatgataaaactggaaagagatgtcaaaagaaatattgccatctccatctttggagagcttcgtgaagaggatcattgtgtgctctagttgctctgaccggagattccaactctaccctgaaatatcttacagcatctttaaatatctctctgatgggtctctggcaaaacaaaacaaaacaagaaaacaggcagggcgctgtggctcatgcctgtaatcccaacactttgggaggccgaggtgagtggatcacctgatgtcaggagttcgagaccagccttgactatgtggtgaaacccccatctctactaaaaatacaataaattagccaagcatgttggcgggcgcctgtaatcccagctattcgggatggtgggacaggagaatcgcttgaacccaggaggtagaggttgcagtgagccgagatcacaccattgaagcctgggcaacaagaccgaaactccatctaaaaaaagacaaaaaacaaaacaaaacaacaacaacaacaacaacaacaaaaacaagaaaacagaaaatcctttaacctaagttaccaagtaatttaaggtgaaataattttctccttggccacttcttgaagaaaagaaatatgaaacatgtattaaaaaaaaaaaaaaatcagggctttataacaaccctgaaaagaccaggaaccatgagttagttgtttttcctgagtaaggacattgtgcagccgagaggtaaggactgcttttggcactggtgacctgccctgaggctttttcagtccatgattgccaattcttccatctaaaaatggagatctcaccacttctcagcatgtcataaggattaaatggcataatataaatgaaagcatcttgaaaatttttgtatattgacctattgtgagtctgcagagataaatatcccaaaatatttttgtgctccaaaatatgagaaggtaaatacggctttacaattccagttttctatcttgcctgctttattatcttcccctcgccaccttttttttttttgagacttgctctgtcgcccaggctggagtgtagtggcgcgatcttggctcactgtgagctccgcctcctgggttcacgccattctcctgcttctgcctcctgagcagctgggactacaggcacccgccaccatgcctggttaattttttttgtatttttagtagagatggggtttcaccatgttagccaagatggtctcaatctcctgacctcgtgatccgccgcctcggcctcctaaagtgctgggattacaggcatgagccaccgcgcccggcctccccactggttttaagcactttaccaagagctttctgttgagactgcatcaatgtcatgtaacaattccacacaaaacttgtttccatgagtctgacgcttctggacaaggacaaggtcatcagttttgggtgataacttctgtaatatcataagactattgtttctaaggtacctactagtggcaaatgtgtgcatgtgcgtgtgagagagagagacagagagagagagagagaaagagagagacagaaaccctttcgagaaggcctccttaaatcagggataaggttatttctgagaataagataaaaacctaaagataccagtgatggcaagcttaactgtgtgcctaatatgcaccagaactaaaccttagaaaacaaaactgaataaagcatatccctacctataaggagattacaatgtcaaagggtaaaatggataattaaacacagtaattatcacataagcactatgataagggtaaccgaggcattgagtgatcatggaaggtttctcaataaaggtgctacctcgtgtaactccttgatggatgacagggagatggaaaaacatgaggagtaggacagtaagaatgcaaggagcaggaaatggattgggggagaaaagggagaccaggaaaagggatggctaatgtaaggcccgtaggtccaaacaaaccaaaacaaaggcatattaaggaatttcatatattccagaatggccaaggattttaagtgtaattttacattgtgtatacattttcatatttctactatatgcatatagacagctacatctttatatacctactgcttggacccaaaacctgattcatggctgtcagttcttccacatataggcaacaagaaaagggcaaatacaacatgcctgcaatgctcaaacggcttccttctgttaaatgcaatcatgaaatgatacggcttaacataaactcattgaagcttcatctttcaagcacaatgtaaagattctagctctattcaatctcagctacagggcaatcacaactgtaactaactcctacgtctttcatcttttgacaatgaaattaaaatattgcttcatgctatagtaggaaagaacactctaaaataaataatcccaaagttgaaataaaactgaaaataacagcagtgtctttctgagacagtggggcagcaatgttaatgaacggaagctttgctacaaactgaacaaacacgcattgattttgaaggtatacggaaagacgactcagataagctatagacatcagaaatttaagaatcaaagccaaaatgagacaatttagacaaggggcataactatttttttttaaaggtgggggatatgcagagaaagtaaagatgaaagttagcattcacttgagatactcaattacagaaaagtcatggaaatcaaacatgcaagatgtttaatgcacagagtgagatgaagaaggatcatttttaaaccttaaattctccctgctcttagtttggataaagaggaattcctcaagtcctacgttttcaaaattatgtctcttaaagaattagtagctttgcaaatcaaagcaggattggctcttatcatctcagtttatctctgtcagtgctcctggtggtggtgacatgctggcctctcatatttctgtaagcctggccctttggattttcccacagtatcagcctaaaaggccaaggagttgtaaacctgcttttaactctccttattccctcccaccacacacacacacacacacacacacacaaacagggtctacctgtcccatggcttccgaattatgaaatgtgccccattcagttcttgcaactcttcccacttatccactctgttcatcctctctggggaatccaatcttgacccaaagagaccaagtaatctttaaaatcagaaactgctttaataactcattagagatagatgaccatctcttatatcacttgagtctttcctttcctcaggcatttctagattttgggtcaccaaaacaacccaacagccatccactcactcctctctacataaacataaataaaatcaaaaccaaaaataaaagcagccaggtgtggtggcaggtacctgtaaccccagctactcaggaggctgaggcaggagaattgcttgaacctgggagagagaggttgcagagatattatttctagagattactatattatcctctgagaaaacacacctgcttgtcctttggaagcaaaaccatagtgtaaaatgcaggttgagtattccttatctgaaattcttgggataagaagtgtttcaaatttttggtttttttggatttcagaatatttgcctatacataatgttcacatgggaaatctgggcatgagcagaaaagatatatcacaaatgaggatgactgggagggttttcttccccctaaagaatgctgaataaactgtgtattgtgtgcttgtattttgaccgcaactcatcacattaggtcaagtgtgggattttccacttttggcatcaagtgggtgctcaaatctttggattttggagcacttcagatttcagattttcagattagggatgctcaacctgtactagtagctgatttttaaggtttcctttgttggtaatttttatggaaagaagaaaatctcaacagatgaaataaacagcaactaaaagtggatttatgttgtttttttttttcagcaataagtaaatgcaatcaaaatgttttttttttttaaaaaaaaagactgtcaaaagtaacacatgtaactaagagtgaaatctttggagagttagactttatagctccaagtgaatgtaaatgctttactaacagtggaattggaaattggataagttcccttgagatagaaatagtcaaaatgctacaggagattccaaactgcttgctacaaaaaaaaaaaaaaaaaaatccttagctttgactataagtagatctctagttcttctccatacaggagatatgtggtcttccatcccagggagaataatggttaggtttctcaactctcataacagaatgtcaacatcaccatctgctcatctggctttcaaaggatgcatatgggctcatcttctcgcccagaatctcctcttgctttggggcttttcccttcagtttggtctttagtatgtactcctaagtttgccaaatgcacactggagatcacagaagactttgctgaagaacagcccagtaatgagttgaattcttatctattcagaggtttccgtgaaaaaattcctctgcagcgtattcaaattgtatagccgcaattatactccctggctgtggtaatttaaacgttattttaaaattaaggcctttgttaataaatactgtttgcttaaaggttaaaaggtagaattatacccttcacaccaaattgcagtctccatgggtccttatctgcttgtattaattcaaagagaagattctgggtgtcatctgccacttagagcctgaagtaaacctctaaaagcatacatttctgttgttgtttccattctacatgggcttaaagtatgctttagaaacatacatcacaactgagatgtgcgtgggcattatgaatagttaagcaggagtgcagaaagcaatatggacagaagaaacaaaataatttcctaacatataaataaattcaaaacctacttgaaatgtagtatatcggaagaacattagtcagggtctctataactaattagctttgcgactttgggtaagacataatctctctggatatttatgtaaagctagaattatgtacgagaaaactacagtttagaaggaaagaaagtaattacaaagtaaagacattgaacataaatcttgaattttaccattaattgaataatggaaagaaaatacagactatattattaacttttatttgtctattttctctataaaattttcaatccatgatttagagatcatgtccatcttgatcaccactttatctctggtgtctagtacagtgcagactgaccatttaatatattttgaaggaaagaccaaatgagttttaaacatattatctaatactataatactcttatggtctcattcttcagttatttgctaatataatagatgcatttgtatcctctgtaatataaaaataggaagggatggtattggttgtagttgaatatttaatgggagaaagttaagcctcaaataagaaatttcctgaaatattaccaatgagaaaatgggtataaaaccttccattttaccaaaaacagaactttttttttatcacaagagaagggtaaacggttaattaaaagcaaattagatgaaataagatgatacaaagaaggtatcccatttaatgaacatgttagatactttagagaatttatttaaatttctgaacaactctaaaaaataaatccaatattagttttaaataagaataaattaaaacatagaaaagttaagtgacttatccaaagtaacataagctgtaagcagaagaattgagatttgagcactgatattactggttctaatgtcagttctttttacagtatccatttcacattaattgatagtctaccaactaccagatgtttcactgagcactctttaggaaggaagggaaattaaatattggcattagttaacgagagacatttctttccaccgagtgtaagtaataggatgaagatacattttgagatgatatgatttatccagaagaaaaagcaaagtttgttagaggtctccaatctatgataaaagcattgtgtaaaatacaagaaaagtaaatttcttaagagtaatgttagatgaaagcccatcatagttaatggtataagtaaaactgcattaattgtcaatggtatgaaaatgttcagataaatcatgccaggataaaacagagggcttataaacaagtcttccagttgggtggtcatcaaaaatgtatgaatatccactgagttaaaactacttactctttggctttgccatcttcatgtttagtgaagggaagcagggcgatttttggtgtaacgttccgcttaaccttcactaaagggttaatcaagaaccattactctaaaaactcaaaacaattctgcaagcctttataatgcctagtttatcccttaattttattatcatgggaattaacagaaaatcctcccaatacaaaataaagtgtgttctttcaaagatatacagaaagaggcagctgaagagatgtttcttcctcacattagccttgggcagggtaaacagaagataaaaatccaaagggacatactgagtaagaatagccattgaatgataggaagaaaacctaaattccttggtcttgtggacaaaatagaaacaggaatgcaaaaagagcctggaacccccagaggaccctcagcatgagcagcagaattatccacaatgattctcatgcatttgtactttttttaatcagcaaaatttagcagcttatatttcaatgagagacagcaatgttttcactggggggcaattctgaaccacaggggacatttgacaatgtttgtagacatttttgtttgttacaagtggagtggtggttgctttgggtatctattaaaaataggtagaagcagggaagccgttaaacaccctaaaattcacaggacattccaccacagcaaagaattaactagcccagaatgccaatagttctgaggctgtgaaaccttggagtagaaggagaatcagcatcaaaccctttttcataggcatttttcaggtttctttgttacatccgactgaaacaggcttgactagcaaatttcaagagtgaccttgtttcaaggtgcatcatttgtcggcatcaaattcacatcctctttcttatttaaaatctaccattagttatttctccctcaaaaggcttctacaatttaacagtgaggacatgttatggctgtgaaatagatgtccctatcatactgctttagatgggaaaagaaacattctgcagtgtttataagtcataaagaattctaaatatctcccactcaacacattcaggcaaaatgatggtataatttctgtgctgggtagcactctttcataccattatgtgtcgtgtgaaccaactgtaggtaatgcactatcttcctttaatcaaatctgcattgtaatttctataaaaaaaatcaattaaacacaaggagcaattacttattttttatcacagcataatttactttcccagaacagcagcatgaaaatgtgaagaaagatctcatctacctcagtgtatttaaagtatgcatatttttaaataaatgcgaatggaacactgtcaaataagcaatatattatctctatataattccccatttacatcaactttatggatgggtaatatggcttaatagcaaaagcttaagatatctttttgaaacacaattttttcatagtcaatattatggctgaaaacatttttcagactcttacagtgaaaatataattagacaacaatttgctcatcaacctcatcaaatcactttcataaatgacctacttaggtgtcaaataaacctaaaagaactatattttttccaagccttacaaatccatccttgtttacatttccctacctatctctgtgcattactatcaaggaattttgttaactacatgcttagtagttagtaggagatcatggagctaatctagcatccttacatctgggacctgtagtcttttcagtgaaatctattttacactgagcatcaggagttttttaactttatgtagataagatttacctggagggtttggtaagtaggtttggagagcccccacatttacattttaacaaggtctcatgtgatgctgacgcttgacccataggtctggaaactacccaagaatttaaaagacccaattttcttcatgattcagtaatctgtatgtgctcttaaccactgtgtcagcggcatcagtttattttttctcccttacttttatgttatcaacctctgtgctcatcagttaaactaaaagatcaatccactccaacctggaagattgcattttctttccttcttttcttgcctcttcctgctcctccctttcctttctttctcctcctctttcttctctccctctttctctctctttcacccccttcctcactccccaattccctccctcccatataattctgtaactctgatctctttcaaatccagatgtaaatctcactttggctgtgaaatcatctctgatttaccccagttgatacacaattctcctccatgtggaactgctcagtacttatgaactcacttttattagacttgtttgtactccttgcttcattaattagtaaattaaagcctttgtgtatccctatggtgcatggtcttaattatattattatactatttgttacatgcattttttttttcctttttataacaatgcctgctggaatgattggctcacaatcagtgcataataaatattattagcccaataatgtactgagtcaggggctgcaaagcagtatttcatcacgcaatgacccaaggttcacaagaaatctaattagtgcttcaactaaagccaccagtcaagtctgggggaaactggctccaaatcacaatgctgctttagtttcctcagtagctgctgatattatcctattaatgggggaactttatggaagaattattaaataggcttggtctggttgctaggctgtctgcgtgactataacagggattctcagaagccatgttaagcatgttcaaatactcctaaaatggctgctggtgatagagaaagtagaattctccaaagttaatttttatacttctttaaaagcctggtttgctctaaaggaactcataaatgagacatattttaaccacttcatcatatttgttggatcactctgttctgaacataagcaattttggaatgaaggccttctggccacacgggtaatatatgtgttgcaaaaagtgggacaccatgagaggtatggaatgaatgaacccgctctctctctctccttctctctacttcaccactcccaccccaacggccccatctaagatctggatgactaatggaaggttaattctctgaggcctaaaggaaaatttcacactttctcagtagttcaaaagtttggctttcccctaagtgataacatacaaatggagtaacagcagaactctcaacattaaggagtttctgtgaaggtgccaaggcatttatttaaaagttgctaatcagatttcaaggcccaaagtcccggctccctcacattagtgatcagatttgttaactttaatttttcataacaatcccataaatttatgtgtttatgagttttttagtattttagtccatttgggctgctacagcaaaacaccttcagttggataatttataaacaagagaaatttattgttctcagttttggaaactaggaaatccaagatcaaggcaccagcaaagtttggggtctggtaagagtccagtctctccttcaaagatggtgccttgttgctgcattcccagaagggaggacactgtgtcctcacatggcagaagggcaagacagctcccttcttttataagagcacgaatcctattttataagtgcagagccctcatgacttaataactttccgaaagtccccatctcttaatactatcacattaggtattaggttccagtatatgaattttggaacaatattcagatcatagcaattagtttatttttaaatttttttcctgattggttcataattagatttattgttatatggaagctgaggctacagacttttttcctctgtatcatagacaagatattagaaatgcagcaacggcatttgcaaccaatatccaggtgtagacagtagttctcaatcactggagatattgctccccaggagacatttgaaaatgtcttatgacacacttgattgtcacaaagatggaggggaggaggaactctacagcatctagtgagtacaggccaagcatgatctcaaacattttaaaaacacagaacagcattcccaaacaaaaaatcatccagcccaaaacgtaaatcatgccaatactgaaaaacacggagctagatcatgggtagactttggagacaggttaatgtagactcttctacatattatctatgcaaactcgggaacactaattaaccctaacacctcaatatcctatccataaccagggtttagaaattattccagcgcaatctctggaaaggaccgaatgatgtaatttatgcaaggtacctatttcaatgtcagatacagagcaagcactcaataaatggtagccctggcatatcacaggcactccataaatgttagcttcccattagttcaaatatattttgaccagaagcttctcctagagaaactgtcattctaagacaaactaacttcagtgaaaatgtccagaagttcccagtgtaagctaaaagaacagttgtcttgtacacaaatatttaggtgatcaggcttctctgctcacataactcaactatttaaatatatatttgatatttgttatttgaggcgggctggtagaaattgtatgctaaaagtagatatttcctatgattctgtagaatatttaccaggagaaggaaagagaatgcttaattattaggaataatcatccaataaactgttcacttgaaagaaaggaataaggagaatatgggggaaattctagttatatataatcacttaggaaactccaatagcagtaaaagcattggttaatatagttgttatgatctcgaaaatgcagaccctcaaaatcccaaatcaatattttcctcaatagtcaaaaagcagaatttgtttaaaaattattttgtataattagaaaaagcttctacctttcttaaccagaaattgctttttaagtctgctttttcaagtattagagtactcataaatatttcagaaaagccattcagtttcagcaccacatgaaaaaggaatgataactttatatgtgtatctctgattcaggacacattttctgaaccacccatcatattccatggacccttaaaattctctggttcagcaagttaacactgcccacttcaccttaacaaagaaaataagaaagctttaggaggcaaatttaaagaaggagaacattctccctgcaatataaagaccatggaggctatacgctgattgatatttctgtacaaatgggtaaagaaatatcagaaatgggtacagaaatatcagctactctactaaagtcaatgccgtgtctcaaatgctgcaaaattacagcagtctgtatcaattctcttttgagcaatagtttacaaagccattcaaaaactgtttaaatttttattaaattcaaattttaacctttaatatcagcagattagaagatcttgctaaaaaataatttgagaagcattttctacataggcacttgagttattggcagcaattgctgaaaagttagcatttttatttctctgttgttataatgtgtctaaatattaggttggtgcaaaagtaattgcagtttttaccattgaaagtaatgacaaaaaattcaactacttttgcaccagcctaataatttggtataagctgtctatctatatgtgtatctaccatctatctcagtatcctctttcttgttggacatgaaaaaaataatataagctaaatttcctctgttcatttatatatgccgtgggatgatactgcattggtaaatgaattcatcggtcaatggatgagttatttgtgtactttgttccatgaagacatattaagtttcacctaaatctttcactatgtttggattccagtacaaagtagtttttgagatttgagaaaggacaacaatttaattcctatacagatggtgaaattgaaaggcagaagaaacacctgcattttggagagatggagatgagccacaaagtagagagtcagagtgtgtgagaactgtccaataaagccacccaaaatctgaggtgggctgggggatgtgttcagcacatagtacagacaatcccctaattacagttgttcagcttaggattctgcgaccttatgatggtaagaaagtgatacatattcactagaaaccgtacgtcgagtacccacataaccattctgtttctcactttcagtacagtattcaataaattacatgagacagtcaacactttattattataaaataggctttgtattagatgaatttgctcaactgtagcctaatgtgcgtgctctgatcatgtttagtctaggccaagctatgatgttcagtaagttaggtgtattaaatgcatttttcactgggctgtaactccatggtaagtcaagaagcatctgtatttgtttagaaaatacttggattcaatttccaactctaatcttgtgacactttaagacatcctcaattacaaacacacatacacacacacacacgagagagacagagacagagaaacacacatgataatttttttaaaaattaaatgtacttaaatttaaaagatgctgtgcacataatttgtggaaataaatgagagaaatggtttcacaaaacaaatgttgaagaactgtagttatgcaaaaagccaaaagtcagtatttcgtgacatactctttggcctctaagcaggaataacgcactgttttaatcttgtcattttatccattttattttgacccattgcttatactgagttcaaaggtattttgactttataatttttctattttcaatttcattgctgatttgtcaggaaatctctgaggagcccagttttctcctttaactaatagagataagaggatcactcttcccgtctcaaatcatcctctattcacaccaggttaagcctcactatctatatttacattgcactttgcatttttttctatggtacgtttcataatttgaaaacattatttttgtactaatttatctatgagcgattataggacatgttgtaggaaccatgggtgttttgctaacagatgtaggccaagtcaatgagttgctactgcctaactcagtgtagtcacctatggaatagctataaaatgaataaattaataatgaattttttttttaagacaaagtttcactcttgttgcccagaatggagcacaatggcgcgatctcggctcactgcaacctccacctcccgggttcaggcaattctcctgcctcagcctcctgagtagttggaattacaggcatgcaccaccacgcctagctaatttttgcatttttagtagagacggggtttcaccatgttggtcagcctgttctcgaactcctgactttaggtgatccatccgccccagcctcacaaagtgctgggattacaggcgtgagccagcatgcctggccaataatgggattttaatagcacttgttacaaaaatcttcatttttaatgacatttggaactattttttaattcttaaattgtctaacattttatagtaaactttattttacgtcactttctaatgtacgcaagcataacttcagaatttactgagattttttgaatgacttctattaaactaatttaattgcataattttctacgtagcaaagttatttttttccaatttttaaatttctctgattctttaaaattagcattatcaattattttttatgcaagtttataagaagcaactgattcactaatcaggcttatttatgtcaaagtttctaattatttccaatatagtgaggtttttagcttaatttttattagcatttctacaaaactcaatttttctgagtcaaatcactcagattctatttttttgttcaggataaaaatgtacctatgacaagtagtattgggttttataaaaccataatttatatctgatgattatgtcaatctgcaatatgtattgtgaatcactttatttcttggagaaaggaacagggtaaaagtttcagactctgtgaatatctcttagagaaaaaaatatcatagttacataatgatgcaggatctgtggatataataaggtctaaatggcaggactaaatgcgaggactaaagcattctatgcttccacattatacctatgacacaagctttgatatttaaaaataaacaaaaacaaacccagatactcccaaaatatgcacaaaaaacttcagcttttataagaaaaaaagcaaatatcagtttatataataggtttcctaaatgttttgtgagaatctagtttttgtataatatttatatttgtattttcattatttcaaggctgggtttgatgtattggaagcaagggcacagatttggtaaagcagtgaatgcttccaaagacaaaaatttatttctgatataacttttgaagcaatgtgaattttcttctatcaagtttccttaaatcgaaatcaaactataacaatatcttggtttctatgggttctctgtcatgtgcatcctcaagtatatgtgaccaaaggtttttaagccataatatcactattatatcatcacctacctaccataagaatgctaaaaattgtcctctttgagattttgatagtttaatatttctgtgtggaaaaaaaatcaaacccaacaaaagaaaataatatatgataaagaattacaaggccttctatcccaccacttgttataggtttaatggtgtggccctcaaaaggatacactgatgtcctaaccctcagtgcctcagaatgtgaacttatttgaaaatagggtcttggctgggtgcagtggctcatgcatgcaatcccagcactttgggaggccgaggcagggggatcacctgaggtcaggagtttaagatcagcctagcaaatacggtgaaaccacgtctcaactaaaaatacaaaaattagtggagcatggtggtgggtgcctgtaatcccagctacttgggaggctgaggcaggagaatcacttgcaccctggaggcagaggttgcagtgagctgagatcgcaccattgtactccagcctgggcaacaagagtgaatctctgagaaagagaaatggaaggaaggaaggaaggaaggaaggaaggaaggaaggaaggaaggaaggaaggaaggaaggaaggaaggagagagacagagagaaagagagagagaaaagaaggaaagaaagaggaaagaaaagaaagaagggagggaggagggagggaaggaaggaaagaaaatagaaaatagggtctttttagaggtaaaatcaagttaaaatgaggtcattcatgtgggccctaatccaatatgattttttgctctgactaaaagaagaaattgggacaaagagatagacacacacagagggaggaggatgtgaaaatacgcagagaaaccatgtgaagacagagaactggagaaatgcatctgtaagtcaagaaatgcggaagactgcctgcacaccaccagatactaggaagacacaaggaacgatttctctgcagatttcagaagcagagtgaccctgccaacatcttgatttcagatttttagcctctacaactatgaaatgatagtttcttttgctgtaagtcacccagcttttggtactttttgtggtagccctaaacaacaaattcaactctttttccagtattaacagtagtaaaattaaaacaaggataataagaaaagaaaatctacttttctgcttactcttataaaatctgcctagcactcatttctgctgatttgattacatttacatacaattttaattaaagaactactaataaatgtttcaattacaggaaaaaatacacttaatgaagaaattgtctatgatgatgatctgagaagccttttcagaaaatgttgttgatatatttatttttcttttctactattacagagaagactggaggagaaactaattccaagcccccatacatgatcaactgagtcataaatccttccccagtgtaggtgagagttcacagatactactctcataatctctctagtaagtctttccatttctcaatcatttaagcagtagaggacactgtttttatttctttgcattttcaatgtataaatcgtgcaataacacattgttcaattttttctaagttggtttaaatgctgagaattctcctgagttctcttccttggcagaaaaaataaatttctggaatattttcaaaagcatatccttgcaaatggaaatggtaagcttaataaaccatgctgtttgaggtcagccttgctgaatattgctcctcatatcatctttagttatataaggtcataagggatacttacgttcaagatcataaacaaaatgttggtgtagctcagcaatttcttttctatgcttaagaattattttcaaaaacaatatcacttttaacatacttctgattctcttgatgataaccccaggctttgatagtttgtttttcttttcagcttttgcactgggcctttgacatatgaatatacctgtatcactctcataaacttcagaagctttgttgcattttccttcaaattctctctgggtcaacacttaaagtataatccattaaccaagcccttgcaatatccacagtagaaaatgaagataagtaaatattgctgtgattcttttactgacattttttccaattcttacccctttcaaacagcgaatcagttctcgaaatgaaatcaatcttgtagacatgattaccaattataaaaagatgaaattttcaaattttattaattggatcaatttttagtatcattaagattaccttgctttcatttacattaggtgaagttatggtatacaatgacactaataagcaaaggcgagtttaaaataacaagagctaccatttattcaatgtggtattatgtggaaagaaacagtacctgatgctttgcaagcattatcttgcttaatttgcttcataaaactatgaaaaacatattatttcagttttataggtgagggatgtaatcgctagtacaatataggaaacacatgtcagagccaagatttgaagttgagtctctcagactccaaaatctgaaactttttcaaatatgccgtcttgttttccacactgatgcttttgacccttgccataaagtcagcatgacctctttgacaatgtgaatacagttaacactgtgcactttgaacaaaagaaaaggaagtaaaaggacaagaccattttcaggcaaaatgaagaatatgcaaaatgtcccctttttttctttctttttgctgatttccttcctaattccctcctcactactcccacctctaagtcaaaagctttttcttctaccttcaaacatctgcagctatgctatttcttaatttacctatcaaaaccacttttctctccaaccactcttcccttctcccaatatacttttatatcagtagttgttatccaatgactatgaatttaagtcttttgtttctttgggaacagtgtgtgcatgtaagaagaagcagtacagtataataaagaaggcaggtttgggagccaggctcttggctgcatcactaggtgacctttttgtagcctctttgtgcctcagtttcatcatttgtcaagtagtgcctatcccagcacttactgtgggaattaagtgaagtgattagaacaatgcctgccacatagttggtaatatatgtgttagctgttatccaaatgtatctttcattgaattaaaaatgtaaataaaatatgtcttctactaaaggaattgcacaaattaccatgaaaaagtaaaaaaaaaagtattgggattttgttttattacacctctaaaaacatattacgtgaggactttagacatataaggttacttctatgaagaaacagaatggaaaatgtcaagtcatttaagatgctcacttattacattaaaatattttccaggcaggtgtggtggctcaagcctgtaatcccagcactgtgggaggccgaggtgggcagatcacttgaggccaggaattcgagaccagcctggccgacatggcaaaccccatcattactaaaaaaatacaaaaattagctagatgtgatcccagctgcttgggaggctaagtcacgagaactgcttgagcccaggaggcagaggttgcagtgagccaagatcacgccaccacactccagcctgggtgacagagtgagactctgtcaaaaggacggaaggaaggaaggaaataaaatattttccattgattacccatgctttttattttgaattaatagtgttcgatgcattattaaaaaatagaatttaaaataaattgtagaaaatatggagagaaatatttatgtttcaaatttcccaagagtagggctttggtgcattataatcccctgatagctggcatgatccactttgttggttacttttacagggtccttctactctcttccttagtctccaggcttttaataatcacacagaatattcttttcactacagaacatacctacctatattttggctgtttctcaagctgacttatttcccagacatattcatcctttaagtacgcaaaaatgactttcataatatttccattgataggcaatacacaaatatgtttaaatgaaggaataatttattgcattgtactttaaaatccacattccttgctatacataatctgaaaccactgtaaaagtacacttttttaatgcaacagcaggcatacattttttccagtttgatgtaggcaggacctcaaataatgtcaaagtaaagatggtcaatctattcactattggaggaaaacattcactgtgtatcagcttgagttggagaaattacagttaagaaatgttttgtaactaatgatggcttccacgtttgtaaatcaatgactcataatgtatacatgtaaacctatatttcattattttgttagtaaaccccattataacatatactttaaccctattattcaatataaaatggcaaatgcatttttatgattcatttgtcgtattgttattttactcaagatttgttcaaatgttttactttttgtaagttaaactttctatgcttaaggagtatatagctacaagaaacagataaacactaaaaattacagttctaagacttagttgaatatctttcagtaatttcccttagagatatggtcacactgaccaagctacataaatatattttttaaaatttagtataccaatgtgtctattcatgataggttgtgtttttctccttgtacctaaaagtttgatggtttcttttccactctgtctctctctctctcttattgagctacctcgtactagtcctgcctaaagttttatattgtttctattctaactatactcagaaatacataatttgaaacttgaatataacctcttttgtatttctaatttttggtgagcattattctggttgttagccccttgaaggcaggtactttgtgttacattcccaatttatctgacaaaatatttagttcagcataaataatatgcttagcattcaagatataatttgtgattaatttattttgctttataagaggaattctgggggtagcatacacgccaatcatccttgaaatatatataaactacagtgcctctagagtgttatagaaaagccagtggattaaacatcaaaacctcttagagtctctgaatcatattattctattacttctcttattttctttatctatctttgtctcctattataagaaagaagacataaagatataaaaaacttttcctacctctgccttgaagaaagtttaactataaccttcataattatgaccagggacaagttaatgacagattccagctttggtatggctaaggtagaccactcaagggatcaactaactaatatcaaggacagtaaggttcttaccccattcatgagcttcaagtgttctatctcaccccaaaagagattataactctttttttacaatttcattttataatataaaccactatttaacctatatttctgaatcactggactgaataattttatatcaatttattccaactgctatgaatactgaaagtgcatgaatggaagatggcggcccatgaggcaggccttgttaacagtgtttccccagcagaagggtaaaacacaaataatccctccagagaatcaatttgcaaaaggagctcttcaaggttctgaactcctttccttgctctgctgtactaattagatctgacctaacaatgattctgcttatcttggcgttgtgtcactacccttagctatactttaaattaagaaactaacataatttattttgagttactagtacaaaagaaagtaatcttcttgatgggattcagtttgaggcagtaggttctgtataaaaatttttatcgtagatacaattgtcacctgttttctagaaaaaatatattaaatataacctaatgaatatgccaaacttactaggtctgtatttttgctttatataaaatgtcatcaaatttaaatataattcccaataaagtccacatctctgaattatctattacttgcattttggggtgtgtttatactacctagaatgttaacccttattgtgccttaaatgtgcatttgtaaaatgtaggcacttttataactatgagtgaggctggtaaggtagtgtttaggattctccatgtcagttagtgaaagtaagaagtacagtgttaaaactattgtaaatagtttccggggcaagtatagactgagtccatccagaatgactgtaaccaatttgacatcatgttatggataaagaagcaatgaaaaataaaccaaatagctacattatatcatattcttaactttcataagccatgttttatggaaaactttttagttttctcaaaaggctaatatatttcaatattttgaatacatcattgttaattttgagttggcagaggtaaattaaccaactaccattacgttttaggattaagagatatagcttttaataaagttactgaaatgcaaaaaaaaagagaaactaacataagttaaaattgattgtacatagtgtcaagacagcaaactcaaatgtctaaaaggaccagggagaaaatgtcaataaataaatgtttgtgttcaaggaaacccaaaactagagcaattgagggcccacacaatctaagcatagtgttttctgactcttgatgcatcaataaaatacttggcctctgataattttattttataagataaaccagtatataacctatagttcaagatcactggacttcacacttttataacgatttactcaggtaactaaaatatttcttcgctgagaagatcaccctactgcctcactttcaacacattaattaaagatcttagaaccataacaagctttaaggacttactaaacaattaggcaagaaattacaattttgccagtcatcccaggtaatcataccatcctgactcataaaatttccttatgaacatattgacaacttttaggaaaaaatctttctaacagactgcttgggaaaattcataatgtctctggcctggtcacacagcttaagtactttccgtagaaaatattcatgggatttatagaaagtcagtctacagtgtttacagattaagaatcagacaatcagggtcctcttcatggaaaatgaggatctatttacagtttatcaataatcagagatgctacgaagttgttagaatgagctaggtgtagccttgaggacttagtaaaagtcctcaaaggaaacttaagcataagcagagtaacttctctctgaagaataaatcaggatacttcctgatgtctaccgaaggtcccttgaagccataagcccaaacatttttaaattatttctgtcccaaatcctctcgctaaggaattaatgtcatcctttaaagatttagcatcatatgaatggagaagagccaggtaggtgctttcctagagagaaaaaataaatcaaacacaattcatactttattccagaaattaagtgttaacatgtcaaatgcttttgtctttaatttgaatgtctttcccttcataattatgtagagcagaggtttagtatttttgaggctattaaaattcctgagataaacttgatttttctctatgccgtcacgctccagaaaacataagaagaatgttaattctaacctaaaagaacccaactacttctgtggataatcagtttaaacatccatgggtcagaggaggggatgacagtttattgtgataaacacatgtctaagagaaccagatcaaggtcactgacatgtttaatattaattgctaaacaactgtcagatggcaatggtttgagttcaccacctctcatgagttgaatccaaattgctctctgaaggagaaatcatctactaaattctgttctttcaacaatgaaaacaggcatacctgtcaattttctatataaaaaataccattgtgtttattcactcacgtggattttcagctctgccaattcaatttcttcactgaacctactagtatacgcctcttcaatatagtcacgttcaaataaataagagtaatattctcattgagaaagggatatatacctcagataaattcattgttccctcttaccctctgttgttgataaatttagtttccaaacattctaaagcaatcttttgaaatcatctgttggcttgagtacaaagaacatgaggtccaactaattccaagcatttctttaatatggtaaaggtgttgctttgattgttactctcagccacgaactaccattggatcatttaattccttcaaaagcaattgaaggactggcttcaaacctttcaaaatctgttttcatatctacatatactgagaggaatagagagaagtttctgaataaaataataatactttgcagttctctgaaacttgagagggaaccagagaatgtttattactgagttttaatgtcttttaaagagccaacacctgatacttcaaaaacgttaatcactccaataaacattttactcccagaaattcatcttaaatccatcttataacataaacaagcctagtaagtagcattattaggagaaatttctggctgagttccacacatatattcaacttcctgaacaccctctaaaagcaattttaccttacttgacacaatacagaaattaatcagcataataagtaagctaaaacttcaataaaagtgtttgcatcttgtccaggcaggtggctcatgcctgtaatcccagcactttgggaggactaggcaggtggatcaagaggtcaggagatgaagaccatcctggccaacatggtgaaaccctgtctctaccaaaatacaaaaaatgagccagatgtggtggtgcacacctgtagtcccagctactcgggaggctgaggcaggggaatcagttgaactcgagaggcggtgattgcagtgagctgagatcacaccactgcactccagcctggtgaaaaagtgagactccgtctcaaaaaaaaaaaagtgtatcttaatttgaaaatattcataaagaaaagtgtaccctggtaagggggacagataacctaaaagaattatagggggaagagttttacatatataatgatcacattttaaaaattatagttgacctgcagataaataaagtatggtgtttttgcctttattccttaaatataatacatatcctttctctcaatgaccggctaatccaacactgatgattccttgaaacatccctgtgacttaaagtttacaatttctaagaacttttcctaactcaccatctctcagttattcacacacttaaattttcttttatcctattgaaatcatgcaagtattgtctgcaaccaagataggtaaacatatcttctagaccactagaacacatggctgttttccagatatacaataagtgatgtcacagacaaagaatcaagatacacacttctctttaccactgaaaatgttcacctcacatttttatctcaacttaggtgggtgtgtttttgttttttgattttgtttttcctacttatgaaaatagtgccaaagatcttcagttggcactccaaagcacagacaattgcaaccaatgttctagagttacttctgaatattatcctagacaagtagcaggagcactgacatgttttcataagagaataaaagacatacaaagatttattatctggcttcataaatttaaagcaactgtagtgccttgaatgtctttgtataaacttttatatgactctaaaagaagataaaaatctaatagagactttcagaaggtcaaatatgaaagatgatcatgtctaatgaataaattgatttctgctggagtaaataggtcacaattccaaaaagaatctgtattattttttgacagtgcacctaaagtaaaaatgtggctccatattatgtaagattttggtacaatatttaaaattctaaaatcattaagcaattccaacctatacagaagtatgacaccttgggattatctagactatatggctaactcttttaattgtatacagatgttaagtcttacctctgcatgtgtgcattgagaaaccagatgaaaaaaaaaacttaactgtacttttcaaaaaacttggttagatatttttatttaaacatttggttttgtacagtatacatttaaattacattgcttaatgaatccatctgaaaacagtcactggttgcttctgtgatttgtgaataggagaacatataaatatagcagaatgactttgtctagcaacatgttcttgccaagataattgggaattaaatatttaaatacatggaaataatatctttgcggttacatatgtgacttccaaatcagaccaaactaattccttaggaaggccaagagatagtgaagccatagcatcagagtgacacccagaaattacagacgacaagcattatgcaaaggcatagaaaatttgagattttggttttaagaaattttcctctttgtaagtcaatgtcttagtaaacaggaactatgtattcattacaaacatattgatagatgtgtatgtgtgggcattcatgtgtgtgtatacatgactataattcacaatttaatttgggtagataaatagatattgtatagatccacatatactttcatttggctatatataaaatatatatacataatatatagaatttcatctggttattatattaatataccataaataataagagtgtgtgtgtgtgtgtgtgagcgcatgtgtgtgtgtgtgaaatttagctataaactttgagaggggaaagagaaagcaaaaaaaaaaagaaaaggaaaagttaaacctcagaagagaatacactgatctagtgagtttttttaaatcttgaaaaaatggttttaaatttttgtttgatacttttgtaatctcaaagctgtcgcaataacatatagtggttttgaattgaaaaataaaaagataattgcctgcgctcagaagctggagatcagtttgggcaacacagtgagatctcacctgtacaataacatattttaaaaaattagccattggagcagtgcatgcctgtagtcccagctacatgggaggctgagtcgggaggatggcttgagcctgggggactgaagctggagtgagccatcactgcctcattgcaactcaagccagggtgacagcaacaccttgtctcaaaaaaaaaaagatattaatggcttaaatatgcataatctcatgtttgttaaatgatgcacagccatgaatttactatcaataaatatttttaccattttcttttttgttatcttttagatctccatcaaaataaacataagtaaattaattctttatctttacttttgcactatcttctctcgtttatagctttatcttttcaatcagtttctagcttcctttggttttattagtaatgtattacatttgcatagcattatgtattatattgaacaatataaaagtgccttttataagtaaaaatcgttgattattagcaatttcatatggcttaaacttaactcttctcaaagtgcatttttatgaattccctcatttgatcatcaaccttgttataagattaatactcaggttacacaaaagaaaataaggtttcaaagagttattactaagtctgaatcagctagatatgttaaagtactggtgcattgattgtagattaaagatgtgaacatgcatatacaaaggcattgtcctgaaattggttttaattaaaagctcaaaatccacatttccatcttcccgccacaatctcttaccccactaaaaagttatcatgatgattaacatggggccttacttcactgaactactaattattcttttcagtgcttcttttattattatgactttaacaatacatcttctgatcttactaatatattttttattaagaagcttagttgtttctaccaagattaaagaggagatcatagccaagtttcttttaaaaatgaagactgcttattcttagcaagaggagaaaaaattgagggcaaaattttgtggaaatttaatttgcctcatttgtccacagtaggtaagtatggcaactgtatgcaaaatgcagcagccacgcatttcatcagtgataatatgtgactagactttctaccctctctgtttgtttttgtttttgtttggtagaggtagcacctcccagtgttgctcaggctgttcttgaactcctggcctcaaggaatcctcctgccttgtcctcccaaagtgctgggattacagatgtgagctgccacacctgcctttcttctcaattttttaatcaatataaattataaaatgtggttcacaactaaggttgaaaaatatctagtccttcaccccttaccccttctcattccccaaaccctgtgaatctactgtaaaatgaattcataaaccaagagtcattgcttttttattctactgcttacattttacttggcaaacacagaaagaagttgggtagtacctcatggaagaacaaaaaagaagaaccctggggaacaatttctgggagtatatcataccacatgaaatctggaaaactccttcattctcatctgtcttttttccattctaaatcaacacactaattggataaaattttgcccagttaacttatacttcctgcaaatattacttcaaggatctcacttaaaaatgtaaaataattaaatccccccacaaaaagaaataatttaaaaatatacaaaggtatttgatacattttattcttattctctcaaaattattatattttgagcagaattattatattgaaattctgtattttccttacttagcattgcactgggaataagctggacaccatctgtttgattcaattgtttacctcaaaggggaagtaagttctagaaaacaactctgaaaaactgtgtagatgaactttctgattctacgacatagaataaggagctatatagagaattcttagaactatgtcatagaatcagaaaatgtataaggcagaattcttagaattatgttgcaatcagatgaactgacatactcttttttttttcctttttgcctcttcgctttacaatcaagttaaaccaatttaccttgactgtgtttgcactattcctacttcatctttattgagtaattatgttccttctcatgacaacaaaactacattttgaaaccttctcatttaaagcaggtacacaagacaagacagacaccgatctccagtgcagaggtgcattggacaatgtgacaagggacgcagtggtaattataaaagatctgttgacattatgtcttttctaaatcccattagaatgatgcattttaaacttattatttgatcaggatgaggagagtaagataattaaaatctttacagtacctatatttcatatactaaaacacagtaacaatatgtgagaattatatttcaagcattgggtcatttctgtgtcttataagtctctttgctatttaagaacccatggtatttttttatttctatttctatttcaaatattaaaatgtttatacccatatgtctatttcagaagaggtattgtaaaatgatttaaaattttgtggtcccttaataaattctatataaaaagcatagattaaagtggtcaggactatttaaaaaccagtatttgtgtgtatgtatatgtgtgtattttaagagagtgaatatccatgaaacatatcctcataaactggcctaactggtcttcatagaaaagcattattttcacgctattttatctatagaattaattgttttgcatagtcatagaattttctatatacaagaatccccagtgcccatcttcctacaagttaaataatgcataagtgtatcctgaaaaatgctagaatatctctcttcagagaacccatgtaaataaattagctcatattcttggaaaacagccttgctgtgtctgtgtgttctccttcaccacacctggacagacctcaactcgtaaacaaacatcctaagatcttaagtataattagtgcaaccaaaacacttgaatatcaatattattctttttaattgcattagcttaaaatattgtatctttttgttgtctaagaaccagagccctatggttttctcttaatgttaaattgtctataataatgagtcaaagtcatattagaaaatattagtactcacatggccattatctattatgccccattgatgaacgctttgggagggtgatgttaaatcttcttctattttatttaggaatctcattggatatcatagcacagtctacacatttcagtgtctcctgggtggcagacctcacagaatgaagccaggagccttatgctgagagaataggaatgttcaatgggttcttccttcatcaagaaaaaaagcacccagaaaacaaatagctaacagccatcttgaagctatcttgtgtgcttgtctcagtaaaaaaactaaacagaaggaggaaaaaacaaacttgacatggttaaaaagcagaggctgctcatctggatttatcttgcgttatgcttttttaatcaaaaattcttcaaagcttactgattgtttggttcatgaggtgaagggcctgtatcttcaaagaaagaagaggcaagatctgctaaaagagaaagcctctcgtgatgatgtacttactgccactcagaccagaaaagattctggccctgatgcagttaatcacttgggccatgagttggtcactgctgtatcctacggagagcctgaacaagtagaacttttgttgagtcattcaactgtagaatttctgcttcaaaggcaacaaagtcctttcctccaagatattaaaacatagactaaccaggaatgatttatgtattttaagatacaaataatacggatttttttaacactattactaaattatgtttaaggtctttgagtttaaaactgttaggaggactctcaggctatataaattacacagggctctcggagatcacaaactgtctaaagaaaaagggtcatgaggaaggcaccatctctccccatgttttcatgactgaatttccataatttatttagtttctaccaatgacagaaggcgggtggaggaaggaacaagaaagctatcttaaaaggagatacaacagagtaaatattttcccagttagaatcttagtgactttgaggggattaaaagaacctactgtgaataattatacatcaataacttggataatccagaaaaagtatataaattcctagaaacatacaacctatcaactgaatcatgaatataaaatctgaacagttcattaactattaaggagattaaatcagtaattaaaagcctcccaaaaaagaaaagcccagatgagatggttgcactggagaattacacaaaacaataaaaaaaaatagtgctaattcttctcagaattttctaagaaatagaagagaagagaacatttccatacttattttatgaggccagcattgtggtgatagggataccaaagctagacaaggactacaagaaaagaaaacaacaggccaatatccctagtgaacacagatgcaaaaattcacaacaaaatactaacaaagcaaatttaacagcatattaaaagtatcatacatcatgacgaagagggatctattcctgggttgcagggatggttcaacataccaaaagcaaatcaatgtaatacaccacattagtagaataaagagtgatcatctcaatagatgcagggggtaaaaaagtattttactaaattcaaccccttttcatgataaaaacacttaacaaactaggaatagaaaaattacttcaacataataaaggccatatgtgaaaaacccagagctaacaacatactcaaaggtgaaaaactaagagctcttcctggataatcaggaacaaggtattaatgctcactcttgccacttctattcaagatagtattggaagtcccagctagagcaatgaagtaagaaagataaataaaatgcatcaaagccagcaaaaagtaaaaaaaatctctgtttgcagatggcttgattttatatgtagaaaaccctaaagactccatagcaaaaaaaaaaaaaaaaaaaagttggaactaataagcaaaaaagttgcaggatacaaagtcaacatacaaaaacaattgtttttttttttattcctgaaaaaaagatattaatagtttgataaggattgcattgaatctgctgattgctttagatagtttggacatcttaacaatattaagcattccaatttggaaacacaggatgcctttctatttatctgtgtcttatttaatcagtatataagttttcagtatataggtctttcaactccttgggtaagtttatcactaactgttttattatttttgttgatattataaataaaattggtttaattttttatttttttattgtatatatccatatgcaaaagattgaaactggatccttatcttacacacaaaaatcaactcataatagattaaagacctaaacataagacctgcaactgtaaaatgcctaaaataaaacacaggtgaaaagctttaaaacattgctcttggcaatgatttcctgaatacgacaccaaaagtacagaaaagaggaaaattggacaaataagactacattaaactaaaaagcatatgtgcagtaaaggaaatgagtgaaaaggcaatctatggaatgagagaaaatatatgcaaaccatatatcttataagaaatcaataaccaaaatatataaaaaactccataactcaatggcagaaacacaacttgattaaaaagcgggcaaagaacttgtttagacatttgttccaagaaatacaaatggccaacaagtatataaaaagatgatcaatatcagtaatcaagcaaggaaatgcaaatcaaaaccacaaggaggagggaaagcaatgcgatatcaaccgacacctgttacgatggccataaccaaaacacaaaataacaactgtcagcaaggatgggaagacattggaacccttgtgcacttttggtgagaatgtaaaatggtgcagccactgtgtgaaacagtatggaggttcctcaaacaattaaaaatagaactaccatatgattcagtatttaccatgtgatttctggtattcacccaaaggaactgaaaactaggaccctgaagaggcatctgcacttctgtgttcgttgcagcattactcgcaatagccaaagggcagaaacaacctgtgtccattgacagataaatggaaaaagaaaatgtggtatgtacatacaatgaaatattattcttccttagagaaataggaacatcttgttatatgctacaacataaaccttgaggatatcatgctaagtgaaagaaaccagtcacaggagacaaacattgcatgattccacttctatgaggtacctaaaatgatcaagttcatataagtagaaagtagaacagtagctgacaggggataatagggcatagggaagatagggagttgctgttcaatgggtagagagtttcagtcacgcaaggtgaaaaaagttctagagatcttccctacaacaatgttcatattattaacaatagagtcctgcacacttagcaatttgttaagaggataaattacatgttatgtttttttttaaatctcaatcaaaggaaagaaaaaaagaatcttagtgatttttagagcagtgattatttccctgaattatttccatgttcaccccatcattaaaaaaagaaaaatccttggttgttcattcaaccacagagaagtggttataaatcccaacatattggtactttactgttaacactgacttgagcagacatcactcatgataattcctgtgtttgccatttgcattgtatcaccctgacttgtcctggtacgcaccagcaccactctgctcacttgttaatacacacattttccactgcacatgttggttacaggtcactttttccttaaatttaattgcaacacttaagcatggactaaccaggactcatgtttttattaatacatttttaagaacccatgattgatattcttttagccctggggatggggatatgaaaaaaaacaagaatcatgaagtggtccagaaaattgctctggaccatcctgatttctctcctgtattaattcctattgaacttactatcctttctattgaattttagtgcagaattgctttctgatagtgtctatctttattctctttccccattaaatcatctcactgttaccttactttctaacaccacttcctgcacaggtgttgtgtgtcccataatctcattgcttgagtgatttgaactaatttaactcacatgactgacagttcagtggagggtgtccttttgacagggtggagaagaagcttgactgtaatattgctcagctgtactgctatggacctcatttaagaccacaaacactttttcaatgatttatttaactttttgaacagataatatattcacaaagctcaaaaactaaaaagcacaaaaagatgtgtgctgcaatgtttccaacctattcttgtttgccgtctgcctttcatcctcgctctaccctccatccaggtgaccctgggatgtagacagcagtacctaaagtttcccagacgcttctaaagcagaacattgttgttttcagttgtaaacaaggaggagcctggtgtgatttcaggttccagtttccagatgtcgcctctctgtcagggatcaaaaccacttacagtgccaatttcacttgtcaagcaatcaaacactaaataaacaaaccaaatggatactgaacacccacgaggtctgtttgtgttatagattatggagaggatagggataaacaagtaaattattaatcttgaaacagatatgtggaaaaccatatctacattaaattgtcaataaaactgcattttctaattaagcaggtgtgagatttccatatatgcattcacccccaacaacatatttatttaggacttggcagaagtttaggtgtcatcaatgagaatccactcatttaactaatgagaaaactgaagttcagagatgcatcagggtttataattaagaatatgaagagtatggatccagccagacttggtttaatccaagcttgtccaacccacggcccacaggccccatgcagcccaggatggttttgaatgcagcccaacacaaattcttaaagtttcttaaaacattatagatttttttgcaacattttttaagctcatcagctatcgttagtgtattttatatgtggcccaagacaattcttcttcttccaatgtggtgaagggaaaccaaaagattggacacccctggcttaatcctaccacttagcagctgtgtgacattagacaaactacataactcctatgtgcttaaatcttcccatctgcaaaatggaaataagaatatatccttcataagactgtagtgattaagtgagttaacatatgtaaatagctaagaaggatgcttgacatagaataagcaccatagaagtgcaagctgttataggttaagtgtcttgtgaaagatgagaacagctgggagagtctagagagggttacatgctgataaaatgatgtactgaattatccattacaaagcattagaggaaaataaaattcataataaggtaatgtgcacattgcacacgtgaaaaaagaatttaagaaggctggagtaaaataagcaaattacactgatttagctcataaacaaggaaataaaaaaatcaataaggtggacaaataagtaggctctcataagcatcactgggccaggacaaaggtctcagagactccaaatctactcagttctggaaatgcttcctttatttatttatttatttttaattttctgagggaaaatacagaatgaaaaggacgtatactcacaggtaagtgccaaatgttttgataggaaaacattttaaacactaattgactttgaatcacgtttgagtaaattttggtcttcattgtatttaagtgatagtctaattactacctatgatttcagaacttttaccaaataagaaaataaaaacaattagctattgctcatctttttctatgtgagtgctaacataaatttttaaaatataaaacaaagtgaaagattagtataattttgcttttcattttaaaataaatatagctttccgtttaaactgtcttcagatacatttctctcagtatctaaaacaattactaaacaagatacgtttcaaagtaagaagtcatgcttttattaaagagaaaatggataataatgttcacaagtaccactgattcacaatttctagattagttatatttaagtgattgaacaacaaataaggaaagtcttaaaaataaatatttttctgcagaaaatacacaaatatattccactcttgagagatctcacctttgcataatataagacactcatctgatgcagttagcctatagatcctttaatgaccttacagccaaatctaatcaagcttagattgcaacagaaagtaaaggacacactcctattttatcaaaatgtgaatgctgagaaaaagagaagagggaataatatgccttttaaatttatgataagataattagcaaccttgctaatgtagttcttcaaacattaaatcctcgttttcattcttcttccctaccaaatttaatatactatgagaactctttagcttaattatgaaaataataataatagagttaagggtctgtcaatccagcttaagcccctatctagaatttagaacctggcatcctaattaaactgcaaatactttatttacaaagttattgtttatacattgtaatgaattaatctgattgaatctctgactgattatgggctaccatgtatattttcaaagcaatgagaggggcatacaattgcatttccaacattcagtcgctcagcataattagagaaagtaactatagacgtcaataatcaatgtgcacttgcaccctggagacctgggcaccattacgattccaggaacctctttgagttgtcattttaattatttgcatattaagatctctgcaggcaggcaatacttcaaaagataggccaaaacagctccttcaaatgttattaagttcaacattgccaaatatattttagttgccaattttgaaaaccaaagagattatttaaagtctatcacaaaactgttacagtgagaagactgagttaactacctgtgaccctaggccatcagtgcagacctggggttgctgaagatttggaaaagtgaatcaaaatttttttttctggaaaaaataataaaaagtaacaatacctaccatcatacaactacaataaaataaatgctttacaaataatgtcaaataatagatactccataaattctggtgaatctttgttattataagtagtagcagaggcaacatcaacattcacattcctgattcccatagcactgctttttctatgaattaatgttgtttcctcaactagactgaagaattaataaaaagtcctattttaccttaagtacaaagtgttttgtctacatgctaattaagtacgccaaattgttttctatgcttctagaagacaaataatgatttatgggtcctaaagagcacttggaatagtgctggatccacagtaaatgtccagtaattggttatttattgcttgatataagtaagcacacaaaatgaaggattcaatgttaaagaatcaaacagagatttatgagtgtgatcaaacagagttactatgttggaggtaaatttaattcttgtatatttcaaatatatgtcaaatatttctgggacattttgaattgactttcctctctgtgaatggcaacactacccaacatctatggtaagcctcattttctcttatccccaacaatgcctcacacacacaatgaacaagaaatgagaaacaatgtggtcaggctttctgtcataaaatctgattatagagcaggatttgctatgcagaagaatttagaggaagtcagagccacaaagtgtggctgtgccaccaaactacatttttttcacacacaaaaaagagaaagtagaataagaggctgaatggaaaggagaaataacatagacagtactgagtacttgttaacatccaatatataaaagagctacctgaataaacagagaaaaatatgactatagtattattattgctacaattcaaaccctttgagtgtgtgtgtgtgtgtgtgtgtgtgaaaaatagatacacaaaaatatcaaatgtggctatttatagatcttaaatacttaaagggtatgattattacaccttggctccttctcactcacattttaaagatgtagggaaaggtgatgcctaaaaagactaccattcctaaaatcttatgatttcacaattttctgcatagaagtagttgcttttaaaactctagtatgtatttgagctgtatgactccctgagaatggaatatgctaggatccagtaaagggatattgaggtttggcctaagggctaaacaaataaatacgttgaggccagaggcatagtcaaaggttagctccttggtaagaaaatagataatccccctctgaaaactccaggtgaatctagggcccagaaaaaaatacccacttctccagggtcatgcaaggctaaaacagaccagcctaggagcatggatacaaactggactagcaagcaccacaacctcagaaattagaatttggtgaggcagcttttcattagtaagatgaataacaagagggaatacttgttttaaaattgcatcaagctaactgaaaaagaaagattaggtgcaggcatccacaatttgttattatgtttttcaatcttggagaccggaattctcctgtgctttgaattaacagcacgcaagtgatacactatagagaagaaaagtcaaaaaattagtaaatcaatagggctgcctttatataacttgccaccataatttttccctggatgcttccaacgtatctatagttttgtttattcatttggcaaaatagggcacccacatccttggcacagttcatgggcttgaattgtaaccgggaagaagacaaatataattcctgctgtgatactgtgatttaaaatgagatatatacatttggtcttcactcccttctcctgacatataactcttaaaatctttgaaatctctggagtgataagaatatcatttgtatgctaatgaatgtttgctggctggcagcctctagatagcttcagaatgggggccagtcaccaagaccaagacagaattagagggttaaaactttcagccccaccaccaacatccaagtaggtgagaaaggctgaaagctaagttgataaccaatgaccaatgatttaatcaatcaggcctatgtaatgaagcttccataataactcaaaaggactggagtcagggagcttcctgacagctgaacatgtggaggatcccagagagagtatggcagctctgtgccccttcttccgtacatcttcatctgactgtttatctgtatcctttgtaatattctttataataatcaagccaaatgtaaagtattaagtgtttccctgacttctgtgagctgctctcgcaaattaatggaacccaaggatggggtctacagccagtcagtcaaaacctgtgcttgcaactggcattggaagtcggtcgggaggcactcttctgaaaatgatccttcaacttaagggatctaacactttctgctgctagactgtgtctgaattgacttaaattagagaacacttggcaggtgtctgttggagaactgctggcttgatgtttgggggaaaacccccacacatctcatgttagaggtattgtgttggctctgcaagagtaggaaagccactttgactcttcccacatatcttacatctgctctcatggaaattacagtggctatagacagagaatgaattcttaaacttaagaaaaacaatatagtttcagagagtgatccatgattggagctgtaaagaaaccagaagatgtggttgagagggactgggggaagggaaagaggggccacaggttggtggattctttaattagatgggctaattggaacatcctcactaaaaaggtagcatctgagctgagagtgaaatgacaagaacaagctagtcatgtaatcttctggggacagttttacaaataaaagtaaaaacaagtatgaaagccccaactaggaacaacttaaagtatgtaagaaaagcaaagacaggtaaagccaatgagccagtgaaggaaagtgaggtatgatgcagcctggagtcacagatcatttggcctgaaaaaggagttgaaatttagacattagatgaaaagactattctagccatcttgctactagatgatggtggcctgactaatgcatcacctgtgaaaatgaaaagacccatataaattcgggatacattttggaagtgaccctaagtaatccttcaattgttggggtgattatgtatgtttgtgttttaaagtgcggttcagtgagggatcagatgactcctaggtgtatttcgcttgaacaacaaggcatatactaatgatatctattgagaagaaacttcggcagaaattatgaactagaaaatggagaatggatagctctgttttggtcttgagaagtttgagatagctcttagacatcccagtggaaaggtcaagcagagggttttttacataaattaggagctcattgcagagatcaggattagagatatacatttgggattcatcagcatttagatggcattaaacgccacagtactgaatcaccttcagaaagattacagtctttcagaccagcatttggaagccaacagagcagaagtcagcaagaaaggccaagaagagcagtaggtatggaggagaacatagcatcatgatgccacagcagaaagtgtttgaagaagaaaagaactgtcaactttgtgacttgctaccgctgagtaaaaaaatgaggacagaaatgtgatcactggatttggcgcatagtgaccttggtaacagtctattcaatcaagaatggcaaatagcctggaagaaactgttgaggtcgatgcgtatgatacaatgaattaaaatacatcaatatttctagcaaagaaatactatcatttttacctatacttcaattcatccctgatttcatgaatatcacaatatagaatttggttataatttattgtttcatagcagttagttttttgaagctgtgaaaactcacaataattagcagcaaataattaatgtgcttataaaatactctggggaaatatgccctgacacttagtatcccaaatggcattactcttaaaagcaatacatgtgaccctctggctataatagtaaaaaataatttttaaaaatgaagaacaaagtaaactcttttaaagacttactttcaaatgtcacaatagcaataaattattgatttccacatctaaaattaatgtttttatttatttatttatttagttttttaattgatcgttcttggatgtttctcacagagggggacttggcagggtcataggacaacagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgactggacacagcacatgtttcagagagcacaggtttgggggtaaggtcacagatcaacaggatcccaaggcagaagaatttttcttagtacagaacgaaatgaaaagtctcccacgtctacttctttccacacagacagggcaaccatccgatttctcaatcttttccccacctttccccgctttctattccacaaaaccgccattgtcatcatggcccgttctcaatgagctgttgggtacccctcccagacggggtggtggccgggcagaggggctcctcacttcccagtaggggcggccgggcagaggcacccctcacctcccggacggggcggccgggcagaggcacccctcacctcccggacggggcggctggccgggcggggggctgaccccccccacctccctcccggacggggcggctggccgggagggggctgaaccccccgcctccctcccagatggggcggctggcctggcgggggctgacccccacctccctcccagacggggtggctgccgggcggaggggctcctcacttctcagacggggcggctgccgggcggaggggctcctcacttctcagacggggcggttgccaggcggagggtctcctcccttctcagacggggcggctgggcagagacgctcctcacctcccagacggggtcgcggccgggcagaggcgctccttacatcccagacagggcggtggggcaaaggcgctccccacatctcagaagatgggtggccgggcagagacactcctcacttcctagatgggatggcggccgggaagaggtgctcctcacttcctagatgggatggcggccgggcagagaccctcctcactttccagactgggcagccaggcagaggggctcctcatgtcccagacgataggcggccaggcagagacgctcctcacttcccagacggggtggcggccaggcagaggctgcactctcggcactttgggaggccaaggcaggcggctgggaggtggaggttgtagcgagccaagatcacgccactgcactccagcctgggcaccattgagcactgagtgaaccagacaccgtctgcaatcccggcacctcgggaggccgaggctggcggatcactcgcggttaggagctggagaccagcccagccaacacagcaaaaccccgtctccaccaaaaaaatacgaaaaccagtcaggcgtggtggcacgtgcctgcaatcgcaggcactcggcaggctgaggcaggagactcaggcagggaggttgcagtgagccgagatggcagcagtacagtccagcttcggcttggcatcagagggagaccgtggaaagagagggagagggagaccgtggggagagggagaccgtggggagagggagagggagagggagagggagaggggtaattttgtatttttagtagagatggggtttctccatgttgatcaggacagtcaaactcccaaactcaggtgatccgcccgcctcgggctcccaaagtgcggggattacaggcatgagccactgtgcccggctaactcaggatttttccctttgctgatgtagcctgacagcaggagggagcctataataatgagaaaggcgcgaatcaaaaacagcacagtggcaagtgcgatggccttataagggatcttaggaggggttttcttaaactgaaggtccatgtagccatcgtctgtgctggagagccttgaatatttcactttactactggggattccagtagccaggttggtacgggacggcatcataacaggctgacacagcggagcgccgcgccaggccgcccgcacacccagagctcgcccacggttggcagcgcccaaggttgcacggcatggcccgcttaagtgccactcagccctaatgtttttatttatgaagtaacttaacttttggtaacataatatataacttctctttcacagattattttatttttttagaattctagagtttgaatgaatccaattaagtgtgctctgtgtgtcttctcagcctgcccttagcaagactcacaatgtgagttctgttctacttgctatcaggagaaaccgcacaggaacccaaagaatactgcctgctggaaaaaaaaaaaaaaaaaaaaaaaaaaaaaaagctcatttcttcacaaagtctctggctgtggcaaatagaacacaccatccgtttatagagtctgctaattggcactagggcattgtctgggcttgcacttctttactggcaaatgcagctcatttttatttatgctcttcaatagattcagctaccaatacatacagatttggattatgaaaaattatctaggcaggtaaaaggaattgaaatttcagacagttcagtggattaggagggagggtgaggtaggcccaaactaccttgaagaaggagtattttgtgaaaatgagccaagccccatgttcacttttgaataataaaaacactcatccacatgccgacatgacacagggattttattgtgaattgtcacacacggtagttttattagtacctattcaacactaagctaatttaaaagcacttgaaaccttgggcagacgtttttaaatgaaaaaaaaaaaagttcaaaaagctctgcatcatatactatctactataaataaaataagactcagttcttctgagccctgaaacacattcatttccacatgagctgcctgcaccaaggatcactttcatcattctctagggcaacacagttccctgttctgtcagaactttatggcattcacccttttgcctagttttcactgcttggtccatttataatacatctcctcccatactagattcctataagaggtctcatttaatttcttttaaaattaaattaatacaattaactttgaaaaactggtagtctttactaaatctcaacataagcatactccatggcctagacttttcactcttaagtatagacccagcagaaaaaacgacacacacatccaccaaaagacatgcactaaagtgttcgtagcagcgctatttatttgtattacttttatttttatgttttatttttgtgggcatatagtaggtgtatatgtttatgaggtacatgaaatgttttgatgcaggcatgcaatatgaaataagcacatcatggaaaatggggtctctgtctcctcaaacatttatcctttcggttacaaacaatccaattatactccttaagttatttataaatgtacaattaagttattaaaacaaatatgtgtggtcaaataaagagtagaatggataaaattctcacacaatggaaactgtaatacaatgagaatgaacaatctacaacttcatgcaacaaggataaatctcaataatagattgttgagccaaacatgtcaaataacagatcacagtgaattatttcattacataaagaacaaataccttatcctgactaatataccaggtctgagtaaaataattgggaaattttagccaatgtaaacatgtctaattccctttttataagtacaaaaccagtcacaattagactatgttcctagaagaaagtattagttatccttactgtgggagctaatgagtagagggggcttgaggggcttctgaaactctggtgttattcttgcatctgggtacagattacacaaatgtgttcagtttgtcaaagttcttcagagtgtataaatatgttaagatatgtacacatttctgtctttagaatacagtttgaaaacaattttaaaacccttaaatttctaaaacttgtttttaaaacatggacgttacacctaccctcatatttggactgaatttccagccttgtaacaagagagcattctccggaatatgaatagaactggtggcagactattcatgtcatgcgaacagttagtttgctttctaaactagattgtacttttcccaagagcaggagccatttcttttgtgtctgttcatgtgtctgttttgtgcacagatgcacagagaaacagcgttctgagtgacgctgattgttcacattgagtagcagtggcgggcaagcaaaaaagagcagggctgaaatttggaaggctttaaataataactggtttccaagtttggatgccatcttctaggcaacagtcaactgtaaagattttgagtgaggcaataacataaggaaaatattattttaggcatgcatacgtactagaatcgagaaaatcaatgccagcagaccagtcagcaggcttagtttaagcctaaactagaatgatcctggcaccaatggaaaagagggatgggcatatatgaaaaaaagtcagacaaaaataatctatagagctttgaaagtgatagaggtcaagagagttgtaagttctaaagtgattgagttttgcagactgagtgagagcttaatagaggaaggaaaaccttatggattaattgatttgggaagacactgaaaaaatgacataatgggccaggtgcggtggctcacacctgtaatcctagcattttgggagtccacggtgggccgatcacctgtgggtcaggagttcgagatccacctggccaacatggcgaaacctcatctctactaaaaatgtaaaaatcagccaggcatggtggcaggcacctgtaatcacagctactccagagggtgaggcagggggaactgcttgaacccagtaggcagaggttgcagtgagccaatgtcgcaccactgcactccaactccagcttgggcgacagagtgagatcccgtctcaaaaacaaacaaacaaacaaacaaaaagacataacgaatagccaaagttggagctcaatgcagaactcatacaaagtacaggactcagatttcatatattaaatgtttctgttttcctcagggtattaaaaatactaaagaggcacagagatatagtgagaaagcatgagaagatttagaaatgctaaacatcatcaaaattaaaaacactatttctgtgaaaggatagactgagaggaaaatattttcaaatcacaaatctgacaaaagacttgaattcagactatataaggaattctcaaatgtcaacattcagaaaacctacaaatcaatttaaaagtggacaaaataattaaacagacacttcaccaaacaggctatatgggggcaaataaacacaggaaaaaaagtttagcattagtcatcagcaaaatgcaaaataacaccacaatgaaatgcaaattaacaccatgttctatacatatattacaatgaataaaatgaaaaacactgatagtaccaagtcccgacaaagatgtggaacaactagaactctaacacattgctggtgagaatgcaaaatggtacagttcctctggaaaacagtttggcagtatcctataaaattaaatatatacttaccatatgtccccaagattctacttttagatgtttatccaagaaaaatgaaagcatgtatccagagaaagatttgtatatgaatgtttacagttgttctatttataaatttatcaggtacatggataaacatactgtggtacctccctacaatggaataatacataccaataaaaaggagcaatctatttacagagagaacttgcatatatctcaaaggtcaagctgacagaaacaagctagtctcaaacagttccacatgttatgattacatttatacgacattctcaaagagacaaaactatagttacagagaaatggtcagtggatgccatgggtaaaggtgggagaagagtatatctacaaaaggacagcaagaggaagtattgttgggcattggaactgttcttgtatcctgactgtagtggtggttatacaaaactgcacgtgttaaaattcacagaacttcatataccactcaaaaagtcaattttcttatatgttaatttaaaaaaatcttctaaggaaatgcacagatagaacataaagcaaccatttaaatgtcagtattcttttgtatttttactgttatttatctaagagtatctaaaaattccacagtaataggacaagtaacttactagatactccagtatgcctataaaaattacataaaaacaaatttaagaaattgaacttttttgccaaacaactgaaatttaatttataccagattatacaaaatacttaatgtaaaactagttaccaaacctaattagcaaatgtacagtaattgacctaattggcaaatttcttattatttattgagatcactgactacccagctgggcttactaaaaaactgagaagtagtcaaaagactaaagaaaaaaaatccaaatatattgaacatgggagggattttgctcttaaatttaagattctctgtaatcaactgtgaaaatctgaatacatttgttttctaggtgaacaagggacaataataaatcataactgtcaattttgctcaaaatatggtttaggagtacattttggacttctcaggcagttaattggttttgcagttttgaaggatgtggtgctcagtttttgaggggttgaaaacaactcaactgctagaatttcaggaggaaaacaataactataacaaaattcacagtggctttttaactaaggtgacttttttggaaagttaccctaaatgatctgaccagtttcatgtatcataatgattttgaattgagataagaataattggtacgtgatctcagaaaatctgaatttgaaggacgccaataacaaactagataaccactggcaaattagtaaacctctttgatcctcagtttactcatttgtaaaataaactatctgtattagataagaagttctaatctttactatattacatatatctctgtgtgcgtatcttagattcctaagcagggcccaacccaggtctgagttggggctcaggggtgcatcattgtaataggagcctttgtggtgctgaggcagatggtccttagtgcacgcctttagaaacactggaccagagagacagtccctcactcttgcagctttaacacttgaatgcagtcagtgtcttcttagcctacttttgtgtcatccctcttttctctttagcagagaccagactattagatttgtcttctttcatatcagaaaggcaaagaaattactatggttttccttagacctgtattttctgagaataatatagacaacctcagacagcccagggtgagcttccttttcaaaactgctttcagatgggatgtcttctacctcgtaggttcaccttccctgtaatttctgtaattcaaacaggcctcataaaccacaactgatctttaagaagtcacctttcagattgtctcccaaaaaaaatttaaactcctaagtgaaagatgaagtaatatgatataaaagaaaatctaatgatacccttaaaataagattttactcaggcaaactaaaaggcctactaaagaaaattatctttgacctttactttcgatttcttatgtaatcctacccagttgcttttccaacaataagagaaaaattacatttaaaaatattttgatatttatttaagggaattctactattggctctcaaaggaagttttaattttatttgaaaggcaaagcaaattttagattaatcttagcctctgagtttaaaaatgcaaatgtttccaataataatgataattgacatgccagcacatgacatttgctttgagaatattaaagctgaggaaatatggatataaacattcaacattaaactttgagataattatattaatcctaaatgaataataattcttcaaaaataaaaataatctttaaatgctaaaagaatcaacataatcacatttatttatgctatgcaagtatacatactgtgtggaagaatccagaagcagggttgatacctgacactctagccagaatctgatgagactgatagtttggaactcagtccctttccttacaaactaggttgtcttgggcaagtaatttaactttgctgagcctcattttctaaatctataaaataataacaacctatcaaatctttctgcattaatcacatgttaaatgaggataaagacaccttttaattagaattttcaaatatctaaactgtggtgcttgcaaagtttcacattcttttcacgtttgtaaaattgaaaacattttactagtccccataaatctgaaaaagaatttctaattctagttttcgaaattcaaaagaaaaagaggcacgtttctgtcttattaatgtatggttttcttcttgttttccttcgacggtcgtctgtaacctcccttttgttttgtttaggtttttaatcgacaaataataattttacttatttatagggtacaatgtgttgttttgatgtatgattaaatcagggtaattaacaaatccaatgcttcatatacttaccatttttttgtggtaaaaacatttaaaatctacccccttagcaattttgaaatatacagtgcattatgatttattatagtcagcattctgtacagtaaatcactaaagcttatttcttctatctatggaaactttgtactctttaatcaacattccccttttgccatccaactccccacctccagcctctggtaaccaccattctactctttatgacttcaccttttttagattccacccgtaagtgagatcatgcagtatttgtccttttacacctagcttatttcacttagcatagtgtcccccgatttcatccaagttgtcaaaaatgacaggatttcctccccttttaaggctgaatagtatttcattatgcatatataccacatttttttaatccatttatcagttgatggacacccaggttgcttccatgtaatcttgacctaagttacaaatttgcgaactctttagattcttatatccttagtatatgagaaatatttaaatcaataaagcatcataattgtaaaaaaaaaaaaaaaacagaagaacaaatatgactgtggcagcatcaatagaaaccaattggtttgtgtaaattaaaaaaaaaatcagataaaactgaaatcagtcacttagaacaatattttaaaatcagtatcctgagcatatggtcatgtctgggttttcatttccaaaagagtaaatccctgaagatactttgcatatttttatcctctcagttagactttgctctttaaaataaaacctaccctggttaacaccgtatctccagagaaaaacacaatgcctgctacttaataggtgttaactttttatgtaattgatgaatgaaccaatgaaaaatgtataataattcttaagaaacaacaagtagtgttatctactcatagccaagtgaaaggacaactaaatattctgaagaatagcgcaaaaattgtgcttacccctttaaaatacaagtgatatcaatcgtttactagttccaaacaaagcactttctttgcatttgcttgaggcagtagagcataatggtttggggcaggcatactttttgggtcagatgagaatgggttagaatccaggctgtccttataaacaccattaacttgggcaagtactttcatttgttgagactcattttctttcttgcaaaactgggaaaatcaattttaacttatgacgctactgaaagatttaaatggcaacattttactggctatttgttaagttgcatacctgagaggactcctagccctaagagtgaaaaattaaatcaatattatttctgaacaactttacttaacaattataagagctgagtaagaaagaaagaaaatttgtattatatgagatgcatacaaaatattttagcataaaccagaaatatttttgcataagccaagaaaagagacaaaatgttaacagatttaagtggttagaaatgtgcttgacattcatgaaaatgcagtattccttatacaaaaataacaatttagttttattaggaaatacagaaaacttgaatagaaatctatttcagaaatacactcagaaatacttaaatatgaatccacagtgagctgatttattttgggcattaattaggtattctattacattatcaatcttttgatattctgcattgctggcctcataagactgttgcctgagtgaaacacatctaaagactacctcaatctaccttaaagttaaggagtagcagagaacaaatggctgaataaagagctcctcacattttataaaacatttcattgtctactgcaagctacttagctcaatttaaatactgaaatccatctttagccttccaaattatgtttcttatcagcaatgttagtgtaggtattactctgaaaactattataaacagtgtaaaaaatatgtatgtaagtcatgaaaatcattctgtttcccataatgaaatcaaaagctcattgcgtgtggatgaaagaaaaaattgagagaacagagagatggttttaaggaatattttggtgatactgcaaaccaacatgtaatgttttaaatttatcattaattcttcttgatattgcttagaattccagccatgtaggacctaaaagaattgttctgggttgaattgtggcaccccctcagagagtatgctataagcctaaccctcagaacttcagaatgtgaccttatatggaaataacgtctctacaaatgttaaaatgaggtcatttgtgtgggctccaatccagtatgactggcgtctttataaaaaggtgaaatttggtcacagggacagacatgcacagaaagaagatattgtgaagacacaccgggagaagctggctgtatgactagagtgacgcatctgcaagtgaaagaacaccaaggaccaccagggaaaaccagaagttaaaagaagcagagaataatcatcctagagtcatcagagggagcactgccctgtcagtaccatgatttcagacgtctatcctccagaaccgagacaataaatgtcaataaaccaccaatgtcttcaaactttggtactgaagccctaggaaactaacacagggacattccagagcttacagtcccataagccaaaacactgaggtgaaaaaaggtgaaatcttgctgaccaagatcttacagttacttcagacagaactctagaatcaagagcctggttttcttgactttaagtttaggcctgtcatttccccttggagaactgacagattggaaatgctaaattttaaaaaagttcatcaagttaattcctttaagctattttatttagtgacttctgtttaaactaaaaataaatactgtgactctgcccttttgatttttttctaagtagccatgctccaatttctgaagcctttttaatctaaaagataaaattgaaattcttattaacttagttgatacttcatttttatctcatgatccctttactattacatgcaagaggatgtgaaatttaaaaactatgattaaaattttacaacaaaaactatgaggaaaaggaaagtgtcataaaataccatcagttattttagttaaatagtcattttctcataatgtttgaattattgtaacctcccctaaggtatcaatatttttaacacacagatatcacggaacatctcctttctgatgttacttgtaggaacaattatttatttaactaatttttgaaaccgatgaggccagagaaagatcttcatgcatctttgcatctctagcatctagggccacaccaaacacaaagttggtgttccataaaggatgaataatacatcaattcaacaagtatctatttatcagatactatgagctagacagtcctctatatgctgagtataggataataaagaaaacacataagaatgcttgtcattattgagcttatgttctagtgagtacagacagagaagaaataagataattaaattagacggtatattggaaagtaattctcctcagaactaaggagaaaaataaggcggggagcaaaatttagggaatatggttgttgctattttaagtagggtgggaggggaaggttgtagaatttcaacttgacatttgacacttgagcaaaatattaaagaatgtttcagcatggctgaaagctttaaatcctagttgtgtcttttcacttctaataaataagaggacactgattcccagtgtacccaggatggtcctacttttacatgtatttaatcctagtttaactattaataactcctcctgtaattcttactggaatctcagattgaatgatatatagtctcattatttagatcattatctctacataatagttacaaatgtttgttaaatgaatgagtttttaaaaaggtatatctcagtctcacattttatcatttttatttgtcaagctgtttaaccactttaagcagcaactttgccatcaatctcaaaaccgtgaaaccaagattgatgctgggagagtcttttaatatccttaggtgaaaaactcaaaagatacacttatgattaacatcaacaataacaattttctctcactatgtaagttttatttagtatcccccttgtctttcatttcaccgctgagacgaacatctttatagaggtccagatggtgcagagagattatgacaatgaaaagtagctcatgctgagggcctcaaggaaaaacacgtctcggcttgcctgacagaccaatttcaattacgtacttactatgcccctcaacagctgaggtgctccctcttaccatgccttgtgcaacttcggataacacctgaggggattcatggttacacacaaaagagaagcgacatggacaagtaaaattcttcctactttacataagtgatgccacacccattttagaaataggggattcatcacaaatgatccactctatagaaatctcatgttttctgagagtaaatcttaagagaggacttcagggttccttgttatgaggacattttgaaacatcacgtgtttgtcaggctggcccaaacaatttctacaggcaggttgtcagaagaagatgccttcacctcagatgtgtaacgcttacttccctcaacccccatttcagtttcagaaagaagtgctaattagaactggggtagcttttgcgagtctgcataaattcagctatgtcaacgttgcttctgcccctctgcaaagtggaaaacagtgatgttctacataccatgttaatgtagaaataacttctatgctcatttagccacttcagcacatccaggaaaatgacattatgaatgagctacattacctagaggaaagagacagactaaatgtggacttctatacaacttaatatgcatctaatgtacaacttaagcagtatcttccacactaaatgacaggcaagttatctccatacatcagtatatgttaaggacatgacacagctttattgttgaaggaatttgaaatttccagccatacctggattttcctatatccatttattagtcagctacttgcagaagtcaaagtaattgccacattcattactgtgtttgcctccatttaatcagttttgcttaagcttctcctatcctcctctggaatccagacaagcaaaggccactatcaaaaagtgacaatgttacatatgtatacgtatgtgtgcacattttgccactgctaaaatccctttatttgcgttatgtaaatgacctacgttagtcacaggacatttacctcaatttaatatctgttatttagagtgcttgtttctggcaagacaaatgtcaacagtttttgaaaactaagcactgtttattgtttagctggcagttataaataaccacatctaacatttctgttatgtctttgggaaaaaaaattgtaatttttgtaaaccaaagtgtttcacgagaaattgccacagattattccataagatctttctttatatttccagctcccattctctcctcttgtattacataactatttactagccctacaatgcacatatctgatattgaacttactgaattatagtctggtgagttgaataaattctttgtcatttttggaaggaacaaagtctgtgtatgcattgacacacctaagtttcattaaccaacaaacaaaattatatgcaaagtgtctttcattttgactacataatatcaaataactagcttgaatgaattttatagccccaactggacatcatctccatttacagaagccatgtgggtcaagtacccagcatctttctgggcacctcatctgtgagtggacaggttacctgtcaccagcaaaaatgcttaccaattattaaccttccattaaatcatcacccaacacttggccctattgtaattacccccttcaaatggcttttctattactatttaaggtctgatttagatcacagatatgtgttaatatatccatatctgggaacagtgaggagcagaaggaaaaacataggctaacaattaatggagggaagaatgtgtcttaggcaatttcttagatcatctttagagaatacaggacaactgtaagtaaattacacattgtacagcattgaaaagtccttggatttgactctataaggaaaccacagtacactcattaagttagcaccaaacagttatgggatccaagtcaaaattatataataaaggatgaatacaacaatggcattcagggtgtcagcattggaaatatctgctttagcgtctaaatatttatttgctatacctgggaactaatctgatatccatttgtgtagtttgatcaatttgtctgtgagtaataaattagtaacccactacaaactagaaaaaagtgtacataaatgacccccaaagtggttgacctctacatgttcatgggatgacttttcatagaaccccttcaattatcacattggtattagcaagaccaatatttttatttacagattttcatgtaagtgtgcattccctcccttttatgtagcagacattttatcctggctagaaaatcaggttttttagacactgtaattgttctagtcttaagattacagaataggattatacagtatacaaacgtactgttaaaaggattttatgcttattcctatcccctcggtatttaataagagagaatccaaatcatttacagatgtctgtgggtagtaaagaaaaagtctatgtgtatagtactcattatcgctaaagaaaaataaacagatctgtgagcgagaaggcagggaagatgctggctacctggaatataagacagacacatactgagacctggacccagggacaagaaaccttagttcattcaagctcctgtcttcctggaagggatatccctatggctcttcttccacaagccattattccacaaacaattaactcctttaattaaaacatttttcctccaatggagactttgcaaaaatgttgaaaatctcaagaatttaaacctgaacagaaggtacaatatttttcaatatattaaattcttgctcctgttgtttaagtctagttttcctgatagaaaaaaacaactggatcaaagaaaatgagatagtaatggaggaaagtgatattttggttttgaaataaagatgagagactttcctttttcataaggactttagacttttcccctagtaacctaaaatacacctttgccttttatggaattgtcccacttgccatttcatttcacttcatttcatttcatttcattggtaatgggtggaagcccatgcagtggtaattgccagtgagaactgaaactacctatccgccatccaggttactgtttacattaacacacatttactatttcattgctctcattggtataacaactattctaggagagccatgcccaggtaaacaacttgatggttaattacagaaaactcccaaaagactcatcaagactgcagtaggaagtatcaaccaacagtttatgccctaaaacttctctgaaccccttccctcaaacgtctcacaatgctatttccaccaatcctaactgttacatcaggatcattatccaatctcaaccaaaccctaacataaaaaggtcagccttaaaccaaacttccaactgtcaatttattctgattctgcctttactcttctgagaccttgccacagcctggtctaggtggtcactctcactgaaggaagcaatgtgtcgtgagaaacacgctcacctgtccaaacccaaagaatggacctggaggcacgaagaacagcgaaagtgagacttttaatactagtcttgcaagatcgggtgtctggtgagcaggcacatccaggcagtcacaacaggtaatttatctcctagcacataagtccttcccccagttcctcactaatcaagtactatggcgttacaatcttcccggacgtcacctaagtttcattatcccccttgtaaggttataccctgctccacttctccgcttaaattttgatttcccaataacaaaactttcttcccttttataggctgacccttcgtctacattctgttcacttatggtgaccttctaggtgcatgaccatgtggtttgttacatttgcaggctggctgccagtatttagatatatcatgccttgaaaatggaccattgaaattatattctcacatgtactcagtttgtcttatcaatatttcgtataggtggtatttggggagcagccttttgacatcatccatttcttacaaaaagagaagtgtgtgcagattagtgggaaagactgttctagtaaaaagtatacatcatattatgataatccttcctgaaggaaatttaacctctggtttcagacgccacccaggttttcctgctttttcgaatagtcggttcgtcattcctcacgtaaggaaagtggtaaacacactaccagaggccagagcaagtatcatggaatggaaagttataggagagtcatttaataaacatattcactgcatagtgtggtttagccatcctcagctaatcattttttttttttgaagcagaggcttattctgttgttcaggctggagtgcagtggcgtgatcacagttcattgcagtctcgacttgccaggctcaagctatcctcccacctcagcctctcaagtagctgggaccacaggtgcacatcatctcacctagctaattttcaaaaattcttttgtgtagataggctcccccatattgcccaggctggtcttgaactcctaggttcaagtgatcctccctcatcagcctcccaaagtgccaggattaccatgcctggctctcaactaatctctgaatttaaaaaattgcctctgagaaaagtaagggagagttctctattttgtatggatccagagaatcatttcaggcatcaacataataccaagaagaaccaagccacaaaaccattatgataatgagctaccatctacgaacacttactatttattgagtacttactataatccaggcaattagaatatactgtcactcttaatcttcacatcagtcttatctggtagatgttatcgtctcaattttcaaaagaagaaaatgcttcagataggttagggaaccatccctgaccacacaaactaaaactcctctattccaatcatcctctattgaaacgtaatgacttactttcttcatggcgtttttcaccatctgaaattagcctgttcatttattcacttgttaactctctgtttttccctcacaaatttaaagttcagattaggaacctcaccatctatctacctctctaactctactgcctagagtggtacctggaatatggtggatgctcgatctatgtcaagtgatacagtagcatattccacaaagaagcaagggctgaaatatgtgtttaaaaatttccccacataattctgatatgcttacctccctccccaccacagatatgtctgatataaatatctacgctgacacactgaaggaaaaataaggctttttgaatttttatattttctgagggaaaaaaaaccagaaaatttatgtgaaagctcactttgactgacaaaagtgatgattctctagcaatagcacagcccatgaatttgttagcttgcaatcaactgctaatagcacatttcagtattgctgactggctttagagattactgtttctgtgttgtttttcacattaaaatttcttttctagcatcagacagtgagttactagctatagggagtaaaaggcaggagtagaggaggtctgtagaatcaacttaaaaaattttttttcattgatttagtcagtaattccatacattttttctgaaccacgggtgaccttcatacacaaccaccaggttgttcattttgttttgtgttttagagcatcagtaaaacatacatggtcttactgaattctcagcaactaaagccaccacagatctgccttgaatcggtattctcaaagtgtcaggtgtaaggctagaagagaaggaatgctcctcactccaatcaatttgctcattcaaatcaatctactgcactcgccagccagttaacaacctctgggtcggcaagcaagactttttttttttcttgcttttaagatgtgaatcctgtggtatatttagctcatgctactgtgtttgtcttactgtctctcagaaatgtctttaccctttaaaagatccataaacattttcagaaatatggtggcaataaatagatcttacaccataaaaggcattctaaagaaatagcatagaccaacaaaaacagttcaaaaaaatattttctgggagcagttgtaccatggaattcctcaaattgtttttactacaaaagcaacaattcaaaaccaaattgcaattcaagataaaaatatgagtgatttatgattccctctctaggagaggaaaaatatctttcctttatccttcctttggttcatggccaagcccctataacaaaagacggattaaaaagagaaaagcatataaatttattttacagaagttttttgtggcatgaaaagtttcataacgaaataatgaccttaagaaacaggcaatcctacaatttttaagctagttttgataaacaaatggatagtcatggaaaagaatgattggataaaaagtatgctctagtggtaataaactgggagaaacttagtaagacctgtcggatcagattcttctctgtaacctttgccaaagataaggaggaacttatattctcggtattggcaaggtatctctgacatgagggtcttgtgacatgcatcagggggaggtgagaaaatccttcctaggttttgtggcctgcttcaagagacaagggaaggagaaggtcagagcatgaccttcctacttcagtgttctttttttattattattatttttactttttcaaattccttcttaaattattttaaagtaattgtgaccagaaccccatcacctcacttaaaaacatctggaaactggcgtttagagggatatatcatccgtcaaggtcagaggccaaacaggtttctgaataaagctggattgaaactaggtctgactgcaggggaaacaatactggagtgctgggaagggaagagtgtggtcgctttaaatgatacagaagcggggaagggaagtgctgggtagagaaaggccagtccctggctagggctccacccccacggacccaggtgagaacaggcatttcctgcccaaatgttgcatttcccaagactaccctggcccatcctgggcctataaaaaccggagaccctagcaggccaacacacagaagcggctggataccctgaggagcacatcagcagaagacgacacaagctgctggacggcgagagaacatcgagaggatgtccagggagcacgtcaagaggacgtggagggagtatgcaggtggaagagcacaccgacagacgtcggcacagcagccagccgtccaccatcgaaaggtggcggagtttggctggagcgaccagagaagagtccggctgcaaagcggcctgactccaggggaaaaccatctccctctggctcagccatcagctgagagctacttctactcaataaaacctgccactcattctcctagcccacatatgatccgattcttctggcacaccaaggcaagaaaccccaggatacagaaatccctctgtcggaaggggatctaatggatctggttaacacaagccgcctatagacggcaaactaagagagcatcatgtaacacacgcccactggggtttcaggagctgtgaatattcacccctagacactgccatggggtcagagccccacagcctgccagtctttatgcacccctagacgttcaaacagcagggcactgaagcagccagccacatccccatcgcacgccctgcgagggggacaagggaatctttcccatttcagaagctggattgaaactaggtctgattccagcaacaaagctccaagttgctggcactctctgccatttgtcctcctaatgtctatgctccctaggaaagttattctccaatgggtcaaagttatcatctagtgtgtacatgttcagaaaagctaatgacatatgttagcggagctgccccctacagctctgcttcggtttgggaggcaattggttgctttgctatttaccaacaatttcagaggcgggagagaagtttgaaggatttctaagggatagtgagggatgaaataaaaacctgaaggaaaaaccctgtggggttttcagttaacattccaaaaataattcagagactaggactggaaaactttgtataatttattttgcttcaaattattatattttatgtctcttataccctaaaatgattaggaagaaacagctaatagaacaaatacaccaagactggtctttggatgtggcaaaaatgccagggtagtctcttccaattttgtacactcttggagggaaagaactccagggattagtgcataaactggctgctttaaggaggacaaaacaactgccaccctgggatttataggaagtgggcaaaggagaatgttaaagttgatccatgaggaacagatttgccttaacgaaagcaggtcccaggcgattccccacatacagcgccttctctgtccaactaacccatcactcacattgctattcttgacagaaatgtctgtctgtctttttttgtggttacaacattcttcaaagaccaactcaaatctctcctcctccagaaaactctgttgatcactctctaattgccagcatctccagaatgcttactgcctatatatcctgaactacgtaactcggaatttaattttataagtgggcaagaaggtcttaaccttcccttcaacttgaccaaacttcacacaggtttgttactgaccacaggcccttgatctcccttttctaagaggatttactttagaccacttggaattgtaaattctttctgtgttcccttaacacgtaaatcttctgctagactcctgtcagttttacaacccaggaatgtctttctcaaggtcctgggagccatcccttttgaaataaaatcttcaggaatgctactgttactatctcccagtcttagggtgaaggtaagagcctaacctctacaagcatcaattagcaaacacagatggcctcgtcaggatgaccaacgttacccaattaagttttctaatacttttccacttgctcaccccagttatcaataactcttcttttgtttcagcacagttcagttctctctctctctcctcttgcaatagtcttgatccctgttgcaataatcttaagtcttccttacccgcttgtccaggataacttctctttgatacactgataaattcagtagctatttcctgtgtgctatctttcttagaccggaatataagatcctgtaactattttaattgaataatgtggtctttctggaaacttctctgttaatatagtccctctcttcccctgtttactgcttctaccttccccagtacacacacacacatcattgacactttatgactgaattctaagttttttaaaaaatacgtatttgtccaggtgtggtgctcatacctgtaatcccaacactttcggagactgaggcaggaagatcgcttgagcccataagttgaagaccagcctaggcaacaaagtgagacctcacttctacaaaaattaaagaaaaattaaagaaaaaaaaatagccaggcatgatggtatatgcacctgtggtcccagccactggagaggctgaggcaggcagtaggatcacttgagcccaggcagttgcagctacagtgagctgtgattactgcactgcactccagcctgggcaacagagcaagacctgtctcgacagaaaaaaaaaaaaaaaaaaggtgttttgttgttgttgctgttgtttgtttgttttaaatacatatttggacctcccttctccactgctttttaacaaggtgctgagtggctaggaaacattcagtaaatactagtttccttggtggtcaaaatatttttcttctctggaactcagaaaatagattacagatgaaatatacgggataagtcagcctgtggtagtcacctctaatgactattttgactttctttcttgcttcagtcacagtaggctcagagtccttctcaacatcacatttcaggcagccagcaccacgctatcaaattccgcacataaattgaaacctactagcctttcttaaagatgcccttttaatctaaagaatatttgattttaaactctgttttttgatgagattcatcaccttcatgcttaaagagccatttattatttggtaagtaaactagttcacattccttttaaaaaatcaatatcaaagattaaactaaggtttttttttttccacacatttgagttgcgaaatcactggcagagggtgtctaaaatgaaatagaccaaaatatgctcaaaaacaacagatttttgttttcttgaaagacaagaactttcctagtcagtacatcttctaaaataaggcccttagaatgtgattgcctagaaaatattcactgcttttcttcttaaagtgttcattgttatttttgaagaaatgaagcagagtagaatgttaccagttttaatagccatcacttttactcatcatctttctaattcctagggttcaaaatataaaggaaagaataaaggaaccaccataatagattatgaaacatagagatgaccacggaaatggtcttctaagataaaaatacatgcaatgaataattgagggagaagagtcaccatgcagtcacttagtacacattgtttcctgccttaagaggagccataggtctaggcatttattccccccaaaagtgggggtgagggtgaggggtgagggtgacgggataagactggtttcaaggtaggtttctagttgattcaataaccaaggtaaacagagaaatgaggtgattcgagtttctcagggactctcaaagacaataatatttaggtaaacaagaaatatataagtgttttaaggttttcataatttctattgctttactatttttttaacccctggagtaagtgggggtgttgtctgtcttgctgcaatggcctcctctctctgaaaattgttgcctcttcccatccacatgttgtacacactaaggtgccaagtttgtaccttgacacctatctccagctactcctgtacatcaggatacacaactcactcaagatgaccaataccattttcagaaaatttgcaattgagtgtggcttgttagtttaaaataaacggataaattcctaagcagtgagacaaaatctaaatgcaacacacatggaaataaaacatacaggagagaccaaaaagggagaaaaaaaaatagaacaaaaacatggctgcccaaggttctcatcggcttttctgtcccttcatcaggccctcgaaaggacccttaaattctgtaagatacgcctgtgtcctcataattcattatttttgctaatggtaacataaatgactttctgtagttaaaaaggaaaaagagagtaagatactcttaatagtgcctttgtttttataggcagtaacaatagaaaacactccaaaggacgcgaatgtctttttagccacagaaaactgaaggagaaagctgtgctagcaatgatctgaaaggcaagggacacaggtggaaggccagatggttgttgccagaaggggagaaaatgggccaagttcttgatacccttgggatatagagatgcaaggtgaatagaatgttggccaggagacacaactggccccaaaggatttgaccaggcaaaaggcactagtcactcatagctttacactatgacagttgaaatgctttttaaatgggttctagaatgttatacatggagaaaatctactctttcccctatcaggcaaaaaaggcaagagggaaacaactttaagcaagaatgaaaatgattttttcctctgactaattgaattttgaggagccttgaatgtccctcttatttcattttcttttgttgttacgttaaaataatcaaaaaatagttttttaaagtttaaaatatgtctgcctgtttactcagaccccaatggagggtcatatttctgtcaattctttgattgtcaaaaagagtcaggttctggtacaagatctttaacaactgaattactctgaattctgttttactgcttaagaaggatggttatatttgtctttcatagaatctcagagttggaaaaaatcttagaaaatgtcaaatttaatttctcattcatatatacacactacctgtgtcagtactttcttgatatttttccttaagtagactcagtttttacctcttaataggaatttaatagaaaatcaataacatgaactaaaaaccagtagcatatttcagaaatagaaagtattcatttaagaaaatgttcatctgaatatcacctaaaatcaactggcatacacatattaatgataacattttagttgaaatagagtcctttcctcttgccatctaacaaggatatcatgaaaggctttgtaaaatattgtgctaagaagcagacagctgttaatcccaaaactcttcactctaaatggaaatctctttcatctaacttggcatgttcttagtaaatacaccttaattcactctcagtgtccactattgaagaccacatatacccaggaagatgctgtgacacatgtaagaggagcagttctttgtagaataaatgctttgtaatgattttattctctgctatctgaggactatctgtatatattgactacttgcacaaacgaaacttttacacattctatatgctcacatttcttcaacatcttactgaacaaaacaatttcacagtaggataccagtgaggattttcataatgaaaatctgcatgagagcacagtaataacatgctataattgctcagagagaaataattcttcatgtccaagtttgccaatggcacactccattattatttgaagtggaacaggtcacttaaatttctctgtatccatgtcacaagtttcatttaagttgtgcgttttacttgcaaatttacaaagtgaaatatggtttattagaagagatagtactggaaattatttgtcagatgtcttttgtagtaacatttctattcacatcttagcttcatgcaaggaataggaccatataaaaataaagctagaacacaaatcatcacatattcatatgtcaggactctgagcttaaagaagaaatcccttttatatctgtgataaactcagatgtctagctttccctgcaaccatgcatatcccttactggataaattgctaaaagaggttccctatacaaattcttatccataaaagcaggcatcctaatctgtacttgtcactgttattttctttaatatgtaagtcaattatagcaagctttaaatggaacctaatgagaaattctcataattaaagagaaaacagtacaggaacttcctgccaatataaactgttaatttcgcaacacatgctccatagactttttccaatttctatattttattcacactgtgtgtttccccaaaataatgcttttaatgaaattttcccattgagtacaattttcttaatttaaatgataactacatttttaatctgaaacctctttaagatcctcattggcaaaagacaagattgagaatcacttccattttcaggaaattgtgtaaaatcagcatggcagatatagcaatagatgtttctctttattttccactttgagacctgggagcttattatttgaatagccatgaaaaacagaatggattaacaacaaaaaaagagatcatacacatttttcttatcagaagtcaaaatggtatttcacttaactggctaaaaatacggaatgtaacatctcatatattaatgcatcttcctgtaagatctgttccaatatctaagcatatccaaatgctaaaatccacagaacagtgcaaggaaaaaatactagtaaaacccaatggaaagctaccatcagaagctgagtgtattcatctagctttgcactgcagtaaagtacattccgtagagtacattctgaatagcaatagcctacctttaagctgcactgtcttacatatttcaaatcacactttgtttgaaagaacagactggttatttccaagatatctcatgaaaaacttattatagttcgaggaaaataagagttgaagccttggcggaatacccaaaggcattttgcttttctgactactattcaaatcttacttggcccaacttgacagccattctttctgacaacgttaagcggtttcagtaagtggtatgtaacctgcagttttctttcacttgggatactgtttatagctaattcaggcacaagggactagaaaacataatattttcataactataaattacttttatgtggtttctcaactactatgtagtgtaggatgatgtacaggagtggaagaaagaacaatgagcctggacaggtttttcaaatttgagcaacagaaacggatttaaaagacagattacagggtcctcactccagatatttgaattatgtgcagggcctgaaaacctgtgttttgaaaaatctctccaaattattcttatattggagtaccttctctagacacaccggggttgagattaactaccaaatattaatagtgtgtgactgttaagaggaagaacgtggtgcagtggggtggagtgtgggaggtggttcaagatataagggaagagaatatattactttatttattacttcattcagtcatttattacttcaagtagacttcataaagaaaactcactttgctttgaaagtatcttaaagtataaaaaaaactttaactttatacaagcaatgaacgtatgtttcaaatatgcaaattaaatattttaaatattccaaaaaaagtatccatcttaattttatcaaaaagaaaactgagactcaaagaattccactgacttgtccagaattacacagctaacaaggtcaattacaactaaaattcaaattcaattctgcaaaacttatggtctttgtaatactccatgctgcttccttcaaatagtaagttaatttatcttggcctcactttaccaatggccaaaatgaaagaatgtgccagaggttgagaaatgactaacccagtaattatttaaaacatccaagggaaggtgtatggcccaatagcaagatttggccgaaagaaagtaattaggaaaagaacttcttggaaatttaaaataatttttttctactttaaacaaatatccaaaataattttccttaatatttaaaaagaggaaaggacaaacattcattgaatatcttactatgtccactgactatcctatcctgcatgctatacttaaagtgtattatttgatttaatcctcaagacaaacctctaaatatagttgtactgaatacatcatacacgggaaaaagtacggttaaacaaattaatttgtcaacaattgaaacaaaaagtccatgttagaatctataccgccttcccttaaaatcctatgtctttctaatatagagaaagacaacatcatatgcaatgagcaacagaacacgagtagcctttttttttttttttccaccatggaaagccttggtttctaaaaatgcattgcatgagacctttgtaattatgcagaagacagctggttattctcagttttccctgaggaaagaatgggagataataaacttcaaccatacttgtgacatttagattactgggaaataatctttagaagtattgggcttctagaagtattaggcaacaagagcttttagagtcaactatggatgaggaccttcaggggattatcaccttaaaaatcctggatcatttctcacttactggtattactcatgcacacccctcctagcttgaaagcaagagaaagtctaaggagactgctcagcagcttgcagcactgtaaatttatgtgcaggcactttcaaaacaacttcagaaaacagatttccctttcaacttacttgtttttttcatttagtgtattctatcagagcaagtccaagacaaaagctttcccaagagaaaagctgagataaggaataatgtattcggtgaaaatatgtaagatttattctaggtttatcattcagaccaaacctagtatctataaattatccacatttccccctaaattttatatcatcacaaatgtacatcaaaacaggtattcctttttaattgtcgtgaaatatgttatctcaggcaagtgtaataacttgaaaaatattcatgatacttaattacttttgttctttaattcatttaacttccctctgagggtgttagcatttcctagtatttcagaacaatggtttacaagttgtcttccacagcaatatcacgttcccatgtaggaatccctatggacatgattagtttagatataaatgaggtttatcaggaataattcccagataactagctctagcctatcctattctcacagtaattgtcatatccagtgctccagataccacaagagacaaatgcccttttacattgctatcaagggccagtattctacatttatgtttagattaagttggctaaacttttgtatcagtgtaagtgctaacactgacgttttacagaagagcttgcattttagttgcatatgtattaaatgatttggagactattttaattactaagatgctttgttgagagattattttgatacatttacttcggggtaaagttgagctgtgtgccctctgagtcaatattaagaaaggagagaagaggggatttgatattgtcaggataaactaaaaaggaaagaagaaacttggttggggcaaggatagtggggtgggggaaatggtgaagggtcagttaaaaagccagtggtggctacatggctgggaaagaactttggtgagtagatgtgtctagcactatttttttatgtggttgatttgaggtgtgaaaaattagcttccacccctttcctttgtagaggatgatcactggtaaattatgtgtgactcactgatgcttttgtggaagtgaattctctttggagagcttaaacagaaaaatgaagaagcagttaacatctaggttttcgaagtatatactcagagatcaacatctttgaagaaagatatacaaagccattaatttctctagagagtgcttcatcatgccccatgagtttataattcttcaaggcctaggtcaaggtctattttctccaagaaactgtttctgattatccatccctcggtgatcttcctcccttatgtaaccctacaattctcacctcctgtgccttttaatttagcatctaatactgtaattcataaaaggcctaatcaaaatagattaaaaaaaacagacaatggaataaaattcagaccaaagcctagcaaccatcttattcattctgcatcggtactggctggtgacagcttacaccacctgctatacaatgatgcaatccaatgtgcgagaatctttttttgttacacctttacatgtgctttcaggtgttttggttacagctatgggtatcagaattttattgatgggtgagcattttcttttcctaagacctaaaagtagcaggggaaaaggctcagcatgttttacccaaatagattttttttttttccgaatggataaagacaaactttggagccaaatgcttcattgtttgtgcataaatctcaacaggctggttgaattaagctctacatattcatcaacaggcattgccaataaagacacaaatacaacaaattaatatttttcaaaactctgtgtcttcagaaaatttctatgaggctttgatgaacaaaacacaaacataagaagcaccaccattgtctcactgtttgggcgcaatcattctcaaggacatctgtgctgattccttttcaaacttggatggctgctatctgaatcaggcccagatgcttttgttggaaaaaaaaatctgaattttggggttttcatttaagttgagtaacagctttctccactcaaacatgcaatttattttacagtgtgagattaatagcaataattgcctgggaaataaagaagtcttgaagaaaaataccacatatcaaaaggctacttaaaaaaaaaatgcgggtctttgctcaagcaatgaagctatgcttcttatttgcaaatcattctattataacttcagtcatactatgcagactactttaaacatctgaaatttaacatctgaaatttaaacatctgaaaattttaagtttttaaatgaaaaatcaggagggttgatattaggcttgtaaatgtaatatttgcatttacatatttctatataaaattgcacaattttatctagaacagaacccacctggcagtcttaacacaataattatttgcctaggggcccagaaagtggccatcagtagagattcaatttttctgagatgaaactattgagtgaagtgcattccctccttgataggaagcccaactgagagataaagttttgatggattcattaacagcccggcctgtaaatctcatctccactgagattttaaagcaaatggcattattctttcattatgctgaggcccttactaccctgttccgagttggtatttgaacctaacggcctaagaatatttataaagtgaagaaaagtaagggtacatttttttttcctttattttttccctcaaggcttgtctcacaagtgcaattacctggctctgggtccaggaaagccaggtctcagcatacagaatacattcacactgtgtcttccagcaacccaccagacctctgcatttcccaaaccacagtacttctcaaaccagcacaccttggcagtgctagggggcagtgcacagaagccagatttggcaagagagaaaagggaaaatatttaagtgtcaatgtaaagccacagtacactgcatgattttattcagctcataaaagggttatttctaggagaagtaaggaattctgcaaacatataagacaaaatcagaatgaaatgattattcaaagaaacagaaggggtgcaaaaaaaagagatgtctcctaagtcttttttgaggggaaaagggagaaatctaataaatctaacagaaatgtttacaggttggttacaggtattttttttttttttgacagatgaacacattggaaaggtggtctgggacagatgtcaacaaaagggtttgccagtataatgactgcaaggtgcaactacagagtacccacagttctccatctcaagtaaatcaattcagccttgagaaactactttgacaattataaatataaatatatacacacacgcacatattatatacacacacacattatatacacacacacaattatgtttgtgtgtgtgtgtgtgtgtgtgtgtgtgcaaaatacccagaatgtcacttccctccccaaactgatatctgtatacatttctatgttgtattggatacatatttataaattcaaaatttggagatacatatttatggataaatacctatctctttgtaaactacaggcaccaatatagcagtttttaatcttttaaaatctagtttagcatggaaaattatcctcattcttgttctttctgaaaccctcttactttatatcatagtattttgatgaaaaagaatacaagaagatcataactctcaatcaatcaacaattatttggtggtgaccagtaatctgatcagccttgtgccagttgctttgttgataaaaggactcaaaaccactgtcctgacataaacaagataacaacatcagaaaaaaaaaaaattgtgaggtatgtcacttatctttctgggtctctacttgcttgatttttaagaatcatatacaaataacagcagcctcgtatttttattctgtttatagaaatcagagattatatatgattttagagaagggagaaattagaaaaaactctgtggtttgaggtgcgacctgcagaggtcctgacatgtggaagggttggggtgaaaagatgaaaggtgaaaggtcatttctgaccaggaaaacaacacattgcagaggcacagatctggaatttgtatagggcatgtgggcacttgggaagaggacattaaccagctcttatggaaaggagtagtttgcagaggcaaggctgagtcaggcagaggtagtcctagaaagccacacaggagtttagtttggatgcatgggcaagtcatgcatccattcattctacattcactgctcatttcctgagttcttcctctgtgccaggccatactgaaaagcgatgacccagagtgagagaggataggcatggtcccagaccacatgaagtagaatctaagactaaagtgccagatttaaaactgtatataagtgaagagtcttcacattcaacatgacatacttataaagattttaaaaaggtctttgatgtttcatagtatctaacgttgttgcctagttctctcaaagcataattaaaaatgtgattctcttgacatgttataagcaataaaatttggggagaggaggggatttctagatgtcaaagtaagtataaatgggcatagacatgattaggttaggctgaaaggttggttggtcattgtttacagttggtggtagaacatgccaagttagatgagtcccaaagagattttatagctatgagatatcatcttgtgtgttcctggctttcagattggtacttgtcaccatggaattctagagcagcaaggaagtgcagatcttattattttgagacagagtctctctgtctctcaacctggagtgcagtgagatgaccatagctcactgtagcctccatcttctgggctcaagccatcctcccacctcggccttccaaagtattgggattacaggcatgcgccaccacacccagctgccgtactttatttagtttcaaactctattttctgaatgatgaaggtggaattcaaattggtcaaggattttactaaagccacacagctggttagttggcaaatcctgagctaaaaataatgtatactgattcgtataaccacccccacctttaccaagtttgagatcagattttaagaggatgctgcaatctctattctcttcataaccagaggagcgtttagtccatggtcctggttcccacagtcaaactcttttggatctataatttatttgtgaatgaaaacaagccattacaaagtggcaataaagcaaatgtagggtgtggctatagcaataattaatcataatctcaggtcccaggtggttcatcttgagctgatatttttttcctactgtttgtgacatgatgaagatataaatagattttaagtttaaatggaaagcaaatccatttctctagcagttataagtgtattaatagattgtttagtcactcgaacatgtttataatctgttattttcttaagaaatactctcagggctgggtgcagtggctcacacctgtaatcccagcaatttgggaggctgaggtgggcagattacctgaggtcacgagttcaagaccagcctggccaacatggtgaaaccctgtctccactaaaaataaaaaaatcagccaggaatggtggtgggcgcctgtattcccagctacatgggaggctgaggcaggagaattgtttgaaccagggaggcagaggtttcagtgagcagagattgtgccactgcactctagcctagaggacaagagcgagattccatctcaaaaaaaaaaaaaaaaaattcatgctagtatagtaggaatcagttgcagagtcagggaagctaagctttgcaagaaaccttggaccatttttattcagtggtatcataaatttatttggaggtacgatactttagaatacacatatacacacacaaaacacatttgcttattatgtcagggggttcctacatcttttgaagtctctcttcagacccacccttagctaagaaaactgatttggtgcagtcatttaacttggtacatggatacatttctttcagcattaagtggtctaaggtcaactcatgtgtaggaaggtcctgagtcaggaaaggaggaatactagacacatcatgttcatttcaggtccaatcccattgcaacgctgggcaagataacttacagtctttggccctcaggttcttcctctgtaaaaaagataaatgatcacagtagtacatgactgctgtttattgagtacctactgtgttaatgctaggcactttacatatttgctttcaattactgctaatatcaatattttgtagtagacatgaatcaccttttcacagatgagaaaaccaaggattagaaatggaaatgtgcctcatatcacgaagtaaaaagatccaggatttgtaccatttgtctccaaaatgcatgtccttctctatgatatggaaattcctacttgtaaggaataaggcagcctcatttatctgcctacgtgaaaagagccttcaaaataatattataaaaaccagagtttcatatcaatgtgatatagttgagcatttttataattctagagaacagaatgaggcaggaatgagagggaatatgaagaaaaggataacaggataacattctttatgatggggtacctgatttttggtgtcactgactatcatatttggtaaggtagtttataaaggggtttagaaagttacactaacagcttagaagtccaataatattttccttctaaagtattcaaagaaagaacaatgagataactttaaggagagtaaactggcttttcagatgaactttctgaaatgattatcaaaaagagctctagttttcttatgtctaagataaattattacaccaccgcagcaatttcaggtctggactgcttcctgagtgtagccccaaataaaggtcctcaagacacttccaaatatgcaaatcagctgagtgggtttgtgtgtgtgttaaactgtattgagtttcagagtaaacctgcttcagagtcagctagggaaacaaaccacagtttgattttagcagagtgaaggacaagcacagtccatcccctttcacaccccatagcttcaccaggtatcagcacacagccctttaaagattaagctctaaatggccacactttttgagactttaataaaaaagctttttacagtatttctcctaaaaatgtctgaaaacaatttgttttcttgaagccaaagcacagaactacagcttcccctcctctccctattattgtgatttccaaatgaatggcattgagttgattgtttatcatgctggataatggcttaatttattacagaaaccctagtcagacattaaaaaactgtaaaagcccactgatctaccaaatccttttgagacatagggcctatgcgcattaaaaacctgctagaccatggtgagcctatgagataggaaacttttttgtctcattagcaccaggatttaaaaatacagcacctcctcaggttgaaatgccaagcttgagactgctgtgtgcagctgggtgtagaggacacctggataagtcttaatggtgtgtaaacagcaggattagtgtttctgagtctccgctgtgcagagattttccgttggcttactcaatttacacacaaaaggtcttaggttcctttgggaaaaaagtccagctagacaaagaaaggacagaggaccttttcctttcacagggtatttggattcatgcatgcattcatccatttaagaaatctttcccaaaacatcaactaagacccaggtactgtgctaggtatacagtggtaagcaaaatcagacatgtatctgatcatcataaaagctaaaaaagctgtgggtcaaacacacacatgaacttcagcctgatttcaagctccctgaatttataggaatgtcttatttatcttttcattttccaagagactagcagagtgacttataaataataggtgactaatacacataaaggtaatggaagtttttaaacaaagtgtgtatgattagttttaaagtagtaataataacaaccattgtcatttattgaaaccatactatgcagcaagcactgattactcgaaataatcttgaaataaattgataggagacatttaaaaatctatgtagaacccacaaccccccataatactgccatatcacaaaaaatattcatttctcctgcgaagctgaaggcattaagatgctgtgtgtactgatttttaagaaagtgtcccaaaatctctgggccttttccaaatgcctatgtgaacagaggagaaatttgcagtatctgtgagacgtcctttgaaacttggtttttgatgagtgcactgtgtccaaagcagtggttttcaggtatcaagaagcacccggaagaactgttataacacaaattgctgtgctacatctccagagattcagcaagtccagggtggggcctttctaacaagttctcagggaaggtcgatgctgacagtgtagggatcacattttgataacctgcctttataggatttcagtttcaaagtctgagtcctactatgagaaggctctctttaagaatgtataagaggaaaagagtgcgtgtgtgtgtatgcggtgagggggagaaaaatgaatggatgaaggcctcagaaaactctctgtggttcacctccatcccagaatgagcaattgtagttctagggtctacagacaggtgaaacgacagaagacagctaggaacagtgcaagaaatattcaggtattatctttcagcttgattactagaggataaagggaaaggaagctcttagactagaaatcccttgctatcctgtaatttatatttcattacaaaactaaagaataaaagtagtcttatccagagaggggaagtcagtccaaattctggagattcctaaaattagtgtgtgtctctgtgtgttaaatcatcccagttttataaaaaaggaattgaggctcaaagaggtcattttggaggatctccaggatcaaaaaggaagaacaccaaaagctgagtctggtccaggtctctctggttccagagtgtatttacccattggaattattctgtctctgccttctctaagtggctccaaatatataaatgtgtgtgtgtgtgtgtgtgtgtgtgtgtgtgtgtagtagcacctggcacacagtaattcccagtaagcatttgaaagttttttttttttttttttttttttttttggtggtgggggtagtagcacctggcacatagtaattaccagtaaacatttgatagtttttttttggtggtggggggatgtacatacatctactattaactgcttactgggaatgggaattactatgtgccaggtgctagtcatatttatattagctcatttaatcttaaaaacaatctgagaaggggatcttacagaatcccaattgtatagataaggaaatagaggattaaataaagtctcagaccttggagaacttgcaaaagaaaacaaacaacaaggacaaaaaaacgaactccaaaccaattttacctcagagctagaatttttcatgttttttctttcctaataccagctacctcccaccatttggccaaattggtctgtctctggctctttatttaattatgtttctacggaattagattatcagtatcaaatttaatatgtaaatgaaatatccaagaatataaagatttctactgttgaatatcaattattagagaaaaatgtgaagagttccaccacattgaaactgtggctaatggccacattagggatgatttatatctatattagagtttcagttaatgtgaaataaaatgtatccttagttttttccattctcaaaatgaaataaacctgaataaattattatgaattgtgtactatcttacgacagctttttgcagttaaattgattaattgttattatccaatgctgaaatcattttcttgtgataactgggcaagtgagttaaaattttctaaggagaccaaaggcaatccactctgacacaaggtgaatagttttaagctaaaggtgacttccttgcagtatccatggctgtcatgaaagtagatgttaaaatatcagatctatttaccctcttcttacttcacaaaacagaatgagttatatagttataatttacacgcctctttaagggcaagtacaatgccagtgctggtctgtactgacatagagataacactggttaacaacggaatgattatattataaaaagaaaggacaaaaaaattgggttagtattagagtttatggaactcagagaatgaggccaattcatgctactctggagaattccaaccagctacaagcacactttccttaaggaaaaaacaaaaactgggttataattcattaaacttggctccttgaggtctgatgagatgagcacagggaacctgctctcttagcacaatcactactaactgacaatgtagtcgagaacagggtctgtttccataatactctcttaagctgtttgctcccaatactcttttaataataatgaaataaactaccttctcaatttttcatttcagtgctaaaagttacttatatagttttctaaggaagttcaccatgagcattgagtttcagaggcatgttgaactttcttaggacatctcatgagctttttacttttgttttttcacttgatgcataaaacccctaacagatacagaatatattcttctttaaacatttctaagggccctcttcccatctcctatgtagtgacagggcaaaaacactgagtcctagatgctcatggcccctgattaagacctgtggttgggaattcatgggaccctatttaaaccacctgctttgatggctcattgaaatcagaaggagatttttactctctcactgacactgtataaatgttagttcactacagggaaatggttgagaggggacagacggagaactgtgaagaaattaaaggacctttaatggattaaaaacaaaaagccattctgctctccagggtgcacatttatttagttagattttcttaaaaatattctcaagcctccaagttcaatcgaccagaatgactttaaaaccttttttttttcctgctccattggagagatatgcctttacatgattactttaatgacaattatctatcaggtaattgcaatgtaaagctaatatgtaagtatggcagaacctgtgaattttacaagtctaatgtctccagggtattttaaaaagcactttggctacatttttaaatctaactaaccattccaacagacatgggagttactactcttgggcaacattcaaaagaatgggtaaagttaaaaagagtaattttctgaagtatttttgacagcaattaatttcacaggggatacattcatatcctaaatctccaggaaaaaatttttttcactgtagaacaagatgcactttttgaagagaaattcctttactagagtttatactttataatgacctgaactgtagaagaaatataattaagtggattcattactatttcttttaataaggtaacttaattgcattttccccaaaccgcagaaaatttacagttattgttcaggcctaaaaagaaatacagttaatcaacctatgtgtccatcactggatgaatggataaacaaaatattatatatatatatatatatatatatatatatatatatatatatatatgcatacacacacacaggaatactatgcagccataaaaagaatgaaatcatatattttgcaggaacatggttggaactggaagtctttatgtgaaacaattcagaaacagaaagtcaaatacttcatgttctcacctataagcgaaaggtaaataatgtgtatacatggacataaattgtggaataatagacactggtgactgggaagggtgggatggagggagggcgggagggggtgaacaatgagaacttacttaaatgggtacagtgtacattattcaggtgatggttatactaaaagcccagactccaccactatgcaatatatccctgtaccaaaactgcacttgtgttccttaaattgatacaaataaaaaaaattaacttcaaaagaattacagaaacagagttacagaaacaagttctatacataagcatattatcataatttattgttaaagaattaaaattattgtagacaattgatatttgtggtcttttaaacttgatattaaaaattgagatcaaaatttcagagagactcattgacagcattttatttccatgttggcaatagttctcttctcctaatggtcatttgaggaaacattggtttacctctttccccatctctctgtatacacttaaattcaaagtataaattgtaggattaccttaacattcaatgtatagtcagaaaagaaacataattaagaaatataaaagcttatcatcttgaaaaattagttcctaaatgccaacttggagattttaaactaattttaaggcaaaacaatgtaatacaaataaataacaaaagctgatattcttcagtatagaaatgccttcatgttcatagtccaatcctctttaggccttcagacacaatgccattgtgttttctcccttttttaaattcatgtgataatattgttttcttgctgacatgtgatctctttttataaggaaataattctttaagttcaataatgaagcaattaataacagtctgaaataatttagatggcattggtcctttcttctggaaaaacaaaccaattcattggaattctcttattcaaagttaaaaggctgaaattactatttatgtaataaaataatgagaaattaacaagcaataccttcacgatgacagaattattattactattgctgctactactgtaattctcaaaatttttccttagaaacaatttggaagaaaatgacacagttaaggtatcctgacttaaaagtaagtcaaaaaaataaaaaaaaaagatgactattaaagttttaatcactctgaggagagagaatggaaaaaaccacatagaagaatcaagctgaagatacaagttaaatcaaattttaaagaacattgatatgaagctgtgaccagttttagaggtttaattagtaaggtaattacatatagagctactgatgacacacagcctagaggttctatattaatgaaaattaactttaattatttaatttgtctaattaaaaggtagttatgtcactagattttgaattacattaagccaagtacaacacattacatccttgtgtccaccaaaacccaacacattcttagccctgttattaactcaacataagtgagttgatttgaaatttctagttaattgacaatttaaggcattaaagttgaaagactcaactaattaaatacatcattcatttattgaataaacagttgctgagcatctgctcagggctaaataccatgacaagtttggggaatgcaaaagttaataagacacttaaatgctttttggcttttaaaataacttattagaaactgtcatttctacattctaggtactcaataataatattgtaattggattctccagaattatcataattttgccaataggtaaataacattttctactcagagaaatctgtgttggcatatcaaatatgtgaaatttggagacaaataatataaaaatacattactctccaaattcctaaattatcaaatttcctagtataattattattcatttattataaaaccaaataaccataggtttaatcttttaaacttcacttacccaagcttaaatttctaccatagttcccacattgagtaaaatttagtcaatcattgagtcttcttttaagaggtgggtgctcgttatgttgtccaggctggtctctaactcctaagctcaagggatccccccgcctcagccttctgagtagctgggactaaaggcatgcaccaacacacatggcagtcaggtcttattttgtacccagacattctcaatggcttcctatgtagtcctaattacagctctgcatttgcaacttactattcttttgcataaatcttccagtttaagtttttcttgactctgtctccagaaattactttcctatcaccacacttttgagcttgtaacccatgtgttgccctattatcttcttcctttgcctccaatgatctaaatgttgcctggattcttggaaacattttcccctttcctggacttccaaaaagaagctcctcaccaccctttcaatttttcactcatcacatcccttttgcaggatgtcgtttgcaaaagaccatatgcaatctctatttagcatatacaatttatcatcaatatctcaagctctctgtggttaggacctatgtcttggacttctgcacaacatcctcagaagttactactctgctataaataaaatctcaatatatttcattgaataagttaacaatagtttttgaggtgctgtgggattttaaagtacattctgaacatatgtgcattgtaaaagtgttaatcacattttattgaaaaattaaaattatttgaaagtttcatttatcagtagcatataggataaatctttgttaatcagaaaagtctattaatcagatctagcattttgaattgttccgaaacaataaaaaatagagatctacggaatttatctgaagtttttgctcagtttattttcagtttatctttactgcaatcctaagcaagaatgctctcctattctctattatctttataatttatcaatttattatttaaaatgtcctattcctgtatgacattttacaaagctaaatgttttttctaaaaagccctatattctccactaattagctgacaattatatgatttatcatttttaatatggctttctttcaatttattcagataagcaggatctaacatgggcttataaggtgaacaaacgtagaaagttctaaaatattatgatctcccttcaagcaggactttataaatgtgtacaataaattatgctaagtaaatgagataattattcattcaatttaagagaaatatacaggcacaggccacattgttagatctagatatgtttaaggacatctctgctgctatattgtttctaatttcaaatgtatttaaattgacccttttttggtggagagtgttgggagaaaggagaaactcaaaacatgccgaggggtcactaaaagcatattaaggagcttcaaaattttcaagatgaatggtatagaaggatttctaagtttagaaaaattcacttagtttaagcagagatgtcacattcaatttcctcattcatccattggtctaaatatattaaacactcactacattccacatattaaaatttagagtattttaaagcccttggtatataatgttcctgttcagtgaagaactccattttcatttctaacaggtctaggatatgcttatgtattttaatgtaataaaactacttcattttccctgtagagaatttgaaatatttagagaaagtgtaagaaaaaaaattctcataacaaaccctactactcagagacaactacctttaactctttcacatatttcgccctccattctttttcccctttatgtgtgtgtatgcatgtgacataagttagttactcttttatatatttttcatatttcttctttatatataatgtgagtcatttcacagccactatcttcacggaacttacgattttgtgggagagagagatgtgagaccaaaagatgaactaaaatgtaatgtgtaataatggtgattgtacacagtataacccatgcctacacaagggcccatccatcagtctggtggagtgcagatatacgttgttgagctgagggttgaggagtgtggagtacttgcaggagctaggtgatggggatgttgaatggggagcgagtagtgatattgggtatttagggtctaaggcataccttggaggtggtagaaaactcgcagtagaatagcagagtaatgtttgggtataggagacaaagtagaggttgacggggctaccattttatgctaaatagtcaggtctttcctttaggccagggctcaagaaaataagaataaaataaaaataaaataaaataaaataatcactctcactggtttgttacacctgaaaatctcaggcctgatgcagtggctcactcttgtaatcccagcactttgggaggcaaaggtgcgaggaccacttgtggccagaagtttaagagcactctgggcaacaaaacaagatcttgtctctacaaaagaataaaaaataaaataaaaattaattagctgggtgtggtggtgcattcctgtagtcctagctacatgtagtgaagaatttacacggtcaacaatcaaaacttgagattgaagcaggaggatcatttgagttcaggagtagaggctgcagtgagctatgattgtaccactatactccaacctaggtggcaaagcaagaccctgtctctaaaaaagaaaatataatttcccactcccccatatgatgtctaaaagttagatcacagacactggaaccaaattactgacttagaattctagttccaccattcagtagctattgggtcatgagcacattaacctatctgtgcctcagtttctttataatgaagtaaccataatatctagcccttgaggctgttataaggatcaaatgagataacatttataaagccgtaagaatggtgactggcatataataacactatataaacggttgttaaataaaagcaatacccctgtaatatcaaaacaaacaaatcttgatagccaaaattcctgctacagaatagaattcatgtgctttggggtaattgctaatgcactgtatagttacttctaaagaatttcatgattataacattctataatgaatcaatataataatagcatttctatggattaatttaaaagattaagcatccaagctgattataattgagctcatttccagtctggttaattctggcagttttggagcagcagagtacttaggttctgagttatttttcattttgggcggggtggtttatgctctgaattaaccatgagctccactttagagaacttgaaaaaattgactttttagaatatttttggcagaatatacaaattgcttgataaactgcaaaagattgagtaatttttcaaaacacccagactgcacctgttagatcattattatttcagaaattccatattgtacattgaaaataacctcacaagtatattttctgtatttatggccaagagctggtcattggagatttatgatgctctgcaaaaaacaatgctgacctggcaagtgcctccagggaaggagttgctcagaaaccagtgaatgaaataaattgctattaattatggtactaagtcttaactccagcccaccccattggtttgtgacccaaatgtttttaaataccttaattcaatttataataatgctgcccaagggcaaccaatttgcctcatatggttttctaggacacaacgtagtattttggcacactgcacatgcttaaaaattatttgttaaattagttaaaaataaatcaaaccaaagtcatcaacaaagtctgtttcctattgagccatgaagtgttttgcaaagaatgactctcttgtcttagttcagatgccatcttgatttaggattttcacttatccaacttttcttacaaggaatagttaattccagttattatttccctagcaccgttatctcagatagtgtaaactgaatatcaacacatacatatatcatactatcaattctttgtcaggtacttgatacactttagatttaatcctgacaaccacactgttttaaaatgggcatttttccatctcttttttttatagatgaaaaacctgaggcaccaataggggtactggtcacacaaggagaaaggggagacttcaggattcttttcttctaaattaactttgaaatcgttttactgttagcatcacgttttgagaataatttttgataaatgtggtatgcttttatcctaaaaagtgtattttcatctccaaatgaaatagtagtaataaaagtaataaaactttttatttcatttttttctagcaagagatggtcttacttttacttccaacaggagaattcttagtcaaagaaaaataatctttaacacaattaacagaaaaaagttgaatctcatttcatttcctgtggggccctcccaggcctaccattaatactcattgctaccattttgcttttctttggtccattaagtaggctgacagtccttcatatttttatatactacgttgagaaatgggaattcctgtcaaatgtatcttacgaataagcattactataataaaattattaaatgggtagatttagatgctaaaactggtagaaccacaattacaaagtatgtaaaaaagccccatcagttgtccatacacaaaagtggtgttatatgttagtgaatataaaatattttatactagagcattctgctcccaggagttgtttttgttgtgttctactttgttttaaagagaaaattctctagtagtatcagactctcccccaggacaaactttcagtttgtttcttttgttgttttgagagaacatatttacaacttaattttcttaagaggggtacatttttttgacatcactatattacaatttgaatcaaaactaagatgttgaccatataacttcttcactgcatgtaagtatatcaaaacaccatgttgtatatcttaaatataaataaaaacaaataaaacctagtataccaaatatggagatactaagattctactaatgtacactctccaaccatgagacaatccatctaaagatgaaagatgagtaacatatattagttcctcaatatattttagcaattattattattattactattcttattactatatattcaaatctttatcctaaaatccagccatttttctccaatgcttttctttttatggttttcaagcttgctcttgggaaacaagataagatttctacctcatgcctaaccaattacaataggccttaaaagctaagctcctcaattgagattttatttcttttcccaattacattctccccatgggattttcttagaggtaagcagagaccaacagaaccaacagcttgatatccaggcataaaagccccaggaattatgattttgtgttggcagatggtcaaactaagctaatgggtggcagaagcaaataacaccccagttaattttctagctcaatcaattctgatctcatctcaggcttatagcacattgcactgtcagcccaaatttaaaaagacagtacattccctcaccctacagaatgcagcaatagatactacaaccagaggactcaagttctaagcagacagctttgaaagtggaagagaccctgtaattccatgttgtttattagactgactcacataagcctcactcctgacagggattctgtcatgctgggtgcaggagtggaacacacctagcaaggctaactactctttttccagcccctcctggattgtaactattaagacgggcaggcatgatcccaagtaaagatctcaaaattcaaactgttgaaactcagaagtacatcttcctcttgatgaatataaaacccatcctagaggagaaactaagattttttttttctacctaactgaaaatatggcaagggattcttttttgtttggtttcttagaacatttccaaaactctgtgacaccattatcatgatgaaaaattccacttaggaagtcacaaaaaatactgtggtctgatgctggggactattgaaatatttaaaaacacaattatttacaactaaaatgtaattaagtccaacaaattcttttttaatatttactatatatttcccactgtactacacactaggaaagcgaaggtgagtcaagcccagggcctgatgtaaaataaggacattcacctttctggttctctttggattacatgtatattataatgcataatacaatatcagtatttgctcatgagttctccattctttcaacgtcttcttttcacatctcattatggtaagaatctgtaattctaatgagatcaaatatgccagtttatcacagtaactaatatacattccaaaattgccaacaatctccacatttgcctaccgttcggctctttatttttaagcagtaacatggtagaagagacacattacttctttatgttcttgtaagaagataattattcccatctaccccaaaatattggtattatgaatgacttagggggtacatatgggagacaaatttaaaacaaaaaataatctgattcttttattggccaaaggaaatctgtttgcttctgttaaaatcttataatatttttaacagagttcagttacttcttattttcttcctccacatatccacattggtaattgttacacttaatttttattgaactatttaaacttcattttaatgttttactgtctctttcttcctgttaaaactttactaactcatctaaaggatggtgtcctagttcaatgttaatgatgtgcttgatgtaatctcccactcaatacacacacatccccaacacacacatagacacacacatatacacacacacacatatatatacacacatacacacatacatatctacacacagtttgcagtttattttttctattgattattcttaaaaagttaaacaaagatagagaacatcacaaactacttttccgttctagtctcagtgcttcacaggctagttaattctaaggtagaaaagatggtaaggagattagttgcagggactagaaaattctactttagcagctgagactttttctctgcctgctcaaacactgaactttttccactcccagatcaagtccaatcacatcttttctgaatcactgcattaaagtgattccttctttctttgagttctttatgctttagtcatttacaattgaacactaagttatatactttaattgttcttttgttgttttccaaattcatattttgcctcctgctaaatctgaaggtttcttgaaaacaagcaatataatcacttgactatactacattaatagtatttgaatggtaatatgcatgtgaagagttagttaatacatactggtgaactgcttcacaataatattctactcataaaaccatgagtgtaacttgttgcagggttagcaaggagccagaggagcttagcaaagccatgctctgtgggaagagtacaaaaacacaaaaacgttagagaattcttttccttggcatcaactcttctgagatggagccatataggcattccataaatgttaactgattgtgatcaacatattttacttccaagatttcacatccaaccacctgccactcatccacctctaatgttagattccaaagggactgcaagttctgttttccaggtttgcctgcttgctcctctggattctgctttttaaggtaggaggcaagtggctgtgagaaggaacacatactgcttttaaagaaatctgggcaaaacagttcaataagtgcctgaaaacgaggagaattataaagttactgaaaataagaatttaaaagaggaaaaactaatgcattctaaattctacattaccagagcccacttttacttgcttcacagttttcttcagttccaggaacctgcaggaaccctcctgaggctgagtgccattttaaattttccctgtgagtagaaggccctgtgaagtagctttagaagttttggaaggtttactggctttggtattttgtcaggcagttcttttgatcaattgctgagcctgacaccagaaggccctcctcctccacctacaccctacagctctacaacatctgaagtcgcctccagtttctattttgtttttgttttttcctcaaaagaaaccagaaacccatgtgggcatcctgtactggctttttataaactctgtaattctagaaccctggacatcagaaagactaccacctctttaaaagtgactgagctataaggattcaattaaggatgatgaagaagaaattgctcattcctttgtatgtttcccttatgccaaccacagaatacaataaatagcatggctgacgagattgttccacagaacctttcatcagatgtatttggggaaaaagcttataatttaaaaataaaactcttcagaatcacctctgcctggtagagtttttccttccccagggattctctacaaggtaggtttttgcttccccaaagattctcatgtacaaacaagcactttaacagtactattaatacaacattttaacaaaaggtgggagtagtaaagatttgttttttgttttttagagcaccatgatgggtaatttttgttttatgtgccaacttggctatgatgaccagttgtttggtcaaacactggtctagatgttgtaaaggtaccctgtagatgtaactggcatctaaatcagttgactttaagtagagcagatgaccctacatagtgtggctgtacgttatccaatcagttgaaaaccttgagaccgaagacaggtttctcagaaaggagggattctgcttctagactgcaatatagaaattctgcccgagtttccagctttctaagtaaagactgcaactaacccttacctgaatctccagcctgccatttgcccaacacatttctgacttgccaggccctacatgagccactttcttaaaaatcaagcaatctataaatactcatatagattgcttatttgcagttatttctaattattttttctctcttaaattagtgtatattgctagacattagtcaagagagtatcatttcaggagttatgaataaataaaattttctcccaaataaatgttttaatttttcttccatcatgctttaaatgtatgtgttaaaaagtcaaatcccttcatttaataatctgtgagcagatatgatgatgtaataggtagcacattaagatctaaaggaaaagaataggggaggataggagttggggtggtgggggcagcaggtggtacctatttgccaagttcctctttctcagtttcgcctgtggtctagtctgtgaacagatgaataaataattagaattctctctttccacctctgtttttcttgctattctgaagtgcctgaatatgcctataggtaactgtggatccaagtaccggctataggaaaagaatcttgtcatgttgtgttatggtcgtaatgctacagaaagtagcattaaaaggaggtgctgaggcatgcccatggttgagacgtatttgcggcaggctccgagtcctgccacccagtactccacacaaactgagctatggaagaaataagtatacatttttcagcactgaattaaagatgcctcttttcccagtactctatactagcagtagaaatgaattccagggatgtgcaggacaatgacacagacaaatggttctctgctgcatttctgcagtcagatatgggaactgcagaaacatttgctttgaagatacataatatccaataagcaaagaagctgggttttttccctgtgaagttatccccaagagaaaaaaagatcagaattagaatgctttgtaaaagtatttaaaactttatatgttggcacccaagaaatgtagctccactcacccagtatcaggttatctcttttgatttcttttctaaccaactgaaataaggagtatatgtattctgaaaggccaagacaatgttacatttcttgcttgtcaagttaattaaacctcagaaaataaaggtattttgtagaatagtcatatgtgatcacatattacatgtcaatcttcacaatttataagcattagcatataagctctattaaccactgtgtctcccacagatagaacaatgcctatgatactcactcatctttgttttaggagtaatcagtcatttttaaaagacatgacatcatttaattgtcattatggtttctgaggttcttcatattctaaatgaatgtttactccaaatggccaacaatttgcacgaggttaacagaagaatcaggcattttgtgttttgtcttgctttcagaataacagaatttccttcctagacataaataaatggagtttgactgtgaacaccaattatggaacccaggtctatagaaatacactgaaaataatgctgcaaatcactaaagcaagaggataattcacaacaaacatcagtatggggctgtaccaaatggaaccatccaaaggttccctgcctcaggtaacaagctttaagcaatgcttgtaataagccctggggaacaattatgactagagaagacatgagtagagtcaaggtgtctcaacggtgtcaggacacagagaagtcaagagatatagaccagatttggcagctaattttagattattaagtagcatcacattatcaaccatatgaatttattaaagcaactttaaaactttattcagatgaacttacccagacttctctgagacaaagcaaacagaaaatattttcctaaaagatgtgcaatgtaagagtcctcctctctgcttaaaagcataatacgttaaaatatcagactgatatgtgatctcatcttaaatatttcctgtaagcttcatcttcctgttttctttagcaatctattccccttctgtccttagaaagcaaagggtatttgatgctaatgtactttgttgcaatatatacacatttctcccttgttccagctttcctaaagacatgaaaaatagcattgaatcctgtttctggcatggtcaatgttattcggctataaattttctgtgatttagtacatgattttggttgacaatttctacttttactatgcagtataactaattaaacattaagaagctttgttgtcatgctgttgataaaaatggcacttgcaaaaattactaatgactaattctataagaaaggacacacagggttttctttcctacccacaaggacttctgaattatggaaagtgaggtctagacaagatcaaacaaggctggaagagtggaatcaggggctggaccctgatttgagtgaggaggtttaaatctatgtgcttatcaatagatttaaatgttaaccaaataataatgtctctgaaattgtatataattaagaatacatgaaatttacattagagggtaatgccttttaatataaaattattattcaaatgctgtagtaaattcctgaatttactactcctgtcccaggagttaatggagtttgccagctgagaacatactgtttttttaaaaaaatataatacaaacttttttttctataaacgcaaaaatagcaattgaagggggagggagcgaaaattctgtcctatgttcagtgtctggaagcaaaacatatgctcaaatttttgttctttgcaaataactacttttcaataaaacaaccactaaaaggatatattgtcaaaacaaaacactgttttcatgaaaaatgacttaaaaagttaaagtagaatttatgaatttctaaagactgaattaggttacattgcctaacatttcaaaatcaacctcctaacatttaagtagattttcagttacacatatactttaaataaaatgtggtggtattttatcactaacatcacacatggacaaaccacatttaaaaccatcgttacatttgtttttccaacatttcctctggtttaattcaaaaagtatataataacttcatttatgaaattcctactatttttcaggtattttccatgcattatctctcgtttaaaatattgctttcagtattttatttaaagaaaataagtttcaaagaatttgtgtaacagcccaggtgacatagctggtgtacggctgagctagagtttaaaccatgtttatcaggcttcagtgcagttttctccccatgttacccagacagaaccagcaaaccataaaaagttttataagcacctgatctcagataaaaattgagcgccaagttaaagacgaacccacaggtgcccacagtatttttattgtcaccatcagtagtgttctcaattcctgagaaataataattttggggatctggaaacaagaaattgaaattcatagcatttcttagaaattccttcaaccataaattattatgtacctttaataatattttgttttaagataacaatgagtgaccataatcataaattgtgtatcatttttctgtaacagacttatacatacaaaagtgtcagaggcttttctataaaaaagatatacagtttttattattaaaacatattgtgaaaagaaaacatatatatttttataacatcaaaatatgcttacctgacatacatatttggtaacagacaactgtcatagtagcgaatgttaacacaaaataaatgtccataaaattattttttaaattgtaatataacaccacagctatttaatatttaaatgctattattcttaaaatgaaattttgaagcagataaactaactgctctctctgaaagtcttgacctttgttttgtgacgaatattctatttgcaattttcttttcatttttgcattgacattagttgaataattaagagtaaatccgaaatggtcttcatgttaggcattaaggtgtatatactgatccatataagctaattttctctttgaacataatagtttctaggtttatccagagtttggttttgctactgaaattgacattgcttttgttaattgaagtttttaatcattttcagatttcatttcaaagtagttcacaacattcaacatttacatctttttttttttttgcattttaagtatttgtacacaactgtaccctacagcaaatattcaaacactggaaaatatctgtgaatgttattggataacattaaaataatgtaaaatttgaattgctcagcaacactaatactacacagaatcaagtgtagaaattgttaattcaaggatacattttgcctccaaaacttgtttcttgggacactataggacttacataaagtatattatgtgtaaaaacatataaacatattttgtatttacaagtatgattactcactgttagtagcagaataaataaattgtgatttaggtaaacaatagaatactataccacaatggcaatgacaatgacaatttagaaacataatattcaagtctcctgacacagaagcctacaaactgtgatgattccatttttacaaaatacagaatcaggcaaactaatctacttagttaaagtcagaatgttgattactttcaggggtgcagtgtgtaacagccaggaagggagcaccaggatggcatgcttctgggagctagaaatattctgctttttgctaaacacatgtgtgcactgagtttgtgaaaattcatttatctgtattcttagtatgcttcgataaaaagttaagaaggtaaatataaagcacaaaaaaatgttacttcaaaacttttgacgaaagcagcttaccttttgaactagtttctgcagcagacaagaaattagaagtcaaaaagattttttaaaaatttacaggaaaaacactaagaaaaatcactgagactcctatcttatcattagatataaatggacatattgtttggtaaatgttattttctcaacaatgtatcaatcaaagctgtattaattgtattctacttatcttgtcaatttagttttttagcaattcaaattttcttatgcctacacatattaacagtacctaaatgaatacttaaaatgaacttgagaaatgagctttcaaataatgcatttctgtgattcaaaatgtttgtttgtgagcaaagcaactccaacttctactaaaaaataaattatttagttttgaagatctatatgaagagtggaaattagactaaatatcttactagagatcatgtattcatgttttgcggccccagtatccagcattgtagcttcgtaggagataaatatgaaccatgttttccgagagcacattatctttccatgaaagtgtagtaatatctacacttgaaactctatggaaacttgaaactctatgatagtttgaaactcactgctcacaggtacatacaactctgctttaaactaagttgcagtaacatagaaacccataggttttaacagtattgtttaatggagtttaccagctgagaacatactgttttttaaaaaaaaaataaaatacaaacttttttttctataaacgcaaaagtagcaattgaagggggagggagcgaaaattctgtcctatgttcagtgtctggaagcaaaacatatgctcaaatttttgttctttgcaaataacttgtggaagaaaaagaaagattgtgaaaataatgcagaatatcttacaaatgaagttattttcaaataagagacttaagaatataaaatgagactttcgtttcagtatctaatattactaagcaaagtgaaattgccataaagccacattctgtaactatagcaaccttgcaaggtaacacaaaagggctcatctttatgcaacagttttagaatatctatgatcctgaatgtgacagtatgtactatcttttttggtctgctgtgacatcctaatacatagatattatgaactatatccaatggttcattctttatcagtcaagaaagctatatcttagaaacatgtttaaaattaaaatgaaatacgtttaaatttaaaataaaacaggtttaaacagttaaacttgctaaccataaactaccaaaaaaaaaaacccacaagtgatatcactgttgctattttaaacataaataaaaatatcatacttatttgtatgtttatttccaactactattttatacctgaataagaaaatctcatcaaagtgctatgatatccccataatgacaacttccaaaatgaaattttcttggtctcaaagcacacaaaactctgacacaactgaatgaaaatgtaaaaatgaagttgtcccaggagatatgaagtcatacatatttactgaagccagcagagagcatcattaaaaattcccatggtagactcaatgtgaaagataatttattccacttaaatatgcctgatgatgatattagaaaataatctaaattaagaactcttggataagttgataggtgtctttttgctcagaatgtctaaatcgtaaatatttctataaacacacacacacacacacacacacacacacacgtctataccatttaatgtagtccaaagagatttgagttagaagtacattttagttaattgtctctcctcaaataactctctgtgggggagaataaaatacaaaataaaatatctaagggaattcaccccacagactaagtataaagaactctgtaatttggtttgaatgagcttttggttttttggtttaactaatacagagatttttatttgatcattgtatagactagtgaatccatttttgtgctcctttttaagtagtctactggggagtataacaaacatacactgatgacttaatgtgaaaccaaacacaaaggtgtttacccaaacacttttctaactggctagataacatgtactaaaaataaaggcccatagaaatgaggagaatgaaaggaaaagaggtggtagaaaaataaagatagaaatttacttaatatttttcaacatatattgtcaaatttttatctagattgttctttctggaatgcaataaaatgatggtttgaacaaagcagtggaaaaacacgtgatcccaattttggcttgtttgttttatataatattgtggtttctattcaaattaatatttctaattttaaaaaaggaaatttgcattaggacacacaaaattactatgcaaggaataaattagacaatctcataagatttgagatgtagaagattacaaacaaaaaataattataagcatgactttgaaggccaaagggaagttatttgctgcttacaaacaaattctattattaaagtctgtattctatcaatagtcatttgtgtgactgggtgggagtgtttgtgtgaaacagacaatatgtccatctgagaaacagtaagctgactgaacagtcatgagattatttgctcatatactgcctggcaaattttaactgtcctttaaggatacagtttttaattttgttctttttgtgtctaataatagctatattatactttggagagcccaaagtctagaatattcaaagaaataaattagggttattatctcaatcattaattcataaacgtgtttctcatataagcacatcactggccttattcttctttaagaaaaagaactagtcagttaaatttcaaataatttttagaatatattaaatttggatgagaactacaatagaaaataggggtatttaatgtatagttgttagtcttattcatcacttttaagaatatatttttcttgaaaaagcaataaaattatctcagaatgcaagttactagttttattttattcactttatgttttcagtatccaaaatggatttgaccaactacaattacgttagactgttctccatttctaaataaagttctgatgttgaaaaagaaaattttgcatctctcttctacttgatccattagaggagttcggtctacttttctttcttggattgccaaactctacataaaaactaagcagctaaatatttgcaaaaggaatatcagtttcagatacgtactaggctatttaatactgtttcattgagaaagctggccatatttgtaaacagttagaatagcaaagatcttcagaagtattttcctgctctaaaaagatgaaaaactcctggtacatttctcagagtgggaaagaagttggaaacgcaagaagctttgagaaaatggctccaatcattttaatggctcactaaagtctttagtgtttaacatctgtgagtttatctagtctttcgtttactcttttaatgtctatgagtcaaaatgatgaggctgaattgtgttaagtgatatcacatccttgagcttgccatttggaatacatttttcataatagctaataactatcatttatttaatttttctatcgtgtttcattcattaaattcatgttcatggtcagggaaaagatgaaacttagtcaccaatatgagggtgttcagcaacagattcaaggtgctctttagtaatcatgctttttactttaacctcaaattgttttactgaattccaaagttgttgacaccaagactcataccaaattgtaaaatagttatttttttatctttcctttctggaaaataaaacaataaggtaccttttaagtaaaaaaaaaaaaaaagtagaagaggctggataatgtataatcagtggtattttcatttacatggtctgttttctattggtcaccatttctacactgagaaacaatgatatctgtcttaatctttcaagatcagtacagtgtcacagctgactggaagaaatgacagacaattcttaaaaactgggagaatgaagtatagagcttcaagaaaaatgatatcaatactaaccccaaacattaaaacaacaaaccaaccaaaaacacaacgcaaaaacctttggaaattataaaagagaaagaagggattggtcaagatcaaacaattatacaaattggagggaaagaaagtccatgagatttaattggaggcaggtgaaattcagaatttcttccaactgatttcatgtttgcaagggtcttatgccacagccagtactaaagagaaagaacagctcagggctaaggtggaactgaaagcagtgaaagtaggagggaggaccataaaattagccaagtaacctggagagttaaaacagtctagagattttttcttccttctttcctttcttgctccctctgttatcttttcctccctctctctctcactctctgccttactgtcttcattcctctctgcagaaaatcatgaactgcaataactgtaatccaccattagcttcagaaaaaagtataatgttgcttgaattttatgccaaaatatgttttgacaatgataatttctaattgccctgacaatgtattctcaataatcatacaaaatcagaacaataatgcaggtactcaatttgaattctgtggcttaactcttgtttgattttcatatgataattagcacaaatcattacctacattctatctctgattaagaaatggcttcctttaacctgatggatttgataactacctgttcaaagattttgctttcctctttattattttcttatgattgtcacagcatgaaaaatatccttgttgtttggaaatatcagattataatatgtttaattggtattctactttacagatcaaactatcatagcctaaaaagtaaaatctaaccttaacacagacagcatattttcatcatgtttaatcacaacttgatcatttctcagtctttcagcaaaaaagattcggttttgaaacatggagattggcaaagaattttagctttgtaaactatgagtcttcttaactgctcttcatgtatttaaaatcccaccaatacttgaaattggcttatatcaaatgtgccctctttctttctgactttccatcagacgggaagtgttctctgagctcttcaaaatactttgctcctgagttatttgtgtactcttgcatattaatatgttgagttgcttaaagatagtaaccatgttttggtttctttgatgtctcccactctacttgtcaatgatttgtacacagagcaaatgctcaataaacactccgtaagttcatgcaagtaaaagtaatttgtttcccatctaaacaaaggaaaaaccatgtctgatggcagctttctttccgattctatctgtttaacctcaaattcaaaataagaagaggttgtggtataacgtgtacattattttcagaaaaaacatatttttacattcaaatataacttgtaattaagtccaaggttatttatgtagtagagctaaaatccttcttattggtaatagcttttcatttaaatatagaataagactttggttacatgattaatttatgttggaatatcacacttttagtaaactttagaaaatgtaaatactaataaaatgttataaaacaaattttataaagcattcataaacataactgcatacaatatataaccacttttattaaaatatagcatttagactatcataccaggttattccttctaaaacatttaagtatttcctttcagttacttttcagtaactaataaaaatgcttatttttcctaaacatatctttaaaataaatctaatttatcagtatttaaaatatttttaataatgctgcatgttaataacttcctactttctatgtgctcattctgtaacatgagcttcaggttttcctttaatatagaggcttagttttaactcaaacacacaaatatgcactgggcagagttctcaacttgtataatgcttctttgtatttaatatcatgcatcacctacttccaaaattccttttgctatctgttatgtttagcaaaacaaatgtgtcatccagcagtgtcattaattagaattccttgtaaaaggtggtgaagtgagtgaaactctaaccttaaaatatattttggatcactctgcttcacaaaacttagagaagacattaacactgccctttaaaaatcaaccactcagtaaatgtaccatatacattttatctatatcacataatgaaagagtaaaacataattaaaagactgaaactgacttattttatttaatggaggacatttaaggagtgaaaatttatttcaaagttttacttagattttttttaatgtgaatcgttagttttgtcagaccataattgtccttagctactctttaatggtatttaacactcacccatatttcaaagttcagatcaaatatatctgatatttgtcagactacgttaagtatgaatgtgattattgcaggagaactttttattcttcttaaaatagtatcttcagggaaaattttatttccatttatattgaacaattaaaacaaaaaacatgaacagaaacctacactgaaaaattcatttaattatcaccttaccagctcataattacttcattctgaactgagataacgactgtagtgaaacaactgtatttgttttattgtattatgcacaaaacacaaacttctaatgattaggtttattttcagtaatatcattattcttaaattttacttcaacgtaaagaataaaataagtagatatttaatgccttaaccaaataatgcaaaacttaacatattttaatccctatttagtgaaaacaaagcacatgtttatacatggtcaatattttactacttaggggcttagatttttacttctggccaaaggatactccacagcctcctcgaagtcaaaatttcagccaggcaaacagtctgtcagtaactattgattgtttagagaaaatactagtgatttattgaaagatctatgcttctgtctttcaatagtaaatgaagaagtaggccaagtgaaccatgatatgatgacatggagaaaagaatatctccaaaattgctgctgcagatgcagaagaaatagaaaagtggcaagttgaaatcaatactcattttagacttagtgatggaatgcttcatagttaccagactgaccataaagcacaggactccaggtcagctgcaaaggccataaccttctttcctttttcactttatagtagacataaatggaattgttctgtttatacttaaatatacacgagtattttattatacaatctgatataagaccatgtgaaagtctcattgaccttgctgaggattatgctgtttgaaagattctcaactgctcaagaggtagacttctataaaaattaatcattacttgaaaaatgactgattaaaacagattactgctttaataaaatcacatgccaaggctagagaaacatcctttcttgttaacatatcttgatatacaaagtatactaccagaaaaaacttacttttcctcagatgatgatacagtttctcttggaatgggaatgtaccataagcctggatcagggtaaactcttgtttttatacagacacaattatatttttgaaacatgagtagcgggcaaagacttctcaacatattcacttgtttcttcattcatcacccatccattcattaattcactgaattgatattttctgagtgcctactacatatgccatgcactgttgtaggttctgggggtacagccacatagaaaacagacaaaaatccctgtacttaaggtatccaatattatcaggatacacaaacttacagctgtataatatattgccacatatgaacaactattattttagggaaagaaaggaaagaggatagttctgaagcctttatttcagatcagatggagacagacttctttgagaaggtgacatttgaacagggattacaataaagcagggaaacttgtattgccaatacctgagggaagaatatgcaggaaaaaacaataggtgaaaatgtcctgacagagaacatggcatttattaagtctgcttcattaaatgaagttttgagaatggaaataaaatactgagaataattgtagatggaagttgtgatgcttcctttatcaaacagttattactcagctattgggaattgagagatcaatatctcctaaggctgggttatgattaggttctttatattatgtagcacaattcattaagccctcccagtataatatgtttttccattcaaaaaataatatacactggtgtagtatttaattggtcatcttacagaggcagtaatactcagacttagagaaagagccaccaaatagtctgaaattcacatacagctctagcttgatagttgcaattgtccaatcctttgaaactaccttgacatggaattcttaaaccattgataaaaacctgcaaacatttaaagttctattgagtctgagataccttggccaataatataaacattctttactttaaacatacatggcatattgtgtacatacatatatttattcataacatatgtatgtaaacacatattatatattggagcagccattaacatgtgccagttgccatatgtcactcaatgtttatttcaacaacttactgttcatctttaaggagtgcagttaattgacaactcccaacaaataatacttgcaagatctgctgaggccatgctctctgggtttgcccctagccaatgactaaccatggcgtggtcaagggagggcaggaagattgggacctggccattttcacccaaacaagaactcctctgatgggcagtcttcactccagagctttccagagaggtggctgagagcctatcagatctgtactgtggcttgaggcctgtcacccctttctatctggattctttcctcttttatcactcataattgctacctcccaacaactttttgtaccctaagtgcatctgagcatttgtcccctggagcacccagctgtcacatgtgtttatagatgtacatgcaaatatctattattttagggtaggtaatacattattaaaactcttttcacttacttatagtatatgactaatgccacaaaaggacagacaattattttgtagttaaatatatcctacttaaatgttaaagggggctttcatataatgaaacatttgacatttgtgaataatttttaatgagaacgtcaatatataaggcagcctcaataaagcattttcctgtagggtttaatataggatttggtttggttgtcatatctaaattgtttattaaaggaccaaaagattcttcttagaagctattctgatatttgagatgtccccatgtcatataactcaagtgtcggtgcaggacaaatctttactatgtgatatttatttttattgaatccagaagttctctgattatgcagggatgtattataattatagtaatgtacagtcagcatatacattcacaattataatgtgatttttgataaacaaaagtattttcgtttattagtaagactttctatttctggtactatagttatccttcaggattttttcaacaatttattaaaaacttgactcattgttcaatttccacctatgagtgagaatatgcggtgtttggttttttgttcttgtgatagtttactgagaatgatgatttccaatttcatccatgtccctacaaaggacatgaactcaacatttttcatggctgcatagtattccatggtgtatatgtgccacattttcttaatccagtctatcactgttggacatttgggttggttccaagtctttgctattgtgaataatgccacacaggaaggggaacatcacactctggggactgttgtgggttggggggagggggaagggatagcattgggagatatacctaatgctagatgacgagttagtgggtgcagcgcaccagcatggcacatgtatacatatgtaactaacctgcacattgtgcacatgtaccctaaaacttaaagtataataataataaataaataaataaataaataaataaataaaataacaggaaaagcaaaataaatgtgacatgtctaaaacagtaaaataaaaccaaaaaaaaaaacctgactcattctcagaataaaattaatacaactgaggaaactgtcaattaattgttcttcactttcagcaaaaatgattaaagtcaactgcacgaacaattcaagatttgtcctgattattcatttgaaacttcctattttccccatgtttttccataaacgcagaacacttaattaatatattctatacacaaagaaatagttgaaattatatgggcagcactttattgtataaattttctttatagtgtctaagatctactgaacatgaaaaacatttaacacctcagtccatgagattaacataaaaattagtgctaatataatggtgagccatgtggttatataatttatatgtaaattatctcaaactaaaaaataaaatcaacaaaaagtatatgttatattactgaatccagtggcagaggatatcatttgaggaatgctgtttctacatttttaaattaattagaagaaaatttagcaatgggagttttgtttaaaaatataaattataccacgatgtaatctaacatttgtttgactaggcaacaaaaatttcctggccttctcccaagattatgttattcctagaaatataaaataatattactccttcatgttattccatatctcatgcttacatcaaatgcaattactactgcttttcaagaaacaaccatgacaagccaataaataaagtattttgactttgagttgggttcccactacaaatgaattgccacaagaataaatgacaaattattcatttgctattccctcccccaagtttaacagaagccttagaaccttcagtacatctcaaacgctgtaagagtaatttatgatcctgaaagagaacataccctattggggcctaaatgaccacaaacaatgagccattttatgagtgttaagtaaggaatccaataaaaaggtgatttaaaaagcagacatgacatctttgaattaatctttgctctaactgacaagtaaatgcctctacatattggatatttttccccttacagcaaaaaaggcagtaactagtcatttcattatagataagttgctttaccacttgagcctgttttctcttccgtaacataaagaggctgtatcagaggtggtctagttaactatattcaggggtcaggcactgaaatgagtgggtcactataaattaagacaaaatactgctttgagctattttgttttttttggttgttttttttgtttgtttgtcttttttttttgagatggaactttgcttttgttgtccaggctggagtgaaatggcacaatcttggctgactgcaacctttgcctcccaggtccaagtaatggtcctgcctcagcctcccaagtagctgggattacaggagtgcgccaccacgcctggctaattttgtatttttagtaaagatggggtttcaccatgtcagccaggcttgtcccaaactcctgatctcaagtaatccaccctcatcagcctcccaaagtgctgggattacaggcatgagacaccgtgcctggcctatgcaagaaattttatgtaagggcattgacattccaaacgattattaaaacccatgtgaaatatattcgctccacaaccctccaaagctcccaaatttcaaattttggaccaaattatctcgaaattctctcaagcctcttcaatctctaagaagcaatctaaaaaagccctgataatgtgaaccattaaaatcaatataacacaggcacaagatagtagaggggattaatgcagaaaattatttcttactatttactgagtcctgttagagaattgcatatcaatgtttctattctttcatctggtctctaaatcacccaagtatcactcaacgctacatcttccaagaaaaaaaaataactcagatattatgggaagagagccaaaaacatcccagctcatagcctaatacacacatttattgggaacctactatgtgtaagatactgtcccaggcatttgggataaatcagataacagcactgacaaagattcctgcccttgtggggcttatactctgcagagacaaacaaggaaacaatcattaaactttaagtaattcgtgtatatattagaaaatggtgtgtgctatggttttctaaaaaataaacaagtaaaagggattgggagggtgggagacaagtggcagaaggttgaagtatctaatagaaaggttcagaattggccaggcgcagtggctcacacctgtaatcccagcactttgggaggctgaggcaggtggatcacttaaaatcaggagttcaagatcagactggccaacatggcgaaacgctgtctctactaaaaatacaaaattagctgggtgtggtggggcatgcccatagtcccagctactcaggaggctgggggcaggagaatcgcttgagcccgggaggtggaggttgcagtgagccaggattgtgccactgcaccccagcctgggcgacagagcaagattctgtctcaaaaaaaaaaaaaaattcagaatagactcagtgaggtccaatttgagcaatgatttgaaagatgtaagggatttaagcatctgaaagaggcactacagccagcgccctgagatggcaggaagtgtcctgagcaaaactgcaagaggtcagtgtgagagaaggagacaataaaaggtctgaaaattctcctagaaaccattaacactgtgcattttagctactatatggattttcattctaagtaactgttgaaatgaggtatcatggctaacagcaactgctttggtgttaagcagctctactgtttatcagcttcagtgtcaagttgcttaatctctgtgcttcacctaacaaataagtataattgcagtataagtaccacgtaggactggttatgaggataaatgagattaatgccaaacgtcgtactgtgactggcatagagaaaccgctcaataaattgttttctctgaacttgctactttcaacacaaaatttttctcaaacaatgagtatcagtgataccaggaccattctaaaacttatctccaacatctatgctcagaatgatgaatcaattaaccaacaaacctctactatgtgcaagggattattttaggtgctgaagggatacaaagaatttaaaatgcattccttgatattaataagaacatgatttaagtgaagaaataaaacatacacataaaaacataatttaatattcctatcaataaaaaggaataaagtactgcatctgcacaaacacatttggatgactcttaaactcactgtgcagaaatgaagaagccacacacaagagcacatacttggtgattccaattaaacaaaatgaagactattctatggtgacaaaaggaagatcagtggttgcccagatccaagggaaggtgtgagaatggtttataaaggagtataaagaatcttcacaatctttggaaatgttctgtatcttggttgcagcattgtttcacaagtgtaaacaattgtcaaaattcatcaaagtgtgcactttaaatgggttctatttactgtattcctccataaaattgatgatagcaaaaacaaaacataatagtcataattgatcagaatggattgaataatcactacagtatatcttccactatagtttgaactagaaaattacaggacaagtttagtttagatatgccaggtcacacaataatttccagatatttcttgaattgcattaggtctagaaattttgttaagcttgaagataaagttctcctattaagttgtcattagttgtggctctattcagtcaatgtctgaataactttatgtcactgtttctttgtttctatatgaagaatcctttcatcttcaaactttttcctcaaaaattttctttttttatacagttcattccctcttaggactgtcccttgcagagatttccaacactttcttactgctttcaatgtaactatcaaagattttaactgcagttttattttttaaatatgggccattctggcttctatctgtagcccttttccaaagatgtataagagaggaagtggcatgtctaacatgtctaatcttaaaaaggacacacttttcaaagagttttattttcaaagttatcctactattggttaccaataattataacacatttttatgaaatgtcaaataaaagacatgcatatatccgtagggaggtagaaaatgaaacgggatattgtgctcttcctaggattcaactttgctgtaatattctatgaggttatcattcaattgttctacaatctaaattcccacatttcaaaaatttaattttcctatgaaattaattgcttaatataaaaagcacatttataatttattcttcagaaatgaatgctttgaaaatacatttaaataagtgttgatggacatcattaacagtgaaatataattaaaagagtaaattatttagttgggtttttttaaccagaataaaagatttctatggaagctttctgttcagaatattaaatgcctaagaagtcatactagattttgaatgtagtacctattctggaaagcaaattcaggattcttgccgacagattaaaaattatttcctaatatagatgactcaaagaaatacctgtcaaacagagagttaagacttctgaatgcagacacagcttgaaaaagaagatgatgtattttccatggagcatttgccgaagaactattcagcagagacataaataattaaaattaaactacagtcgctaaaataaatgaacgatattctgaagcaataggttgacttttaatcctgattttcacttacttccaagctcacaaaatttaaccatctgcagcaaatcgccacatcaataatttgaattagccggattccaccgtaatttctgaagtgcacctcactccaatttccaatgcagtacaattgaaaacgttatcagataaaactggttgcagaaggcttggaacattaaatgctttgacaatgacaaatagaataaggtgagatgtgtcttaaaaggagggtcttcccactacactgtgtttattcaattttagggacaccctctgccacattagaggccttttcattttcttctctccagacaaggattagtagatgtgggccctgcttcccccaggtttatattactgtataagggtaaccctgtgaagtaacaagattaccagagagaaaattttttaaaaaatttaaaaaagggggtagattatgtcaaagccttccttgaagagagagttaatttgtttttttctaatattttgcaggatgtattaaagaaagtctgtagaaagacaagcagggaaatgtgacaacagactatacaaagaatttataggttcttatgacattatttttctttgatgtaaccccatgttggtgatgttatagaacttttgatatctggcagaattatgtcaaatacatgaactgcagtttaagaagcataaacgtcaggttgttgaaatcttccacatcaaactaattagaaagaatttttgaatgtgaattacagcagtttattagacgtcatgggagatacagaagatgtactgatattaggcacacagaggtattttaaaatatgtaataactgaagagacaagacatgaaatataccaaaagggatttttttgtgtgtaaattaagcatctaaccataaaataatcagagaattaatcaatctagagtaacatgaatattatcaagagaaggctgagcaatacaaataaaagaaataatatctccccatggctactcacaagaaattaaaccttgctgaatgtcagtttcccctttgtgacagggatcagcctaaaggcctagtgtccacaacatgttggacaatgtgggatttttaagtgcataatagatcccaatcctttaaatctccaaacctcaccatatcctatatcacattacacttcaactctccagtggaagggtaagtatctgggagttcaccctttaaggacagtagttctagaacccgtagtatgtacttgggatcagcctctagttgaggttattaggtctaagtcagttttactttctattataagcatatttgtcagtatcaattaaacaaaccctctcacttgggtaaaatatttagaaaacggaaggcatttcaggtgggaaggcgggtacaagtaagaaaatagaattggaaacaagtatggcttactcaagatagcatgaacagacctacttgtcagagtgaggattaaaagtaaaattattaaataaatagggctcttcaatagtaggaaaataatgtggaggagcctgtaattgatatgacaggtaataagggaacatttgcacatttctgagcaacggcattccgtgatgttgtacaagccagagagagtgaaacctaactaagagaaaccagctaaagcagctggcaggaatgatgtaatgcaagaacgaggtgatgagcgctacctggattagactgagctcactggaggtagaaaggaagagatggttctcctaagaatcaagaaaactgaactcatattgaattacctcttcaattctctcaaatgtcatgctgccagtgaaggccttacctgacaacctcatgtaaaaattaaacctccttttctcatcggtacactcctgtgtcccattcactgatttttttctctatagaaggtatcactatctgacacactatttatctggcttttgttgtttttgttaatgcttgtttcataccattaaaatgtgagtaccatgatccatgattttcatctgttcatttccctgttcccctgagcccacaagaggggattcaataaatttgaactgagtgaacagaatgaattaatatccaataaagaaaacaaagatgaggctgggcacggtggctcacacctgtaatcccagcactttgggaggctgaggcgggcggatcacaaggtcaggagatcgagaccatcctggctaacatggtgaaaaccagtctctactaaaaatacaaaaaaaattagccaggcatggtgggaggcacctgtagtcccagctactcaggaggctgaggcaggagaatgacgtcaacctaggaggtagaacttgcagtgagccgagattgcgccactgcactccagcctgggtgacagagcgagactccgtccccgcaaaaaaagaaagaaaataaagatgagaaaacattaattatgctttcaaagttccccacctggcgttctggtacaaagttatatacaagcaagaacttcattaaaggatctcaaataaatcttacaatcttaaaaggaaagttcaacaatagttcgatatcacgtgacactaagaaaaaaatgtgatttgaccagtaggtaatcaaaaacagactaaacaacaatccaaagaaactgccaatagtccacaagttcttcagtaaatgtgaattatagcaataatgtgctaatttgtattcactaaataggttttcaagctttcaaaatgtttaaaaatgttttcatttatcattgcaacacgcatggcgaatggaagatggagacactaaggagttaaataacctcccatatgctgtccttccatattaatgaatagaacattacttgcttctataccaaactagaatttggtgggaaagtcatgaagttctccaaagcaaagttagagccattagattaagaaagtgagtgtaataatgtactatttttttcctttagaaaagcgtaacctcaattggccattgagaaggatggctttattagatgatgaggagtctgaaatatcattaattcactcatcagcatctagaaatattctttaaccagggcaagacaaagaaaatgcatttattctcagcaatattcattataccaaaacatttattcattttgcttagaatcactgaagtaaaaacagacacaaattagaaaaaaaataaagcaaatgttgaatcacattctgagtttagaatagaagaagaacaaaaacaagttttctcgggaactgaaaaaaaaaagaggtcataaatattaatgtactagatctacataaaaaaattctaaatgcaggattttcataactctaaaccagaaatcattttagcttatcttggaaaacactaccagtgaaacaacttaatatcagttaattttgttttctaattcaatttgtgagacagcactggatgtattgagaaacagtacatctcctgatcttctaagataccatgtaacttgggagtgctgagaatatattacagcaccctggtaaaaacccatgcatggtgtagtttgaccttagtggggagctttagctttcaccatcaggttctgacttgctatttccttactgtgtaatgtgaaaaagtttttatcttggttattttttcttatctgaaaaaaggaagtcaaatgtcattgtccctttatctcagatagttattataacagataagaaaatgctttttacaagtcaaaaatgaattaatagattaatttaatgtattattctataagtttacctaaatcagaactactactactgttacaattagaaaatgataaggaagggaagaggaagtacatttagaaaactgcttttacaaaccaaaaacaagtatttatgaataaaagatgaagctgctgagaaaagtagaaaattacaataatatcactttattcaagaagatattgggcatgtattcccaaccagcaccaatatattatttttcagagataatgttaccaggaagaataaagctatgtttatttagacagggccagaactttttttaaaagataaactaaaataagtaagatactggaattgatttgaggaccctttgcaatctctttatgttctctgctttctaggtattcactaccagacctcgccaacctaaattttaactctctctttagtcttgttgaccaaaatgacttttcttcaatctaaaccatactgaagctgaattcaatctaactataggaagacattaacatggttcaaataaagctttgcataataactgtttctattatgttgatggtcttggaggtaactaactgttaattcatctttaactgaagaattattatagaagtattctgggggaggtgtttttttgttttggtttttgttttttgtagtgacatgtgctctcagtgtaccacaatatcatagccccacccccacaacataccttatgggccttgtgcataagcattctgtaaattataacacaggataaaatggggcttacttgtatcttctcctaatggaaagcctctcctttagttgtgaaaacttgaaattatttcctctcaatacgtccttaggcaaagggagctgtgttggcaaaagccagagagagatgatgcttggctcagagctgaatggctcaaaggtactttcaggataaaattgaacttctgtgatttactcatttgaaataatgagatttggagtgttctaatataatccacaaatacaagacagtaagatctgaaacgccggctgtagccctgagattaataacctctagcagtagttatcaaatattttaaaataagagacccttcctttatagacaatcatgggagaaagcccaatgttaaaacagagaaaagactatgtctctgctggaatcagggcaagggctccaagtcctgctctttccgcactcttaagccccagcagtggtcctcaggtccctccccagaacccttaggctcagtaaggcatgacctgaaatccattagccttacataattctgtgaaatttagaactgaagaatccagtttgttccataacagcaatttgactgaaatacatgagacaagttagagtggccaggccagaatactagaaattaaagtataataataattttaaaaaatgacataaaataaagctggtagctttcaccctaggcttccttgcagccccactctctttctactaggtcttgaaatttagaaaaggtatcttgaaatccctaagtattaaatagtccatacgtgaattttacaaatgtatccaagttcatatttgggaacataaacgatggtaaaatggttctcttctaagtagggaatgggaccgtgtggaaacttgtgaggggatgtcagaggtagtgcagtaaactgctgatgcaatacaaggaatgtccttttctgtgctagagctaactctcccatttaccagttgattaactttacgcaaaacacttgttattcagtttctccatccatgaaacaacctgtctgcattaaatgatcagacctttctttttaaaaagattactaatctgtattttatctagatacataatatttttgctgagttgaaataaactttcttaattttcatattcccttttcattataatctctatcctgagaaccatattcatattttcatcactgctgaatgttgtctccctggatgtcttcttagaacttgatctaagatgaatgttattctcccacaggcactttcagaagcataatccttctgggtacttatatccaggctcttcaagtcgccttcagttctttcctttcacttctcacatccaattcaactactccaatgtcttcattcattcattttttttattatctactttgtgatttgtcccactgaaagaacaagacccaggccatgtcctaatgaaattgtaaatctagtttctcatgtttggtcctttccttcttttcctcatattatcatcacagttcagcccacttttatcttaacgttttaaacaacctcttagcttattcaccttcctctaatgatcccacctttcctcagcactgtaatttggaattcactctgccattaagatgtctttttaaagtgggactctgataatggcagcatccatccccaaccctctgacacacactgtgtgttgactgcaaaataagtttataaatccagggttataaatgcagctatttaaggaacctggtaagacacataaatgtgtgagtctggttagggcacacagtagggagtaagagagcctagggaaaatttggagaggctatgtgctgcccagtgactttcaaattcaattaaaaataactacatctatgaaccagaaagctaccaattctttcattccaaacctcccttgcagccacatttgtgttgcagccacacaacatccctcactataatcatgctttgcttgaagctgttccaatatttctaatgacactgttctttctttcaggtgtcctctttcccagtgaatctatcctcatttctcatctcttccctgtcagctaccacttatccaagcactttttttccagtaagaattcatctcttgctctcctatatggtcattatattttatattttacatatttataaacatgacatatgtatttatgttccacaaagggctttgaatagaatttacacatagagttccctgggttgatgtgtttatcaaaatggaagataaagtgaattaattacttaaatatttaacactattgaatagaaataacttccccaatattgcttcatgatttagacagtctattaaatgtttaagcaaggcactagactaagtttattaagacaaattttggaatatgtgcagaaatatgacctggctaatagtacagagtcaaagctggttgaatggtgttatatagtggattcagattgatgtggcagtggtggttacactaggggcactaaggttatccctactggcactctgaggactctattctctaccacacttttttccattaaaaataccaagtagattaatatcatatttgtagataacacagggatagaattacatacgaggagaaaatatagcttacttatatccatgtactaaaatggaaatcagaagcatttctcttcctttgactcctcatctctactttctcttcagtaatccatactataaatgacatcaccattcacctagagtcttctcatgaaaatctgggaagcagtcttgactccagtcgtgcccacatctttgtaactaatcaaccaacaaacccatagaccctaactccttagcacatatcaaatctattacttatttttcacctctgatgttaggaaaatagtgtaagcttctggtatctttcttgactaaataattgttgctatgctgttttcttatctttggttctgcattttttaaatctgttctcttgccagaataatcttttgaaacaaccaatctgatcctgttccttaagtctttccatcatcttgacctttatctgtttctccagtttcatcctttaggttcccttgttgcattaatactcaattgcttgcaacctgcatttctcttacatacttacattatgcttctgcctgaaatgtgtctacctatgctagacaaatataatggcaccacaatgatgtataaatcttaatctccagaacctgtgaataggttggattacatgtggattacatgtgttgcggctcagaacataccccaaagtatggcaccctggcatgctgagtacttggaactgaaggaaattggaaaagcctcagaaacaaggtctctgaccttttcctgccctcctctctcacacccctctttctccccagaagcaagtcatagcaaccagaattgcatttctccaaggtctgtctagaaactaaaagtcttctcccctaaagtaagccataaaatgtagaaaggtcactctctcccttttcccttgaagactctcattgccctatactctggagggaaaaatgctacaaagagaagaatctgaaaaaaaccaaaaaaccaaaaaaaaaaacaaaaaaataaaccaacctttctggatttcccccctcagtctattaccattagattatactcttttgtccaatcacatttctacatggcggttcattcttcactgaaactcagtataaaaagtacacagttttccctgggtatttgggtcttcaactctgaaagtgcctgtgttacatgaaactttgattaactaagtttgttatacttttctcttgttaatctgtccttcattacagcagtgttggctgtgacctttacgaagggtgagaaaaagatgcccttattctttttgcccttaaagatagcaaaggcaattaaggttgaagatgttaattacgtttgctaatcagctgacctaactatagggtaagaaccctggacccaatgttgtcacaagctccttacaagtggaagaaaacagcagaagaggagtcagaggaaaatgtgactacagaagaatggtctgagagatgcaaggttactggctttgaagatgaaagaaaggagtcaccagccaaggaatataggcagcctcaaaaaagatagaaaaggaagaaagcagattctttgcaagtgcttctaacagaaatgcaccattgatgacaaatcaaatttaccccagtgggatccatgccagacttctgacctacagaagagtgagataatacattcacgttgtttaagctattacatttgtagtaatttgttatggcatcaatagaaaactaatacactacaatgtcactctagccaacactcatcactcaacaagactcagctaatgaagaatgttggtttctgtaaataacttatattacagggcttttaactattgatgagacttccatgtaaaaatgtattcacctactgagctataaatccctctagaacaaataccaagccttatttatgtttgtattcacagcatcttgcataggacccttagtagataatttactacttttaatgattgaaggtagaattgaatagtaatgtttcatgttttaaagtgggctgacaacatcaactcttgagtagagtacagaaaggctgacttatgagcagttcatgtggaaaaacttagagatttcaactgactaaaagttcagtatgaattgataaaacagtaacactgacaaaaatacatacacacattcacacatacacacacacacacacacacacaaccacacccctacctttgattttagatggcattaacagaagtattatttccaaaaccacagaatgcttccattttactatgccttgctcagatacccagggatagtataattaattttagacttggctttaagaggtatcctgacaattagagcatgccaagattaggagaaggagacaaccagcaaagagatggtaaggtcttcagcactgtgaaggatggtttgaaagaaccaaaaaataaaatatggaagagaaaaaatctgaatttgggtataggagttgctatggtttgaatgtgttccccaaattttgtgtgttgaaaacttaatcctcaaattaatacgctgactggaagtgggtcctttaggaggtaattaggattagataaggtcatcagtatggagcccccttcatgggacaggtggctttaagaagaggaagagagacctgagctggcagggactctcttaccctctcaccatgtgatgccctccacatgttatgatgcagcaagaaggccctcactggttgctagtgccatgctcttcgacttcccagcctgcagaactataagaaataaacttattttctttataacttacacatttatggtattttcttatagcaacaaaaaataaagatggggtggagaaatatatttatagaaagtatttttttaagtaaatgagaaattagacataatgtttttaactctagagaaattgaaaacagagcacagcacatcggataaattcaataactatcttaagaatcagcaaaacaacatgcagatggctgattggcaatagtttcagtaggcagattttgattaaaataaagaaaaactttttaataattaaacctctccttaaaacattatgactttatgaggtaacaaggtaacaagtacagccttctgaaagcataaacagcgtttacatcatcacccattacttaactagcagaggagtttgtttgaataggcatttggactaggagacttctaaagattttgtcaaatttgtgacttcattatttgttaattaagtccctctccattctaaagcaatttctgtgatttttctgattgtggtagacttcacaattatactgatttaaaacacattaccatgtactttctggctcctagtaaattgctattcacttaagtgttatctctgagtcctaaagtgttaacagacctaccaaattatgtgaggaatctcgccttcccccacaccccaacaagcttaattttctcttgaatatttatctcactctctcataactttcatataatttcaaactctccaaaacacacccaaaaagggagctgaaggacaggaagggattatatattttttccatggtatattctcttctaatgcagaaaggcaattaggcaaaacaagttaaaagcaagctaagctttttcttcttgagcagtgtagaacaaaaggctttatctgatttatgctaaaactagttcattgcaagcaggatcttaataccctaatcaaagaaatttaaaaataaattaaagaaaacatctcacctttgttacttagaggcaaaaattacgacaaaattatttcctggtcagcattcttagactagcctcagctattttttttttcttgaattaagaataatgaaaatcaccataaaatgaaacaaaaaaaatgtatcacaaaaatattttgcaattctctttctgcccccttccattttacttcctttctcaacatttgggatttaatgagctttaaaaatatgtatacaaaggataactgtctttgacttttttgatctttcctccatgtagtttgtgatttaaaaagttagttgtttcctttgaaaattaattttatttgactcatcattagacacccaatactctgccacatgttccactattgtgcattcactattcactagaaatacattacacactttaccgatattcatatacttcatccccatagctaaaagagatttttagattttactatctgtgctttacaaatgagacaaatgagtttcaaagaggccagataactttcccaaagccacacagcagatacatcatgaatctagggtctaaatgtgggtctacttaactccagtctccatgatccttggctatgcttgtgcaacaagatttcctcagcatctttcatgtaccaagctctacccttaattcaaaactgaaaatatcaaagcccctgccttcaggggtatcacattctaacaacagtgactgaccaataataaatgcaatccagctaaagaactttataatagaggtaaatattaggtataatggtgttcctaaaaaaagaataatccacctttcctagtttggggtaggagtgccagtgtgcgcaatgactgaatatatactgctaacagctaatctttgaccaaaaaagtaagattcagtctatcattggattctgcttcctctataactccaggaatcagccatgccaaatgtgctaagggcttccaactctgcacagatctcactggggctaactcaagggctggacaatgccatctgacaagttccactgacattaaaaaatacttgtctggtgtcccctatcatcaaatccctccttaagaacagatacatcagttaaaattatgtggcactttcaaatactatcatcatgatttattgcaacagatgggaccactgagagatttatctttggcaaggggataatttttggatccccctcaaatcacatgcaatatgtaaccatctatgaatagagcttccctagaccctaaagttgccctctcaggctgctgtcattactctttcacatctatttctacttggagaaatgagtaacaccttgctcttgcagtgacaacattacaatctcgtgttcttgtccccataggagcttgaccttatcaccctcatcactctctccctgctttttcttgtattcacactaatctttcaaccacttcctttatagttttttttttaaatcttaccatacatttccatataatttctatacctgagtctgtcatttctgaatgtctaataagaatactgtctattatttttcagtagaatccatggaccaaatttctaccccaataaagcctgaattttgtacatacaacatattcttgttttatttaatggttctttctccacaatttccagaaaaaagggtcattatcatcatccttttccattgcatcaagatatatttgtgccagattttaaacgtgagctcagtatttgctgtttagcttttccttgtctggatcctttttccattgtacattattgagaatgatcctaaaacatattacaaagtgtccataggtgggcattacatacaaagtttaaaagttgccacatattcaatttgatttttgttttgtctttttgtaaagcacatggtctgaactctacacaatgaaaattttaatgacctttacaacaagatttgaaagagctcagtgacatctttactaatgtgaaaactgacaatttagtttcagggatgaagggtagatctaatagaataactacattttttttcagtcctttcataatggagcaacttcttttaaagcaagttaataattattctttttattatcaaaaaaagtctttcaatgcagaagcattatgaggtgagttatcaagttgtacatgtcactgcaaggaaaaaacaaaaatcctcaccatgaagattaagtcctcagcttttggaggtcaaaggtcaaatcaatgagttgatagcactagtcacaaagtgactgggcattagatcttctgggggaaggagtgatctcttttaaagtacaggatgccaatctgccataacctagtgaataaaatcctctgttaagttccttgaaaaatctctattttagaaaatgcatcccaggtgattgtgggagttcctcaacttcagaatttagggaagctctatacatagagggttacatattgcatgtgatttaagatggtaccaaaaattatccccttgccaaagataaatctctcagtggtcctgtcctgttgcaataaatcaagatgatagtatttgaaagtgccacatatttttaactgatttatctgttcttacacagggaattgatgacatgggacactagacaagtatgttttaatgtgagtgaaacatgtgagtaactgctctgggctgtccctctgagaactactaggtagaacaatagtaatgatctcaaggtttgcactgatgtttgagcaactgttcagatgttctgacagggaagtgagctacttgaacatgtttgattaaagaatggttctcctatgggctttctctctattcagggaataacatgcttaaagtagttaaacaaaaaaaaaaaagaaaaaaaaaagaaataaactggaacctagcctaataactggcattcgttctataaataatgaggacaaatgccaaaccaaagagtcctcacattcatcagtctaggtgttggctttctttgggatcaatcagcttctctcttcttccacctcattggtcagtgcaaatccaactgctctttaagactcttaacttcagccagtcctctggaaaagaatgccactggtcactgaaagtaccgatgggtcagtgtaaatccaaccacactgctgagaaaacaattcaaaacgcatttctgctgactgccagacaaggtattgttttatttaaacaataaacacctgaaagacagctgttaaaagccatcacatcattcttttaggtcagtatagcatcaaacattatctgttcactgagtttagaggaagatttctggcagattttgctactagcaatctatgaaatcctatggctaacttgtgaactagggtttccctgtgaaatggaatcacaattggacaatttagggatttccatccctctagcagcagtttagcccaatctaaatttgattgtttccttaaatggagtaatttaattttctccaaatgtctacagactttataatgccaagtccagaaaatgaaagggaaaactgggtcagtttcccaggtaactcaagccaaagaataaaatattgctttgaaattccttataaagcataagttgttttaattttctgaattatcttattcattgtctcagtagtgtaattgtatagtctatacctgggttatgcaataaaatagtattttaaacatgaaagaaaatattagtctcagttcatagttctttgaatatccctgcattttacctgtttgaaagttaacacgaataattaatagagagtacttcagctgctcctattgtgaatggactatcatggggtcgtaggtacatggcaaacaagccaaacagaaagggagaactgcagttttgtgcaataggcatttatataagtaggtataatatgaatgcaaaagaatacatcccgaaaatggtagctattattatacatgtggctacatttcttaatataaaccgtgaaaacaaccattctgaaaagctgtgcctttacaccacatgtaacagtcccacataaagcagaatctccttggtgattacagtaataatgactacgattgaatgaaaccctttagctctcactctcttttcgaaaggacaagtaataggacatacattttaagcaaaatatggcctcaggcactgtagtactgttgatgctttttaattcgaagatttcctaccattgtagttcttcagcacaggttctatggcttaggacagccggctgtggacctggacgcactgataagtcatctacttggacatacaataatgtatctgtgtgctgagaaagaaaaatcaaaggcttttgggtgtttatgcctacttgatgatctcggaagaatgaatcaatttatatttattttagtgaaagataagctacatgaccataaaatataagatctacttcattttttgaaactttccatcacaaattgccaaaagatccttcctgaaaacgtcgcaatgaatcatgctattcagaagccaaacttccaggatcctcttcctgttacttgtatagacacagagacatgcaaagattaattactgtccctttcttaaagaaatattcatttaagactgagataattagaaaaatgtgaaaagaaacctttgaccatcagtggttgtgaaagtggtttttaaatcttttccaaaatttctagaggcttcttgcattggacagggaatgagaaagataaaaagtgtcaaatctgaggccacttgacccacaatacgatacaaaaacttttttgttttcgttgactttgtttattcttcatagaaagatttaccttggagcaaaaaggaaaaagaaatttaaaaattagtgtactatgagaaagaaaaaatatccaaagtaaaacccaaaggaaacttgacaaacttgtttagctaaccaaccagttgatcattaaacaagaatttattgagtatctatttgtgccagtcactgctctagggacccttgagacacatcagggcagggtagagatttctgccttcaccagattccttcctctggtgaaaggaagacaaataaacaaaataaatgagaatttttttaaagtatgttaaaagatagtaatttctatgaagagaaactagatcatggtatggaagttcaggagacggccaaattgcagtattaagcagggtggtcggttttagtctccttaacatttttagcaaaatcttgaagtatgtgagaatactagccaattatttaactatttcaagataattatatgttatttttccaatatagacacctcagaaatatatctacttagcttttccttgaaaatgtggtattcagataactaggtgtcagcagtctcaactatatatcattctgtgaagtcattagtatggcaaaacattaatttacaaaaaaagtttcatctcattggtacctccagtccatgaaaaaatgtctatctccctgcctccttcaaccaataaatttgcatctgaaaaccagcattttaccaatgatttcctagggttgctcaaagtggaggcaagcctatttcatcctcattattgtatgtaagataaatgttaaagtgtaaagagtaacagatatctaaataattttgattgaggataatcaatctttaatacttttttgtacaaatgttctctgtagtacggatcatcaggacatgggtgtctagttagtttcaaccaaagacaatgccagaatcataaataatagggtattaatatgatggaaagaagatattaagataatgatactgtttttgttaaacctttggcagattacagatcaatcgttttaaaatcatttaatccaaatgcacacggtatcttttccttattgtcaccattaataaaaagcctcctctatgcacttttgcaatttgtcatgtaacattagcctcagtaattgagtatttttattaatccatattacagatcataaggttttgatatttgaggctaaattatttactcaaggtcagtaaggaacaaatctggaatatgaacccagctcttatgacttcaggactattacccatcagttacaaggtggagttttactccctcaaatgaaaatcttgataatgagagacaccggcattctagataaaaatctgtgaatggtttcctttatactaccactaaatttattgactaagaataagaagatgaaactctgtttcatgattattagtgtttaactgaagaaaaatctttgaagtctccttaaggttggctattctatattatgatagttattttggttcaaaattgtacaaagttttgcctatcataataagcagcgtcacctttcatgccttgtaacacaaagagggacaatattatattattatatttttagaagatctctaatattcttctctgctccaaaatgttatgattctaattaaagatccaaatttatctagtttaagagctaaagactatagaaaattacattgttttttaacctctgaccagcacaatttaggaaatagcctcctatcaagcctaaaagtgttgatggttgttaaaaatctagattaaaaaagtacatttgcaaatgtataaataacataaagtcattattttggagaagaaataatcagtttaacctccattatgtcataatttgaaagttttgctatttgcaacatatttcagtaaaacgcatctaagtttctattcataccacctcattttttaaactattaaagtacagagagtcctttctgtgctcctctctgaggataagttagtctacaacaagtttagtaaaagtcttgtttagatgatcagtttttcaatgttatcattgtttaaggaatgtataatgacacagaaaactttgcttcacagagccaggattacagaaatacattcaagctgggacttttattagtaatacatgtaacaagattggttaaatcacagcaagagataatacataagcatatactcttcaattagtttttcttggttctactcagaactaatgaacatgtaagctaaagatgaactagtaaacaaacattgaattctaaatagtcacatagccttctatgtgtactgtatagataaaagtagatatttaatgtctgatattataaggtgaaactccggtcttcccacggtctgcggctgtgagttaaggggatccagtattgcaagagtagaggtaacacagtagaaaatttaaacaaatattcttacttcttagtttgtatatgcaccaaacacaggcatttcaacagtaagggtctgtcaacattcacaaacttttctgaacaaacagatgacttattattatgaaactaaatgaggaaatacaatttaagaatttatacagaagaagatacatatcatattttaataaccaaattaggtctatatcagaaatcacagcaaaatatattttaaaaagcataaaacaaatatgcattaggattttagtaactggaagttgtgcacttcacagacaaattcgctatatagcaacacaggacttgaaaatggtataaaaataaaaatcatggaaactgtgtgatctgaatgttgtatctttccaaaattgataaactgaaatccgaacccacaaaatgacggattaggagagggggattttgggatttgattaggtcctgagggcagagcctttatgaatgggattgctgtccttataaaagacactccagagagctctctttctccctttcaagtgaggacacaaagagaaggtagtgatctatgaaccaggaagcaaaatctcactggacaccgactgtgtcagcccttggtcttggacttcccagcctccagacgtttgagaaataagtttctgttacttacaagctacccagtttatggtatttttatatagaagcccaaatggactaagacaaagacaaaagaaaatgtattaaaaaaacaccaaatgctttattcttttctaagtattaataatatcaaatctattataagagtaagtttaatgaaatattattgtggtatgacagtatagataaaaatttaaagcacatggtaatattagatattactcatcaattagttcaggtggaagagttgtatccaggtcttaacaattacaattagctttaacaattagttttgagaaaaatctatctttattacttttataaattatactaatttaagatctactcttcacaaagagaataaggcttatgcactttcagaatgtgtaactatattcttttcagttctacttgtaatattttgctcttctagtaacatgagaagcctggataattaaacagtaaatgtccatttgactctttaaaatggacagttgaaaccaccgcccccaaacaaatacatttaagtcatgaaaatcgcaaattcaagatacaataagaaaaatgttctggaaatacaatggtcaaagagaaagacaagctttctgccctcatagagcttacactctactaggaaaagttagcattaagtataatcacaaatacaaatatgtaattacaattatgatgacttatgaaggaaaagtacaagcctccaatcaaagtgccaacattcgctgataattattaacttgtgctcctgagctattaaccagctattatggcttgattttcatgtataacatattttgacttttttgtaatttaaatagtcattcatttctgataagccattaaagtaaaatataaataaacaatcaaagcaattattggaatgaagtgaccagttacacatacataggaaaagaaacaagaacaaaagagaaaagacatacttcattcaaggcaaacagataaacctaaattctaaatagaaaggagaataaaattagcattatcaatgatcctaacaacaacatcattgacaaatttcaagccccaaaaaaatgtgatccaaatttcatgaagactatttgaatccatctacccacaaccagcaaaagtaaggttggctttgaataacagatcttcagctgccccaaagaaaactataattcattcaaagtttattcttaaccatatccagttaaaggtgacatatctttgtttaggaatgtaaaaaacacaagtaacagactgactctaaagtttgaaacaggatgactaattaaaaataggaggcactatggcctatgagaagaatgagtaaactcgtgtttaattcattgtgattctgccagcccacagcagtggtctctaacatgtctccagctgacttcgccatttttgtcatgtacacatgataagggattttgcagtttccaaaccctgagttgttatggagcacagaaggatcaacatcaactctgtaaggacacatcacaaagtgagaccagtgcttacctcgagagaaaggacttgagaggaggatgaagaaggttatcaaaaggcatgttctttttacatgtgttaattattttttaatgaaatatattcatctatcactggacatttaaacagttagaaaatatttaagaattcataaagaagaaatcaaaataatgaagatgttcttgaatttatttttttatagtctttttttcataaagaaagacattaatccacaaaacttcattccagatcccctgaattcactactcacacaagagaaaagtggggaaattgagaaaattgctccatgattatattgagatataaaaatttaggaaacataagtttacactgtaaatcagttatataaactgtccagacttaaccccgattttatgcacaactaggatttaactccacataggaaattgcaatgtaaagttcctaaattattttttccagatttttttttaattcctccaacagatggcacaaggtggggatattcacataagacagacttggattgatgttatgctttcctttttctgaattcctacttcactttgtaccagtctcacagcacttccattctgtcattcattctaacttgcccaaatgttttcatttccttgttatatgaacactctgtggatgccatgtcatagtcatgattgtatttctgctctagaatatagatttgttgaattaatctgcaattagagaagacttacaatcacctttctcatttctctacatctaattaaacaatatgaaatgggtaccaatgtgatttgcaaaatactcaagtccatctaaaaatcttctctctccatttaacagcaaaaagcttactcgtcccaataatagaagaagaatgcaatgaaaaaaacaaattcctgtcctctgtgtctttgtgctgattgaggaacaaaatctgatgaaaactggtgaagttaaaaaataatgtttgacacacatgccaacagaaaacatttaagactgacatagaaaaactaaataaagttaagtgacacttgacattaagtacaccaaaacaaatatcagctgagtataaacatgaactattccatatgtagaaaatggttgtataattaaaaaattattttaagagttactttttcacaaaataacaaatatacgagtgtatatacttagaaattgtgtatttatacatgcatccatacaaatacacatatgcatacatacaaacacatatacatatactttactcagccagtaagataaagtatattcttccctctatgccatccctaagtccacaaactaaagaacatgatgagaaatgcccacttaagagaacgcagtggatgagattttggcctcaagtaaaaatgtttagaaagcactcaaaatggtacacaaaacctctaaaataattgatacatactgtcatttgcatagttgctagaggcttaatatgagattaaattatactattgaaaatagctgccaaaaccaaaactgtgataacctatgttgttggatcaaagtattcaaacagcatttgtttctaaagctctattttacacatttaaaattgatatcatttcttacatattgcctggctcatgttcagatgctttttcaagcagaaaagttttcctgctagatgacacaaacataaaggtgcagaactgtgaactgtggtcccaattcaccagattaacactgagaacacaggaaagaataaagatattcctgcatttaaactaataataataattaaaaaacagaaactaaatagaaacattcactaacacacagttaaaaatggttgatttaaagactattctatatgtttgccacagctgcataccacttacttccttttaatgacaacattaaacacaatgaggatggttttaaatggcaaattacacatgcttctggatttcgtaccaacatcatcaaagagtacacatgcctgacttaccaagcaatgcgggaatgcatagctagttgataatgcccttaaaacaaagttagtatgcataaaaagaaatgtcttgctcctctgtttgtctctttcttaatactgcctttttaggttactacagtgttcatgtgcataaatgacacctagcagacaacaagatgatgcacccacagcagtaccatttcagtggtgcacatgcttagacttatgtctcaatacagaatggctagggcaggtgtgctccagagctgaatatttgaagatcacatatttacagttcctacacttatttaagtaccattaaatgatactgcagaaactgacaccgaaacttgtagctaatttctaaatatattaattatgtgagcacctgacatgaaaaagatcactctaaagagaaaaaaaagggtgggggcgaaaatggaaacatattgatggatttttcttatcttaaatttataaaatatttattaacacatatacctacctcccagtgcccattaccaatgccaaaaggtctaaatacatttatgtaactcagacacactgtaattcatacagatgatattaagaagaaataaaataatgtaatacctttacttttacctatggatttgatgaaatgggtccatgaagaaagggtttccagacaaagaggataaagaggagaaaaacaacaataagtattatgaacatatgtaaagccactactctctgaaaattaaacaagacatgaaagtataaacaaggttttgaagacaaatggagatgcaatcaggacatgttgggaattctgccttttttgaaggcaagtacatgcaaaaaactgaaaggcccatgctcagttttaaaagatcacacaaaagagagacatacaataaatctacgtagagaaagtattgattctgtggaacactatactcagcattctacaagccagaagccaaagatgtctgcatgttcccaaactgtcatgcatggatgaaaaatggacttattttttggatacagtggtttaaactgaggatcttctttcagacagcaacttctgatggttctcggtttttctttaccataaccaccctttactgcatatgctgataagtatatagaaactttcaatcacaatttcttatgtctcatttatttgcaaatattataatgcaagaaatgaaggaaaataaaagccacaggaacaaaccaaaatcaaacgaacaaagaaatggaagaaaaacacatgaaaaaatgtgaacaaaagatatgtatttaatttgcagccatataatttgcaagcatttgcccatcctttgcagtgatggtttgaaagcagctacagaacaagaaaacactgaaagcagagtggaaaaggaacagagcccataccttggtcgcccatcatcaggtgcgccagaccttgaagggaaacaagagcacagtcagcaataaacaagggagcatgggaaggcagggttgtcacggtgacaaaaatgttcagtgacagacatctcttttcctatgagacatgtctgtatcacagaggcaaatcaaaaagcattctttcaacccctggttggaatgctttggggcaaagtgttctagaactgcgttttaaacactggcatatgctgcactgtgtatttcttccatgcatcagttggaacaaccaagagcacaagagcatgacttaaaatccaaccaaacccctcaatattacatctgccctctgtgccctttaatgagactgttttgcatattgcccccacagggcttgtaattcttcagtgatgaaattacatttttttaaaacccaatggaatacatgaaacatgggctgggtctgatctttttcccctcatcaaaaaatgagcattttataattaaatgaagaaaaaaaaattgtagtcacattgaaatgataatgcagaaatgtctccttgtctgacacatgtagcggctgactaggcttgttcaaatacaaaatgatcattagacatgcagttgtaaagctagaatttactacaaaaaagggtttttaagaaacaatgggtcagctgcaaatacactaaagcaattttcctcagagaacaaaattatttgagatttcacctaaatatttcttaaatgctgaactctaagttagtgtaaagatacatattacagatgtaatttcatcaaggaattctttaaaggacattgaaattcctttatttaatttatttattatttcctgcttgacaattcacttcaaactgaagagcacttctcttctaaataatactactaacatgctttcaaaaattcttttgctattcaagaagttactttttactgaaaggcataattcctagctttttattttaaattcagaaataaagctatttctctatccatgtatatgtctacaatacgggaaaatgttagagaaatacacatttatcagttttaataaacttgtattttcaatttccagtgctatttcagatatatttgaaactttatttgagctatataacattacacattggtttcatcagtatttaaattatctgtgttgttttcttaaaattttaggggtattcaaacatctctgtaggctagatataattacaaataatcatctaatcacaatataacatgaaagttattaaacacagtagtgtgatgcctctgaactgtagcctctctgtattttctgagtgattttaacaaaaagttcacacaggcagattcaacagcttatgatctattgataattcatagtgttttatatgctgatagtggcttatttgtccaggttacatattttttcatttaatttcacttttaaaactactacagatatttccaagtaacattttataagttttatggactaaatgaggaaattgtcttgaagatctaccttttagaaaatatattaggtacttccaacggttttgatgctacatcaataaggatggaaattcactaatccccaaagaattcacattcttcctgctagactttctacctatactgtaaaggtcatattatagatagaaatattaaaattatgattgaacagactttattacaatagcttatgggcctatattctaaaaataaatcttaccatgggatgagtgtgtgtgaaaagagagaagcattcatgctaattaggctgattttaaagcctcttgggatgcaataggattttaagagaaaagaaaagcatttcacaggatggataaggaaatgcaaaagaagttgaaaagatacctctaaaaaataacttttaaactcagttgacatgcacaatataaatgagactgacttcaaaagatattaggcctgcagggtaatatatcatttttatcaagtatatactcacatgcaattaaaattatagtatacaaaaacagaagccatatatggatacaacacttagaaaatagtaatttatgatttcttttaaagttttaatctattttatttaaataacaaaacagaaatgttcagcagctaagcaattataatattatccatgtacgaatcacaaatataatgtttacccctgctactggtcaactctgtattatcatgaagtgttctttcttagatacatgaagtcttggtaaccttaatggctatttatctgtaacctgggatagggagtctttttctaagaaatccttcattctatggaaatgtacatttacagaatgactatatttcaaaatatggtagtaaaataaaatatactaaatgctgtcttcccatatacaaatattagtaaattagtaaatctttatgtaggaactgttaatgctgtgaatatataagttgatagaacatatataatttgataaaaccttccctttcaccattcttttgttatgccttgttctttttgcatgttaacactttgaagatttgtttgtagcacactgactaatgcatttaagttcttaaaaaatgagaataaggaaatatgttttaatttgctggattctacaggaaaatatataagctatataacttcttcaaaattccttgacagagataattttttataaaagactgaataaaatatttagcaggcaaaaaatattacaaatatacttaccaggaatcatatcgaaatgctgtatgctttcatgtccactggccaatggcttattttttaatctaaatttatgtctcttacttatactcagtactttattgcattctttttatacatccaatcattttaaacaaaccaatgggcttgaaatgagataatgctaaattttgccagaatagaataagtcattttgataaaaaatggaaaaaggatcatgcactgtcttatgaaactacaaagaaatattttgtcttttaaagtaaaaaaagcagaattgttatcatttttctcatacagaacactgtaataactattctaagcttcatatgggatgctgaggtctaacaagggttggagttaagcttgaaaaagtttcatatacttgggatggcagggttgagaatgtatgtgttctgtatgaaaagtgatacacaatccagaaaccaacaaatgttcagaaagaagttcaacttaccatctaacttcaagatgtaccctattagtactaagaaataaaggacaaatgagagttggaaaaataaggtagaaagcacccaccttccacattgttgtcttctgaaagcacatgacaaggagggagagaaaaggaaaaacattcattaagcagcatgcagactggaccttgcctttgcatgtcttcctcatgcaaggcaccaaacacatcatgcaagtgctccatcactatcattcaagggggaaaacaaaatcacagggaagcaggttccctcccattggcagcattgataggaagtgagacaaactttcataatactgccatgccctgtgcaaagagtttttaaaaaaatctttcaactacccagtataaagcaaacattattgttattacatgttgctggtgtggtctttctaggcaattatttttaaaagcttttttgttttctttttaacaattctaaaaggttctatttccacatactgatttggccttagattttaagaagtctattggaaagagctatgaaatttcacttaaagatattccagttctaccaaatatattatccatatgccattactgccttttagtatttctaatacctcaattgctttccttaaagaaaaacaacgtaactatatggaactaaaatctgcaatttatttggttaatttatagcatattaatattgtattgcaaatgagaatagtttattggaatttataaaaatgctaacttttaaaaatgttaggtaggaaagtgatcactggaagagaagtccactgggaactgtccataaggcaatttggtttgtcgtgatttaaaaactttgtacttctgttgaggatgtgaatatgaatttgtttgagacaatgaaaatatttagctcaatttctcttatatttctatatatctataaaatacctacatgttttcatatattttgttagtcatatttccatgtgtgtacctatgtatatatgtataaacatatatatccaagcagatttgtatttcccaagataatcaatataaatatataaggtttaaagtattattagtacctagtggaaaattcaagttctatttgagactcggggcctgcaatcccggcaagaaatggaagggaaagctgtcttaggggactagggcaagagcaaggtttcagtagttatcaaaaatgttctaatagtaaactctacccatgttgacattctagtctcatccttattttttgtttaattaattgtactttataaactcatcatctgatcagaggtgtttataaacatggcaacatgcaagtatagaaacttgaaagcaaaaacaactaagaatgtaccatttgattaggttcacctaaaaccttcttaattggataaagttactagtgaattaaaaatcaacaattttgtttaaaacatttcagctgaaaattgaagtatcaacacaggcacatctactgatgtggtgttagcatgtaatagaaaatggctggtggctaaatgtgggtaataacatctttacacaatacttggttttccagagtttatttttaaagaaacaacaaaaaaaactttcaaatatttggtctgtgatattgacttctagtttgtttttgtttgttttttggactgccaatttattaaacaaggaattaggctgaatttgttacttttcagtggtgactttgatgttacacaaacacaaatattaaagttttgttttactgcattatattggacataatacaaagatataaattattgtaatgtttaagatatacttttcctgtatattaactttgaaattgtatcttctgtttaagatgcttacttaacaagattatttaatatgtattgtaaaataataaaatcagggaatttagaggagagtcatgtgccaagacagtatgtcaattgctacagcattatttaatttctgtaaagacgggcaaatatggttgtgaggagcagtgcttcggtagaaattttggtaaagtgtggcctaaaactacaattaaaaaaaaaggaaagaaaagcaaaccaacaaaatgaaacaggcccaggcctgacaccaactttaggaatgcactaagtagggcattataaaaggagttcaaggtcactgattcagtcctgacggcaagttctcctttcatgaccatagatacaagcctaggttttgccatggatcctactctaccatctagcatttttttctgaattcttattcataatgagaacaagcttaataatgggaattcctttaaacgatccaagtcatgtttaatgtgtaaacaaattctgactcgactaaatccagaaaagtggtctgtctcagaaaatttagatttagaaaaaaaaaatcaaagtactagaataaatgggtgatatattaaccactgtttaaaaaaaagatggtgatgatgatgaagacaactggcttggagcagactttccttgagtttccatatactttcagattcaatctcagaataaaaatcctctttcctcttccattctattctattctggtatccatttgctaactttacataatttaaaacttgttaacctaaagaaaatccctacattatttcagaatttggacgtgattataactggtggtagctccagcatttacaaccattctccaggtatttttttcccttctctttcctttccattttatttctgtactaaataataaatgtcgagtcaaaaaagaatagtttatctcctcataacaattttttctttatctttgtaaattcttatacacacaaatgctactttgcttttgagcagcaacaaagacaggtgctgaattttggcatgccacggtgtacaggtaaagcagcatattttggtttagtgtaaggtagaaagcagtccatccggccttacctgtggacactgtcaagttagggaaaatctcttggtttgcagaaaaccctggcttcttaattctgctgacctaatccttgctgagtaaatgaagtgcgtctcttaatcattaactttactacgatgaccacgccacctataaagatcacactcttgctttcttttcattggaaaaataatgaatatagagctgtgaaaaagatactttacattttatttttctttcagataggatgggcttctctcacaaagatgggaattaggcaccagaatatcaatcatgctatgaataatggctgtgtgctgacaagaaggcaagcaacagcctgttttaaaatcactgtaaaagagcatcttcacaaaatttttatcttcggcccccagcttataagaatgcaaggacagtaactttagtttatcattccagtgttctttgcacatactcttaagtatacggttctaggaaaacaaatgaatacaaaaacaaatgtgcttgtttcaatataaagaaaatcatgaccagtaaaaaattaaaatttggaataaaatatcacaaaaatctcctttctgtataatcagtgctaaagtttggcaatatgtaagtctttctctaaatgtacagacagtggtccatttagtgctacaacttacattaaaaaatgaccaaaagaagcttcctgatatcacttgggcattcctttacttctttaatttttggtttccttccttctctgctagatgcctgtgactggctcccctcattttccttgattccctctctcctccatcaaaactgccactactgcgagtagcttctgtcccagataccagcactccaaggtatggcatattacagcaaaactggtggtggtaacaggcagtggaaagacagatgaagaataagattctatttccttcctccatacagggagtgtgctaacttctatccacgtctctctcgcccatcacattacttctcaagcctgtactcctcattttggagatcaaatgccagtacagcagagcttagttcccatggtggcacaggatggagctttgttttttcttttggtattagcagtgaaagcctttaaaaaacctcaatagtctgggaatgcttcaagcactgggaaatggaggaaatcattgagactgtggattaaagcagcagtcagctgaaggaatagaaatgcggcccagaaccaagacgatgttcaaagagaaaatgaagcataaaggtccattatggagacttagggaaggaaagaaatggtcctggacaggaattgggctaatttcaaacatgctttttaacagaggacatcacctcctttttcaatcccagctaaataatattgcaggacactcccacccagcctgcttggagtactcatcctaggaaatatatggagtcaactacaacaaccagtttttctccttcttcactgctcgggaataaaaaatgtatctctaaaccggatgcagcaacacagatgttcctggcatcacactagaaacacttaaaacaatttccccccaaaatattttgttacaaagacatttgtggtatttaattcaaaatgttctatcttgttaatgacaattaaaagaaagaagagaaaaagagaaagggggcaggaggaaggaaaagcaagaaagcctaaagttattgcgatttatagtgattaagctatttgatgaacctgatgaaatttaataactgttagtcaacatattataatataaatcgaatgactcacataagctataatgaattcaatttcaaattttcatgaggaactactacaaggattttcaaatttgttttgctttgataatctcagttcttccccaagtctaaatcttgagagttaacatttcaacattcatttcaatagttggacttaggaaggaacactgaatttaacagtgactgtaaacatggtgacaagcacagtctacagtatgtgtgctcacaccacctatttttattttttattgctgagaaatgaatgcttcctgatacggaattgacagacaacactgagcagagtgcttatcacataccctcccaaccaagcttaatcactgttaaacaactctcctaagaaaggtggctcaggtgagcagtgctttcctttctaagagtttgacgtcatcatattttaggatacagagcaagaaagctcttggactgaggttaagagagtgaacttaaatacaccctacctactttcccaacttaccaacccttctagtggttatgtggttttgacttctttgttaacagatggacaggagacatcctttggcctgtgtattaccatcagagaatattctgcaatgtgttctaggtttgctatcattaagatgaaaagtaggtgaactcccactaataagactaatggtcttcatttgaaagagctgtcaaatgtctactggtatataaatttttttcaccattttttttcatcttactacagatgtttttcaactaaatattaaaatactcttaactttattattctatacctgggttcttagacatgtccaaaacaaatctatttaatttatctaagaaaaggcaaaaatactttgtgatgaaattaaaaatatgactaaaccacattgtaaaaaggagtcttaagtttgatgcttaaaaattacatttacatgcagtgtacagaaaataaaattatttatatgatatgaccgacctgacaattatacattctttttatatcaaagaaaaaatgaaattttatatcaaattaaaaatattttatattgttatcttcacttcaataggaccctcacatatgtaacaaacagcttggaaggaagctattccttggaaggaaaaatgcacagcatattaaaaggatttgatttttcatttcttcagagctcttagtttttcattttatatggtgttaaaaattcactgtatttacatgtgtcagtttatgactaaattaatttcaaagttttatgaaaatcactgaaaattattttaaaaggaataggccattcttagctaaataaattagatcatacattgaaattttccaggaggctctcgggattgattaaaatattattttttttttctggagatggagtctcactctgttgccaagactggagtgcagtgtcaccgtgttggctcactgcagcctctgtctcctgggttcaagcaattctcctgcctcagcctcccacgtagctgggattacaggcacccaccaccatgctctgctaatttttgcatttttttagtagacacaggatttcaccatgttggccaggtgcctggccaaaaaatattacttataatcaggctgagcacggtggttcacacctgtaatcccagtactttgggaggctgaggaaagtggatcacttggtgtcaggagttcgagactagcctggctaacatggtaaaaccccatctctactacaaagacaaaaattggctgggcatggtggcacatgcctgtaatcccagctactcaggaggctgaggaaggagaatcatccttccttcctgctcacttttggtttccatttacatggaatatctttttccacctctttacattaagtttatgtgagtccctatgtattaggtcaatctcttgaagacagcaaatacttggttggtagattgttacccattttgccattctgtatcttttaagtggagcatttaggccattgacatcaatgttaatatcatatgttcccacttacaagtgggaactaagctatgaggacacaaaggcaaacataatagactctggggactcaagggaaagggcaggagaggagtaagggatacaagatacacattaggtacagtgtacactgctcgggtgatgggtgcaccaacgtctcagaaatcgccactaaagaacttatccatgcaaccaaacacaacctgttcccaaaaatctattgaaataatttaaaaaaataatgtgctagaaaaacacacacacaaaatataactactggtatcacttttttttcttaacagcaatagaataaatgagtaagaagactgtgagaagactgaatgatttcatagatcctgctgcaagaaggcagaaaaacctcagagaaaaatactattttcttaattgcatttatttgttgattctataaagtctaagaaactttaatactgcttaatttcctttattaaagaaaaaaaaaggctcccagtcctcttctctagattgttacaataaattgcttcctcaagaaaaaacaaaacaaaacaaaacaaaaaaacacgcatttagaaaatattttgtcctactttaagagcaaaattaggtccaggtttataaatgtgtttacccatgggcattctaaccactagaaatcaaagaaagaattattccataaatttcttgctgtctttaaaatttaaagaaaagcactcgtttcatacccatcacataaattgtgccttccttttaaaacatctgaaacaaaatgacacttttgttcaaagccaaatattttggtaggtgagacaatatattatgaatttgccacataaaatatatttgctctttcatttgagttataaaatgcaaatttggtaaaaaatattactttcattccccttacatactcgctgtgtagtaaatctcctgggaactgagcagcaaattataattcttttgcaggaagaaaaactaaatactatacaaactgcaattctcttttggaaaaaaagtgttttgtgttacagagttataggaaaatagtttgttcataggtacaaccaattctatacttttgaagatattatatatgtagttatttgagttaatgtctagtgactaaactaaacccatatgaatattggtcatgtggaagagagagccatgatcttgattaatccattttatatctgttgatttactgatccataaaatcaaatcaacacaaatacaaatttctaggtaccctaatgattcctttttaatgttttcctgaaatgggcattcactacttaagaaaacatgctgaacagaaagagaaatttccttttgtaaccctaatatagcttcttaaaatattaattccataattcagagaagttcactttactttttaaaaatgtataataagaagacggtatacttaattacttcttcaaatttgtttaaactgctttctatgactaccggcaagtctgcatttctaccaaaacaatttcaagaaaatttaattttaaaaataatctcatcaagccacacctcattatatgttgctttaaaatgtgtggcaatacaatgataccattacttcaaaagctcctccctaaacatcagtaccagcatgtgtgtatctctctaacacatatgtgtatacatatacacacccaattggtatttcatttcataaacaaatccaaactgtgatatttttctcaataaaaatattttttctacaaaagttaacgtgaatagaagaaaaacatttataataaataatttgataagatcatcaataataacacaactactacatgaccacttttcctataaacattttaccttactaataataggcattaaataaattataaacttctcttttcctctttgtatctgttatttcaattttgtttgtacgtattagaaaaacagagtgttttctaactgcatgattgaatatgtaaccacagagacatatggcatatttctaagtaaaattaaaatttcagttccttagccatgttccacatgctcaatagccacatgtagccactggctaccaggctggacagcacaaattgtgaagctttcagtcattacaataagttctattgagcggtattaactacagcttctctgacaatatcttttaatatcaagctattcatataatgtacatattatttgttctttattcaaaaaaggaaataattaaaatgcatgatggttttaaaagcaaacatctatttagagcagggttattacatttgtgcaatatggagaactttgtaatatttccacttaaccttaaaataataacaattaggaaataaacctgataaaaattttattgtattcatttaaaaatgtgtttgaataattcaaactctggacaattattactcttttcatcataagtcttttcctttagacctcatagatgagaaaacgctgaacctattttgatttttaagtaaactaaactagtaatctaatatcgtcttactcttaagcccctcattctcgcagtatgcccaattagatcatttatcattactgtctttaagtctatgaccatttttcaatgtaagagtttaataagcttttaacagagtagttttaaaattaatttaaaaagcgcctttcatcctactatcttatataatgtattctcttataggtcaaagactttccttcctataacatgggcctctttttgaatattacaccatagaaaaataaaccaaatgagcaaataaaatagtcaacatttctgtaagacttaaatacagcagagataaggcaattggataaatggagcagttcacacctctagttaattctagaaaagtccaagatcctattaaggaactactacatagaaataaatgaaccaatgagaaggcaaataaaaactgagtagggagaatagaaaaataatccttaggctgggcgcagtggctcaggcctattataatctcagcacttcgggaggccaaggcaggcagatcacttgaggtcagcagttccaacaccagtctggtgaaattgcatgtctcttaaaaatacaaaaattagccaggcatggtggcaggcacctgtaattccagctactcaggaggctgaggccggataatcacttgaatctgggaggcggaggttgcagtgagcagagatcacaccactgcactccagcctaggtaacagggcaagactgtctcaaaaacaaaaaagtaacccgaatatggaatggtagaaaagcaaaagaaaaaaaaaagtggcaaaattatctatgggatgaaatgatgaaataaaaagtttcatgtcaagaatgagtaagatgtataataaaaatttataatagactttgccaagtctattttagtatttaaagtattttccaagtctattttcagtgttgaaagaatgctggcctgctccaaagattaaatatctttaatgattatagaaaactgacctttttatgttagattagtgacatcaaatctctattgatacatagtgaatgaaataaggcaatgcatttatacctcaatttcctaatgaataacatttaatctaacatttaatccatatgtcccaagcatatgagctgttgtttggaaaataaactaagtattgagaaggaaagatgatttccaaaagatactgaggtcatctgatattttatcagcaccatgctctaaccaactgagctaaccggccgactggtcatctgacattttagcccaaccctggtattagaacaacttgaaagagattacacaacataatgagatgcttattaatatttataatgaagaaaatatgtgttggaaagccagaatcagcatcctgactcagtactatcttatatcttgtactactagagaaaacacacttttacataaaataataaatgacagaaaaccttaatacatttctgacagtattgcaataactaagaaaaaaactagttgtgcaacatgtacagtaagtatgtgaaatggctaatagctgctagtaaatgtagcttgtggcagtacctagtagcttagacaatgtatatcttgcagctatctaaagtaaactatgctcaaaatgtgtaatattgaaaataatacttaacacatggggaaagcacagtggaaagagagtagaaaagtcactgctttctgaaatactgaatagaaagtgtcatcgtttttttaattaatatggctcagagcaatatgaaaactattctggactgagattgagaaaatagacttgataactttaaataggcctaataatagactatgagaattaaatcaatcacttgaaagtttgtaaacatgtatgaaaacgtgggtagtgtgataatttttaaaaaatgaataaattgtcaggaacaaaaaatacactaagaaactacgaatcattggagaatctaggcatttcttaccaatacttcaatgttttatctattcatcttgaagaagaaattggagagagcaaggtgcctctcgttacgagacttctagggtctgttatcacaaataagataaatctaatatactttttctaatatttaaaaatgtttctcaatgctaaatatttaacttgctccacagagcctggcacacagcaaaagaatgtaagaccccttattcaataatgccagattataaagcatcttatttatggctaatacgtatttaatgatgttagccattatattattataattaatgcttccttatacaaatcacaggctgcttaagagcaatgccttttccattccccttcttttgttcagcttctagcacagtatgtatatgtagaatttgcttaataaatatgtgttataaagaataattagtttcctacctcaatttcctgcttggcttctatgaaactatcagtagcatgggaatgagtatgtttcttttagttggcaggatttacttgccgcagtgagctttcttaagttgtattctcacaccagatgtaaggaactcaatcaactggacatgtcatttggggcaaaataaactgaaggagtttagtattagttgccatccaaatttcaggcagtcccagatttattagttaggcatttccaaactttctccatcgattgttgtttatgaagtagatgatgatgatgatgaagatgatgacaatgatgatgatgcagaatacaactgtctcttaaactcaaaaattatttccacttgtgtaatctcattcaattattataaagacatggccatgattagttgagagaaaattaactattaaagatccaattgggtgctaataaagtcatgcatgcctcagaaatggggatacgtttcaagaaatgcattgttaggtgatttcatccttgtgcaagcataatagggtgtacttgaacaaacctggatggtatggcctactacacacctaggctatctggtatagcttattgcttctaggctatcaacccatgtagcatgttactgtactaaatgctgtagacaactgtcatacaaggtaggtatttgtgcatttaaacataggaaaggtaaagtaaaaatatgattttttttttaatggtacacctgtgcagggcacttaccatgaatggagcttgcaggactgaaagttactctgggcaagtcagacagtagatagtgagtaaatgtgaaagcctaggacattactatacactattgtaaactttataaacatggtacatttaagctacactaaatttataaaaaatgaaaattaaggtatgtgtgctcgatggctattatgtcactaggcatttttcaggtccattacaatcttgtggaaccatcatcatatatggagtacattgttgactaaaacgctgttatgccacacctgacttcattgtcaatatcactatcagtatttttgtcagaaccattcaacaagactctaggaagttccaaactttcccatatcttcctgtcttcttctgagccctccaaactattccgatttctgcccgttacccagttccaaagtttcttccacatttttgggtatctttatagcagtaccccactcctgatatcaattttctgtattagtctgtttcacactgctataaagaactacctaagactgggtaattcataaagagtttaaattgactcacagttctgcatggctgaggatgtctcaagaaacttaaaatttcatttttagcaaaatgcctgacacatagcaaaaagtcaataaacatgaggaattaaatgaagaatgaatgacccaatggtaaaatcaggcctgactccaaattctatgttcattcctctgtattagggagttttagcaaacttttaattagtcacaggtaccctacaggcttagcagtatatttataggaagtaaataattgtagatttttaaaaaattaaatgtaggggctgagcgcggtggctcatgcctataatccctgcactttgggaggccaaggcaggaggatcacgaggtcaggagatcgagaccatcctggttaacatggtgaaaccctgtctctactaaaaatactaaaaattagctgggagtggtggtggacacctgtagtcccagctacctgggaggctgaggcaggagaatggcatgaacctgggaggcagagcttgcagtgagctgagatcacaccactgcactctagcctgggcaacagagcgagactccatctcaaaaaaaaaaaaaaaaaaaaaaaaaaattaaatgtaggtagccccattaaaataatgacttacaaagcttcatttagaaatcatattttttggaaaactagcattgtttcctgaatacaaactattgtttcatgatatatttagtaagttaacaatgaaaacatttttagtaaattaaataattttgtttacaatctaaaaatcaactttatttttcagaattttaatagatttatgatttattatttataataaaatatgtcaaacttaaacctatttttattggataggatgcaaatattgaacacaattagattactgacattttaggatgatctcaagcaacttttcttttctctaacaatttgccttgataaacttcaagaataagcaaggtatttaagatggcattctcaggattttggtccaaataattaattttaggtttcacttaaactagtcaccatggtacctaacacgtaaatactaaactaaaataaagctccctctaattaaaacaattcaaaataaccacatcaattatgcacaacagaaaaatacaattttaaatactgttttcagggatactaatctggtaaacatgacatacatgttctgattccagtgcggatgtacatttagaaaattcatccatatagtagttaactgagacatgcagaaacaacagaaccacccactgcatttagaattatatagctgtcaattaaatttttaagaaccacccattgcatttagaattataaagccatcaattaaatttttaaatgactttcttatgaagggattataatactagtcctgactttaaatagaacagacctacgaaatagaattatttcctatttattatttaattctatttatggctcccgaaattgtggctaaacttaagtttttcaatccatgaacttagagtgcagtttaagagatttaatattatcttatttaaaagataagaaaaccagggcaggcgtagtggctcacatctgtaatcccagcactttgggaggccaaggcggaggatcatgaggttaagagatcgagaccatcctggccaacatggtgaaaccccatctctaccaaaaatacaaaaattagctgggcatggtggtgcatgcctgcagtcccagctacatgggaggcttaggcaggagaactgcttgaacccgggaggtggaggttgcagtgaaccaatatcgtgccactgtactccaacctggtgacagagcaagactccatctcaaaaaaaaaaaaaaaagaaaagaaaagaaaaccaaaggccacattgtatgacacaacataaccttgtgctctctgggtcacaagtttgaatacaacttcaaaagaaatagtgtcaataactaaactacttaagaagcagacttcagataacaaacaagatgaaagttgcatactccttacttaaggatagtaagtacaacttggctaaagtttttgttttttgtttttcacattaattttagatgagaaactggaattctaaggtttggttttgttttgttttgctaatagactcctgtattaaaatacaaggggaaaaataatcaaaagtagccaattaaccaataacccctgtccccaaaagggcatctgaaactatgtatatcagaatttgcaaattacaaaaaagaaaatcaacaaacaagttttgccggcctgagatagagatgtattgctatggtttggctctgtttctccacccaaatctcatctagaattgtaatcctaacgtgttgggagattggcctgatgggaggtgattgaatcacaggtgcaaacttcccccttgctgttctcatgatagaattcttatgggatctggttgttggataagtgtatggctcttccccttcctgctctctctctcttctgccatcatgcaagatatgccttgctttcccttcactttccactatgattttaagtttcttgagacctcctcagccatgtagaactctgagtcaatttaaactctttatgaattaccgagtctcgggtagttctttatagcagtgtgaaacagactaatacagaaaattggtaccaggagtggggtactgctataaaggtacccgaaaatgtagaagcaactttggaactgggtaacgggcagaaattggaatagtttggaagactcagaagaagacaggaagatatgggaaagtttggaacttcctagagtcttgttgaatggtcctgaccaaaatactgatagtgatattaacaatgaagtccaggctgaggtggtctcagatgaagatgaagaacctcttgggaactggagtaaaggtcactcttgctatgctttagcaaaggagactggtggcatttttctcctgccctagagatctgtggaactttgaatttaaaagagatgacttaacatgtctggcagaagaaatttctaagcaacaaagcattcaatatgtgacctggctttttccgaaagtgtacagtcacatacgttcacaaacagattacctgatattggaacttatgtttaaaagggaaacagagcataaaagttttgaaaatttgcaactggaccatgtggtagaagacaaaaactcattttctggggagaaattaaagctagctgcagaaatttgcataactaaagagaagtcaaatgttaatagccaagacaataaggaaaatatctccaggacatttagtatatctttgggtagcccctcccatcagaggccttgaggcctgggagggaaaaaatggttgcatgggctagtcacatggcccagctgctctgttatgccttgagatatggcaccctgcatcccagtcactccagttccagtcatggctaaaaggggagaaggcacagcacaggccatggcttcaaaggatgcaagccccaagccttggcagcttccacatggtgttgggcctgcaggtgcatagaagacaagagttgagctttggagccactgcctagagatttcagaggatgtatggaaacacctggatgtccaggcagaaatctactgtgggaatggagcccacatggagaacctctactagggcaatgcagagaggaaatatggggttggagcccccacaaagagttgccactgaggcactgcctagtggagttgtgagaaggcagctactccagaccccagaatggtagatccaccgacagcttgcaccatgaacctggaaaggctgcaggcacttaacaccagcctgtgaaagcagccacaggatccataccctacagagccatggaggtagagctgcccaaggccttgggagccccactcttgcatctgcatgtcttggatatgagacatgaagccaggggagattattttggagctttaagatttaataactgccctgtttggttttagattttcatggggcctgtagcccctttgtttgggccaattcctcccatttggaaagggaacatttacccaatgcctaaacttccattgtatcttgaaagtaactaacatgtttttgattttacaggctcacaggaggaagaaccttgccttgtctcagatgagactttggacttggacttttgagttaatgctgaaatgagttaaggtcttgggggactgttgggaaggcatgattggttttgaaatgtgaaagagacatgagatttggtaggcgccagggatggaataacatggtttggctctgtgtcccacccaaaccttatcacaaattgtaatccccatgtgttggagttaggggagtggcctgtgggtggtgactgaatcatggagcagacatcccccttgctcttctggtgatagaattcttaggagatctggttgtttgataagtatgtggctcttctcctttgtgctctctctctctctcttctgccatcatgtaaggcatgccctacttcccctgcaccttctgccatgattgaaagtctcctgaggcctcccagccatgaggaactgtaagtcaattaaacctcttttctttataaattaccaagtctcaagcagctccttacagcagtgtaaaaataaactaatacgcggacttcacatgttaggctagtacaaaagtaatggtggtttttgcaattacttttactggcaaaaactgcaattacttttgcaccaacctaatataatcatattttcattttatagattagaaagctatggtccagagtggttaagctgctaataagtgtcactggcaacaagacatactttctaagaacatttctatttctctttttagaccagtgctatctaatagcaccttctataatgatggaaatgttctatgaaacttaggaatgaattatcaccctaagcaagactaattctctatatgtaactgttcacatctagaactgtgccctgggaaatatcccacaggccttgtagatcttgatgagaagcaatcatcccaataagaattcctgtttgtgaggacttctgtgtagctctggtaaaaataaaagaaggctcatgatcacctagcccagatcagtcttccacacaaaggtaaagaaaaatgtaatgtgaaataacttttttctgaaaataatatatgttgcagagacagtcagacatgttagaaaacagtagagagagaaaataatttactataattgtatttcctcatcctaagcaactccttacaacatttacttaagaagcaaatattatttttggaagaccctggcatacgatttctgacaaatgatggaaggaattggaatggagaaacgaaaaaccatcttgcatctctgataaaatcaaaattggcttcagcactcaaaatatgcagggcttggttgtttttgtttagacagaattaaaaaggaacttgtagatcttattttagaattgttttttcacttggctaaaacagtaagcagtataatctggtactataaaagcaggactatgtatttagtttgccaattgttgtgcaaaaataaaagcaaatcttggaaaaaaagttgagaagggctgatccattttaggcactggttacacaaattataaagaatgggtataactctcctggtgaagaaattcacagctaagcaggaaactcggggtctccaacacaaactactctctaatgtgacactgggaaggtctttccacattgtgagcctcagtcaccctatctttaaaatggagataatagaatctacttcataggattattttaaggacaaattagtaaaaatcacatatattatgtaacacatagctaatgaataatagacacccaaatactttcctacttccgtttattcattttgtataagaaaacaggataaaaataacttaaatgaaaccaaacttttaaatcttaacatatttaccaacaattttcttatcctatacttctatctggcaaaaggaaattgtatactgagtaacagcaagaatctgaatgccaattgatttccaaaatggtgcagtataattaggaaattcatgagtcaaattcctgtttatgcctgtactgcaaaggctaatcatttgtttgttttctataagaaggacttgattaaagcctctagcagcaataattaaccctgtgcttgaaggatgcagactcaactagcactgtgtgtgctaaaatctgtaattaatgcataggaatgcatgtaaattaacagatgagtgtcatttacactgatggtacaaatgcaggtttctttttttgggaattacttcagtgttttctgctaaccattacatactataaactcagactgatgtaaacagcattctaacatctacaaagagtctctacttcagaccatgatctagatgaggggttggcaaacttttctacaaagggccagatagtaaatattttaggatttcccgaccttaaagcctctattgcagctactcaactctgttattgcaatgggaaagcagttacaaataatacataaacaaacatataggctgagctcattggctcatgcctgtaattccagcaatttgggaggccaaggcaggaggatcacttgagccccaagttctagaccagcctgggcaatatggtaaaaccacatctctacaaaaattagctggtgtgctggtgcacatctttgatctcagctactgaagaggctgaggcaggaggattgcttgagcccaagaggtggaggatgcaataagctgagatcgtgccagtgatttccagcctgggtgacagagtgagacactgtctcaaaaaataataactagatatataaatatatagctccctctctctctctctcttactatatatatatatatatatggctatgttgcaataaaactttatcaaaaaataggtaatgagccagatttggcctatacaccatagtttgtttaaccctgagccatagtttgctcatccctgacctagattctaattattaggtaatacagcatactgtataatcttagaaaatcaatatttatagattagatacgggcactgaaatataaacctgatgtgaaaacctgacaagtttctgaacttaagttagtctccctcctcacataaaatttagataaaacatgacagactgaatttaccacgactttatcgtaagaaacaagtgactccaaaatatgaaagtacttcagaaaaacagatatatatatatatatatatatacacacacacacacacacacacatctttacttgtaaagtattattattattattattattattaattggtcatcttttcagctctatgttttaaggcacctagaggactcacttactctggaatgaccatagaggatacaaactacacaaaacatactcagagctgatccagtaatgctagaatttaagaaacacctggcagacttaggatcccatggggctgccatgttaaggaagcaatttctaaagtcagacccaaggtacactagtcatgagagatgtccgtcaagaagtccttcaccagtaagtttggaaatgctgcatacgacgctatgaacatgagcttaattacactatgagcattagtactaaagagatatttgtcaaaaagttcttgacaaataagtgtggaacacttacacctatttcagaggctcacagtgaattattataaacttaagatgctaagatgtcctgcataaactgtgcacctttgtccaatttcccaaatgtgtatctattgagattctttatcttgtgggtgaagccaattaacagagctccccaaaactaactttgaggaaagctttcatatagattattctgaacagttacattctttcactctgggtgtgagaaaactgccctactaaacttacatttttaaccacataagagcaaaaacactcatttaggtatttacttacatttaatttgtctgtcattataatggaacttttacttataaacaattttatggaacccaaccaaatttataaaattatttaaagcagtataaaaattacactcacctcaatatactttaaaaaaacgcaagacttattccaaacatgaaatatttctgatttaaactttaaaaaatcacagacaggtatctactggagcactatcaagacacagtgacttaaataactttgtgctgaaggcactaaaagctattaaatccaaacatttgttgcttttgctgaatattgcttaaactgtccatcaggaaagaaggttgaaaaataactgcatagttcatgactttcctatatatgtggctttctgattattgggtttcttctggtggctttttcacaaactatttaatcaagaaaggcaatcctattcttactgggcagggaatagctaagtaatgatttctcttaattccaaatgtttctttcatttgcaaccagaaatttcttacatgacaaagacaaacatttttgtccagtcatgtattttgatatagaagttgaatctccctttggagctaaacataaaaattaaccaaaatcaactcatatcaaaatcaacatgataccctttttctagcatttagcagtctagcataatccctgacatgtactacgcattcaataaatgtttggtgaatgaataaatgaagaaatgaatcagacatttgtcaaatactgtagttcaaatatacaaatactattattttaaaataatttatattgaataatttaaaaatatattcttagtccaaatatccaataattcaaaagatctgaaacagtgataatatgttattacagttattcatttcaatatcataaccattcttttcccatgcacggcaatggagaactaagaaattttattctagacaagataatatacccattcatgatacacagacactagatacataaaacttaattatagagcttagattatattctaaccagtgaatatgcttcttgtgatttttggaccctagaatccatcaattaaaattcaatatcataatattcccttacagaggaatagggcactcctgccttgaatgcttaggcaaaggtacgtatccaaataaaaccaatcatgttaaagctacgaagggtttccctcatttccagtgaaatagacatgtataatatctacttaacagtacacttgcaaattttttcacattagtgaaaagggaaaaacttgttttctcatcacgctgagtatcaatttgataagtttacataagccacaaaatattggtttcatttattcagacagataatatggttcctaccatattccattgccatttatgaaacatttgcttatctcaaaatacattaaaaaatccttcccacataatcctggcaagttatttattttattttaaaatatattaatatttcagaacacacttcccaggacatccttacaacgcatatggcacagacaccacatttcttcaataaaaaataaaagccatttgtctctaaatacacttgaaaagatttcttgaggtaatttttgttttctttactctcaatgaacagaattattaacatctgaatattgacaactttttaatcatcaaacgtccattatatattatggcaaaattaataaactgtaacatggcaatttagatagatccaaaatttcacaaatgatataagatattgttctaagtatttatacacataaatcattgctaatccctggatgccttttataagtaaaatagccagataacaaaagaagcaataaaaaacacacttaaaatatactgtgcaaggaaagtacaattgaatgcttttaaaaatatcagtactctgggcaggttaatatttgccaaaatcgtttgctcctttgaggtttgctggttgatctgaatttattggagttcatttcattgctttagaactcattagcattagaattctgatgattgagggagcagctaatacatactgccccatttaatcttagagtaggcttctaaaataatagtaagaattaaccactttggaacctcagagtagccatatcacaggcaaatgtctctttcaggcagtcactaattgagcccagttactttttatttgtccttcaagataccacactgcatagagcttatttggaagtctaattttttgtgagaactactaggttatttacaagtagggacaatgaaacagacacactttcccttggagactttccagaatactgtgagtttcctgaataggtatttccatgaattcaatatggcttatccaccaattttggatctggtggaatacaccaaaataaaaaggcttactacaaaagctgacaaccagggagcagaaaactgctagatctgttctataaacccaaggaaatatatataattaattagtccagcatttgttaataagaagactgttcttaggactgtcctattaaaagttgagtgagaggaacctgaaaatacctttgtcactattttgtccaattcacttaaattatatacataaattttattacatattcttatctccataataacatgtggggctcaaaagaaagggaaaacattcactatattcaaccatataatactgagttgaaatagggatttagttaaacaaaaaggatgaaagtgttgctggttttaaatgtgtctaatttagttacttacctttcatatcaattctgatgtttccaagagtcagataatggcatcaagaaatagacttggctgaacagtctacacatactcatactgaaacatactctttaaaaatattattaataaagttaataaaatcaaaatgaggaatacaagggacagagaaggccacaattctgatacaataattctgcttcatctctagaatgaaaaaatcattctcactctcattcttcctagtgcaatccagacatcctgcaaagttttcccatggtaccacgtttctgagcataatacatggtgtggtttcattcctactcaggccttcattctcccaggagcttcttattgtttttataataaaagtatcttctgacttcttggaaaaactaggaggtcaaaataaaaacttttcccagaaagcttttaccggcacagccagaacttgctataaactaatatttgctacctttgtatttcatgggttagatattcccacagatgagtggttccagagccacacacagccttttcttggtattatatgtctcatctatttctgttgaaagtgtgtatgtacaaggaagatttggggaaaactacaatttgactggagtttgtaccatcccctgggtatcatgctaacttacataactgtgaaggcaggaggagattaattgaagtaagaatatgtgtgcaagtgctagctatttgctaagcagaataacaacactggaactatctcctggcctgatgtttagagcaacatataaatgctctcaaagcttttccacttgtttctttttttccatagtaatctgggaaagtggttgcattatttcctttttttctggattctacaaatcttttaaaacatgtgtcaaggtattagcttcataaatacttcaagtaggaaaactatacagaagggaaaatagaaatgtgtggactttggagattgcaataaaaaagaaaagataaaaacatacatgtcaaattatatatctagttattttttaaaatcaatttatcagaatacccatttgacaatttaggctggctttcactggagaagcacattaactcagttaagtgtctgaatttcttccgttaaagagaaaaagaaggcaaagtcagaaaatcacatattaacaatgaattgaagactgtactggggcgtgcatgtatcacggtttctcacctttgttgctattaacattttgtatcggataagtctttcttggaagggactattctgtgcattttagaatgttaagtagaatccctggcactaaatgctactagtgtgccccgcccaaattcacccccaattctaagctgaaaagcaataatttttgtaacattatttcggtaacaacatttaacagcattttggtaataataagcagtcacacagaatgtgagtgtaagcgctagggtccatgctaataactttttacaaagataccttgtttattaaccacagaaacaatagctttagttctaattatcatctccattttacagaaaagaaaacagagtctcagaaatattaaataacctgagagttctagtctgtaatcagtggtcagtgaaattatgtcatggctgtttggaaagctaatataacaagacatttctttcatggaaaatggcagtggactgaaatttaatcagggcctctgttctgacctcagccaaaaaatgtgaggtccctgtatgtcagtagtaatatactgggaattaatgtattagattgtattcaattgctcaaggacagctgtttgaaacaatgtattagaaagaataggttacagctcaggataattccttggagatgtgccttgggggcaacctgagggacaaaaggggatgagatgagaggagatgagatgagaggagtactatatctgaggcacaaagcctgtaaatctgtgaatgcatatgcatatatggatttcacaggatcagagaatgtgctgacctttagtgggtaggggttggggtactaaacgtcccataatgcaaaggacagtacagtatgctcattgagctttcaaatgtcccgccagatacccaactggatgaataacttgtgtataattatctgagcctagaacctagctttaagtaaattgaacaccaagtatttttggcacacctttatatagttcactaattttttttcagaatacaacaactatgcaaacctggaggagtttaaaatatatttggtttggaaatttaccaagaattcctcactatttcaaaaaaaaatgtcaccaactgtaacatctctcatagtatgagtcaccgatgtaacacagctccattagtgtgcaaatgtagcttcatattcatgcttcttttaggtaaaagcagctgcctacctcactatgtcttctattaccctcatgcctgaacatctgcatattgagatacacagaattttataaaaatatgtttcctcatatttttccttcatattaccattatggaattatagtgattttaaaaataatatatgttatataatctatgttatctatctcatataactggattatctatgaatttcatttttagagtagcaaaactgtacatgaataaatatatatatatatatatatatttttttttttttttttttttgagacggagtctcgctctgtcgcccaggctggagtgcagtggcgggatctcggctcactgcaagctccgcctcccgggttcatgccattctcctgcctcagcctcccaagtagctgggactataggcgcctgccactacgcccagctaattttttgtatttttagtagagacggggtttcaccgttttagccgggatggtctcgatctcctgacctcgtgatccgcccgcctcggcctcccaaagtgctgggattacaggcgtgagccacgaataaatatattttataaaaagaatatactgaatatgagaccctgtcaaaaattctatcttttctcacacatacaaatacaagacaattataaacttaataaacattatttatagaattggaccagataatttaaagaaaagagaattctacaatgtaaaaccctttaatataagctgttttaataattggaaaacagaatgaataatgtttttgtttgtcatgcccaattatttcaacaagtttttattaataacttgctacatggtaggcacagctgtaggtgttggagatatagaggtaaacaagtctgacatgatctatgctaccacggagttcttattttcaaagtggaaggtagaaaataaataaaaatgaactagaagagcaaagtgcctctgatgagcatgcagaagcatgtttcaaaatgtctgtggtgggataaatagatcagcaacacaccaggccatgcaatttggcagcaaatcacttctgcagtctagctgctgttttttctactctgaatcatactccccctttcgtcatctatgccagattccactgagcttcaaccctaccctcccattttacatacgttgccattttaattaattaagtggaaaagttttgacccatcaaccagagctcaagctgctagaagaagtgaatcgtttcttatgcttctttgtgctccattgtgtccccagtaaagtggtgtacacaggaggtaatccataatgatcaatatatatggaggagaaaatactaagagagaggaacactgtcaccctggcaagaaagggcaggtgaatgggagactgaatgggagatttaagaagtagactctgactctcccttaataacttatttccacttcctgatggaattgcacaataggatgagtatagacccattatgaatagcacatccattgaacaaagttgaaattctgatttagccatttattattgtaaccttaggcaaatacctcaatgtctctgagtcacactttcctaacagagaacaatgaaaacctaatgaggttgttacaacataatgcttcagaagcccataacaaattgtctggaatatagtagttaagtcaataagtatagttcattttcagttcactattttaagagttgtgctttcataactggcaacaaatggtataagcattttacgtcatcaggacatatcaaacacatcatacatcatgtgaactccctaaaaattgaaattgaagaaaaaagctacaacaagaaaaagtagtattacagtatttctatgttcaagtgacaattttttttttttttttttgagatgaagtctcgctttgtcacccaggctggagtgccatcgcatgatctcggctcactgcaacatctgccgctgcctcccaggttcaagcgattctcctgcctcggcctcccaatagctgtgattataagtacccgccaccatgcctggctaatttttgtattttagtagagacgaaatttcaccatgttggccagattggtcttgaactcctgacctcaggtgatccacctgcctcggtctcccaaagtgttgagattaaaggcatgagccaccacgcccattctcaactgacaaatatgagtcacaccaattgtcattacatggtatattgtagataggttaaaagtaaaatcaaagggacaaaatatagagaccaattgaataaaaaacttttcatagctgaatcaatactttctaagcattcaaggtaggaactccttagcccccaccctcctaaataaatgcacataaaagcacacaccctttttaatggtactaaaagacctagagtatacattttaatgaagttaatcactacttcctctctctgagtagaaataatacatatcacatataggaattatatatatcaaatctcactccttattttcattatatcttgtttctctcaggatgttttctttcttcaaatgaaagtcaaacagtatgatattacattactgctcaacttcagctttaatacaattattttaaagctattcaaccagttcttttgaagggatggcgttatgtggaccaccttgtataaacttcaattctcaagctctctacatattgctgtcaacattcagttcattgcagagcttaaagagtatacttcactgatgtaaatgctactcacacagagtccaacccagagcgggttcagccatttatggggcagaacagggacatgcaggaattagggcatagacagactcacttgaagggagtaagcaatcaagaaagttccagcagagctgggaaagaaacctgaatgggtagataggtagtccaggcagtatgctggtacgcagtaggcacagttcaaagaaagaagagaagcaggcagggaagctggaggaataaccttggacaaaagaggtttggtcagagggcctggcatgcaaagcttacttccagttctttataaactgtgaatcaaggcagagttggagtttctatgaattaggtactcaacaggagcttcttcacagacgtccttattactaaaaccagaattcactgtcagaactggaatggcaacatgagagacttgatggtatcaccaactgggtcaggatgcaggatggttccaggacctggagagattggtgtacagcatttttgctataggagataaacagatttagccaagaagaccaactcaactggcacttacacatggggtgcagcaggtgaggaagacagctgggaagataaaaaaagggaaagaagcaggtgcagggtgtatttccttcatttctactcatctctctctctctatctctcacacacacacgcacacacaaactcttacataattgtctggttagggaagtaacattttaattcacagctgacatgggtcactattcatacaataaaacatataaagtggaggctgcaaataattatgtaccagagattctgtgagcaggatgaaaaccatagttcacaaaactgttagtaaataaaaaacaggagagggacggctggccctgactgtcaccagctgtgtatagtcacagctcttcagtggagttcaaagagtaattacagaggagtgagttaaattctgtaactgctggttacacagcatttaatgcaatgatccatttagccatcatgctccttctttaagaggaaaattttaaagcaggctttttaaaaagtgacattgaaaatatggcagcttaaaagtaaattttattagtaaaccacatatgaaagctttgaaatgttcccttaagctatgtcaaaggatcataaataagtataactgtcaacagcagaacagtgccatttttatatatgagtagaaagcacagagaggttaggcaactcatttatgccagacagttagataacagcaagttgagattgaaagcaattctcttggatggatacagtgaagctgcctttcttttttacatttcccaagaacatatttagagaaaatgcaacacttcattctcaatcataacttagcacagaaactgccaaatagaaagtgtttgataattactgaggggggaatgattgaatttataaatgaataaattatacagcctctccaacaagttctgtagctacagactggggaggacagtccgttttcccagagtctgccgggcagcagctgggttagcaaaacacatgaaacatgtttgtgagaaaacagcattggaaaactagtgcctggctctaccctaaaaactcagatcctcttgaggtatgattcttttttaaatgtccagttagttcttccagggaagcaaggctaatacggttgtctcccttatccacattttcactttccaaagtggctgttaccagaggtacacaacagtaacatattttgagagagagagatcacattcacataatttttattaaaatatattgttataattggtctgttttataagttattgctgttaacctcttactgtgcctattttataaatgaaattttgttataaatatgtatggatagggaataacatagtacacaggttttagtactatctgcaatttcaagcatccactggggggccttggaacatattcccctcatgtaaggggagtaatcgctatacataatactagctacttactcactaacgtgatgggcttaaaacaaatacactttaaaagtaagatttagctgggtgtggtggctcatgcctgtaatcccaacactttgggaggccaaggtgggcaaactgcttgagccccagagttcaaaaccagcctggccaatgtggcaaaaccctgtctatactaaaaatacaaaaattagctgggtgtggtagtgcatgcctatagtgccagcgactcaggaggctgaggcaggagaatcacttgaactcaggaagcgaaggttgcagtgggcgacagagtgagactatctcaaaaaatatataataataataataataaatttaatttaaaaaataaaaagcaagatttaacatttatagagcttaatcattatttcgtttactggcctaaatgccttacagatgacattcatcctaacaaactcaatgaggaggtaatatggtcagccccagtttacatacacggaagctcaaggatgggaagatcaggtcttttccccagaatgaaggagcagagggagtttgaaaccagagctgacacttttaccacacacaatagtatccattaatatgaagcaataaggatgccatgaaagatggaattgggagtatgtggggttagaataagttagctaaaatgttctctatgcttggaatgtcacggtagtgactaccaaggcttctttgtacaatactcttttctcaagatttgtgcccttgggtaaatccctattccatgattaaaaataaaaattcagtaaaagaacctgttggtcaagatgatgcaagcagacatcaagataaacctggtttcaaattttggcgctgacacttattagctatgtgtccttgagcaagttatttaatctctctcagcttcattttcaggatataaaaggggaatcataataacttacataaattttttatgaggttataaagttctgaaccaggagccattacgccccataaggcatttttggttatcataactgggagtggatattaccggcatttactgagtagaggccaaggatgcagctaaatatcctgcaatgcacacaatagccctacaacaaaaatttacccagcacagaatgccaataaagccagtaagctgacaaatccttaaagaaatacatttgtgatatccctggcataatattagtaatcaataaatgattctgcggctttatcatatgtatgaaatttgtgaagtaatttaggccaaagttttaaatactaaacactaaaggattcttattccttctttaatccagaagagaaaaagtgatttattcttaattacttttgtcatgtttgatttcttgtaaaatattgttttttctgattcttccccacattaaatgaaattataatacatttcaaatgacatttaaaacaattcataagttaagctatcattctggcccagaagtcttggtggcttataaatgatttatagtatccactgagaacagtggagaatattttagaaatgaaaataaaaaacaagggatcattcaagagttagctttttttgtagtggaatcattccacccctctctattgtctaaggaagtaagttgcagcacatctttaagaaaatgctacagatcagaatcctctgtttatttgtcttgcgcaattgtctcagtgcctttctgggccaaagttttgtttcgctttgtttctgaaagcatcagtcctggaaatgggaccattttcctggaatatttggaaagattttaatcagaaagtgtggtcaagggaacgagagattcctatgttcaacagagaagacagctgcaaaataaaactccttgctttggagctcaacattaataagctttctgtgtacccagtagaattctagatacaagtataagcaccagaaactctcaaacgacactggcttttgtaaaataggatctcaaagccttcatttcagctctcaaaagttaacatatatactatttacaaattagtaatttgcattcttcttttacctaggaacatgtctttacaaaactactattggtgaatgcttttgtaataagcttgttttttttaattcatttatggagtatttattgatatttttatagaaagtcaactggtttttgtgaattgatcttgtattttgcaaccatgctgaactaatcagttccactttccttagccttttctgtatgcaagataatgccatttgtaagtagaggtagttgtatttcttcctttctagtctggatacctcttagtttcttttccttacctaagtgccctggctagaatctccaagacaattctgaatggaagcagcaagagtgagcattcttgtcttgtttctgatttaacgggaatgcagtcagcaatcattcagcagctgtgtgatctcagcagctgtgtgaatttcataaattttctttattaagttgaggaactgtccttctatttctagtttgccattacaacgatttgtttccaaacattaaactaacattgcattctacatcctacttaattatgatgtggtatcatttttagattttgtcgtagtgtctttgctaaatttttcttcagaatttttgtgtctacattcatgagatatgatctatagttttttaagttattttgtctaactttgatgtcagtataatttttaaaacagacaataacaagtgtcggtgaaaatgtggaaaaattgctgatttttcttatcatacactgctgataaaaatgtaaatgatgcaacccctttggaaagcagtctggtaggttcttaaaatgttaaatatacagttaccacatgacccagtgattccactgtcatatacatactcaagagaacggaaaatatatgttcacataaaaacttgcttataaatgttcaaagtgttattcataacaggtaaaatatggaaacaacccaaatatccatcaactgatgaatgaatgaataaaatatgctatattcacaaagtcaaatattattcagccataaaaagaaatgaagtactaatacatattacaatattaggacattatgctaagtaaaagaagagagtcccaaaatgccacatcttatatgatttcatttgcatgaaatgtcctgaacaggtaggtctatagagctataagtagatgaatagatgccaggaactggggacagtgaagaatgggaaggactataaatggttgtgggtttctttttggataatgaaaatattctggaattagcatgacagctgcacaatcttcggaatatgctaaaatccactgaattgtacactttaattttatggcatgagaatgatatatcaagttacatgttatgcacacatacacacatatgcacacacatctattgctgatctcagtttcaagaaacatggaaattaaaactagaaataacatttcttgatagctcatgtaaacatgctgttttaacaaatgaaaacttgagatacagagaagttaaatgacttgtccaaaattgcaaagttatttatataaaatttcaaaaaattacttatagtcctggactgcttctataaccattttcttatacacaaaaattctccgatgttgaaatcattaaaacaaaaacaaagtactactttgactcttccactgttctcaaaagaattttttttttcatgtcatgttgctttctcttaagttgtatgaaatgtcctgggactcctcttatctaacagatgaaaaaataaacattaaagatcaggtatttatctccataaaaaggttagcgagaaagagaacaacagatctgcctccataaggcattaattttccatatcagatggagacagaagctcttcaaaggacttaacaactttttcccagctttctttctctcctcatccctccctccctccctcccttcttccctccttccctcctttccttcctttcctacctagcaatgtaacttttcttaagtagtcctctcttcttagggtaaatgtactccgcattttaaatgatttgaaacctaccaaggtctgttttgacctaaataatggaggcttaaaaaagaattattacagaaaataagcactgtggtaaaccccaagctggtgaagttggtgcacaacaagagagacatattatcacctacatggaggaagtatatatgacacccatggaaggaccacacaaatctatgaatttctagaccttgcttcctctcaggatttacctttagcttctcaggcgtgaacttgcagaagctctctgccagaaatgagtgctcagagtattatttacactctgcctctgggcctatatcaggggactgcaagggctcttctaccctgtatgttagcagacaagatgtaaacgtttaaccaaagcaataaaaacaaaaaaaagcaaacatacatcaaaaccaaaattgtgtatttccaagaaaattactattctctactgagttctcacaaattaacttgtaacttcatagtcaaaatatgatataaagctaacataatttaagcaactgtctctgttaatccttacattggtctcattaccaccattttcgggtgagtagtatataagtttttgtaaaaattaggtaacatttggaacaaatgaacacgtgacttttttgcctactctctatttacaaatatgctgatacagagataagactttaaagattatatgtccattgacagagaaataattatttattcccatccactatgatatttgtttctctcgataatcctgtgaattgactcaagcatatatgatagaggcccatttacacataagtacatgataacatgtattcaaattactgggaaatcttgttaaaatgtagattatttttcattaggtatggacctaagattctgcatttctagcaagctctcaggtgatgctgatgcttctaattctcatatcacactgtaagaaataaacacactctaaccactagaaaaaaaagggttatatatgagatggatccatcatttgttttaaataattgtactatactgaccaaggctatagatgttgatctaatcatatggtttattgtcttccacaacaacaacaacaaaaaacccaaccagatgctaggaaaaaaacacggacttttatagacagagtaatggggaatacttaaatctaggaagttaaattgaaaaagaaaggctataatatgattcatttgaattaagctaagctatttggagaaaaatcattgtaatatcatcaatcagatcagatattttaaccaatgattctagtccctccaagagtactctctgcttctggcccaaaatgaccccaaatggcaatccagacacagcatttgtgatgttgaatcagggtcaacaaggagggattttgttaattcctttcctcataatattatcatttgtatatagatacatacaaccatattctccacaaaatgggttagtataccatctgttatcttagaaaatctagacgcttttctattagctattacaactgagaataatttctggactaggcctgctagttaaaaaaaaaagaagaagaaaaatttaaataaaaaactaaaggcaatataagaaatctcaagcatttgcagaataaaattgcattttaccttaaaataacttttgcaccaatgaatgattctgagactgctgctgactattttccaaattaacagaatactctcaccttcatttgtattgagagtttcccatacttgcataaataacaaacggcatgccaatgtattctacatctgtctgttccacaattgagatgttcctgcagttaatattaacaaaaggcgcctctcccttcggtctgtaattctgtcactgttcttcctatctactttccagttaaaattctgattatcttcctgagtatcccttgaggcctcttgtttcttttttagtagttgctaggcaagttctatgagaatgctttaaaacatcagaacaatccaatgataggtatcctcttatagaatgcttcatggaaatttaaacctggcctccacacattacagcttccacattaatggtattctctatatattcacagagccaagtgcttggtttgtttgtttgtttgtttgtttgtttgtttaatttcccaaagtaactatgttcaaggccctgagacccagtctacaagcttatgggatctcattgtcttatgtcagctttcttatgttgatggtgacttaactattagttttgcctctgaagttatgattttgctataaattgcctttagttttttgagttttcatgaatgttgattataaaaacaaattaagcttcaccaagaaatcaagttgaccagttctgtgttcaattaaattttcgctcccaaatgatctcaattttccagaccacaggtgaatgcttcctaagatttcattcattatcagtcaaccagcaagtactgaatatgttccacatgtttagcattaaagaaagcattctgaaaaatacagccaagatcatcagaattgtgcaaaaatggcttagtcctgttgtctagggattaaggaatgtctctctgaagtaggttataggaatagttactttacaacagatttttcccaaggaaaagaaactctatttccttcacattaaaagtacacaagtgttgtcttaattgtacacaaagttgagaaaagcatgtgttgcaagtgaataatttccctttttgttctttaatctgactaggaattgcctcattaatctgcccatttttacttcaccacaacacttaccaggatgctgctgcctattaagattgttctgatgttaaaaaacaaacaacaacaacaaaagaaaaacactgactcagacatggcctttctaaagtgggacagctgtctaccttctctccttcccttttccctccttatttccttccttctttctccctttcactttcctcctttcattccctgaaaacattctatactggtcaaatggacaacgaggaaaactatatgtagcagtttctttaatgtatctttgtatatgccaaagtacttccaccttactatctttcctccaaatgctttatttttaattttccccaattgacaaatttattttgcaagtatataggtttgaactatgtgtttacacacaagtgacacagagaattcttcagcagtcattattcatggagatgttgccagtttacctgaatgaggaagacaccagcattgacatacatgtttaagcaagatacggtgatttttcccttgaatatataaaatagcagagtgactaactgatagtggtgttacctttaagcagattcctctattctgttcatgaagaatgtatatcttcctaaggaaagttgtgtttgaataaatgcctttcttctgtgtattgaataacttagaaagtgcttctttcaatttagcatacacaatgttctgaaaatagccaactcaataaatatttgtttaatgaattatggtatccttgcactaggcatcagtccagtttaatttgagctcaaataatacaaacatatgtcattgtccttctctttatgaaaaatagagcaacatgctaatcagcatttaattttttgcctactatgcagaagaatatgaaatgaaggtattaagatccagttatgctatttagtgtatgttatttcgacaacgattacaaaatctttgtcatctcaactattgatacatttgaaattgtccagtgagtagaaggtttagactatgcaaaggaaaaacctttatgctgttaatcatctcaaactttctgccattctaagtcgcatgtttagagtaaaagtcaagtagtattttattcttggcaatgggaaaactatgaccgttttcaaaatgaattcctatgtgtcaggtgaccactaaagcaataatttagtccccagtgttagttttgttcatatactgtagcatagaaaatctgcattctgtaccttctattccttgaagatggtgaacacgaaaattaaaagatgtaactatttaaaggatgtaactttttcatttaaaagatgtaaacattgcctttccctcaaacgtgtcctattatgaaaatctaacttacagatattcagatgtttaaaataactgtgaccactttgtctccaaaaggattttgcattttgtaaaagaaagcactacaaatttcttttgagaaacacgcttcagtacaattcattacacatgaatttgacaacttttcatttagacccaattttctatagagattatcatgtggcagatattcataaatgctttatttcaggtggaattttaccttgagatacagctccacataaaaacattgttaaataaccaggtattaaatatagtccgattccaacttccattaagtcatttaagaaaacaattcccattgatgcttgtctgagtgctcaatattctttttaaatcaggggagtgaaatatgaaagtaggcaacatactctggaatttttgttgagcctaagtaacttcatttaaagataaaactgaaataataaacatataatttccagttttaaattttaagagccaagaacacattaggtgcacttctcattaaacaaatgagataaggatctatttcagtagcaattaggagaaagaagaaatatgagtgtcgcaaccattctattcttccctcaaatactatgaaacttataacatcacaattgattatatatacacacatatgtatatagatatacgatatattgtgtcatatgtatttacagatgcaatacataactatttgattgcagctatttttatctcaaggagatttcaagctcttggacactaacatttttatctcatggagagacattacaatgctctatgaatggggagtattagctcattaatatttagaaaaataacagattgtcataaagtagatactatcctgttgaccaaatatttgtatctctcctttcaagcatggaggaaaaaaaaattagggggaacattttgcaaaataaccgtttgatttttaaaaaaaataataattttcaaactgatgcttttaatttaataacaaaataatgttattaaaacttaaatacttaacatgtaatttagaataattatctaatggcccagcttacatttacttttacttgaatggtttttaaaagttttgctttttctataatttcatggagctaaaatattttatggatattttgatgccatgcttatatttggctaggtaaaactcacggttttaatgctgacaagaaattagcaggtcctaacaacttttattcacaaatgaatgcattaataatcaaaagaaataaagaaaacattatactattttaaaggaaacgcttaaaattttaagaatgtgattttctagttaaaattgaccctagtgttcattattttttaggctttttacataaacttacaagattttagttttatgtatttatattaaactttttacatgagaccagtaaatagcttactactactttttcatgttatgttgccttctctcaccatagatttttgtcttccaattccttaaagttgcaccttagtagtaaaaagtgtgtacagcattatcagcttttcatattattttactaattgcaataaaaaataaagctcacctatttttaaaatgttatttaattaacctagttattttgaacactttgtatccaatattttttgaaaagtaagacgactttccaaattcatttatctctaaagtacttagtatcttacatggaagataatgacatgtctgtatgatcttcagctgttataaaatgtcaggtgctggaaattcttaacagagctgcccataagtcaattaaatcatggcgccacatcagcttttcccccaatcccaaaagagttaaaaaaaaaaaaaactctaataacatctacaattaatagcattcctgtagcctgtaggtctggcctgttactttagtcttccgctgacaataacggagggccttattatttttccccctgagcatttattaggcatgatgaggaaaaggttacatctctggaaaagagcacaatcttcaactctcttcaggttagatgctttaatgggcattacattagaaaggcattctacactacctattatattacttctcccaattagaaattccattttaatgtgattgccaaaaatttagtgcctgcccatttgataaaattgagagtggcatttgctaaacatcaattaacagaaaatgtgaggcaaatgttgtatgggtagattggctgccagtggggagaaatgaatgggtagtaatggaaattaatggataagggaaatctactttaatttccttgaaaaatgtgctataacagctatctgcattaataaatcaaacttattgtttaaaaagtgaacaacaagatattttgatttaacaagacagcaatccttccaaaatcatagaactcactatcaggtatcattctcttggatatattcaaactgcaggctttgctttggcaaataatctttcactatccttagctctaaataagatcaaactgtcaataaccaggaaataagttgttaaaatgtcattctccaatttatcattttaaataataaaagttgttttaagtaaacacgtttctttccatgtctattttttaaatttctcctccataatatcttccattttaatcccacaataggctgtggccttttgttaatgctacttcagatacataaatttctgataactgaatggagacataaaaagacataaaacacttacatttgaacttaaaagacaatatagatttatatgaattcttttatcattttataactacatttatctaagactcatttaaagtgatttcaatctgtatttgtttcctctaacatttttctttataacaaatttagttaattccatcatctcatctgaattctatgatcacacaaagccacctaaattaaatccatacctgaacagtctgggtaaattccccatataatatttcttatttaaaactttagtattaactaagtcttttaaggaagtatgggcactgattatgttctggaaaactggaagaatatcattaatcattaagagcccaaaatatggaacagggcatgtacatttatagagatgtaatgatttttagcacagaaattatttaccttaaactaagtactaaatgggaagagagggcaaaaggctgtaaatggagaattcttcttccagttttgcaattaacagtgttaatgtcgaataagtaagtagcttttacctctgtgcattttgcacttttacctcctctgggccagaggaggcaacctgcaccatttctaaggtcttttctagaagtttgatgagtctgtgttatttctgttagtttttctgcttatttcacagtaggctaaaattatgaatgaaaatatgtaaaaataaacttagcatggcaattttggcatagcatagagctcatggataatgattacacttctcaataaaacagttaagaatctctctcggggctaactttttattttaggatatgggataatgctaacgaaaggactagattagaaatttatgattaaaataaaataagactaatactgttaataataaatacttctgataggtagactggtgattctggaaagaatgatggcaaaacttttcagaaagtttggtcctacccattctctttgactgtctcctgcacaaaggcttctgtgcctcttcttttcattttggtacatgatccaatcaagagaatatgatccacatctcaaagttttatataatgcttgcaacaattctctactaatatgcctattgatgatactgtatatttgtattcatcttttccatcttctcagatctcctacaccctgtgtactaacttaatatcagccattaataactgagtaaatggaagtgaccaaaatgaactctattttctgaccaccaattccaccagtccacctctatctgtacccatgctctctccatataatgttcttctcccatcagatgtcaaggttaactcttctggtggtaatctggatcctggatccacttcctgtttctgactcaataattttgtttctgaaactaaatcactcttacaaatcacaaattatctcgttactagatcattcacatcagcattcagaaatgctgtattatattttcacatttaataaaagaaaaataaatatcaaattcccctagtgttgccccgtttatttgctcctcttcaaacaaaattttctcaatttcctctttcccattttcctctcaacacataatagttgagttttgtccctattatgtcactaatccttctgtttaaagacaccagtaatctccattttgtcaattccactggtcacttcttcgttccatgtcgactcatatcactcttctgcttagagcttgccgataaatttctatctggtttagaaaaatgtctgaacaccttagtctggcctatttgtctacttctactgaaacttcatcttcttttccaccctcaccttctgcgccaggtaagtcccagtaacactccaagcctcttcacaatttagtgcccttgtacttagcaaattggccagtgaagtgttctccctgaactccacacagctatgcccttcctgcctttcacttctcttgtcctcagagataccttgccggatgacgcaactgaaagtcagacatgctctttatactgtttttattttctgcggagcactaatcattaattaatatattaattcactgattttttcctcaataatatgagacttataagaaatcttacttttcttttgcttcttcatttccagtctagaacactgcctggcacaaagaaggcactcaaaaaatattgcttaattttctcatctttgtatctcaaatgtcattacacatagtaaatgattaataaatgctggttggtattaaatgattataaactctcttgatgaatttacctacactattattttatgatggtaatttatcagtggcttttaataggtattaatatctttcaggaaagatttgtactggaaatagaaagtataaatcaggaagtaggaactatttgatctctcaaaactatttactatttaagcagttgtttcataaatgttaggaaatgtttgggaaataaaaagagttttaaaatcagtacatatatctaaatttaggacaattgaggcaactctttaatctattaattctatgactatatctagatcaaagctttggttttagggcaaagtactgtagaggccaaggagaacctcagaaggtttgctgaaaaaaatcaaattgcaaagttgattaattggagaaaagacaaacacatttatttaatatgtatatatgggagccttcggaatgaagacccaaagataaagaggaaattgtccacttttatgcttatgttcaacaaagtatgtacagcagtgcagaaaaaagggtaagaactaatgctgatatactgagtggggaaacccaggaaggtctatctgtctagactcttcctggcctctttaagcctgcattccttccttctgggtatagaacatgaccccttctggaatgggagttttagtacctacagtcaaacaaggtatatcagataatttctttatgggtcagtttttacacagaaaggtggagagaaaaagtaatatttgtaggtttttatggctggctttggagaaaaagggttctagtttctgtgacctgccttggggaagagggattataggttctatggctagccttaaggagaatggaactgagagaaaagagggcaggaggtcagagaaaaactttagcttctgaggctgctgctgaggccttcatttggtgatattgttttctgaaccccaacagtacccaaaagcccacaaccgtatattttgtattatcaggacattcttcactcaaatcaaagcatctggcatcccacatttcacctagattactttggagttccaaggtacagcaaaacacattaaaaccaattaataaagaagaataaatttatattaaggtgagcagtaagatggaaacaccagaataaccaaacactcaaaggaccttacaaaaaattattcttgattccaactttgaatgttaatcacattttagagaaaaaataattaagatcagttgaaggaaagcaaataatgaaatctttaaagttcactactcttacagattttgaaaaagttaaacagagggtcgttatgtttaaaatacgttgtgggactctattattgaataacagccttttaatctttgcggtttttgctactagatacaacagtgctcttttaatgatctaaatctttccattagtctaaaaagaacaacttgaccacattatccattatctttgtttccagaaatttactcttgaaattctttaaactttgcttttatatctcttatattttcttctaacacaagcaaaaatatttgaaaatcacaatattttttaggacttttttctttatcctgcaagaaaaggtgactttaaaattgttgccctaatcaagatttgtgttgacttaaaagggtctatctacaaacttcaattttatattggcctaacatgtttgaaaatataattttcttttgtttgaagaaagttcctcaaaataggaccaattgtttcatatttcaatattcacctcccaaattagtgcatagtagacagctaataaacatctgcagaattagtaacataaacataatgcttgttagtgtcaagtggctgaaattcgatgattccaatttctgtgtttaaaacaataacaggccgggcgtggtggctcacacctgtaatcccagcactttgggaggccacagtgggcggatcacaaggtcaggagtttgagaccagcctggccaacatggtgaaaccccgtctctactaaaaatacaaaaattagcctggtgtgctggcaggcacttgtaatcccagctactcaggaggctgaggcaggagaatcacttgaacccaggaggaggaggttgcggtgagccgagattgtgtcattgcactccagcctgggtgacaagagcaagactcgatctcaaaaaaattaataaaataaaaaataaataaaataaattttaaaaataaatatttcaggaaatacttaagttttccttgaaaaacactccattcatcctctttatatttttacacaccttcaaattctttttatgacatttacacctttctgatcccacttgtaaacactctgtaaacattacacagtcagtgtttaaaaatttttttcattaaaaattctttctcaacataatacaaacacagatttacgcatttacaggacaattattcctctctcatttacctttaaatagcagtgtccctgcccattgcttactctaccagtttgatataatggatcctttggtggcaactacatgcattttattttcccaaagagaatcttaatatacatcacttccttcacaaagaatttcagtaagagggaagaagagatatcctggagactcaaaatatcattattaattgcaaccagctaaatctctgataatttattttattcacaaaaaaaaaaaattatttgctgtgaaacaaagaattcttattaggaattattaataaggtattatgaacaacctaaacttgaaggttaaatgtgtgtatatttttatatgcccatttggaaaggttcatacttaaaaaaaactctcaatactcatgttgctaaataataaagaggccatgaaattaaataaatacatgttaatattaatgctttatgttggcctgaaacttgctttattgtggctttgatctacttttacccagggctgccaccaatctatatgccactttgtgggaagtggaatatgagtcacctccacatagagacacagtgacttagagcagcgatcccaaacctttttggcaccaggaactggttttgtggaggaaaatccatagactggggaggggggtggtttcaggatgattcaaacacatttattttgcactttatttctattattattacattgtaatatcgaattaaacaactatacaactcaccataatatagaatcagtgggagacttagcttgttttcctgcaactagatggtctcatctaggggtgatgggagacagtgacagatcatcaggtatcagattctcataagaagctcacattgtagatccctcacatgcacaggtcatcacagggtttgcgctcttatgacaatctaatgctgccactgatctgacaggaggtggagctcaggcagtaatgtgagcaatggggagcggctgtaaatacctggttctctgggggttgggaacccctgacttacaggcaagacttgataaactgatcactagcagaaaatcaactgccatctgccttcttagctaaatgcccctgtgcaaggcacaaagtttgtaaattaactcagtggccctgtcctttggatctaggactaagaattcattccacatggcaatctgtactgggtatctttgtcatggtgtcttccgtgtctgttttcctttatcaattaaaaaaataactatgatctcctattcagagatcctttgcacagagttagctatagaatgtattataccaggagcaatgacttaatccaaatgcattgcaactagaggctgacttgaaactttaaagtggccagggatgcaatcatctgtcccaaatgcagaaccattagctaaacaaatcagaccgactctctcaaagacactggcaaacactggtcacagaaaatgctcagagaggtgcagagacatacatgaactattcctgcagaattcttactagggaagccaattgttcaagggctaatgattttctaattacggtatctatatatggttctcatttgtcttaaagatatctcagattaatcctctatttctgcaacaggaaaggaatgcctactaagtacacagtccttcttgctcttaaaaagagttatctgattcgggagtcattctttaagtccaacatttcatctttcttcattaattaattatatgtaacaaaagagttacatatagagtatatgtatatagagtatagaattgacactcaagcgacaaataaaaacaatggtgctatctttggtgatttataggctttaaaaattatcagacatccttggggcaatataagaaaattatatgtattcattcctagtaggtagaaaatttgtgttaaaccaaatctgtatcacagaagttaatttttataattgtagcttcatattttttatttatctcagtcattattagtggatttaaagaataaacatcatggttatagatttctggcttttgtagtgactgattcaattaacattattaattgagccctgcatattaaaaactatggcatgtaatgtgagagtacagaaagaataaaatatgcagtccttgcactcatgagataatacatctgatgtaaaaaaaaatactaaaaatcatgaaattatttgcacattacagagcagcctgagaagtgcgttctactctaagtgatccaagtttcccaaacagagatcaatgagggtgactcgttcaaagctccctaactaaaattaactcaattattcaaactgccattttttctcatgatgtgaatacagttttactatttcaataaaagttatagtgattattgataaagacttttggtacaaaatgccagaccagggatcagaaatgagcttctattccatgttattctcattttggccacaattaacttacatctataggacaaacacccaacagatctttaggcctgaaaggcagaaagaaaccagtacctggggattgtgccttttcaagcttacacagcaggatatgaagaaaagaggtcatgatttgtgctaaagtaactccaaagaataacatatttatcagaatacaaaacacagatatacttgaggaaaggctgacctaaaattgctgaccatcttgtctggtagtggagctttttcttcactctaaacagtcagatttttagtctcatcatagatacccaagatttcctgttctgaacaagtcagctctttatatttgtggcattatcttactaaggccctcaatgtaattcctgggtagcttttatccctatctgttttttttcccatctaaaatctaatcttcataccaatatgaaataaatctagcgtaattgcaatttgagaatgtaaatttcaagctcttaaaaactacagtgcctaataatttgcattgtaactaaatacatgtgctcacatacccacacactcccacgactcataattaaatttcatttaaaatttgttcccttactatataaaatgtacttgtattttccattcccttccattgtatttcatttcatttcattccactccataaatgccaaccatgagccactgaattaattttatgatcctctaaaatagtggttcccaaaatgtggttccagggccccctggaacacccaagactcttccagggaatccacaaggttcttttcataaaactactaagatgtcatttgtctcattcactctcaacatcttgcaaatgtatactagtgttttccagaagctacatgatttgatgatgtcatcactctgagagataatggaaagtattcttgtatattcttttctttaaataattttctcaactttaatttctaatacagtaaatatttataaacataaccatataaacaaaaactctttgggtctctcagtaatatttaagaacttaaagagatcaagagtccaaaaagtttgagaactgctaatctaaagcaagcttccatttgaaaaacagtgacttaaatggaatcattgcatacatacacacatacaagtctctttccatacttttctattctctgcaaggcaaaatgcaaactggcaccaaatgtcttacaacaaattagctgtgattctactatttcctactattctctgctctttactaggaaactccatctaagtcccctaaatatataatgttcacctctgcctttgagtctcattttatagtatactcttgaaatatatttaacactattttctgctaacataagtcctatctaactatgtggacatctgcaatttctttgcttgccctgcgtcctttcttttttggaactgacccttccggattccttgaattcacacgggaatgcgaattatgtggccctaacctttcataggcctgaggattcataccagtcaatcaaactaccccatacctttggtactagtgtgcagattacatgggaagggctaacccaagagcagtcgagggagatatatcaatgttaggggaagaagaaattgtgttttgttctctaagattgctcactgttaggaaggcaaggagaaggccagccttattaagcaatggcttagggacactgtggcacaattctttttacatatatattttttatattttgtcccagtgtccccttgactagacatctgcatatgtctgtcctttggcattgctcccaataatgcctgtgtgccctgtagactccctattttctgatgaggacttgtactgttttcaaatgcctctctattccctttaagacactctattaatttactttgcaatcaattattttatgttattctttttttttttttttcttagaaactcactaggtgcacaaaggaacaattctgtctctgcaactaagtggggattctttcttgtatttcctaaaactctaaaagaactctaatttttaatatatttttggaacctatttgcttgaattttttcccttgaaaatgattgacaaattgaatgctgtgttatcttaacagtttccttacatcttctttaattgctgtgtcatgcacagtttttcttcacttatgttttgaagagaatatgttatccttcccccaccctaaatgttatccctttttgatttgaaaaggcacacaacttaaacacatgaaatgaagataatttccatgctatttaatgtaaatttggaatcttctaaagtaaaaatattaggggaccaagtagttaatgtctatattaataaaggaaaagtgaatacaccacctctgtaatgttagaagacagaagtactcgggaactgtaaccatgtgtacatttcagtaagatgaaaattgagcataccacaaacagaagacagaagtactcgggaactgtaaccctgtgtacatttcagtaagatcaaaattgagcataccaaaaaaatcatcgattaaataacattccaaatgtcctcagcaagtagactttgttatgcatgcttgggattcatattaagatatagccaaaagaattcatgattccgttacctccttcagaaattgaaaacaatgatcatcaaaggtcaaagatgccttcttatgctaaattttattatcaacaggtcatttgaaattttgaaggcatagcttaatgttcttagaattagcacttcttaattaaccaaacagcataacagaattatagagagggagaaaaaccctcagttaaaatgacataaatagtaatttgtgaagttcaatacctcttggtctgctaattattatatgatgcttcattaccatttaaaataccacatataaaaagaaaaggaaagagaaagaaaatttagagcacattcattatataattttgatttattttacaaatgcaattataatcatatttgggggtcagagataataattttgctcaatatttcataaggaaagaaaatctaatttttcatatgtagtcacattttaatatgagcatattttatatgtgatacataatattatatacataattttacatatgactggcagaatttctgcattatatatactttttatgaatcacttaagttggtttttaaaaacacaactacatataccaagaccacatatgcctcagtaagaagaagtatgaaattatttaaactctcattcaggaaacactacaagtttaaatgaagtaacagaaagttactgcagaataatctctctattcaacaaaaatattacacagtttgaaagtaatgtaagtgggtccaccacattaaacacactcctaccctctactgacctattttctagactctaagtcagagtatggaatttatctaagttacttcaatcctcttatctttctaaaaaccaaaggcagtatgcatttataatgcttccttaactcacatcacttcataaatctgttttcttaaaaaaagtcatatcataaatgagcatgcaaagcacatactgcctcattcaaaaaatgtttaatcattagaaatagggcattgcatctattatcatttttaaagtgttaatgtgatagcaatctgaaacaacaaataaaacatctaagaaaggaaagctatacaccttttcttcttaggattattctcagtattgcagcatgttgatggctttactaaacttaccaggctattttctcacctaaaagttggacatcagtgggcaaaatattgccctactgatactacagtgatctatacattttaaatattctttaactgttccaaaatatatatattcattttaaacaaaataggaaaaagaaacagatatgaaaaagacattacctgtaagtccactgcccagaggaaaatgccattaaaacttattcttatacatattcttccagagaccatactctgaatatggatattatacatatatatatatatatatatatatatatatatataaaatatatatattatagatagatttgtttttaaatggaattataattttccatagtaagctttattcaattcttaataacaacaaatatattttcaggtcaacaatatgtatttgtataatctgcatcaatgttgttaatggctgcacaatatattttcaattaccataccataattcagttaaaaatctcttaccagatatctaatccctttccttccaacttctgatactgtaaacaaaatgttggaataaatatccgattactataatgtgtgcatctttcttagtgttttgcatacaatgcttggctaatgcagggtatcaatgaaagtttgttgcattaatgattggatggatgaataaagtaacaaatgtgggtttttaaaatatcatttaaaggagcacgtctatttgatattcagattttgagtcaaatcacttcacacttctttgtgcttttccccatgaattatgataacgagaaaacatgcataatgattaaatgactttcatccccggatgcttccttaatatgtgtgaacttgtaggactataagtaatgctctgtgtgagataacatactcaacaaatgttctaatagagaagaaaaaacgtaattgttgtttttaaatgtagtataaacttcataggatgctgtaattttccatttatttttcttgcataaaatacatagaattacataggaaaaataatttcagcataactcatatgtcccaactctcctctaggattttctaaatttgatttaacaagcagctaatgagcatttatgtctgacattaagctaatcacaatagagaatatttaaaaccttgatatagctaaaacacataacttacatggtcatcgtatgtaatttaattacagaaagtaagcgatttcctctgtgatatgagaaaagactaagattctccagctaagataaacagatgcaatatttacatcagctggaaggaagagagaacttcctcacccatggacaatgtgacagcaattccatccctattctcagcacagtatcctccttgtttaacaaataccttggaaacttgccagttttcaggtatttccatcttgggatactagccagttattcaggacatgaaaccaggacaagaagccagatgtgcaacatataagagtaataattattttccttttgattcccttatcatgacaatggaggatataacctatattttcaattataaattatttcatagactgacagaatttataaaagttcacctgaatttttaaaaatgatatgcctactatgcacaaaatcacataccagaccatgcagggcttgctctgtgtctcagttaaatctggcaacgaaccttggtcaacctgtaaaaccccatggattctcactgaacacactgtactttctcagaagaaaaggattctacgtatgccatcagaggctactcagtaagcaaccaacaccattcaatatattcatttatatttccctaagtttcttcactgtcaacctttaatatctattttcctgaaagagagctgaagcacacataatggtttcaaacatctgtttgttctaattttaacaaaagttgtcccatgattagaagccaactatttggagtaatatcacgtttgttctctataaataatataattaaattgctacaactaacaggaaaaataggaggtagccaacaatataaataaaccacaaaccgtgtttaacctagatttgcatatcgttctcttagttttgctatggttggaatggttttactagagttaaatttctttaaatcaggagatgtctgattaaaattttgaaatgttgctttctaaattctgctttttcttagctcactgcaacctccacctcctgggttcaagcaattctctgcctcaaactcttgagttgctgagactacaggtgcaccccactacatgtgcctgaagaaagtaatggcaaaaaccgcaattacttttgaggtaattaatatattaatagtttctacttttgttgtatatattaataatgagctgttcattcaaaagtttttacctaaaaaacagtttgctaaaagaaaagccattgcattacaatattttgacagcttttggcttagaaattagaaaataaaataaccaccaactaatataatctttagaacatttttctttgcttttcatcttttgaataagtgacaaatattaattaggaatagtagtgatagtttatgaaggtaataaccactactgtaacatgttaataatttaattaagctagtttctattatgaagcaaatttagaaaaggggagtaaataaatgtacacaataatgcattttatctcttcaatcaaaaaatccatagatgctaatgtaatttgttaaaatgccacaacgctattgaaaaccaaagttgccatatgataaagtgatatttattaaacctatcattccagagagttttcctgccttttgttataaatgtatttaactgaggccatattttcttcacatttgttccctaggtttgcttccagaaagattatctatggtagaataatctttataataaatctcaatataccctgctgtgccctaacactttaacactttagggcaacaaattgccctaaacacttgttagttcttctaggcacagagagctactatggcattaaaatagatgtatgcagcaccacattacattttaaaaagtaattacagatatctcttctgtgatcacctataatgtaaggtccaagcccttctgttgaggcaggaactatcagaaagataaaaattgattctgaaataaaatgcttatttcccaatattataagaaacataactgtctcggcgtagtggctcacatccgtaatcccagcacttagggaggctgaggtgggtggatcacttgaggccaagagtttgagaccagcctggccaacatggtgaaaccccttctctacaaaaaataacaaaaattagccaggtgtggtgacaggcacctgtaatcctggctactcaggaggctgaggcaggagagttacttgaacgcaggaggcagaggttgcagtcagccaagatcgcaccactgcagtccagcctgggtgacagatagaaactctatctcaaaaaaaaaaaaaaaaaaaaaaaaaagaatgaaaagaaacatagaaacatacccaacttattcattgtggaagattgtctcttcagccatttgtattacgtattaattttttttatattatggtttctacttttgtcatacatctattaatgatgagctgtttattcaaaagtttttaaccaaaagaacagtctgctaaaagaaaatcctttccattacgatatctttgacagcttttggctcagaaattagaaaatgaaatgataaccaccaacaaagggattctgcagctgagtatggatttcctcccagtgacaggcatttttgtaagcacagagcctaataattgtttgaataaacaatgtgtgtgtgtgtgtgtgtgtgtatgtgtgtgtgtgtgtgtgtggtgtgtaatctacacagaaaattgaaaaaaaattttcacaatggttaatggtattaataggaataaatccagatatcttaaaaagagagacagagagagagatagagaaagaggagctctgaaaataattcattaagactctttttatcctgaaatccaaaagaacatctgagcttccatcattcatcttaatagtttatagagtcaactctaatttcaccatggatgaaagaataaacttgaaataacaaataggcaaaaagctatggagaaaaagcttacagatttatcttaaaatttagcctgacaatttccaccttgacagttcggtcatgtttcctaaaaatgattagctaaaaacattactttatagtgattcaattgtaagactttctgaagaacaaatcaagactatttagtaccagatataaattattttaggcaactcttttactcttagttttattaatgaaaggactctcttaaagaatcaagtcaggcattgacactattttgttttttaacttcatcagtagttaatttggacttcacagcagaatgtacactgaatacatgctctgaacgtggcctaagggacaacactaacctgacatcaaaaaggcctgttcatattactaacattaacacagcatattacatatagaaggtgattcgtagatagggagtaatgaacaatgattaaagtttacatgaacttcatctttcagatacaactagaagcatttttaacccaaagttatcaataaggcaccatttggcatagcacctaagtttttccttttatacttcaccttaaaaagcttgctgttgactacaaagatgttgaaaatataaaaatataaaaataataagaaatgtctcaatagtttgcatgtctagttgatcattttaatgtgcacctaatactaattttaaccatacacttaataaaatgatccaaactcataaatgtattattccctttccattccaataactctgtttttaaatagtttgcaaacacctaactgacaaattcctgaagctgcctgagagtcatgaaccacttgtaccccttcccaatttattcacttatttattcatttattcattatttctacttaaaaataaaaaatgtgttggtcaaggagttttatatatatatagttctattaattcaccaaattactaaagccatctttaccaatcaaaagttactctaaatttgttacattagaagttcacatttccaaatcacagaagatttactaattattagtctagatatagtataaatattttggcttccactttttgccatttatttaaatctaattaaatgctcttaattgtatatctctaagtttacctctcaaatcagagaggatggaaagatactctttgcatttaggggtatgaggaatccttatcactttctcctcgatagaaaaatcaatttatttccttttctaaggccactgcgagatgcttttccagctccaggctcaaagagagagtgtttcatccctatttcaatggacaccagaatcaatattttctttaggtacttgctaaaaagtagttacattaagtccccacccagtggtactggccttagtcttttcttactataaaagaacatggctattcctgtttcttcctatactagggatctcttcaaacacaggacagttaacaaattgtcagtaactattggtaaacacatccttccagggaaaggcttcacatttatttgcctacatacacatattagggaacttttcttatttagatataatagtgaaaatgtttgtaaaaggcaaacgtaaaaaaagaaaaaacataaaataaaaatctgttcattttaatgaaatgcattatgtcccctaatctgccaggatggatcttgtctatgtaaacaaatttcatagtgactttcaccttcttcaagatacttactaggaagtatcttaaaggcaatgaatataactcttctacataaaattctgtacatagtagagtggatagacattagctactaacaaatatttgctggcaaaaagctagagcaaacattcaaagcatttttttatttttattttttaattaatctattttttttgagacagagtcttactctattgcccaggctggaaggcagtagcatgatctcgactcactgcaacctccacctcctgggttcaagcaatcctccctcctcagcctcccaagtagctatgactacaggtgctcactgccacgccaggctaattttttttttttttttttttttttttttttagtagagatggggtttcaccatgttggctaggctggtctcaaactcctgacctcaggtgatccacccacgtcggcctcccaaagtgttgggattacaggcatgagccaccagagtgttctctgtattaggctgcccagtcctgtttttgtatgactctctatctaagaattagaaaaaggtttctctttttaataaataaaacaaaaagaagaatatataacgaagagtgtatgcggccagcaaagcctaaaatatttatgtggtccattaccgaaaaagtttgccaatctccattttacagtacagaccctttgcctaatatatgtgcctactatatacagggtattagatttccagagaagggaactaaaaaaagaaataattttgacttttcttcctgagtcctataggctgaaggctatatctgggatagaaagggattaatatttccaaaatacttaaaatgtgttttcctcttcatcaaatctgaatcaaacagtctgtattaaaagtgaaaagtatattgccctgtatctttaatatggataagggcaccagagttgtgcccttttttagccaaaatgtagttatgaagaaagaggcttctttaatagatgttaacaaatcaagtcagtgacaaagggaatgtgaatagagaaaccgcttaaagagtaattagtttgtatttaccccaaattttatttagatctaaaaaaaattatctctgcaaatactttatagatctagaactcttttagttacataacactgtcagttaaatttcaccaaatagttactgggagattggaccaaaattgcagattcaacatttgttagttttcctttctgctctaattccatgaaaagacagaatatatactttttaagatccagaagagtgctagaaaacaaatgacagattttgagggctatcttaaaaatataaaacatacaggaaaaaaaatgtgtgaagtaaatctgtagattaccacagactaaaattcacatggacaaaaatgctgtaggtttggtagtataatagtaaatatcaccaacatccatgataggtattctcaaacaaggttaagcaaaaaactaatgattactatacatttaaaaaggatcaccactttaaaagagctatgccaatttccactaaaagaaaaattttcactgagaacttactgagaaatgggaataaaaattacctatattagaagaaaaaccataacggaatcagacttatcttcaacgtcggttaatagaagagtatggagagatggcttcaagcagaaaattctgaatctagaatgttttactcaagcaatccaacatcaagtagaatgaaaaatacaatgttttaagatctacaagaactcagaaatattaatatcaatgaaaccactctgaaagaattaactgaaatgtactacaataataaggaaaaaaggatccaaggaagaagataatggagaatgagaaatagtcaaataaaaagataaacataaacaaatcaaaaatgttaattgaaaatacaggagaattgagatatgggaggctgtgctaagcaagaaatacagttcaaaggcatgaaggaaaagactgatacatttacccatataaaaaaatgaaatgaaaacaaaacttcaaaatgaggaaagataaaaatgtttaaaaagactatataatggctgataaacatatttgtcccatatatgacttacaaaatgtcaatagctagattatataaaaagattctacaactctcaaagaaaaaatgagcagggatataaacagaaaaacactacagagaaattacagagaaaatgaacaaaagtgaccaataaatatatttaatgacttcccatctccccagtaactctgtattaatagagttaataaagattaatatagattaatataattaaagttaacttaacatacagttaactttcatttccataatggaaattaaaacagcaacataattctctctccatgagactggggcaagcaaaacatagtaatattaagtcgtggtgaggagaattaaaacagaagctttatatactggtaatgcaaatataaattaggagagactcttgtaacgtaaattggcagtagtttgctcttgggaatttcatttttataaataaaaaatattcgtagatgaataaatgtatccatgtgtgagttaaatatggacaaacatatacagaatatccactgcaacattattttttatagtaaaaaacattgaaacaacctaaatatttaccaacaaggaatcagtaaatacatcatcttctatgccagaaaatactgcgcagatttttttttgaaaacactgaatatttcatgtgttgttacattgtgaatactaaacattaacatagtgagaaaaatatctaataaattttaaaaagtttttcatttatattttccatttctccttccactcatatatcgattttgcccttatgcaaactacatatctgtaaaaatatctaggtcttttttaaactttttattagcatataagcttttttataaatataattgccaaatattcatattttttttccaaaaaatcgagatagtgctatcaaatatccaaaacataggaatggaaaaaagcaactcacagaaaaaatgcttattagataattctatttgtttaaaataaacacaattgacatagatatatatgtatatatgcgtaaatgtacagaaagtaaaattgaaaaacagcaccctgaaatcttaatagtgctttactttgtagaggataatgagaaagcagtaggaatggaggactcttttccatttcacaatacatttctatatgctattcatcttttacaataaaaatgcacttatgtgacttctacaactaaaggcattcagttatacaaattaaacaagaggagaaaacttttaaaaaacaaaaactcatttttttcactgtcagtcttaacattcattttatttgtcataatttgaggttttaatagttcttcatatgttgactacttattagtaaataaacaacttactatccaattttaaagattttctatttaagttagtacaataattcaatataaaataaaaaagtattaacaataaaataaagattgcaccccacaaatctggatgatgttgaagccatggtcctcattttcttcttctagatattcactctgctattacatagagtcaggccagattaacatatgatttgggaaatgtatgctctttttcccacattctggaattggaatttgtggtgacatattttgaacaattaatgctcctagaagatcctgttacaaacttagaacaaaataataaatgggttattacatctgtgtgtgtctaaagtttatttaggaaatcagaatcttaccaagaaaaaggcctcaaatcagcgcttcatgaccactaaagtataacaacctcccactctacattcactttgtatgaatacacttaaggcagcttctaataaaggatgcatatgttctgtgttattttggaacatatactgtctgttaggttgaaagagcttgtccatgaatcaataataacttggaatctggacatctctttggagattaatggatagctaagtagagctattcacaccagagaccactaacccccattggtccctgtccagtttgtagcagctgcagaaaaggaacactacgaaacacagaattacttttttggacgttattccaatgatcctcagcaagtgtcttttgcaaaaaatcaaaatggattaattttttaggccaggttcactatattctattcaattcagaaaatccataagtctaaatccggatagctgctattgaaatgttcatacactactcaggtctattcagggaactgggatagttctgatgcaacagtgctttaataagatacagattcttccataagggtcagtgataactccaatgttcagctgacaaaaataagtcaggcctaatttaccacatgagtcttgtcggcgctccttagagtttatcctgccaaatcaatgactattcctgtggcataaaccagatcattttctttttaaggtcttagtcattatttattaactcatctagtaaagtactcaccttgaaataatatagactttagatgcaaaccatttacatttattttttccccaaaaagggacttgtgatgaagtgaacagtatggcttcatggcttttactactatgacaaactagacagttttgtttggacaaataagaatgccaattttgtttggaaaatcaaacgagaatgctgtctaaaggttctaaccaaggagacaatccatccgtaaatgactgtcaaggtgagctagccctagaccaaacaaggaagaggttaacagctctaaatcccctctcctgtttaaattcttattacccttagggtatctaaatcaatgcaaccatgtgttgtactgagatataattccttgagataactgagataaaacaaccgagataactcattgatatagcagagtatttaccctaatgctccatgcagagaacacaggcgttagcagctgctgtacctaagcttcaaatggtttttccccagtttattagctgtatgagggtgcctaaattatgcaccctgcctaaaacttcagttttcctttatgcaaaataggaataacaacagtatctactctactaggtggttggggagatcaagtgagatcacggactcctgcctttacctctgctttatgacaacttctctccttgtctttcaatttatttattttctgcctttcccactttttccccccatattttcccctatttttcttttttaaaaaaaatccaggaacttgcgtcctgagagatatttttcttcttttgctttgattcactgtttttagatattctaaattggcaaatttatcccaattggagggataatcagtgagaaataaacaacatagtaacagaatattttgaaatttatgaaggttttgttttaatgtctccaagaatttactaatgacagtaaaataagcagattttgttcttatataagaatgaaatacatgtgttcatctcattactatgactacattcaatatttgagtgagaatacaattgttaaagttatttatgagatataatttacatacagcaaaaaattacccttataagtgggtaattatatgaatcttgacaaacacttacagtcagataaccaccaatacaatcaaggtataaataatttccaactctgttcacccttgcccctacaacccaggcatttagcaatcagcaattgttttctgtccctgtagttttgtgttttccagaataccataataatagaatgatatagcatgtagacttctgagttggtttcttgcccttagtgaaaaccatatgagattcagccatgttgttgcctgtattcgtattttgttcttcttactgttgaatacataaattgcatggatgtaccccagtctgtctatccactaagcaattgatgggaatttgggtggtttctaaaatttatcaattataaataaaaccactctaaacgttaggtacaggttttgatttctggtatggatgtagagaaaaggacttacgttttcacttgtctttgctaatatgtaggagtagcattgcttggtagtatgttagactttatcagaacctgtcaaatggtttaatggttttcccaaaacaactttatcatttctcattcacaccagcaatgcatgagatttttagttgcttgctctacatacttgccagtacttgatattgtcatttttttaaaaaattagccattctaataaaggtgttgtggtagctcattgtgactttaatttatgtttactaatgactaatgatgttgagcatcttttgccttccatatatcttctgtagggaactgtctgctaaaatattttgatcttttttacattgtgttcattaacttatcattgaattgtaagggtgtttgtgtatttaggataggcatgtattattcaatatcaatttgcaaacattttcttctatctcttgagttttccttttatttctcaaatgcacctttgaagcccagtgctaaaaaaatcaatttttaagaaggtaaaaacttacttaaattactacttcacattatttttccctttataaatgtcaatgaaatattatggtcatatgtttttcaaagcttttagctcattacacttttcttatctactttccaaaagagaagactatgcatagttaacagttcaagcgctcttttgaatttctttgccacatagcttattctctagggaagaaacacttacataaacatgttgctctgaagagtacagaggggaaccttagtgacacagtttttggttctgtcatcaggtgtagacatagactttagtttctcttctctcttctctccattcttaatacttttccagtttgggtttgggcctacattcatcctcgagtcctattaaacaggagtatgatttttgttctcccaactcaacaagacaacgtcttgctgagtttccttttctcccaggagctgtttcccagatccatggctcacatgctggccaaggagctgaagtgtcgtagtgctgcactaaaaaagctttcccaggtggagacctcgccatttctcaaatcttagccttcctctctgggataagtaacaacagacagagcaaagaataaaaggaaaacaagcactttgggagcatccaatagacctgggcctatgttctggatctgacattattcatttgtttatttactctttctttaatgtattcattcattcattcagcaaataactctttcagcatctgctctgtgtgccatgctaggaactaggaatacagtagtaaatgagacagacttagctttttccctcaaataaatggcaggtctgtcatttctttgttgtcctgaataagctgttaagcttttttgtgtttcctttgtctattctgaaatggagaaagcagttcttagctcacacatctaatgaatattataataagacaaaccaaaatatccacattttaaaaaataaggtggatgtgatgttctttgtggtcttccatacccccaattttctgcaaaggtgacctcctaaataaattatacctaaggtggaaaagaaagatccaactgcagtagtacctcatcaaaatggatgcttgtgatgatggagagctggttttagcaagaagcccaagccagccagctttctagtatataatcctgataatctactcaactatggtcctactgcaatagcttctgaataaatgctcaacagttcaggttgcctttccatatattttcactcctatactagtgctttgactagtctctatagttgtcattcacccatctatcctcattgtaagcacactttgcatttgtcaatgaggcctttgcacttgaaggagaaaaacatggaaaatagaaccagaaaatagtctgacatcatgtactaaatttccagaaaacagattatctaatatcttgggaacgcgattcaaggagcacgttcttctgagataaaaaacagcttttacaatacaagctattaaaaggcaacgatgcaatacaagctttttattgttaactccattctcataacttcagtttcaataaaagatcccattagaaatgcttccccatgtggcaactgctctggaatttccgccattattttctaagcattttatctatttatatcataaagctataaaagaaaggtctggatcaacagtgtgtacatatgaatcttttcgtctaaaagcctaagactcaatccgagaggggataatataaaactttagaagccacccagtttctgtccaatctgccatgaaataaattcagagacagaaagagagagagaagaataaacctggctgttttctattcataaaggtctcctccaaaagctagtcagttctaactagctaacagaactagcaataatgagtttatttagtataaattttgcatgtgttctcttttattccttaactagtaaagtagatatgagcattacccacattttatagaagacaaactgaggattatagaagttaaataaccttgtccaaggtcatacaggtagcaaacagcagaaaatatttgaatgtaaatattctaccctcaaaccttttattaaattatgcaagatagaactttgaaaggctaacaccctcatcattagcacacagtaggcatataatagaaattatcagctggtagatcagtgaatttgagggctccaaaataggtttagtgcttataaaaagcacagttctttgtagacagaacactacctattatgacaataagctgttggcaggacctgaaagaaatcagggagggccttttgaggattaagaaggtataatgaaaatcaggaagctggtttaatgagaaagaaatgcaatatactttgcctctccgattccttttgtatttggtgtactcatctaggagcaactccgtttgttttcttactgtcactctttttttcacatggcctggaaacgattcatgtttctttagtgatgcatggggagagaatagtttatgcagacaattataaaaaggatggattattggtagagactgatgggtcaatataacatatggtgttcaatgcaactacatatctttggaagttactgacaagtctataggtacagcaatataaagcagattttaccaagtgcataaatttgcagaatgactatattttttaatcaccaaaagctatggactaagccatctctagtgacttgtgaaataacgtatgcaagaaatctaaatacaaggacatacaaagagtagaataatcacaaatatatcaacagggaattatttgaagcatacatgtattaggagtaagttctattacacgagagaaaggtaaatgattgttataggagaaaacaattatatattgtctatgagagaaggtagtcattcaatatttatattggaagatatcattaatagacgataatctaagtctttcattttacaaaatgagaatggagaccgaaataatttatactgtatgcacatttatatagttagcctagggctagtctcagtgtgccatactgccccaaagatttttcgtgaactgaaaattatagtacttttttatttatcttctgttttaggttccctttgattctcagatatttttcttttatgtttctattaactcagccattcaccctttcccttctttagtcactgcctgacacttggttgcaatctacctttatacaattaattagggtgtaattctccaacttgctatgattctttttaattctcagactatcatccaaattctttgtcagccccactttaaaagttgcgaggacaccaacagctcatgctaaaatatttttcatttctggtaaaatgccatgtaagtggaatgctaataaaattttagattccgtataataaatataatccatatagcaggccatgttgctatccacagaaagcttctccacacactatttacataggattcttcactacaaaaatcacatggagaacatcctttccctattctttatctaagctattccttggtaagaggaaaggttgatgattatgctgaaaaggggaacccagagcactttgcaaatttatgttctttaaccggcatgtattttaaccttcaactactttctattttcctacattgactattctaattcatctttccagaacactcacttccattcccaaaatacacaccgacaaaacctaagattttagattttgtttaccatgttctctgtgccagacatggttctaaatcttccatatttatcattcaccacattctttcaagatagggattgtcattgtctctattcacagatgagaatactgagccttagagaagttaaataatccaatcagtcttatagagttgatcccaggtggtgtgatcttagagtctgtacaattaagtactaagtttcattaataaacaatctcacacacacacactctctctctctctaaatttaataacctccatcaaggctacatttccattatatctcaccttgcatttttcaaggaatacacttattaaaagaaaaaatacagacttaaatagggagataacttatcctcaagttttccaattatacttaatcacctagtcaaaagcattcagctttgcataagtccctatattatcacgacttttgttttgacaagagaagaacatagccagagaggcagaacagaatgtacatgccaaggatctaggtttatatctagtctaaagaaaacctcatcataatcagagaattgatttttaaacttcctcttccataaggagaatttctaatttaaatgcagttcactaccagagaatgcattagttctgtgtaatgcatccagaaaatgttcaataaatattaacagataattactaaagttatagataatataaattacacatgtagtacacacatctgagttttttaaaaagcataaattcaaaataggattttaaattatatacaagaacaacaactgcaaaattaacttcctgaaaggtacagcaagcacaggatacaaaataacctgaaccttacttagtaaacacatacaaacggtgatgcaattacactgtttttttaaaaaaaactattttcttcacaattcattctcaatatgattttcagttttaaatactaaaatcactgacgcttaaagtgtctgttctcagtttaagagaaatatagggtaataacattgaatataaaagatcattttagaaaagaaatacatattaatgtatttacactgaggcctaaattatcaaccaatatgttgcttattattaatttcagagagaactgcattgctttaggggctgagaaggggcctaaactgagacataatgaactgccaagctgaaaaggatgttagaggtcattaagttacgccttatagttttccagatgaggacactgagacacagagagtagttgggacaacccgaggtcaaaccacaaattagtggcagagaaaagacaggaactcagaggaccaaacgcagtggctcacacctgtaatcccagcactttgtgaggccgaggtgggtggatcacctaggtcaggagtttgagaccagcctgtccaacaggacaaaacaatacaaatatatctacacaacaaatacaaaaattatcctggtgtggcagtgcacacctgtagtcccaactactgtggagcctgaggcaggaaaatcgcatgaacctgggaggcagaggttgcagtgagccaagagtgtgccactgtactccagcctgggtgacagagctagactctgtcaaaaaaaaaaaaaaaaaaaagagctcagaggatcctagacctcagggtactgtatttgaagatgggacaatcttggaaggtgtcagtgaactttaaataaatagcaccccatctagtagtttctctttcagtcatggataaatgcaactggagacaagtcttggctttacgccgagcaaggcagctcagagattcacagcaataattcttgtgtgactaagcaaaggcctccactgctttaaatccctgcatgctttaatctccagctgtctttctggtgtactctctcagggtagggagggatcttaaagataataacttttagctttgtaaaaagttcagatgattttaatggctaagtatttacataggttatcattttcaaagtccaaatgttggtcaatgaggatattatggaggggaaaagtcttgcctacgtggaatatctatgactttgataatgaagagtgagcaggttctgcaaggagatatgttggaaaatactgagctcccatgactaaaattaagacaggaaataaatcaatctcagaatttctcaaaagatgttaaatgggcagtttgctggttttgggaagtgagaagggaggtggtaattattttaatccgtatttttgtggcacaatgccacaaaggtgtacgtatcatgcttaaagtatattcgcttgaatgagattatcatctcatatctgcttccaggaatagctcagatagaaactggtgctggggttaaggtaagaaatgatgggtttaccttcccttgtcaaacaagctttatcatttagagtaagcacaaggccagtttaaaccagcttaacttttacatgtatgtatgtatttatattttcatagaactacatatttatttctcacatatttaattagtgtcaaagacagcagtgataatagaaaggagccctggaatgaaacccagaaatcttgagttgacatcccagatctgcatgtacctggcttctgcccttcaccaagtcaataccttcaggattctagagctacaagacgaaaagcttagacttccaccagggaaacctccatattacataaatgggggagataagtaggttagacttattcaaatgcagaaaactagaaaattggctgagctaggactcagtcaacagccactctaacctccttctatatcatcttctactattgtagaagatggaaagttaaaaaccatctttcaccaattccctttacattaggattcttcacatggcgtaggtttcatcaaactcgtgaggggggagtaatcattccacagcccacatgagtgggctcacacagtggtggaatccctctttgttattgtttgacgccataggtttcacgtaaggagaaatatgagtcaatgacaatttttacttttttttcaatggatcctggagtttaaaaaactgcaagaaggcactggaattaaatgattaagtttgggtccaggcacagtggctcatgcctgtgatccaagcactttgggaggctgagctggaggctaccagtgtgtaatcaatccacattatatttaaggaagtgtgtttattatgtcttggccttcagaagtattgctccacttgagcccaggagtttgagaccagcctgggcaacacggcaaaaccccatctctacaaaaaatagaaaaattagccaagtgcagtggtatgcacctgtagtcccagctgccattgcactccagcctgggcaacagagtaagaccatatttgaaaacaaacaaacaaacaaaaaaagatactctgcatagaaattaatcacaatttctttaaatatgcaggtttttaaaattttttgattaaaattttccaaaggaaatagctccaacttttaaatatttgaaggggaaaacattttattttatttattttatagacaggctctcactctgtgccctaggctggagtgcagtggcatgatcatacagcatggtaatctgaaattcctgggctcaagccatcctcctgcctcagcttcctgagtagctatgactacaggtgcacactaccacacccaggtaattaaaaaaaaaaattatctggagacggtttttgctatgttgcccagctggtctggaactctgggccttaagcaatcctcccgcctccacttcccaaaatgctgggattacaagagtgagccatcacatcagccacattttcatttagacaatttaatttggaacaattggagcaatgcttctgaaggccaacacataataaacactcttccttaaatataatgtggattgatgatacactggtaggtatttatattttgaagtgccatgatgagttccgaatgtttagataagaaataaaaagggaggactagaggaagtgtaccctccagagaagccaaatttagtctgggaaatagaaatagggtcaatgtcaacagcagcaagatgacgacagaccaatggctgtttacaccagagtctttccaggttttctgacaagttttgtgttacttcatatcttccttatttaatcctggccattaactacaatacagtactaacattttaactcagctatacaaacccaaaacttcaataagtttatcagagacaatactgatatgttaaaaaaattactcacaaaacacatgcatacagaatatagtaatatcacatattttgcaactgtgtccacaattaagacctcctgtactaagtagaatgtcactgcatatagggtattgaaatacagaagccatttcttgtgtagcacccaaggaaagtctttcacattcaaactgccttttacattaatggaagtgccaaaatgatttgcatttgtatattcgcaaatcatattgttttaatatttcaaagaacggatcacactcaccccttatcctatttgattctattaggtcttcaaaaaggaactttgggtggacacaacatacagaaatcctattaagcatatgatttcatgaaggtatgcatgtagagtgtttagaatatgacacatatttaaatgctccattaaaaaactattaatgttaggattagaatataaatctacagtaaaatggtattgatgacagaaacattttaatcttttgtcagtcaattattgatatttcaaagtattttataaattttggtacaacacatacacccaccacaataatgtgaatcctttcaaattcttgttttgcacatatagtacagtataaacttgataaatgttttttaaaattaatatagaaatggatgaatgagattcaattagcccaatgtcagatacagttgttgaaatacattaagtattcaacaagtggatacaaaaatatgtttgaactgccaattatagcaaggtctctgtgtcaaattaaaactaaaactaagatacttcgtatcttgttaaagactggcttaatttttgtcacatggtatacttccaagtgcttttacctgaagaagactaagcatttctccagcatgcctgtccataactagtatttatcctctatgcaatttgttaacatggtacctaagagttgacaaagaaaagcagatacctctttagctagataattcattaatccatgttattttatcattttgtggcccactgtagtgactctcacttatccatttatttgttcaataaatatttcctaagttcctattatgcactgtacaaggtggatactccacagtatgcttaacaggtatggcccctcctttctccaagcttagtttagaaaggcaaataatcaggaatgaaggtgtttatatggggctgaaagattagggaggagtaaaagggaaaaggagcaacacttcttgcacatcttctatgtgacaagcacaattccaggtactcccccatagttcctcttttcagggaattgttgctgacatgtgatgtctcccccaggcacccagctttaaaatttctctcttttgtactctgtccctttatttctcagaccagctgacacttagggaaaatagaaaagaacctacgtgaaatatcgggggtgaatttcgactgatagggaatgacctctccagccacccagtaactcaggtcaaacattttggagccatctctgactcttttcttccatttccactctatggtaaaaccatcattaaatcctgccagctttgcattcaaagtatgtgctaacattaaccagttttcccatttcctccactaccaccctagtccatcatcacatctggtcatacaaaggttactctactgcctctcttgtgcatctgtaagctattctctctatgacgaatgaaacagaatcatattcctatttttcagatacttttcaaatacaaatgattttctgttgaatttagaataaaataggaagttcatgttgtggtctgtcaagttctataaaatctggccttcaattaccgtgcccatctatctctcaatctctgctttgctcagtgtgttcaactactccaggctcccactggggttttcaagcacacctccacttcaggcctgtttcactcacatggagtattctcgctcagagctgcatgtttctttgttgtgtttgctcaaatgtcagcttctcagaagactgaatgtgttcaccctcgctgaaatagtaaccgcccttatccattctctatgtccttatcctgcttaaattttctttatagagcttgccattttctgaacatcaattacattatacataacactcctattgatttctttattatctgccttcccacctgaatatatccatacaaacagggcttccactatacaaggctctatcctcagcacctataacagtactaaccatgtagcaaaatccaagaacacattttttgaaataatggattatttcatttgattcttatatgaaattgctaatattattactattaccaaaaaaaacaggtaaaaaataatgaaacaatttttggaaagagataaaataatttaggaaacagggctcatgattgaggattagatgactagcagaggatttaaaaagtgaagaagtagaaataacagagacagatgttttgattttttttaatttctcaatttctttaattttaatattacaaatgaaatattttggggaacaatataccttaattccgtaaattaatattttaaaattaataatctgctttgttaatttccaataaaaattaaaacctatacatgaagatcatttacaaaagatgagaaatgacacagaaaatatagagtgaacactacttaactactcctccacttttctgtttccatgtcagacacatgcctggtttctgacccttgtcagaccaggaacaaattataatttgaaagtagggcataaagcgctggagttgagacttgtaaggatgtaagagcttacaacaaaagaacataggaaagtgtggtgaaggctaaagagaattagaatgcctttccccatttggtgaatgaatagatttttgtgttttgttttagcatatcttcaggcctgaatggaatgctttgtgtagtaaacacagtaaagctcaaatcgagtttactgcctccatatggttccaaccacatacgtacaatggtagattcatggggttggggggggggggcgtttgtcaggggaggacaagtcattttcctagaaaaggcaattgtgtttctagaattttattaagcaagagttcaaaagcaagccagagcaaaaaatcgtactcagaacatcagtttgttggtgcctttccaaaacagcaatttgataaaagtgcatctgcaagtcttttatctgcaaagttaatttcattattgcactatactgtacttaaaaaaaagatccacacatttattaaaattgtaataaatgaatcacttaggctttgatctcctacaccagttttactgagctcccctaaagggagatcaattaagcatacatttttccaccttttaaaataatactctcagacagagcatttgaatttcattttattaaaatgtaggcacagtaaacattataaaaaataaaattcccacaattcacgctattttaaaaaatatcagcaactgtctcatttcattcttgataggaaaaataaaattttagtttgatgatggggttcaggatataatatccccaaatataacagtttggcatgctgaaaactgcagaagcaggaaggtcactctcatcctcttctgcctttcactcctgaagcacatcacaaaacataggaaagattttctgaccttctcctgaagcaggtcataagatattcaggtgaaagataccctccctatattgggaggaaaggaacatccttgtctctgaagaagggtcacacagaagaatctaaacaaacaccctgataagtttccctaatttattacaattaaatcataccaaatttgtccattcatacttttgtacaactgtccactcttcatcaaacctagcacaaaatacacaggtttaactattttttcaggtcttcacttccttacaaaggcctccatgtcaagtaaaacgtatatgaaataccttgtatgcttttctcttgtttattagctattttgttataggaacttcaaccatgaacccagaatgggtgagggaaaggtatttttcccctcctataaagatatttcctaagtgttctctgacacaatacactaaaaactactttatgacacaaccagaagcactaataaaatgttgtgtttctaggaaagtgctctcttcatcaaatgacatgctttcgtagaaaacagaatcttattcaatattgtgagagttttgatttatttgctatagtgtaccattgcttctgtgttccaaaacacaaaacgattcatataataatgaatttgttaaaatgactttccgtaagaaacacacatttattttccagtgcatataaagagcttagttatgagtctgaaagtatcctctatgtacctaggaaggaagttcccccatcaggacaggcaagggaaaaaattctctgtaaatataaccgaatgaaaacaaaaggagacacatcatcagaaatattacatcatacatgcaagatgacaaaatacaatttttgaagtgttattttctttgctacttaaaaatggaatgacggaaattatatggtggctgtgttcttgtcctggctatgaaactaatagggtgactttttcaaactgttttctttctctgttcatctctaataagaagtggctgcagtagatactctttaagatttcttctaactctaaaattctatggattaagtaatttaaacattttcaaaggtattttcatttcttcatatattcttcctgagcttatgacaaattaattctatgttcaagcatttatggacagactcttccaactgaaagaactggtgaatttaatgatcttgaaaaaggaggagaaataggaggaaacacttaacttattactatccaagaatatcctaaaattctactcatttgagcatcttctatgcagccctcataaggtaacaaaaacaaataagcatagaaagtcttggaggaactactgattcctaaataataatgatttatcaaagtaaaattattgttatcaaccagtggaccagttaggggcaccaataaagtaatgagagatttctaactgaaatacattcacttatttaccctgtagcataataaaaacgaacgtaaggaatatacaacattgagagcattgtttcaggtcattttcacatacgattctaattactaaatattccaggatgagaagaaatgactagagataaattatggtgcctattaaaccttttattgaaacctcctttccaaaaattaatatcacatttaatcatcaaaatatcctatctaaaaatttgatttatttagttgtagtctacttccacatggaatttggagtaactgtgtaagacatgaaagaaattctaattgaaaaaaggcagactgggcaaaagataatcagataaactagatgcactacatgtatgtagcttatttgcctctgactcctggtacatatgacaatatatcctgcttgtacacacaatagtaacatatttctgccacaaggaaggacaaagaaggaagcaaaggagagggggaggaaggaaaagttgactaattgcattttaaactgttaccaaacaagaagtgagttacagaaatgaatcaccactactctgaagtttcagcttgtgaataaagttgccctggctgatactgattattttctacttaccattttaactgtcatctttttagcacattaaggctctcttttcatagacctgcagaaaaccggttttactaatccctttcctcccagaatgccttcgctctttatcctggatgtaccctcacttcctgttttttgttattgttgttgttgtttgcttgtgtggtggtgggggaaaaaaaaaaaaacttagaagacattgaaccatatatccaggtttccggaggtgaactaacaaccccaagtttggggtctagccaaccctttcacagatgctggacagatactaagcaaactactgctcacacacctgccatgaataaaattttaaattcatgacaaagggcaacctgaataaacagattctgggtgagaaaataaagaaaatgtgcagagcctaaaacagttatagcagccaatacataaagtatttgctttcagtaagtgccatttctgtttttggttacttctcattcccttatttctcccttttgacaatattttgtttggataagtcatcagcctagctgaaattttattacacagaaaaaaatgaataattaaaaagttatgaccatttcagaaaactaggctttatggaagtaactttaaagtacgtggttttataaataagcatttgtaggaggctgagacaggagaatcgcttgaacctgggaggcagaggatgcagtgagccgagatcatgtcactacagtcctgcctggacgacacaccaagactccgtctcaaaaataaataaataaacaaataaacaaacatttgctcaaaagggactcgggggtatgattctggtattttccctctcacctataaatgttatgcaaatgtattatttttcaaggaggggaatgcccagtactgggagaccacttctccatctagaggagaattttcttgtgccaaggttactgctaagtttgaaatagaaagaaaagtgtgcttagtaagcactgaaatagatcaaaggaatgaaaaaagtcctaagaaatattaattttagactatagtaaaacttaatgaatgaaccttaccgcataagatggaacatactggatagtcactataatatgcatgcctatatctacatacatatctactacatatagatacacacctgtatctagctattttttaaaatagtcacatttttcttgtgatttctttgtttctgcaactcttgatttcctctgattactcttttaactggatctataacctacatctttctctggatattcctctggtaactctccctcttttattcctcatcttctttattccaagttgacaattagtttacctttaccctgattactcagttataatgcctattcttacttcccaagaaaaaaatctacacatttttaaactcatttttgaattgacatataataattgcaaatacttatgagatatatactgatatttctatatgttttatgtacaatgatgagctcaatgtgatcagcatatccatcagttcaaaccttatcatttctttgtgctgggaacattcagtattacacacagaaaagctatccttcaaaaatgaaaaagaaataaaatatttaacagataagcaagaaataaggggattcatcaccatgagaatggccttgcaagaaatgtttaagaaagtctcacatatggaagtgaaaagacaataattaccaacatgaaaacatgcaagactataaaactcactggtagtgtcaatacacaaaggagaaagaaaaaggaataaaatcttatcactatagagaatcacccaattgcaaaaataaaccataagagaggaagtaaagaacaaaggaaatacaaaataaccataaaacaatcagtaaaattacaggaataaatctccacctatcagtagtaaccttcaatctaaatggatttaattcccccttgaaaagatacagactggctgagtggattaaaacaaaaatgacccaaatatatgttgcctacaagaaacccatcttatctgcaaatacacacatagactgaaagtgaagagaagacaaaagatatttcaggcaaataaaaaccaaaagcaagcaggggcagtcatacttacatcagacaaaacagactttaggtcaaaagctgtaaaaagagacaaatctacattttttcttggatttctcggtatgatagaagctagcaatcttcaaaacgtgtataaatctattgccagtcattgacatttcttataagaacctgtgtagttgtctcacgtgggtccgcagctatttatttccaatttcctttccatttaagacctacctatgcagccataaaaaatgatgagttcatgtcctttgtagggacatggatgaagctggaaaccatcattctcagtaaactatcgcaaggacaaaaaaccaaacacagcatgttctcactcataggtgggaattgaacaatgagaacacatggacacaggaaggggaacatcacataccggggactgttgtggggtgggggaaggggggagggatagcattaggatatatacctaatgctaaatgacaagttaatgggtgcagcacaccaacgtggcacatgtatgtatatgtaacaaacctgcacgttgtgcacatgtaccctaaaacttaaagtataataataaaatttaaaaaaaaagacctaccatttgagcaactatagtcttataataaccttctgttactctctatttttctaagtacaccacatactcaaaaggtaagctccttgccccttaatatagttacaaggtttacaaagcttagtttccagcctgtttaaccacttttcaacatcttgcctctgtgcactacaaattctaagttatttgtagttcttcaaatgagtaagtgtctttttgcttgctctaccctcttctccctatgttcccttagctctaattcctattcatattcaagtttcgccttagctgtcttatcctctaggaagcctcctctacctcccaaatctgagttgcttgtgccctatcattactgttcatcactctgtatcgtggctgaccttctaaatgtctatattcacctataatctatgaacaccaatagagcagtgacctgcctatctgatgacaaacataaccccagtgcctaagctcaatgactttacgtattacttaaaagtcataaatgttaaacatttttctctagtgcataaattacaacattagatactataatgagctataactcttcgtctctttttatttcaaaattctattttgtaacaaattactttgtttccatatgcaattggacatgtttttcagataattatcagaagattaatgagcattttctgaaccatttctgaaatacagaaagggtattcaaaaaaaattattgtccaaagaaaaattgatacaatacttatttggaagtcctgaaatctaagagggttaaaaatatgtgtgcctatgacaatttctgaattatttacaaaattttggtgatacaatatagaaactatttacatactttccttatgagttacttatgaaaacaatgttaacataagttactcgaagtgttaggggtttaggaaaattgtgcataataagcacataaccattatacacatcaaaacgtacttttaccttttgtgtgtgtgtgttttatatattatttttctatttttaaatgaagcagatttgagaaattattgattggatagtttttgataaaggataaaagagttagacaggttaaatacacatttttatgggatgcacttttacatgaatgtttctttcttaaactgagtaaatcctgagataaaatattatcaccaaagatatttagctaaattgtggacaaatacatagagtaacagtctgtagacaacagcaaataattatctggaatattcccttcatttcaaaagttttcatcttaggtatattgtttgaatattttattatcaaaaagccaaaatatgatgaaaaagtcataaagtgataaaatcctaagaaaggaaataacagtggaaagaaaaattaatcttgcacagaatagaaggaaaataaataaacgagaagcacacaaataatcaaataaagaaaataatagtagaaaacaataaacctgttttgtatgctgagatttgcctacagtcttcctataaaattctggaaactatatctagaggttgctctttgattgttgctggcaatgtatcatttggttgggaaatacattcacacataaataaaagagatcagttataaagaaaaatacaaatgtcaaatcaattaaacccaagcagtgctccaaatcaaacaaagaagagagtcagagagtagctcaaatgctattatactatctaaaaagaaggggtttacttttgatcctttgtgtatatgactccatagaacctgcctgagctattctgaagctgtgagtggcgatggtgaaggcagatgagaaagcatgacgtgtagagacaaataaagcttgggttcaaattttctccttgctatttagatttttccaggaatttgttttcctaaatacaaaatgaaaataattaaatttggtttgtgtttttgagaattaagtgagataataatcacaaagttgatcactgcagggtatggcatacaatcattacacatcaattcctttcctctcttgcccattactatctatacagggcatcttgaaaacgtatttattaattgtatttcttataatacatcattttaattgtgtataaaatatactcaaagatactaaaagcatcaatataataatttcctaacataacattttagctctttgtaaatatatataaatataaatttataatttacaaattaatagccacaaatgttttcttggaatgtttttataaaacttgtagtcatatacttctattttttatagactgcttttaatttcgtgataatattaaggttatttggtaggacaaatcacatttttttttagttttaggcaattttttcttaaactggaaaaatctgagacatacagtaaatgaaacaaaaatctgagctgtagagtcaatgaaaacaaagtataactaatttgtggaaaggcaaaaattagaacccagcaatgtactattctactaaatatctttagtttccacataaatcatgagttggcatataacatggatagtctgaataaactcttgttacttaactccaatattgccctaatttcaaggagctgatccagaagaggaagatctgagttgggacttcagaccaatggcaagattcaagcctttcatctccatgctttctgcatttctctatagatattcagttgtgaaacacctggagtttatgtgtagttggctcacaccagctgcatttttgaagaaggggtaaaataagcattttgggttagatatgaaaaattttatgcaacaaatgcatatttggaaactgcaaaatgagcatgcaaatcaatttatatgcatcgatgaatgaatatagacgggctattttcaaagtataggcattctagtgtagcataatatatcgggacaaaaggaatgggaaggaggcaaattgctcagcttagtcatccatttgcaatggaaaattgcattgtcaagttccattatgcctgcacaaatttagacaaattaaagagtctactaagtaattattgataacatacatgtgtatgaagtagagcaggaaagttgtgagtcatttggaacttctcagatgtttctaggattttcattagcgaaaggaggcattgaaagaatgataatataccttactatgaaaccaatttgagacacaacactggcctattcagccatatctcttctatggtgacagagatggataacaaccggaaaaagtgtaaataaaacattaacacaaatcactctgctgaggagaaacgttacatctggttctggaccctgcatcttgttaggatcccttcattcattacttcattaccaggagaattattcaatctgacacacgagaccaagttaaaaaaaaaatccttagaattatacaaactttaaatcctatatttctctcttttacagtgtgtgttcagaatatattctgcaaggttactgtggtattctcttctgacaatataaacattctactacgtttaagacagaatgttcaaccaaggataacataaatccctggaaagtcatataatgggtctcatcttctgaaatggactattggtttgacatttcaaacatctcatagataatccctcaagatggagagtcaccaacttcctttgataatctgctcttgcacttataaatatttatccttcaacaatttaaatatgttttttctttaccctcttcactgaaaacagcaaaacacctggtctttacaggttatgtgcctttttatacataaataagtatataaattctattttgcatatatgtgtatgtatttgacatttatttatactcgctaaacgtatttttaacaaacttccataccagttcacaaaacacacctcattcatgttatattgtgagtcattatacacagctctaccataatttatttaatcaaatccatgttaataaacatttggatttgactccatttacttgttttcactattacagacaacatgcaatgagtaccagtgctaatatatttgtgaggcttgttcaggtatttctgtttaaaaccaaagttcctagagatgaaactgttaaaggaaatacacatttacattttcatagttactgttaaactgcctctcaaaagaactataataatacacactccatccaaagatgcacaagagcataagagtgtctacgttgccacacctttcggccaaaactgggtatgatggtcttttctgtgctttttttttttttggtcttgctttgccacccaggctagaggacagtggcacaatcacagttcactgcaacctctaactcccagcctcaagcaatctacctcagcctcaaaaatagcaggaactacaggtgtatgccacaacatctggctaatttttaaaaatgtttttgtatcgcgctttttgcctgggctggtctcaaactcctggcctcaaacaattctctcacttcagcctcccaaagtgctgagattacaggaatgagccaccctgcccagcctgatggcgctttttaatattttcaacaagctaaacaataaatcatatacttcattttaattcacgtctttacttattattgaggtcaagcttctttttatacatttactagctatttgatattctcttttaagaaattgcctacttgttttgtttgaccattaccgacaatattctcttcttaatatcttgcagtgagacccactaacgtttattgaactcctacagtgggccagactctggtagctcttacgtatataaaaggtgtaagtgctcccctggggacttagaatcaagtgaagaaatcagatgggatgataaattactataataaaatgtgttcagcataagaataagggtctacacaaagccagcattgtccctgctggagaaccaggggtgagcaggaagagggtatcagggatgatttcacagagaaggagaccttacagatgggttttaaatgatgggtgaaatttcactcagtagagattcaatggaaggcactaggtccagagagagtaacactagaaagaaccccaagacatgtgaacacaattattattcagaatataaataatgactggcttagatcacaaagtttctgttgaaagaaaatggtaagaaatgagtctggataaggagaccaatttatatacaagtgcttgcctgccattcttgagaatctgtattttatctttcagccaaaggagcagtactatttataaaggatcactccagtagtagagacaaatggctttgaaaggggacaaaaggagcaatgcctgagattgggaaagtggtaagtagactatagcagcaatcctgatgagggagtatgagagcctaaaatagcataatatcaatagaatcaagagaacttggtcacagaaagcatgtgattaatcctttcatctttctacaactagtcacactggatattcatctctgtggcagcatttattgcattgtaatgaaatcatgcatgttgtctaccagcccaccccactaaaatgtgacgctttccaactcttagacctgtagttgaccaaaacgttgtttcaccaaaaaataaactttcaggtttcctcactttccttgtgttcacattttatgctgcaacaaactcagtatttattaatctaaagtctttttttaaaaaaacttagcctctataacattctaatgccttagtgcaaactgttttattttgatatggaagaatccagtgattacagtaatttgaaatgatggtgacttaattaagagtgtgaagcaatccattaactataatttgtaaaaggagccatatgtttttcactcttttaggtataccattggacttgcattttcaaaaagtaaacctgctaatttttgcttcaactgaggatatcattaacaatatcaccagtagcacacatgtgtaccttattacagatcttcatatactataattaatagtgagttttattcgtatttggatgcctgaattgtttagacttgtatttaggtttcaagccctttatttgtgctgtcaaacgtttagtcctcaagggcttgagagcacagaggtgaacactgcctaagacctaacatctcacctcctcctgtgtgatggcttcttaatatgtggttcaggaattatgaatggagaaaaacaacagaggggtcaaagatgaggctagatttctggtttgtgtaactggctttcctgggaaaccaaaaacatgacagaatacccagaaatgcatgtttttcattttgtgagtactataattttttttctctggtttttgttttctttgttttgtttttaacccaaaactatttttctgccctctaatctcatcctcctccaggaacaattcataccagtactaccaaagaccctttcacccaaagctgtatttcacagaggaagaacaattacataggatataaacggactgagatgtaagagacaccactcgaatattctgtggttatgcagcagggcaagaacatcacacctggtggaggtagagtcagtactgggaggataccctggagatggcaaagcaaacaagaggaagtgcaaggtgagtctgcaatacaggcagcggctgtaactcgagctcaaccagctcaacaacgtttaaggaaacatgaaactggggcaatccactgtgtaaagaggacaagggcagctggctcagggcaaacataagcatgtgggtggagagcctgcccagagtgtattccagggacaccaatgtgcaacaacagcaagtcaagtcactgggggaagtaattcatgggccaagtgttctgtaacagttggtgacatattttatgcaaatgtatctgtgaattataacttcagacactcttgaaatagagttgttttttttttttggcagaaattaggttttgtagggggaggggagagtatttgttttgggctttttccaactcaggacttgggagatttgcacgttaaaaggctttcagaaaagtccaattatttacataactacagaactgaaaatatatttcaaatgttacttagtccaggctgctgaccagaaaaagaggaaccttaagcaatttaaaactagcagttgtctatttaagctactaaggatctctagtgatacagattcacccaccacttctgctgacctgttctcacatttatactagaattacaagtgaatgctgttttctctttccttcggcctaaaccagcacaattttgttcaaatccatttccattgtttagtcctctgtggaccagactaccactgccagttttccttagtccaaattcttttttctgtttgtcagctcatatttttctgtcctacttttcctgcttacaaatgcaatgctatcaagatttttccctttatacaattctggactgcctgatctacagacactagtgagagacattttttaagccactagataacaaaaacctatcaagaattttatgaagttcttgtccatgcaatttccaaggcatgatgggaaattagcaagtcagacaaaggcaacagggaaggtgagggggtcactgaaagtgcagtgatgctgctgctgggatgaacagaccaggatgactgtaacacatttttggaactagcctttggaagagcattagccagctgaagtgatagtgggtaaaataaacagagcgggggctattagaggaaggaggctgaatgtcagaccagttgcaaagaacgaggattggaacatttttagctcagtgaagacagcactctttctcttaggcagataaagataattgaagaggatgctaaccatatggattttatttccactgaagacataaaaaaattaatttatgtcagcagagaaaggatattcattaaacttaagggagaaattttctgctcaggaaaagttattaaacagttaaatggaattttgaaaaagagaaaaaatatgacattgcattagcttatacagacttctttgaaacacaggagagattatcctatgtgaaagggtgtggaggatatacagttagttattattttataaataaaaaagaaggaattacaagtgaagagtctggcctcaggatttacgcagctatgattcaaatgtcaggtttgtgaatttctagtgcgtgaattggggaaaattttaaaaatctttctgggccttaattttctcacctatcaaatgagaaaaaagtcacctactttttagggttgtagagtagaccaaatgaattaatagcacaaagagctgaaaatagtgcctgacacactgtgagagccatttaagattttgctattgttgttgatgttgtcagttggcaggaaaaattccaatgatacactgccagaaatgacagctagagacaaagaatgattatattttctgtaggttaaatgtagacaattacgtatttattcttgtcttttccttcctatttccctttttggcttaagcccagagccagaagtcaagcaatgtatgttcctgtcctgtcttctactaaccagatgtgtgattttttaaattttaaaccaacagttctcaatgtcctcattgtttcaaattctgttaactcttctctgtgtctgtctgtctctctctctcaatttactttaatcacaaatactctttttctctcccatcatcttttctcctatctcctgttcctctcttctggtcttctgtctcattttctaaattatcaaacagctcaagcttcccagcttccctgaggcttgagcatctttccatcctccacctcctatgggcagaagacactcagaattgtgtatttggctccagttcaaattgttattgtctctgtttaggatacaaataaggattttgtccaggatggataatgtcttgggtcgaggagaaggaaggtgcccatcattcttctttattgccaagaacctctgggaacatgaacagctcccagctaacagcaggagaggagcaccattcccagaagatttattctaactcctgaagctctacctatgtctgtacttttatgaaggaaatcaatatatagagtcatagaataacaatggataaacttcaagtgaaaaaaaaatatttaaatatcatttgaagtcaaaaaatacattgtgatagaagaaagacatattttaatccaaccatttttaacttaaataaagggtgaacaggacagaggaaaagaaaatgaatgtctaatatattataaaatatatgtaatgatattaactgaaaaatggagcacgtttttaaacttacaagttaccatttgaaaaaaactactttaaatttcatatggaaccaaaacagagcccgtacagccaagaaaatcccaagcaaaaagaacaaagctggaggcatcaagctacctgacttcaaactatactacaaagctacagtaaacaaaacagcatggtactggtaccaaaacagatatatagaccaatggaacagaacagagacctcagaaataatgccacacatctacaaccatctgatctttgacaaacctgacaaaaacaagcaatggggaaaggattccctatttaataaaccataaagatccttgaagaaaacctagacaatatcattcaggacacagacatgggcaaagatttcatgactaaaacaccaaaagcaatggcaacaaaagccaaaattgacatatggggtctaattaaactaaagaggttctgcacagcaaaacaaactaccatcagagtgacaggcaacctgcagaatgggagaaaatttttgaaatctatccatctgacaaagggctaatatccagaatctataaggaacttaaacaaacttacaagaacaaaacaaccccatcaagaagtgagtgaaggatatgaacagacacttttcaaaagaagacatatatgtagccaacaaatatgtgaaaaatagctcatcatcactggtcattagagaaatgcaaatcaaaaccacaatgagataccatgtcatagcagttagaatgacgatcattaaaaagtcaggaaacaacagatgctggagaggatgtggagaaaaagaaacgcttttacacctttggtgggagtttaaattagttcagccattgtagaagacagtgtggtgatttctcaaggatctagaaacagaggtaccatttgacccagcaatctcattactgggtatatacccaaaggattataaatcattctactataaagacacatgcacatatatgtttattgcagcactatgcacaattgcaaagacttgaaaccaacccaaatgcccatcaatgatagactggataaagaaaatgtggcacatatataccatggaatactatgcagtcataaaaaaggatgagttcatgtcctttgcagggacatggatgaagctggaaaccattgttctcagcaaaataacacaggaacagaaaaccaagccctgcatgatctcactaataattgggagttaaataataagaacacatggacacagggaggggaacagcacacactggggcctgtcagggggtgggggtctaggggagggatatcattaggagaaatacctaatatagatgacggattgataggtgcagcaaaccaccatggcacgtgtatacctatataacaaacctacgtgctctgcccgtgtatcccggaacttaaagtataatttaaaaaaataaataaatatcaaaagcaaatatgtgtataggttccctaacttttctgataaaagaggtttctgggattctttttttttttttcttttaagagatagggtcttgctcggttgctcaggctggagtgcagtggcacaataatagcccactgcctcctagaactcctgggatcaagcaatcttcacacctcagcctcctgactagctgggactacaatacacgtatggccaccacatctggcttttttttttttttttttttttttttttttttttttagaaatgaggtctcgcttttttgtcccgcctggtctggtactcttggactcaagtgactctatttgtactcccaaagcactgggattaccttatttcctagaaagttggcagaactttttaaatagacattcataaatgtatactcttacacatttcactgtgcttttgagtagtgaaatacaatatgtaacttcctatatttagaatgttttcaattcagtaaattaaacatttaacatttgtagcatcacgtataattttaaataaataattacattatttgctggaaaataaatcaatttttcaccaaagttaaagagcttaagctgtatagtggtttcttccatacaacaactatagtcatatgctgccatgccagctatttccctaaggagagcccaggcatgcttaattatagaggaacaccattacttagaagaaaaaacatgagtctttaatttccttgtctccgctggacggggctgtggattctgctgaatctagcaatgtctgagtaacacttaagcctagctgtttccatatacgggccaggtgttgcgaggtcccaaacaacagtacctcctaagctctcatcagttgtgtttccatcatggattagaacccacacagaattcattatgtctataattaaatgaagaaagcccttctgatgtcaggatattagtgaagcaactgttcgtcttggcagctccgcttttaacttttggattgccagatccctcctgggaaccaacctaagaaagcactatttgatgtagcagttgttcctgcagtgtggtgtcagtgcatttctaattacagtccagacagttttgagcgtgagtaactagacaagaggccaggtcagcactttggcttgccaggtcagacttattttcctcccacttctttccaataatagtttctcatatatacctgaaatagtacagggcattcatctttccaactctaagaaccactcctaagttcaatttcaagctatgtgttgggaagccaaacacgcttagccaaaaagaggcactatcttctcattacgacatttcaattaagtgcccactgtaccatcatctagattttcagcagaaccatactctaactcagcaactctcattatttatgtgactgagctagttctttatatttgtgctgactcaccacagaggttgatattttcaataattttatcatccaaactctgaaagagatgaaaactttgtgttgcttgttttccaaaataataagtttttcatcaaaaggacaaaaatttgttgtaatattatttagttgcaatattttggggctttactgctggttatgatagagtagaatcaacccatcaagtagaatatgaaaagaaggttaacaaaggaagcaaataaacaagcgttatgaaaacaaagagtgatgaattctgacaagctattccattttctttattatcatgacagtaggaagcagcactaaatgtaagagtctgccacaaccctcaaatctgaatgctttattataagtcagccatttaaaatagtaccaacctgaaaactagtgaacaaacagcccagcatccctttgataagcgaaatatacaagttgtgtcatacaatggacagggctgcctgctaaggtattgggcatacttggacccaaatcccagctctgccatttacgagctactgaacttttagcaagtgatctcttctaactcacagttttctcactgataaaatcgatattttataaaattatcaagtaggactatggtaagactatataagataaggtagacaaagtacactgcataatgcctttcactcgaaaaacactaaatagtaattttaataaaaactactgtgatttttaacagaatgattttaaattattctcaacttcaagaggtgcttatgaccttacctttaaggagaggcatctagtccattttctgaaataacttaatgtataatattttgggggaaaatcatgtatatttgcagatttagaaaatactatgagagttatggttgaactacctggtaatgccttttccaatatccaattactcattcaagtatttactgaactcttacaaaatactcatcattcaattacttaacaattccagcagttgagttgttctaattggaaaacttacattgcctgattgtgttggtaggatttgtgctccgtggatgcaagtgtaaaataagaacctatgttttatttctaaacattataaagaacataaaagtggaaaatgattcaaattcaaacactgtatacagtgtttaaaacagagtactttctctgcttacttttaaaattattcataaataggtctgctctctggaatactccttggatatatgttacaaatatttgacttttatactcaacatttttcaatatagatttccattaaggattactttgtaactaagcttttttgtatattcagtgcattggtattcactgaacagcatttctgttttaatttgaaaggtttttttttttaagttgagggagagtttacatacagtaaagcatatacattttacgtatatagttcagtgaatctttacaaatgtaaccaccacccatatcatgcccaatgctccattgttttgtcctcttctagtcaagaccactaaaaggtacctttatcccaacctctatcatcatagattagttgtatctgttttaaacttcatataaacagaattatatcgtatgcactcatataattgctgccttaaagcacttattttatttgtttaaattttacccaagcggaataagggaaacaatgtcctctttacttagcttgtcataaaatccatattttaaagcataataataagagaactctaccaaatctgatgcatacttctgggcataaatgatctaaaatacatttaaaatgaccccaaagtagatgtaaagaaatatgattcacatttttataatactattagcattcacaacgtcctacagcaatctacctgctaccatttaatatctcccacaaatttttaagctttgaaagagtgtgtatctattatctactcgcaaacaatctgtgaagtaggctggcattagttcacaatatattagtagtctgattaggtggtttcccaattcgcaaccttagaaaatgaaacagaacattgatggtgttattttacttttaacatatattaagatgtaaagtcccacctggaatttagttcttcagattccaaaccatgttctgtttacacacaaaatacaaataatcatgtggcaagaaaggaatctgagagagcatggtactcattccagtattcaagtagaactacatggaatccatgctcaggagaaaaaacaaaaagccttgcaattttctgaacagctctaaagcaactggccaaaattttgttttccaaagctaattagaacattttaagatttacgtattcagcaaaggccgtgtaaatttacctattcctatacttatgaataatgaataaaagaaaaggaactgggccacaaaattatagagaagtacacaacaaaaaaagtataagatttttgcatactgttttttaataaaccaaaaaactttaaaaaatataaaaataatttattctgaattacatcaaatagcttatatactttttgagagcacagtttgcacagcaacttctaataggtttattaaccctgtaataaaatgaaacctgaatatctattgtaaggcctaattttcagtacatatttataggagttaattctgcaaccagtgtagctgaggaaggagtatagaatgtggtcaacgactattttcaggtactaatgtgtctcagagccctggttttcataatgtagctaagaatgacagaaatattatacagtgccagttctttctatagtcaatcaggataactatacttttagtaatcaatttaattcacatttaatgatatccaaaactgaacatatcagtgacatgtatacatatatatatatatacacaattttatgctgaaaaatataacctacttatgataactaaaataacagcttgcttgaacttttaaagccaaatatattacctatcttatctgcagcatatgtgtaaataactttaatgtataagagagtctcaaagacaagttataaattcaataaatcttttttatactaaaactattaaaacttttcctatttgatagacaatgtactataaacttcaaagtaaatggtatcttcaataagctattaatatagtaaaaatcactgcttaaatataaaattgggatggaatacaggtattagtttatgtggaaagtgaaagcatagtttctacatatacttttgtgttaagtgcttgctaaatcacaaaattctcagaatgtgattttttaacatattttgagtaacagctagacatgggtaacattagaacacagctgcatgcaacagaaacagaggctcgttgtctttataaactgaaactttaggcaggtaatggatcattattatactaaaattccttttagacaagaagaagttctatacatttaaattttgcttgaaagtacccctaaagaaaatagtgtcggtggaaatagtcagtgaggtaatagtaacaaaagtaacacgtggacacttacaaaatgcttactatgtgccaggcactaatctaagagattcacatgaagtcacctgcttcattttcttaagagcactaagaagtaagcagtattctcatcccaatttcacagataacacaattgaggaatagaaagtttgagtttgccacttgaaaccaggcagtctggcccaagagtctgtataatttaacctctgcactacaactgcatctcagaataggaaaacaaaatctcaaaataatatatttgactttatttgtggcattttggaatagtaactcagtttttattattacctcatagtcaaaataaactttttaataaacagatgcctttcactgtcatactttaagagtttcccagaatgcttcctctagatcaaaactattgatgagtttctgtgactcagagccttctcaatacaggtgatccaccttttcctacaatggcagacttcaaacaaaactctggcaaaatctctgaatcatttttaaccactatctacttatataataactacttaaatgaaaacaatcttacaaagattacaagcacctacaaaatattttcctttattgtagtagttacaatgttgattcaaacaacaaatatattttgtcactagaacatgtacttgggggtatactataaagtatggcactgtacttggggtatgctataaagtgtggcactgccactgggttccaaagacccataaattcaatgggtgtatctgcaggaaaccacagtacaatccacataaagggttcaggtaatgcttttcataggtagaaccaaagtgttctgaacaatcaatggccttacatttcaacacctaaccaaacccatgatgactttaacttccttcaagaaagaattgtatttttcccctagtttaatctacagcttactgtgggtgcttaacaaatgatgttgactgacaaacagaaaatgtttcctctttctccctggccccctttcaatctgttctctacactgtagctagagtgacattttggaaatataaatgtgataatgccatcttcctccctaccatccacactacactctttgcattactattttatcacttttacagtaaagacaaaaatacttgacatggtccagaaggttgtgcactgcctgaccccactcctctcaagtagggagttagagctccatgcttaaggcattctctcagtggcacatgctgtgccatctcctgcatcagaattctgttcctctgggctttacctgattaatacttttcctctgccttaatttggttaattctttctcactttttcagatttcagtttaataatcactttttattacgtcagctgacactattttaagttttcatagtatcatgcacccatccttcaaaatacataccacagttttaagcttcatttttttaaagtcaatatgccttctcactagaatatgaggtctatgaaagtaataattatttctgcactaccattttattgcttaagcctagtactctggtacacaaaacaatcagtacttgctgaataaagaaattaataaacaaatgaatgaatgaacaaatgaatgaatgagtgaatgtggttgcctatctggtcacattcacaaagtaatggaaagcaggagctttcttaagtcacatgtatcatactgacatgttcagtgacattaaacaatcaggaagcataagccatacgtgtttatggccatttaaatagagaacatgcaaaaaaaagtgaaaacagtccaatgtgggattttaatatacatgactctaaaatgcacgagacctggggatctggaaatcatgagaattataacttaatttcttattgattatccttgttattcttgtttttaaactggatagctatgaaattcactaattctttcaagttgctagggatctatgagtgctcttaagtagaaataatgttcaaggtcatttagatgagaccataacaacggtccaggcacttagatgaaatgaatataaaaaagctatgtaccctgtaagcattcatcactcaggaaaggtgacatttttgcttagttgagttctgaggctgacgctcagggtcaaagaacataagtgatgcataaattagttttgttctatcagccatttttacgtttttttttcccttgaatataacacctgaacctgaaaataatctcaacccgaatgaactggaaatcttatttgccagacgtcaagaaaaagggcttgggaacaaataaaagtgtttatgctcttacccaggttctgccactaacctggtcatcacacataacctttcctggattctctaacaatacataaataaataaaacttgctaggctcaaacacaaagccaggatgaaattgagctcattcaataaaaatattctggaaattcataggtgcataagttgtttcaaggcactcttggctggaggttgggggagagataatatttttattatcttattatagtcttactttttagtagttcttattgtattttaaacatgaaggcagttaaatggtgttaaaattttaaaagtattatagtttggaccagagataaactgaatttgtttaatatttacttgtctgtttttttccctaaattttctcttaatgaagtgaacttatttattttaaaattagtttttatgaagaacatggcagacaatgtacatactggctacaggcagagctttgttgatatttcatctgaatagaaatcatctatccctagccattaatacatgatctgtattgggagaatcatccattctcaattaattattcaatagtcacttgacacacatgaaatagggaaaataagcaaaatggagccaatccttctaggaagactgactctgcctttatcactccatctcccaattctgtgatactcaaaagaatccaatcttttgttttccttctacgtttcgtggtgatcttttgcactccattttcagttcaaattttcaaagtgactcaatgcttcagaagaatcctaatggatttgctattctgagttgaattatcctatgtaccaggcactacactgttcaattatgcatcttggtaattccaaattctttatcttatagaaagagctatccatttgcaaaataaaatgcatttcagatacatctaattctgcttctctttaacaaattactttttccactcttaactgttcctgattatgcatgatctctgaatccctacattaaaaatgcatagaaaaataaaaattttcatttaaaacaccctcccacacagtacaagctgtcattgtgtcatatttgtttcctaatttaaggaaggaagctatatttcatgggtccttcattaaattgccttctctgtattttaaagtggcattaggatacttaagacaattttcccataaaataatgttcattttaaaatttgtttctattaatcagtgcaaaagtatgcaacttcaaattacagtatggaaattatcatatctacctagcatattattcatgattcacaagtagatttgctagaagaaaaaaactatcttttttattttgtaaaacataactgtaaagcctgctctcataaccatagaaatgtactgttaaagctgaagtgctgtataggccatggaatacacagttttctataattacctaagccaaaatataatgaaaaacaaaaacccacatgaagacagagcgcaacaaaatagccctttctttcttcccctcctcctaatcctgtgaaggctacagaagtctcctaaagaccagttttttttcttcctaactaactctccttgctgtttaaacaattacaaatcttatcaagtcttcatttctcttaaagtcaagtgagagagaactgccaactctaataagatttacaaaggctagttccccttagcactgtcagcaaaaatcaaagacattatacaataaaacgcagccacacagagcttttgtccctatagctttcgaaatcagatttaataattcaccttttttcacccatttcagccacaaatgccatttatccatgtgttgattgccttgctttgacccataagctatctactttaaatcctgacatctcctacttagccactgattcgtctttttcacaccactcactcactttctgttagaggctttgctgtatttatacaacagtattttccttggtcattgtcatgtaacagcaccggcaaaacacactgaagaccgaattttatttctaaagaggagaaaagagaacttaggtatgacttttgtagtttaatgccacactgttttaagccccaagaaccacagaaattacaacttggcctccactacccagataaatgtcattagccgaatatccttagaaaatctcttgcaatcccttacatgcatccctgtttattagtctgcagaagcttcccaatccagcaacatctaaatttctctactactttatttctctttataaggcatttgttaattaagaaatcttatttaatctctaacatttttaaacgtcagctgacctcacacttcaagaaaccgcataaatgacaaaattttacttaaatttcacaaatgttggacttggatataacagtggaaaccaacattattccaaaaagcctcctgctaatgaagaaacgcttcacatcctctctttccctttttccacaacgaaaagcaggtttttaccgctctatctgcaaaaggcagagcactgcccgtgaaccctgtctttctcgtcctttaccacgagtgaccagaaccacgtggggattctcaaccacggccgtggtatacctctcctgtgcttcatttctcatcaaacacatgcccaatcttctagatgcttgtttgcatcttaagggcaaagtctgtgtgttacagatttagaagtggtagagacaagtacagtggtcatataggtgggccgcggcccaatatagggcccaacctgccaaagaacccgaggaataagaagaggccattgtatttgccacttggaagggagtagtgttggtagaaaggtctccagaaggaactcaaacttggatatgggggctgccaatccttaggaggatgtcaagggagaagctgtggaggtggtaaggtagagagtcccccagaaacaaggtccttccctcgaagcgaactgccacacgtttgccaagattaggaagaccccatgcaccagcccggtcccctcctccccgagccccgcccaggccccggcccccgtgggtcgggcgtcgggccttaccttggctgcagtccttgccgcggaagccggttcgcgagcagtcgcacacggcctggtcgtccaccacggagcacacacctccgttgaggcacaccccgccctcgccctcctcgcccgcctcgcacgggcttcccccgccgctgttgggcggctcatcgtccagcttcacctcgccgctgtccacgggcaggacctgcgaggagttgaccctcacgtcacgaatccaccccttgaagggctcccgctccctcaccgaggccagggtgagcttgagcgccgcggcgcgcagttccgggggcagccccccgacgaaaaggccgctgaacaccgtcatgtccctgcgcttggacttgacctccacccacttggcctccacctggtcgatgaagagcgtggtgttgcggaactggcggcggatgcgcacgctgtgccaggcgccgtcgttaaccggcgtgtcggccaggagcgtcgcaggctcagcgcagaagatggagaagctgagctgcaggcggccgccgcgcgtcagaatcagctccaggaagtcgcagaagccctcgtcgtcgaagtagagcacgaggccgcgggcgctgcgagtcttgagctggaagctcatctcgctctcgcagcaggcgttccacttggggaagcgcgtccattggccctcggcgcccggaaactccagcccgctgcccagctccgcccagcagcccaggagcagcagcgagaggcacagaagaaaacagcccccgcgctggagcagcgccgtccccatgctcggggctggggtgcggcgggggggtgccggggccgacagggtcaaaatggtcctggacaccgtgacgaagaaataagggtcccgagagacagaaaggtaaggggaaaggcgggagtgagagggatgtgccctcctttatctagttctttttttcttcttcttcttccaataaccccgccctctctccctgtagtcctcttccaactggaaaacgttgaccccagtggtacagggtagccacagaacttccagaccaaagggaggatgcactttggagacaacgttctggaaaaggcttcaacaaaagatcaagggaaagcactgacccatttgagtctgattaactaatttaagagtatctgcagtgtcaacagatacttaactcctcaaatcccattatctgccaggttccaccagtggtaccaggccaaaaggaagcagtgagagtcagtaaaaagaaaacacttttctcaagaaagtacaggaagccagcagtgagccagtatccttggatgcttgtgaatgcctcaagtctgtctccttcagatgtggtgtcttacagcagaacggagaaagggatgcttgcctctttagggcaccatttcttaacccgaggatagcttcaaaggcctgcttcttctgtcatagcatgggcttcagcaccgctgcagccaaagcctaattccttgtgcgtggtctcacaagttggattttacttctcttttcagccacggcaacagtaggactcaaacccagcagttgcgaaatagccagaagctgttagatgtggaaatcgcaacagctcctcttcttttctctctgcctctgcagggccaagctaagatgccagcacatcaattggttgtgtgttggtgatgcattttggttttatcttgtcttttttaaggactcagacatctgcagagaattaaagtcaaaattaaggtctaaagtcaatatagtattatataaatcattattcagctcataacacaagtgtagacctggtcctattagtaaggcaaagagttaaccttcttgtatggagcttttgttatcctcactacaagtaagtcctaacattttctaatagttaatatgacacttttacagtcagccatgacacccttgtagtttattataactgttagttggtaacccgaagttttaaagagaaatttgattatggttatctttttcttttcgcaagatagtttaatttttaaaatatgtgaggggagaacaaatgcttttaaggatttctacctatgttgtgtgcttgttctgtggacagtaaaaatacaacctattcaaatctcagttaagagattttacaattggcaaattagattaaactgttggcaggaagctgccagcttagacttgtatagcattcctgccattttatttttcttagaaggaatattgatggtttcttgatagtctcttgcaaaatttcacacaagtatagttctcctttatattaatgaataatctgttgtaaaagaaaaccactaattggagccagatttatgtttttggcattgtctcaattgccctaatattaacttctctaaaggtgcataaagtatttaatattttgcctaaaagtgtagatctaactcctcctgaagtctgtatcttgctgtcagccctcacaatttgtgtggtcagaagagctgttggcatgtatgtcatctcagctgcagtggctccaggatgctagaatttaaaaccgtacctttgaatcactcactatactattaaatcacttctctttattcaactctaatctgacaggttcttgaaatggtacagaaatcataatcactgatttttttcctaagtcattttttaaccaaaaaattactcttaccttttgaaaaaaattacaaatgtataatctgttcatgtcaaggaagtgcattatttttctcactatttcttatattccccacctcttgcaaacacacacactgcaatatatatacaccatacacacatgcacacacacaccccaaatttattgtctggatgtagaagctcactacccaattaacactttttttcccttacaagctgaaactagcagtaatttatggcaccgcattgtgctgctgcttctccatggggggagctgagagcatttctcttcagtacagagcaatccccacaggtgtcagctgagagccaccaagctagggtatcccacttcaagttcctcccagatgaaattgatgactggttctctctctttcaacacacacacacacacacacacacacacacacacacagtgtgggtgtgcgcacatacacactgcccactagcaaaaggaaataaaaatctcagttgcttatttattatggctgatacattccacaccatcagcaatcaccagtcatatcttgtcttctcctatatcaaacccgaggaaagaggctcgtcaaatcatctgaaatagcatattattcagtatactttcatattttaagtggactcaggaatctgctaaattttcagtcatttgcaaaataaatctggaatatcatgatcaagagtagtgctttgaaccctttctcaagctcatgtgttagaaaacctttttttttttcttgtgtgtgtaactctgttggagccaattattgtattaattaatgttacattgatcacataaccttttttctcccgtccctcctgccctcctccactaatgcacaccttgacaattttaagggatggtggaagagagaaaaaccgtagagcaatatatatgtacatatagatatatatacattcttatcacagggaggttaactggttttcccagttcttggaggaagctcattgtatgtgagcgagtatctgtatttatatggagaaaagaggattctctctaggtgccagaaagacctggccagttcacaaattagaggatgaaataaagggatctgaaaaacatccttactgcagccaaaagaagaagcgctctaattcaaaagcagactaacagcatcattaatcttttctttcatttctagaatcaaattcatcccaagtcactaggaggatcaatacagtacgctcatcggctgcagttgcatattttaatgtttctgatatcacacacacatacacacctacacctttccatgcacccttcaatatatatatatatcttcataaagaacatgaaatctctgagagaaattttagaagtgcttattatttcacccctggcttttgcaaagtctctcaataccaatgcacagccaaaattctctctggctttcccgcccagtctctaagctccatctctaataccagtgcagtttcttggagctcggggtctactgcacaaattaacgatgggcacagtgtggggctgatgaggtagggaaggaaatatatggagagatattttattgctttgatatctagcctgtctcttattttctttcttttgctaatacatcactgcattcagcctttaagttactaccccagttccaccatctcttcttgccatctatttaaaaggcttcatgcaaaacaaccaagatctacactcctccaccctcccaccacccatctttccctgtgtatttgtggcagatcctggctcagttacaatggggaaagatatccttcttcagcttgcctcgccccatcccctccccccaacccaaattgagcttctttacctgcccggttattcccctcagctcgagccagagcctgaagcatgcatcggtcaaagcgaatttcctgaggtctatggataaggcgactgctgctgccttttcagaggcgtcaggcttgagcgtctatctccaggagtgcgggaggggagaacaggcaacggaggggagcaggaggaggaggaggaggagaaggaggaggagggggaggagagggaaagagctgggaaggaaaaggcggtggtggagcctgagaaggctgggttacgtgacgccgggtgctgtccttctgaaagagaagggcggagctgagctctccgcagtaccatggagagcggcgggcccgtcctttggctggggaatgggtgggctcggcccgtggtcgcagcccctccaggtctggatgctgcggagcgaggtgcttttacctttgcatcgtccccttgcagggggagcctgatcctgggggcggggaccttccgcaagcgcttctaacttgtcaccaccctctcttccccatcggaaagaaagaaagagagagagagagagagagagagag

SEQ ID NO: 1413 - DNA, 1114032 bp, Homo sapiens; identical to SEQ ID NO: 1412

SEQ ID NO: 1414 - DNA, 1380245 bp, Homo sapiens; identical to SEQ ID NO: 979

SEQ ID NO: 1415 - DNA, 1380245 bp, Homo sapiens; identical to SEQ ID NO: 979

SEQ ID NO: 1416 - DNA, 1380245 bp, Homo sapiens; identical to SEQ ID NO: 979

SEQ ID NO: 1417 - DNA, 429252 bp, Homo sapiens
tgtgatagtgttggaatttaatcacaggtttacttaacttggattccattgtcttttatagagaaaaagcatatttatgaaattagtattttaatattgtttgcaactaatactgtatgagtttatggtttctggcatatcaagatgaacaaatataacaaaagtacatttaatggctacatctttaagtgtatgaatatagaggtctttaatgactagttaaatccagaaaaaagagagtcaacattcttcctctataatataaggatgggtcttcccttcaaatgcagccttctttactttcccacttaagcacgaaatggtgccgcatataatttttaaaatcaataaatcacagttgtattaagaaatattttattaacaaaacagtaaattccacttgcttagcatttccaataatggataaattggccttgcaacagaaaaacaaacaaacaaaaaaagaagaagaaaacccctttgatacccaatcacacaaagcactagaagggtagggttatgtggcctttctttgatgtcttagggattgaccacttcacacgttattgtagtatttgttcttttaaaaaaggcaacacattacatggataaaaaagaagcataatcaatcagaaaagttacagtctagagatgtaatcaaatttatgccaagtcgtgtgaaatcctcaatcaactgcaaactatgcagggaaccctgatatgtttggtatgaagatacttgggattcaagtcattttctctttctaactctgttcctctcttttctttttccattgaggaaaaaataatttttgctagagtttgtgtaagccaataatattagaaataattttgctgataataaactatatcaatcattgcatgtaactttaaaatttacgctggggagaaacattgaaatcaatcccaaacaacacatttcatagatatactgcttaaaattaccattattcaatttattttctattatattttagaatctttccagatggaaactggttcaagcttaatagataaaatagaaaagcaatcttaaaaaaaaaaacccttcaagctgtaaattagtagttttacacttcccttcttatttaactggctttccctgagtaagactgaatgagacgggggaaaagaaaagactcgtgaattatttaatgtggcaaattaaaaaaaatgaaaatctagaaaagaagcaatggatattaaattttcattttataccttctactttctgggtcataaaaagccactaaatttctttgtacacaacaattacttggcaaccatagatagtggtgatttgctatgaattatacatatttctaaggtgctgtatgtctgaaatccaggccacttcttggcttttttttcatcaactaaagtatcacaaaagatgttttgcattttttgcctttgctgattaaagctaattggaaagatattcttctcttctacaaaattttttatcgttcttttagaaggtattcaagtaatgcaaccaatttttcctgaaacatcaacttgcaatgtaataatgcattttttgcactaccttctcatattagtaatttattgctgtgaacatcattgaataatatgcaaaacaagtgtataatctatacttttccactacttaatgtgttaaactaaaactatatttaatgatatatatgtaaaaccagaaaagttaaaacatagtcaataattaacagagaatgattttttaagtgggtagtaatacagaatcaaaaattactgaaaaatactttcttagtcgagagaaagtgtttactttccagaaatgttcatcatgcacatcagattcagagatatatatattattttattagaaagaaagttttcaattgcagcagccagagttaaggtgtagattaaccaattttgcttccataacctgcccacataatggttcttattcatgcagcagtatatcagtgatattctatttgataaggaaaggttcatttctttagggactaaaatcttcttaaggttacctgggagcaagatctcaatgaagcaaatcaccccatttgtcatcaataccttggcacaaccctcttccttcctgcttttcaatttgtcaataaatatttgctactgtatgcacgtttggatcttccagcatatctgatggattgctgtggattcgtgtgtgtgtgtgtgtgtgtgtgtgtgtgtgtgtgtgtgtgtgtgtgaaaatagtgaatgtatgtgggaatgtgagtatttcagggagaaaagattataagatacatatgtatatatgtgactttctaattcacacctttcatacaagtactaaaacttaattgcaacagaatgaaggctgtacatataagaaaagaagtagctgagtctttgtatatacattcatacatatcttccttagaataaacactacactgtaatttctttaaaaaataaaagtaattgtggcaatttataatggtggcaaaaaaaaagaaaaacccaactgaaataattgttgctctgatgtcataaaactccctatacttagcaacacttataacattgaatttaccaaaaatggctgaagagcagagatatattttgcattttctatacaacaggctataaaacgtcacttatcacagtccagaaagcacacagagatggattttatataaacatatgtaataacataataagcgtgcatgaaaatttcccaatgattgcatctatgccctcttgtttttgttttgaaattttgtgtgaaaacgtgccttatatttcacatttttgaaaataaggcctccatacttttttttcctctctcacaaccagaaaggggctttttgaatgtgttcctacacaagtcttcaaaaaagccagcactttgtttcaaatgcaagttccaaccactgctccagttgcaccaggcggcaaactcttaaaggtttgcaggttgagtcactcaaaaggacagtcttctctggcaattggactgacttctcaggaaagcgctagcactttggctaaatccaggatcataggtagcttcttttttgtgttatgttttgtgttggtttttgtgttgtgccttgatgctgtagtactcctttgctttatgaatgcgtgcggtcatcactgtcttttagaaatgttccagcaacataaagacaagcagagtaaatgaaaacactgtggatgttagggaatttattggcccctgttttttgttttttgtttttcttttttgagaaacaagagcatgagatacttgtttttattttttaaaaagtctttccttcctgattgcattccctgtcttcttttgtatgtgcttcataaaaaggaaagtaaataagtttatattatgtctcagataaaatgaagactatttctatacaagtgtccatttaagatcttgggatcagacataatactctttatccttgtttttcttatttttgttggagcttttcgcactgctgggttgtttctcctttacaacagccccattggactgtgctgagttactgatgtagtttcgactctcgtccacatggtatgagccttcatcccggtttctgtacttgtacatggcatagaggaggataaggatgcacagggcggcagcggctactatcccaacgaccatacccgtggtgctgctggactcccggatcacttctgctgagcctggatacggctctctgccgcctgctcgggttgggttggctatagaaaagaggatgagaacaaacacaaagtgatcattgagttcactgaataccagagagctatattaacatttattatctaattctaacagcacctatgctttaggaaaggtatgctattgataaatgtagccatccctttgcctcatggttactaaaaactagggactgtgatttaaagttctctgggagatttgttgctgtgtcttctttcttcacaaatcaattttgttcacagagtttggtaagcattgtcccaaataaactccaattagctctaaagggccatgtgggtgacttaagtaaaaaaaacccacaaacccagcataaagaaaagcagaacagccctaccctataatactagagggaatcataagaatcaaataggtgttgctctagaacataggtctaactctagactgaatcaggacaactaaatttaggattactttagaaatcatattccccttgtattttaaagaatacagtattgaacaataagataatccatacattttaactgtctgctttttaaagtataactttagttacatttttataaataaaaatagactaatttccattttgttggagattcatttgtttacataagtatgtgtgtattttattaattgattggggagctcccaagatgaactttggaggagaaagtaataaaatattctttctcagttttaaatacagtctagattgattttttggtcaaaactctgaactacctaatagattagataataatagaaggctggctagtctagttttattcaactgacaaaacccttcttcagtcttcccaaagtataaataaggctctttcttggatgagaccaatggattttggggtgcctacgtcttcttgaaggcctggtcaggcactgaaattgatgattgatggggaagaatggacctgagatttaattggtagatatgaggagaaggggcagctcttttcccctatatataataaacttttttgatataaaaggatagaaactgtagcgagagaagaagattctatcctactctgactgtaggtcattttttccttgtgaattgtgttttctgtttttccctgaatctctatcctctcgcttgtcttacataaaaatattacttttcagatgtaatgtattaaaaatgctacaactttcaaaacactattctttgccaattatgtataatgaacaaataatctcatgattccatatatattagataagaatgtgtgtgtatgagtgtgtgttcatgtatatgtaagaactgaaaactcaagaagactaaaattgtgcttttatttcgctactactaaacatcatttagtaattaattttaatatttctgcaaaagttcttgttaattactgggaatcattttaccaaacatatggctctatactgctttgtaattccattttcaaatatcaccaatatttcttttgcctaaacgtgtgtgtgtgtgtgtttttctgtgattttcttttccttcctcaaataaagccttaacaaatacagccatttccaaagtagtagctcttagtctcaaagtagcaataagctatgttctggtgctacaaaatgtagcaggtaaaactttttatgctgaatgtgtcattgcttgttttacaaaagcccacggagtgtggctgaataaaaagctttggtgttgcttctgtggacaaggtgaaaggagacaaagactataatccacagtatttgattacaggaattaatttcctctcatgaagaatagaatctactgcagtaactctgtcactacctgacaaaccaaaggcagcactttttcttttaaatacagtcatctttgccaaagtgtgccaattaactcagctgctttcactaaatgaaaactttcattttacagagcattcttttactatggtgtctcaagagctaaaaagggaattttgtttaaatgttacctaaatcattttttccagcctgatggaatgctttcattttaaacacattttcacaattacctcacttttactctgtctgccagaaaggaatagggagaatggagataacatttgaatcatttagcttatgacagtaaaatttgagaattttaatggagtggagggtttatattttgtatactaagaatagacatgtatttttttcaataaggaattgatatcgtaaatggactatcttatcaaaaaaattttatttttatctgctaaaatatttctgagaggttttcaaaacaactatgcacatagcatgataacagcaactttgtgttaaaataagaatgaggtcacaaagaccataacaaagcctgaaacacttcaactgtgccatatgcatttgaaaacatctcctgtttaaggaaaacactttcttttttgcaacactagccaaattgttgcttaagtcatatgaggcctaaaaatatctctacacaaaacccagatgtaaatcccagatgtaaaaattctaaatatcatgtttcttaaaaatataacctagaaaatctctaccaaaattaaaatctaaacccaataaacatgttatctttcttttccccagattcacattaaaattttaataaccatcatagcagatattattataggtatgttcggaataggtagttactccaatatctaactgattaattaatattctttttctatttatgcttcaaatctgaaggctaagtgaaatttttcttaacttttcttctgagactagaaatatttatgtgttggtcgggtgtggtggctcacatctgtaatcccagcactttgggaggccgaggcgagtggatcacgaggtcaagagatgcagaccattttggccaacatggtgaaaccctgaaatacaaaaattagctgggcatggtggcatgcacctgtagtcccagttacttgggggattgaggcaggagaattgcttgaacccgggaggcagaggttgcagtgagctgcgatcgcacactacactccagcctggcaacagagcgagacactgcctcaaccaaaaaaaaaaaaaaaaagaaagaaagaaatatttatgtattaatgggacatctctcccagatatgcaataacaggccaaagagatttaaatatattcatgaattataaatgtggcttctcttattgtcgctaatgctttattttgatgatcactgagaaatctctgatgaaattttatattaatgtaaatgtagagaatagtatcaatgactaatatggttaaatgtctttttatataatttgttcaaaatttatataaaaggtaaatgcagtcatctcatccatttactaaaatgtgaaaaaaagagaaacataattaatttgtatatttcatggatttaagaattttgcattccctctacactatataataaactaaaataagacatttttaaaaaattaaagcaatctgcaacatgtttttctcttagcagtgctgaaatgtgaataatgtaattaattaaaatttactttcatccttttctttctttgtcccagcacgtgacaaagaaacaagtgaaagagaataacttgttaaaaaagatttaacttgttaaaaaaagcaagtaaaagagaataagggagggggagctaaaataatggcatacacacaaataagcttaagtctttaagtcttgaatcttcaaagattaactccgacgtgtaggtaaaattaagccgatgtagccagttcattatattgggcccaggggcataaggaactcggttcaatggaaaacttcagtaggactgacagtggtctactacaagcaaggagagcaagaatgcacaccttcatcacaatacaaaggcttttgacttttgctggcatttttaacctataaatgatttggaagctaatgattattctagcaaggaaatagagcagtacaacagttatgacccatttcatatttatattcacttctttctcacttctgagattcatttagccaaatggctatagaaaaatccctgggactcttgcacttataaagcatgttaccttaaaggaccactgaaaagtagtttttaatccttcctctctcttctagcatttggtaagatacggtggtctctagaagttttccacatggtctgctttgtccctgtagatttatcaagaatcctatgaatcttcttgttttttgttgtctaatatgtattgtggtaacttcggtaaacacgagctatcaaatgtttggacagttagtaacctatttctgcactatgctctaaatcaatttgttcatatctgatgataattcagatgataattcattgtggaaaatgaacagttactactaaaggcatattctagtgccttgtcacatagaaaaaataaatgcaactgttgctctccattaaaaagtaaaaaaaaatctttaagattttaatttgtcttttgctgagatagttattttaaacaacaacaggaaaggaaatcgccctatgtattatttatttatttttgatagtctttgatacagtatctgtgaaagaacatcatttcctcaaattagaacaaatttagatccaattaagaaacacatggggaaaatatgtttgagacacattagacttcagtacagaccagagagggctgtcagtgcaggcttcatctcttaccagcttcttgcaccctctgttgcttcctccattctcctctgtatttctcctcccacttacccttctttattgcctctgtgccttgctcttccagctcctgaattatccttgtaggggccctccccacccccaggtaaatgaagaaggtcaggccagcaggggccaggactttttgcctcatgggttagcatattactcaggaaggtgttcaataaaccacaaaatttattttcaagttctgaatttcaaaacacaatgtaaaataattcttactggcacaaatgtctaagtgtgactatttcaccagaacaggttttgtgtttcatattggcatgattacttttaaatataactttctaaatttgtttgcaaataaaattgtatggtttggcaaaacaaataatatttgatcactaatttaaaagacttttgtgatgcatctggtgatatgatgggggcacattaagccattaaactttgcattgtatttatcagtttgcattgtttgattatatctaatcacaccttagcatatgcaaacagaagttaaagcttgcaattacttagtacaatgattcacaactgaagtgctaaaataactaagcaatttgaaagatagatacatttttgaatgttaataaatttttccaaggagatttccctttgcaatggtgacatccttcatttttctttttgaaattggaaacagcaatcaattattgtcattaaagaaaactgctcttgatctatgtttttgcaactctgcatgataaatggtgtttaaaatcctaattcctgatatagaatggggtttggtgggtggtgggaccttatctttctattgacaagttcaccaaggcattagcatgccatcagatggtctttttatcactcaaattgtcatttttatgaaattattttgtatacttgaatgagctgttcttccactgtaatcttatatatatattttggttccaaagttaactttcaaggtaagtttgtagtttctaggtaatttttcgggctggttttatttcttcagtatagactgttaatgtatgtgtatgtcgtcaactatgaacctggcacaccaaggataaagtaagagtatcattataacctgatgacaatggaaattcagcttttgagctttgagaaaaagattgtaagaaactaccaatcttaggaaataataaagaaaaaaacatgctagtggttaaaaaaaaaaacataggctatatatttaagatcaggaggggaccataagggatcattaaactccataatgcccagcacgcatcattctgctaaccagaattgttagatgtcctgtcttgcaatgatccttaaaaaaaaaaaaaactcttggcaagatgcatttactgaatttcttctcactaagagtttctgaccagtctttctggttttctcataaattaagcttaaagtaatagattttaaatttctgtctccaccccacctaggaaagagttgcctaaaatgatctcattagaccagagttctatactgtgtctaatagatgtggaagttattataattctaggctagacttgaaagtgattttggatttatagggggaagatttgacttttccaatactcagtttcattaatactgtgaaaagaaaattggaattgtagcctcctggggtgtttgtgaattgagattagcacacttttttcccccatttgaaaaaaaacaactcaaagtttattactttttcccatttttttgcttcaatacagtgtaggccagaagaaacaattatgatgcaatcattcacaagaagccatgtttaaatactacatttgtaggaaagcagggacacaatgatttatatgacatgcattaatttcgactcatgcggtggttttgtaagaagtgagggatgctgactgtttcaaattccttcccttctccctcccaccaattccacccatgcctgcacattctgaagtacacttacggaggtcagacaagtcttgagagaggacatgtctgacacatcttagcccttccccaatacatcggagatttagaaagaacttggaaatcaataaacctttgctacctgcctggctgctgtctccgatattttcctctgcttctttcaaaaccaccaaagcatgcatttgaagggcagttaaggggccaccactctgatattgagacgttcattatcttctccagagatctaggtattgaatgggaagggatgctagacacggaaaaactcatcatgtgcctgcatgatggagaaacccaactaggacaggctgctacctcatatggtaccacatcgaacagaagagacaatggatgtccacactctgtatgaccttggtgacactgaagacaaataaacagaggaacatgcacaatctccctcatctccaggggaagccataggatcatggtatttacaaatcttattcttcaattattcactatgttgtaaactatatgtccacagcttagtcatctataagcttcatagactttttacatagtcattgtatccttgtggtttgcatctattatggtgcttactccagcaccatggtccttactgttcccatggccattcatagtctgttcacagctacctactccaatttgtcttccatatttgtcaaaggaagttagagccataatattattgctgtccccaactcctcacataccaaaaagagttcaacctttatgccttgctcatataaccttttatctcctgcctgtttaaatagtacttatttctcgaagcttggctcaaatgtcccatcttttatgattttttttctctaagaaaatcccctccttctatcaacgagtatataatgagctatagttaacattccagggactatatgaggtcctgagggtataggagataacgaaacaaacttgatgtatatgtcctcatggaccttaaaatatagtgaggcagagaggcatacaagaaggaatcacacagttaaagtaacagctgggatatgcatgatgaaggaaaactgtaggtaccatgcaggagtaggacaaaggtttctgattgcaactgcagaatcagatctttctgaattagtgacacttatgataaaaatgagtagagagtcgtcaagtgaaagtgggtagagaagtctacgaaaaacatgtcgaatgaccttgaggaaacaaagtttacttttcaggaattaaacaacagttagagtggttgtagcacagtgagatttaagggagagtgagaagaaatttcaaggtggacatgaaatttatcacagagactgtagactatggaataaagtcataataaaaagatgagcgtatttaaccccataaataacaattttatgtggcaaaagccataatatcattaacaaaatgaaaatgacaaaggagggaaatatctgtagtacatatgacggaccaagagtaaatacctctaaaatacagagtgtgtgtcaactgataggaaaaaagacaaacaacctaacagaagtatggagaaaactacacacaagcaagtggagaagagatctcaatgctggtgagaatattcttaataattatttgattgttattagaaagtaatccaataacatctattaaattttttaaaataaataaattctctcaaccgtatatcacatcacaaattttaacattaattctatactattgtaaaatctcacttaaatgtttcatccaatagttttgtcttttttcaactagactgttggtcctttgacagtttcctgtgactctgtttctctttcttattagttctctcaccttccaaactctaatgaagattgaacacactggctgaaaactgcatgttttatgtatagttagatgaaagcttttgtaacttgataaattttcaagggtaaactaggttgaatctaatcattaagaaagtgtgaaagtgtgaaagccaagaactgtgtggctcacacctgcagtcgcagcactttgagaggctgaagccaggtgttcaagaccagcctgggaaaaagaacaagatactgtctctagaaaaaattaaaacaaatattagttgggcatagtggtgcacacctgtagtcctagctactcgagtccgaggtgggaggaccatttgagcccaggagtttaagaatagagtgagccacgatcatgtcactgccctccagcctgggagacagagcaagaaagtgagagacctttgattttaaagttttgagtaaaggtgctaagcaagggggttgaacactgacattaacatctcatatttctttaactcactacttctctaaccctcaacctttgtaatatctgcagtaaaaacgataaatgtaatatttacttcattaaatcagaaatcacttcttctgtgctttggagaattgggatcaatatacaataatgaaaatactgcatttgctttccctatgcttcaaggtaatatgtcacttaatcccaatgactaaagtcactaagctatttaaagttaactgagtcatcagtttgattcatttggatgccttatttacatcaacatcatctgacacccacagtactgcaaatagttgacagctaacttgagctcttttttcaattcagagtagttgtagaaatttctagggtgcttttcagtcctgttgctattggaattgaaaagggtctctttactcaggcccaactttccataattgtcaagcagaagaaagccatataggcaataattgagaaaatcagtttcaaaactagggaccccagagagtctgtatatgtttttcctcaaaatgtattacattccagaaaaatgcaagaagagttatattttgaaatgtggatgatactccttattaactgatttcaactcaactgagcttcttgataccaaaatagcttctcttcctgggagctcattgactacaacacccaaaaatatatacatccagaaatcacttttcttaagatccatttccttttttatatatagataattgaataatctatctttacaaaataatgagatttattccacagaattcttaaggcctgaaactagaaatttttggaaaacctggtttatagtaagacaaaaatggcaacattatagctagagtaatgaggagtatgtgtgtgcatgtgtgtgaatgtgtgtgcatgtgaatattgcagcattccttccaattctctctcagaagttgctgagtttgctgggcatggtaattcatgcctgtaatcccagtgctttgggaggctgagagaggagtattgcttgaagccaagagttccagactagcctgggcaacaaagggaggagactctgtctctacagaaaatgtaaaaaaattagcctggcatggtggcgcatgcctgtagtctcagcttctggggaggctgaggtgggaggatcacttgagcccagcagtttgggggtgcagtgagccataactgcagcactacactcctgctgggcaatagagaacccaattaaagaaaatgctgaagtcattcttcttatcctttcctttccttttcgctttccttttccttttcccctttcacctttctttctcctttctcctttcctttccttcctcctttccaaattaataggtaaagccaagctattaaatagttccaggaaacctttagcaataacttgggggtaaacttacttaactaagtaatcaaaaccctcatcaaaaccttctttcttacattcttccatatattttaacattactcaattgtcaacttatgcttaacagagctactatgacttccctgtaacatctatattttgtttcttattttatgtagttaacagctattatttttactattattatatggtaattgctgtgctatacattttacacataaatttcatctaatttatttctcataacactatgtggtgtaggtattatcattacaggaaagaaaactaagtctcaaagagcttagcctatttagactttataaatggcacagccaaaattcaaactcaggtctgtctatggctactaatattttatatactcagtgtgtctgcatttatcactgtggatcaatttgttattgcttctgattttattcctgtgttaagtgtaaaaacacttagcactttaggtgtattttctttttttgtttgtttatttttgtttttgtttttgtttgagacagagtcttgctctgtcgcccaggctggagcacagtggcgcggtctcagctcactgcaagctctgcctcccagattcacgccattctcctgcctcagcctcccaagtagctgggactacacgcacctgccaccacgcccggctaattttttgaatttttggtagagaaggggtttcaccgtgttagccaggatggtctcgatctcctgatctcatgatccgcccgcctcggcctcccaaagtgctgggattacaggtgtgagccactgcacccgggctttaggtatattttctaagcagttgcccagttctagcccttccagccacattcctcttcacctgctgccaactctctgtcctttgctgtgggagttaacattcccacagaatcttagaaaagcagtgaagagtggtaaaaagaatatcgaattatgcattaggttctagtctaggtcctgtccttaactttttgagtgacagtttgcagttcattatcctctgctaacattcctttatcagaaaccatgataatgacacataaattatttatatcccaggggttactgtgggcatcagatcaggtagggcattcagtatgaaagtatctgaggaggatgaggactttgtaaaaacagtgattatctgattgttttctctacatcttccacacagaaggtactgaatcagcagctgtcccaacaattatacagttttgcaatatgcactgcacacagtgtctcaatcagctgtggcagtgaccatcaaggacattatctccccgggagtagttgtatttgaggacttccctttcatgaaaagaggccttgtgaattcaggtggcaaaaatggtcctttgcattgtagggcatgttgtttcaggccattaactgtggtgctgcatgtggagcttgtttctgtttttctgtgagacattctatctttaatggatcagtgctctctggctcctatggttggagtgaattacatttctctctctttcaaaattttattatgatattttatgttttaggtgtcataaaatcaatcatctaagactattctttggtaataaatagctgacagcaaggcttattatgttggtaaaaactcctttgattaggtttcattgtttctttctaaaattgttaagtcaattttcccccacttccttccctgctctggaattgcacagtgtactccggatgaaatccaaaggagactttccactgcagaggtgcatgctgggtcctaggtgcacccacccctccaccagggtgcccgcacagcatctatataaacctgagtcattctgtgtaatggggcagtgtacaattttcctgatttagaattgggtctctttgctttgggtgatcatctttatattgctgtcatgaggctatttctgtctcaattttcttttgttgggaaaaagatcagattctttttggtgaaaatgcaatagctaaggtgaaagattagataacttcccctctgagcccattagagggaagtgtgtcaagtctagcattaggaaatacgaaagacaaggcatccatcatggtggggaggctgtgtgggtaggtgtgcctggtaagtcatgctgctgggagtattcctgagtgtcttaggaaggaagcaggaaagttaatcatttcttctctcgaaagcactctccctttctctctctctctctttttgtttagtataaaaagcccaatttttttccctccaaaaataaagtaagaagagcagatgatacgtgccctcctcctaccataggaacctaaatttatccagctaaagcactgctcctgtcttagtggtcactgagaaaagttttatgctgatagaatttagaaatactttgaaaaacttgctagatgctgaagtatccatcattaacatttccctttcttgtttggggatatttccatttatgatatggtttactatttagttagtttgctactactactaataaaagctaatttatgttatcaaagctttcctgtggtagactatgttaagtgctttagatgcattgtctcatttttatcagtacagcaatgtcatgagtattgaacattattcctttcattttgcagatgtaaaaagctgagtacacagagattcaatgacttgcctctaattacacagtaggtggccaaattgagatttgaacacaggcattgggatttctcaagtttactcaataaaacaaaatattttagtgtgctcttagatgtgacaacgtcagtatttttctttctcctatttttttttaatgtaattaatggcctctggctatactggcatctttaatacaccatttttaacctggaaatgtaaagtattctggtctttgctattatattgccagtgtcaggcttcttataacattttgtttatgagtaaggagtaactcatgatgagagtgatctaatcgacaagttactgtgttgagatgagagctgaaggctaaagccaaatgtagcatttgctgccccttggagcatatgtgccaacaatgaaagcatattggctcctcatggaggcagcatgtcctctagattggaattcagaatatgcttgctggcttacctctgatatcatctgagcaaatgtaattaatgaggtaccaagagaacgccacaggaagccaatttcattatcaaaacaggtatttgacacaaattacaagacaacgtgactttatccttcctggatttcatgttttcataagaggtaaacttaccttatatttttctaaacctgtgctacattcctcccttcaaggtggttaaatatttcagagcatggatgtgcatcttgttatcttcttccaaagctcaacaggacatgtgccatactgttaaaaggctattatattttagcatcttccaataaaaaattgtgatgtgaaaccgattattaatgctctaaggctggatacatacaggctgcctaaaaacttatgctgtactcactactgaacagagttttctgttgcttattgtaggaggtttctgtatcagcagccatctattttttacagacttcaagtaaatgcttaatctcacttagcaaactcacttatatgctaagtaattattataagtggccaatcatatgttagttaaaacattttaacagaacccactctgtctaatacctaaagagactgtgctgattttttactcagatcaaatgcataatgccttatgagcgacctcactacaaggcagaataatgcctccattggcacataaccagtgctagtagcagtgggtcctccacctgtcattggatgtgtgataattatttgttaaacccttagtatgtggtatgttccagacactctgccaagcattgtgtatgaatcctctttttccaatctcataattaaccgtattctccccattttacagactaggaaactgagcatcaaaactactaagtaaatttcccaagaccaggaaagggctgcgtctcaaattagttctatataattccaaagtccttgccataactaatattcatttctggtggcatgtcacagttcttttaaaatgttgttaagagcttttctaaagtgtagcaaccattatattgttaaaaaaaaaaaaaagttcaaacctcagaaaagggtcaaaatagttcaattaaatacaaattgctatattctaaaaaacaaaacaaaaaacatatgtacacacacacacacacacacacacatatgaaataccttttgcttgtgattttgttttctgctgaactcctagtagaaactaattttgttgaataaaaactggttgctgggaaagttgatgtcaagttgaccaaacaaagataggcttcttcctgcctctgggcccctggccttccatttcttagggcatttgtaatttcaaatactttatctgtccctttgatgtgtaaatatggaggacttgggagccatctcttcgtaatataaacatcagagaagatagcgcccctatctcctaatttctgtggaaagggtgggagcctaactttagtgggctccatgctccaaactgtaaaactatccccctgtcatgaaaacatgagatagtttgtttacatttcctttgggtgaagcccatttgcaagcacagttggtcccaaatccatccatcccagcacttaaataccctccagccttttttgtttgtttgttttcagtgagttgccctcgggctgaaatctggcccacctctcctattgcaatagccttgactaaatcttccttgcctgtttaactttgttcaatataatttttattctgacattactgccttcagaaaagcaggggaaaagtgagtaaaaatgatgtgtgataaatctcttctactttaaccatgtactacttatttttattccagtgttctggacaattaaatttatatggaaaaaacatttcctacaccagcacgttgcacactgaaacccagctagcacatcagtttccaactccagctgccccatcccgcacctgaatgatgagctgggccctcagcgctgattctagcctggtacacaggagatgctctcgatgttccctcaaatggaacactcattgctactgtttttctggctgcagctcaaaatcctccattttgacagcaatgtgttggctattacggactaattaaagtcacttttgaataattacataataaataacacacatttaaatgtagaacaaaattattttctaatcaagctctaaaaatatgacccagcaagacagtccttgaaatgattgtgatgacttatttaatgaaaaggtgcaccttgttcaatatacatatctttattcctaatgtgtttaatggtatcaattgaatagaaatcccttgaccttttctcaaaatagcacactgaaaaaccactgaaaattgcatggtaattgcaacaaatttagcttaatagtaatacatgtaaagaatatgacatgaaattatttaaatgaacttttgaaaaatcgattctatatttgtgaggtgcctgaattttagaggaaaaaccttctgtgttccaagaaactataagcccaccttttctaaactagagaatacaccagctctctcatattacatgacataacttaatctctctgaatctctttagctatgaaaatgcttcatagtttcataaaataatgagatagaataatgtttgtaaaggactaagaacaatgatggagcgcagaataaatcttcaccaaatactagttattattgctatttatcattgcttatgtaatctgaaccttgatcaacatgattcctctgataggcaatcaacagttgtcttttgagtggttgtactgatgacctcacctcctgtgttccagctaaagagatgccacaaaaatgggtgatccttttcttcccccaatgactaatgagatattttattattcaatggaactcttcttttcctagttttacaaaagtttaattgatttgagagtggcctaatatcccattagctatccatcccctaaccactcacagagaattgacgtattattcttagcactgtaaatctaacaggaaattgtccttcctaaacagggctccagaaaacaggaggcaggtctggttccctttgtaacaaatgataaattagagttatttattagggagctactacagcaaagagggtctttatcttcatttaggatcttgaatatcaacataaaactcacctttttaaaacttcttcaggagttttcagaaagggttctatttggaagagggcccccaaactaagagatactgacatgattaaagaccttcttggaacttaagtggttttgcagtgttgccattttgtcaatttactaagtggatctaaaatgtaaaatttcaaagacattttataaaaacttatatttgtgtgaaaaacaaagtcttggaaaatatgtgcgtgtgtgtataaaaataacaaatactaataacaggaaacactcatatagcacttattttgagcaaaacattttttctataacatacttttcatatattaactccagcaatcacatagcaataactatgctggagcaataactccagcaatcacaatttttttctctaggctgagaaaaatcacggaagctgtaaacgttttttgagaaaaattatgaaaaaaatgttatctatctctcatgtgtctacgcttcttaaactgggcactttaggacaacactggcctgtaacattgttaccaatagctggttcaggtttctacctgttcactaagagctggggttcaattagccctcctccatcacatagccaacattttgtattctgaagccatccttttgtattctgaaactgatcatatcaatgtgaagttatcatccaatgctaactgtgcaggacagtgtggctaaaatcaagtataattgagttccatgtgttcccacccaggatgttgaccctgatctagttttaacatgcacagttcccatcaggaggcctgagtggtttcatcagttgcccaccaattttcagccaggaaaagtaacagcattatgtaaaagggaaaatagcttggaatattctttttgtataactgaattgggggaaaaagccaccatttatgttctacattatgccagacattgcaataaatgtcttcaatatattaattaatatagaactgaaggtataaactttctatttttgctcccagagcttagcagagcagtaggtatatagtgacactcaatacctgatcaatgttgaagctgataacccaccaaatatataacttccctgttcattaagagttctgaatggaaccacaggtaattccaatttatcaaacatttgataaaaggaataatttactagtactcaagatgatgctagatttttcctgtttcttccattaacagctttaggaaggtacctaaataaggaacataggacattttcagagaaaaagccattttttgaaggtgggggagggtcagagtgattagaaaactcatgagtaaatacttagggagagtgaggtactcagaagatttgggcaacgcatctataaaggtaatggtgcatctccttacaaagatttgctctcacttgcccaaggactagcaaatgtgcatagaagatacatctgtttcagaatatttacctcaatatgttagttttataaaaagccagtatcccaaaatatagcctaatatgtgaaataatttttatttaagtatttctaacatctaatagcagcagctagaattatccaatgtctaataacagcagcagctacaattattgttatattattttatgtttgcattcaagatggattgcaagcaggaaaaagaaatttaagaaaaccagtacattaggaaacaatgacctgcaggaggggcagcccatgatgaaacattattcagacttaaacaggattcaaaacaaaaacaaacagaaaaacacaacccatattccaagaaaaaagttggaaaataggaaaacatcatataaactaagaatttcattagaagctatcacataaataaaaccaatttctgcccaaagagccaccttcatatgaagcattaaagacaggcttgagaaaaaaagtaatagggaggtggacagaaaaagctaatgtagaaagagatttaacatcagaaatcgaaagtgaaacaatttatggcatatattatcaagaccgggggagataagatcagaggacaggtttacagtgaatgatcccattaacacaaaataatctgaagttcttgttttaacaggaattgatgaattgaaaactgaagagtgaggagggacaaactgaaagagaggagaaaaagttaaactaggcttggtacaagagtgttaaagtagctgtcgttagatagaatcagtagctggtgtgttttgtattttgggtaacagactttggtgcagtagaacagaactaaaattgacagaacaagtccatgcaggcagcaagaaaaacagggttcctgcttcatggaatttaccttgtggggagattcaagctatacattaatgaatgaaaaacaaatacgtaaacatgattgtttcagatagtgatagtgtggtaaagaaaacaaaggtagaaagattccctggagtatggcaattaataagctgctactcacttttcattgtgctatgatatttaacaaagcagacaaaaatcgggtgaacaagcagaagacgatggcaaaagggttaccccatccgccttttctctcctctcctctaccttcttcctccaccatcttgttcttaggtctagtgtcaccagagcaaaagacagacagtaaactagtccataaggaatggttaatcagacctataagcaatggctcgaagaactggatcattcagctgagctcacgaagaaaaagtgacaattttaagtgcaattagttactgtgattcactaggtactcaaggtaaggattctgcaacaagagtatgatagcctatacttagacagtaaaagagggattcagcaagtcctgtaattagtaagaacttcaacagttttcatcgctgtattaatactgtgtaaaatactgaaaaatggattaccctgaagaaaacactaattgagaaaacaaaatcaactataaataacacacaccccaatatacaaagaccagactttgttacatggataactcatgctagaggatgtcagagaagatgagatagaaaaaagaatgtcctggtgcaaaagattaacaccaggaaggttgggcatgtgagcgtagaagaaatggggaagggaaatttgagggtgggaaaatgcagagatgggactgatataatgacagaaaagcaatagcaatgactttttttgttgttgttgttgctaactaacagattaagcataccaatgaaaaccaaggcaagatcttagtaaaggggcctaggatagtgccatgatgtgactttatctgtcacgacaaccaagagggaatgattgcagaggccaatgagctgggagaatggaatggatgatcgtgacagagctgatcattgtgaatgatagatgtttctgggagctgagagtcctgactggcactgtggagccaagaggaaagaggaccagagcatacccagcctggtctcccacgccctgtcctgttgcgaggtgactgccgagctcttccccctccctggcactcagcagctgctctctaagcgctacagtcagtggttacaatcagtgggggaagtgatattcaaatattcaaaacgagatgcacgacatacatcccgatttgctctaaagagcggatttactctaaaatggtattcttcacaagaatgcaaattcattactttcttgtgacatgaaattctcctgggattctaggtgatgtcaatagacaccactagcagatagtggttagtccatatccacctcactcattttgttaatgcaaacaatattattattattattattattattttattattattttgagacaaaatcccactctgtcacccaggctgaagtgcagtggcgtgatcttggctgactgcaacctctgcctccaagattcaagtgattctcctgcctcagcctcctgagtagctgggattacaggtgcacagcaccacacctggctgatttttctatttttggcagggacagggttttggcatgttggccagggtggtctcaaactcctgaccgcaagtgatctgcctgactcaggttcccaaagtgctggaattacaggcgtgagccactatgaccagcaaagaacattattgaatttaaatactgctttaccaaaaaccaaaccaaaccaaaacaaaactaatggaaatgagcctaacacttgaagttatgaatatttggaatcaaatctaggctatgaattcattcatttttcaggggtctacagccaccacttaatggtataagggctgtatggtaacagtatttacgttagtcacatcagaagatgcaaacatatcataaagaagtaaaatgtttcagcttgaattttagggaaacatggcaagactcaaatatttctctattaaagatatcaacgagtctacctgctgtttgttttactactgctataatactctcacttccgaaattcagaaatatatcacttaaggtaatttgctggcagagtgagtggtggggactttttgtcagtagaaaggtcaaataattttgcacaatgtgctgcaaatttttagctttataattttactataagtgacccaagggaaagctcattatattgttacacacaaaaattatgttgtgagctaatggaaagtgaacagtaaggtagaagccctgtgtgctatacccactgctttttctgaaatacataatcttggcatgttttgtttttaattttttcaataaatgtggaaaaatttatgtaaaaaataagagtcctcatctcacaatcaacgatggtataggagggtagccttctatacatgaatataaggcccttctaaggaatataacatgcaacaaagatttacagtaaagccaaggaagtaagaaaaaaagttgactaacctaacccacctgagctcggctcacaggggtcaatgtcctcatcatcgctgggacactctgctgaggccacaaggatgtcatctgtggtctgcaaaagaatcacattcagtagattaatttaaagggtcctaacagattctctcatctttgtctcattgacaagtgaaatacaatttgtttatcaagaaaccaaattcactatttccctttctaaagacacagagcttacattttagatccttcatagaagtaactgcctatttgtgaaaacttgattacactttagtttacatgaggacgcagaaatggtgacagccaacttgtagatacccatccactcaaatgcagatagaagctgcacacagtatcatacagaggtttaaaacaacctggcagaaacagatgatttgaaatttattacagcctggagtgctacaatgtatgcatcagtgggctttatgtagtacttgtgcttggcttcctaaaagcagaaaagccataaccttttacactcacgactatgtagagtttgatgaatctttgagatatagcttgttattggaggaaacacagattaagtagagaattagatagctctttcattggtgcaaaaaggcaaggaaatacaatccatttaagacactttcattttcattatgatttcacacttgaagctcatttttgtaatgttcagatagcaggtattgcttcctcatcatccctttcatcattatggtttcataataaatgaaaagtgtattcaaagtgggggaggggaagaggtggcagttttctctgtgacattctagttgcttcattgcgcttacagcaaaaaagatacctatctctgtaataaaaagcagagtccataaatcctagcagttagtcacataatcaacacactgataagcacgaaaagttgttctttattgccactgacaagctgcagtaaattcagcatagatattgcatggaatctgtaaaggcttccatcagagttggctctgctaaggtaaaacagagaatccaatgtatacaaataaataaaaatatctcattacatctactaaggactaaagagattagaattgttcaaacaattctcagaattgcaacattgatacagttctcatttaaaagtggaattaaaataacataggtcttacttcaaagaaaaagcaaaaatacgatatgagcacctaatattaaaggagcacctaatattgtcacagattaaagtataactaaatttttaagaaagttgtggcattttgaaaaatggagacgaggggtgatgaacttttatagaaagtattaggcttaaaaatctttcaagtgcagagtctttaagaacaaagaatttgttcagatgcgaatgctttacaatataactttaaataaacacaaacctttaaatagcattggagatggtttcatgttactctgctcttacttcttctgagacaattgggagagtttctggattcatgcattttgctgctgctattttagaaagggaaggtgaaaatattggtttgcctggaagtgtaagtctttttttttaactgttgaatttattgacaaagttattcataatattctcactttttattcttcaatgtttgtggcatttgtagtgctaactcccctttcattcctggtatttgataatttgtgggggttttctctttttttttttttattatacttttagttccaggatacatgtgcagcatatgcaggttacatatgtatacacgtgccatggtggtttgctgcacccatcaacctgtcatctacattaggtatttctcctaatgctatacctcccctagacccccaccctccaacaggcccaagtgtgtgatgttcccctgcctgtgtccatgtgttctcattgttcaactcccacttatgagtgagaatatgcagtgtttgattttcagttcctctgatagtttgctgagaatggtggtttccagcttcatccatgtccctacaagggacatgaactcatccttttttatggctgcatagtattccatggtgtatatgtgccacattttctatatccagtctatcattgatgagcatttgggttggttccaagtctttgctattgtgaatagtgtggcaagaaatatacatgtacatgtgtctttatagtaaaatgatttataatcctttgggtatatacccagtaatgggattgctgggtcaaatggtatttctggttctagatccttgaggaatcaccacactgtcttccacaatggttgaactaatttacactcccaccaacagtgtaaaagcattcctattctccacatcctccagcatctgttgcttcctgactttttaatgattgccattctaactggcatgagatggtatctcattgtggttttgatttgcattgctctgatgaccagtgatgatgagctttttttcatatgtgtgttggccgtataaatgtcttcttttgaaaagtgtatgttcatatacttcacccactttttgatggggttgttttgtttttttcttgtaaatttgtttaagttccttgtagactctggatattagacctttgtcagacagatagattgcaaaaatttcctcccattctgtaggttgcctgtccattctgatgatagtttcttttgctgggcagaagctctttaattagatcccatttgtcaattttggcttttgttgccactgctttttgtgttttagtcatcaagtctttgcccatgcctgtgtcctaaatggtattgcctaggttttcttctagggttttttatggttttaggtcttacgtttaagtctttaatccatcttgagttaatttttgtataaggtgtaaggaaggggtccggtttcagtttcctgcatatgtctagccagttttcccaacaccatttattaaatagggaatcctttcctcattccttgtttttgtcaggtttgtcaaagatcagctggtcttcaaagaactagaaaaaactactttatatttcatatggaaccaaaaaagagcccatatagccaagccaatcctaagcaaaaagaacaaggctggaggcatcatgctacctgacttaaaactatgctacaaggctacagtaaccaaaacagcctggtaccagtaccaaaacagatatatagaccaatggaatagaacagaggcctcaatgtaactcttaatgtcagtgaagatcgttagcaattggcacgataatcatgtaggtatctttttaaaaagaaagctttaaaagcaaagacccattctccttttggcacaactacatcttgctgggtaatatacaaacagacttgataatgacgtgttattgaattatgtagtcttgccggtcagttgctccaattccctccagaggagataatcagctttttgtttttttccccccggaccaacatctagcggaaagctacttttattctcaatttcaaattaatttcaaggttacagataatttctcattttctttgaggaatgttaaatatattgatgaaatcaatatagtgttgttcctattggtgttttattcttgttagagggaggaggatataaataaattctttaaaccaatggctctcacatcagcagtgatattgccaccttttccttcctccacctggaggcacgtttggtaatatgtggaaatatttgaggtcacaattggaattctgaggtctgctactatcattgtctctttttgactgctaaacattcttttctttcctcttcctctcttctccttctccttttttctttcttttttttttctttttttttttttttttgtagagataaggttccagctcagtctcactgtgttacccaggctgatctagaactcttggcctcaagcaatactcctacctgagcctcccgaagtgctgggattacaggaatgagctaccacacaatgcctaaatattataaaatacacatgacagcttgaagacaacaaagaatgatctaacctgaaatgttaataatgccaaagttgagaacccctgctcaaaacatttaaaaacagttctgtcttattgttctcctaaaaatatggacagcataatagtatctattgttacaaggatgaaattagtacatgaaaagtacctagaaggggacaacactgtaaatgtttattaaaactttcaatattattatcaacttttttcaatatttcatgaatgtaataccaatttaatttttgcactataattacaaataatataattatagatattaaaccgaaacttgtacatatgaattattcttgaggtctcatgttaaaatttgtatcaaaatacagtagctacattggtattttgttgaactaagtaccatcttttactgtccaactttgaccttttaaaaggcaaacatcaaatataaacttaaaaaactgcttcttaaaaaaattcatgggctacaactgtgtgactcagtgggtagtgtttcatgcagactaaattatttacgcaatacaagttaagctttgttttaaaagctgacctattttcttttggaacaattctacactaaccagaacgtgtgagaatgttctcagtgttaccttctgcaaaacacaattcctaaaataacaaaagatgtcatacaatggtacttcctatagccctcttacagtagaaaaaaataactacaaatgcgacccttttgtaaaactatattttactttttaatgtaatttccctggtataatgaaatacgttcttgattttcatatatgtttttcctccagaaattaaaaaccagcaacaatcttgagaataaaagacctcaaatcaatagatggcttggcaaaaatcatcatcgcagtatgaaaaatcaggaagtggctcaagtgtaggggaagaaaatcaaatttcactttagaagctgaattaactgcacaattttctagccaaagctgtgtaatttaaatttaattcactgtgtttggagctgctgctatgacttgctgttgagagagtggtagaaagaaactcaaatatgtcacattaatcaattctattctttagtatacttttccctgatgtttataacctttttgagaaaagagacaacctgctgaaaaagacagaagcgtgatcaagcagaagcattagctttacataacagtccatttagatgagtgtctctaactgtgcatttaaccacccacaggtgaaattgctatgctgatcttccttaattcagactggtctgtacatgcacatcgtaagcatctcttcttgttgaaaatgtgcactaaaatctaagtctctatacttttaggaagaaaatgatttgaacagaattcaagaaataaaggctgtaaaacttaatccatccttttctatatttgaacaccaatattttgtagggtttgagaaatatgtcaggacgggggcaaaagaatgttcttaatgaatggtaagaaggtagaccaagtgatttaatacccagggatattaaaaagagggagcatttggttggggggaatttagagaaacacagatgtatgtttgttattttttctcacttataggaagccttttatttttcaacatcattaatggtggaattttctgtatatgcatttgctgtcactttaaaaaatatagcttaactgcatatctgtgtggtaaaaatatacaaggaaagcacgaataaacccagtatgtaatattatatccctgctaagaataacattccaagactttattccttatgataaacagctttcctgaagactaatatattccaatgaagacgcttacagaaaactatactattaagacaaatctgttttgtaaggaaaagagcaatttccaattgtaaaataggatattcattgtcagtatatgatacccacaaataaacccgatttattctaaaattttaattgaaagtttatttctaaacagcaacagtgtatcctgctatacctctaaatacgaagccaaaagaattgtctcagacaatgacatgagcattgtataacattatttagcctaatatttaactgttgtgactgatatttagactgaattgatagcaacagttagtgggtcgaggacagtgctggctgaaatatgatatctttggttaactgatgggcacttgttcttgctgatacttttctgtatgcaaagctgctttggaagagagagcgctctcaagtgtggttttcatgaatgaatctaatagtttctccagaaaatatttatcactaggtgaggttccttgaaaaaaaaaaattttaacaggattcaggattagtatcacaaattcccaagtaaggtccaacccagtgtcctgataacctatggagcaagaagtttctaggaggtaagggaagtcataattctcaccagaaggaaaaactgcagaaaataatccacttgtaatgtgtatataggtatatgattcccaaattgcggtctatttgattaaagcaaatcagtaaagaaatagatcaaattggcaatttcagttaatgaacaatcctattaaggtgcaagaggaatttagaggctgtctagatcttattcttgtttccactgtctcaatgaagttgcctcaattgacataaagatgtcaatttcatggctcactatttaataaacataaaaataataagctgagatccagtatgtggaggatgaattttacctccagcacatgaataagaaagacagtgaggcccaattactcaacaatgaatacaaagcacctcatctatgcgtagcattttctgataggcataaaatattctcagtacacatgaaggtataaattgtggttccgatatgcaaataatttactgttctctctctgttctgaggcaaatgaacaaataactctttaatacaaataacaatgaagtaaattcaaatagcttatttttctcggaatgtaacaatgttcccatatccattacttcatttacaattcaccaatagcatccttatctggaatgcagatggaggtactgttattcagagtgttatagttaagtgtctgctaaaaaaaatactcatctgtacactcatctacccaatttgaatgtgtgaacactggctttcatgaatatgtagggcaaagctcaaataccccttaaaacagccactttcacatttctttaatgttctttcccaattgatgccctaggctattacaaaaagtgaccataaatcagctgtctgcttgggaaaaaggcagacttgaaagccattcaattttcttcgaatttttttcagctgtttaaaaagtatgcaatggttccagaaccactaaagtgggtttgagtagaagaactctgccgtggtaaagaaatcacatcttactcagtctaacgttcatttttatgtacatttgatactggttctcctaacaggcaaaactcaaaggaaaatataggaatatggaaataatgtcacagaaatgcactttaattaagttatggggaaaagaataaaactgaatttttgagtaatcaaaaaataacatattttagcaaacttattcaaaatagaaaacctacaaataaggaacctgctgtcagggaacttgaaattaaatttatgtttaaaaaatatgttttttattatttctttatgctactgatgacctctatgctcatattgcatttccatttttagccaaggcaatgtagaaggactggcaaaataaattaatatgaaatttaaactttcaggaagccatggaacaacctatttttctgaattctcactaattagaatttgagaatgtcagacctccaaagactgctggtaatggagtagaggtactgaatgagtgatcaactgtgtttcccgtctctttgtttcgcttttggacaaagcactttctgaaataattttggccatttccaaattaaataaatattgaaagatgtttacaaatgtaaatttaggcttctagctgtatcagtatgaatatctagtcctattatggattagtcacacaggttgaaatgaaaagtagggttctaagctgtatcaacatgagtatctagtcctattaatggattggtggactaattaatagattaattagtcacacacattgaaatcaaaatccctttcggtaaaaggccaaaataaaaccagactttatgattgcaaaatgcctatgatggataatttcaactagcatgactccaaatccaagctttcattgttgccatgttagggaatgaaaacatgttttagttaagcagtcatatatcttcttgtactgagtcagatcttagagatcattaatctaagctcttcattttacatattgggaaactgaagctagaaaattttaattggccacagttataatgctagttaatggcaaatctatgagattatccgactcccagtagattatgtttttctattatcccagatgacttctacctatccattcatctatccatccatcccaaaccatcttgttctctaatgaattttatgtgatttacgaagatacatgataagataaacttaaaataagtgaaaaggttgcaaaggtagagtactggattttagataagtaaccactaaaattgtcctgaagaaatacacacagacaggaggtgcatattcacagcttctgcaccatttgatatggcagcacatcatgtaacactaaaaggggagcacaattaatgctagagttcaacttttaaaaatccaattacagaaattcaaatattgacataattacagttattttgaaatggagttaacccagagagttctttatttacttgtgaaaatcttttctgaaattattgttttaaagaccttacataccatgccctcagtctctgtacctaaatgcataactaattttttggtgacaaaaagaaaatgcaaattattgaatctctttctgtctttttatctctttgacttagaacactgcaggctatgctggctacaaaattaaatcaatgaactccctgctctcttctcattaagccactgattaaaatccttccaacttccaaggtctctctcttactaactactgtcttcacaatgtaagtgccaatgagatattcatctttgtttctctcacacaactatcattagagttctgtcagattatttcttattacatcttgggaataaatacatggaagtgatcatttattagccatattggtagtttctccagaaacaatttaaacatgtattgatcaactcagtcttattgacacaatgaccttcgaagtgaaggttcaagatcaaagatgtagaaggagccacatttacctttggacaagcagccagttataaaaaacatttctctgctactgggtagtactatgaccaatgtcacctgataaactttaacttggggatagatgagaacttccattccacacgatgcttggagtatagaacagcaagaaatatggatgtggctggaaataatcacttagttaacagaaggtgtattttctgattttgagttgattcatgagttgaatatatgcaagactcaggactgcatgcccccaaataagccagtatctgagtagcatctctatgcttgtatctatccagtggtgattgagaataaacattatctggctcagatgtcacaatgttatcttgttcatgtgctaagaggatccagtgtcttctagttctagttaaactggaactccaagcttctacacttgactacttcattccttctggtgcacattggttctttaatacatatttacgatgttgtactgctgaaacacctcagtttaatttatactatgctgaccaataatgcaaaataaatactactccagaattcaagtctcacttttagttttcatgagcagtacacatcatcttggactggtttctgtgttctaaacatgacatatgaatatatacatattatacatttaaatacatatatttatatatgtaattaattgtgtctcacaggatgttaagggagtcaaatttcatatgtgtgaagacattttggaaagtgtaaaagtgcccacgatgcagtgtttgtataaattattattatagaaaacacatggacaccgggagggcaacatcacacaccacagcctgtcagggtgtgggggacaaggggagggagagccttaggacaaatacctacttcacgcggggtttaaaacctagatgacaggttgatgggtgcagcaaaccaccaaggcacatgtatacctatgtaacaagcctgcatattctgcatatgtatcccagaacttaagaaaaaataaaaaaattattattataactaataatttttgttcctcacatgatgctacaaaggagagctccggatagtgcttgaagaggacaacccaatgtccatttacctgaatacattttattttaatgtcctgaaatcctcttgtccctcagttgaataggatctgtatctctcacttacactagcccctcacacagatgctgttcttgggctgcttcctattatgccagcattgaattcattttggcattccttatttagggcatatgtgtggatctcactggtaacttacaaggtaggtagcaccaatctatgtctggcattatgattacctttcctccgaccagatctcctggagagcttagtgcacagactcagggatacttgagctctctctaaattctaagttctactcattagattgtgagaacctgatttattttatcactgcatccagaatttaccactctgttaaaactacagcatataaatgaacagatgaacagggaaaaacagaccacttagcaaacaatgctaattaaaggagagaaagagagagaaaaagggagagggagagagaaagactgaatctctaagtgtaattcatgcatgacaatgctccttacaataggagtggttgtatttgtagttataatatgactttacctatggtttgtcttctatacggattaataatatgcttatcaactcctgttaagacaatgagctatcttttcttagtgcattagaatagtgggagtacttgccttttgaaatcatcttgaaatctaaaagtatgaagactgcttagtgatatgttttattttatttcatatgctgcttttgggtacagtttatgttttatgcccccagggcatctatacaggaattcagtagagctgacttaaaatgacataatcactcaaaaacctggcttatattcttaaagcatttgcgtgaataaaaggattttttgaaaataattatgacttgaaaaataattgttatgaaaatacagcttagttaaaagtgagggattcatcttgactttaaaaatagaagaaatattatacatgacacttgaatttactagaatcatcacattttaaataatcttactcttgatggtcatccactctaagctcactacatttttggttatgaaaaaggcatgattgtcacaattgctcatttataccagctaattaaatctcaatataaaattgaacaagtatagattattttctaggaatacacctaagagtgggagatgagaattgtggcaaaataacactttttcaaagattttatctgccttataacatctctagaagtaacaatgaaactttctaactggcttccacattataccccatggctggaaatgtatggtagagaaatagcaaaaagtgacattatctttaactgaaagagagaatgactgaaggttagaaggaaggcaaagctaaaaatgtcttgcaataagttggtcttcctgcttttatgaagcattcctgtcctttgagaaagcagtaagataaagcctactctgtggaagggactgagaaaaacatagttaactatcattttgggttttttttttacctacataatattcctcaactatctctatctcttacaaactctcttgcaatagtctattgcattataaatgcttttacttagttgcaaaaaagaaaaaaaaactattcctttgtaatgttttccttcaaaatctaactacaggatgaaagctttatctttttcctgaaagaggccagccataagattcacaccaagaaatagtgtaagacagaatgcactaatcaaatctatatctactgattctgccattcattcattcatccatttgtactcatttgttgaatattttcatttaataaagagttatacaggcaaggaataaaaatacaattttctgactcagaacatttagaatactgtggtggcgcatgcaatccagtttcttttgggtttggagaaggcatctatcattttatgcattaatcttttacccatgtattaagtgttcacactgtatattcaaggttgcatccccagggcctgccacagtacctagcatgtaagagacaaatatctggccaatcagtcagaaatgattccagccagtataatcagaaaaatagaagtaatttgataggaaaaataagtccaacactaccccatcatgctagacaaaacaaaagtaccttagagttttacaaaaacgtttccaaatgcaagggattgacagaaccaaagatgttctatgttctctgatacttcagctatcagctgattagaaaaggtatcaatttgaaaagcaacgagaagcattgtcatgttaacttttttggaaaatgtgactgctaccaccattcactgtaaggcaatttgtgctccttcatttttacaactaataaatggtgccagtgtttatttttctccttttccctttgatttcatttttttcatctcttcctatttcattcatggtgtcccaactcccagaggagctacctcaggaaaaaagatctcacatagcaagaaaagtccaaggagcaaatgctgtttgactctaaccaacataccgtagcaccttaggtccatgtataaatttagggaagagaattacatgctctcttccagttattattatatgattccataagtcaaagaaatctggaaatgtttctatgagtagaaatttgtgataaaggagatagtcttttttactctgctaaaatattttttggtacaaggaaggtgccctgtatataactgttgatttaatttgagatatcatgagccctgacacttgacttttagttctccaatttaagttactaagctgcctacattcgatcaggataatttgccatataatcatgaatgggtaggggaaattggcagcttttaacggttctcaaaggtaattcctaagagaggtgagttggaactgatgaaattgagatagatgctaagtgaccaggcatccctgctttgaattgtgaaattgaacttcaatgtgtaacaaatgcaggccttctatgagcagcaagttgctttttccactactgagcatggaaggagcatgaatgttggagctgaacagactggtcttaaatcccagctctgccacttactagctgtgtaaccctgggcaagttccccaacttctctggatttctttcgatgtaaaagtgaagttatttacacctattttgcatgagtattacatgtattaaattatctagacctagataggcatactatctagcacagtagctggtatatggaagatattatcatgaatatttattacatagatacaaccagctttcaaaatgaatggctcttgtagacattttcacattattctcaccgcaatatggaaattaaactttattcctagcactggactccctaatctttagagacaaacacacccttcacagagaaagtacaagtttctcacctaaattcacacatccatgtttaaatattctataaacagagaagattatatgtttgataggacagcgcttgtaaaagcacctcaaaaaatcacattatcagtatattgaaaatacaaggagcatctcttctctctagctacacgatgtaatcaagcatttgtcaaatcatatttggaggctctttgaattatgtgctccagttcccttttaggtaaagagaaggaaaccctaaattggcatggtcaggtgtgggtcagatgtacagtaccaaattactgcactgcactgttcaggagggacttaggagtatatcccagtttcctggctctccatccagttggcgtcttgctccttctactcctcctagtttcatgtttgggtatggggcagataaaaataacagcgggaataatttactacttttcccaagtttcttatacataacttgactttttaaattcttccctatgtcttactgaaattttaagtaaggcctttgaaaaatactagggaatgatgccgtcactcacagctgccagactggagagcactcagtggctggtgcaaagcccagtaaaatccaaccaaagaacacaagtgcagaaacaggacaagaattttgctaattgtcttctttgagaactaggagcttcattagagaatttgcctttgtgcatgtatttaatgagatgggatatgctgctgaactcttcctgcaggtatttcagtgttttatttagttatgatattgcctaatgacctctttttttggtccactattcagacatttttgggtcatttaaaaagttgttataaataaacatcacttacataacatttagatttctaagtgattaaacatatcctctcttggatagctttcctcttgccagccttgcatttacagtctgtctcactcaattctgacatatttcattgcagttgttatcacgcctctgccatctgggtttgtccttttccttcccgcacacctctgcaatccccgcctgccctcttcccttcgttatcattgcttagatgcctactaattaaggacaagaaagaaacctattcaacataaatataccttttatcatcatgcgaacttacacagatgtagctttttaaacagttcagaagacaaacttttcttgatgatttggtgtcatttttatgagcacgagggctggaaacacagtagtgatctcaaagagtattgctgactattctccataggtacccaagttgctcgtttactttttagtctatgaaagctcaatctagcttttgtcttttgtcagcctttatagacctctttcttccttccaatttgccccttcggatctgctttgagctggaaatccagataatcaaagttctccgtcctgagaaatgagaaattggctataaggtaaaggatatcagagaggttctcaaatgagaaagcccaggtgcatgagagcactcagtcaaggctcatggcttaaaatacacaagacctgttagtttcttccaaatgcaaagttcttcgtgaaggtagtatatttatttctaagcgaatctcagtaatattttcactatgataattttcaaatgggcttttcttattttattgagtccaagcatccttattgaaacaagattccacatttctaaatttctattttccaagatctattcaaacagaagccaagcctccttttgtgttccactgagttggctgggagggagggaaatgaagatgaagtaatataataagaaaggtggctgtcttactgtcattgactgctttgctacctgaaaaactcgaaggtacactggtttatatttttacgtagaacctgatgcagccatgcaggcatccagctgtatctatccagagtgggtgattcacctggtgtaccctgaagagacagagaaatgctcttcacggtagcatctttttggtttcctaggaccagttgtttgcttgacaaattgagaagccctggtacaggttatgggatcttacaatgctgctttccagtgatctgctgcatgggcattggagtcagacttacccaagtttaaatctggactgtactatttagagctggtagaacttgtgtgatttatttaacctctcatttgtaaatgggagggatgcactgccaatctatgcagtagttgtagggattaagaaaatcatgacagatgatatacttaacactgttcctggtgcgtgataaattcaaaataaatattggctattatcaccttcattattattttataagacatacatatgttacctccagcatgctgaaaataacgtttcttaataaagtaggcaaaaccccagtatcctaacattcacaagaggtagacaatccacttttgtccttgcctagcatattgtgaagtggaaggggaaaaagccaaacagtgcatgaagaatgcaaatgtattttttttcctgaatgttctcttttgctttttgacttttaaactctactttatttcaaaacacagtcccaaccattccaaagcatttttgaattggaaagccttctttttttgtttcataataagctaactgcaggtgcaaactcaagggagacagaccttggaaattttaagtatgttgccatggcaatggtttgcaagaatgtgtatgagtttcatcttagctttcaagcattcaactgagttcatacgtggaggttcaaatcactaggcacacaatgtttgccactcattgtgtcctgaaaggtttggaaataactatctgtgttgcttatagcaaccagaaaccacaaaattctatttatttatttatttatgcaaatgtagagatctagtcattcatatctgctcttaggtggcctatctcaccagtgtggctgctctaagagaagctgtacacataatttcaacactaatcattttcaccattgttgcaaacacagttgtactcccaatatggagtagctataaaaatgttccactgaatatcacattaatttcctcattcaaatttgacagatccttccagaagcatgataattatttaaagatgttgcattaaagcaaaatttcagtctaatgaattgtggagtatttccttaaaagtgtctcatcctatagtggaagaaagaaagtgaaagcacacaatccagtcattaaattaacaccaccctccccagaaaaagcaccagcaccggcactgccaacaaaaagacatgcaaaaaacatcattttatcacatattactaccccagtggttcttaaatggttcagctaatgcttctaaattccaaaacctgcacactgaactcatgcttcattgacagaggaggcaatggttcttgacaaaagcattcttttccccataaatggaatccatagcatactataattgggtaagttttaaagctatctattgggtacgggaaataattattaacaaattctcttcaaattacaaggctttttttcatgtaaaatgagtactaaacaaataatatcatttttaattaaataaatgatttatttaattaaaatccagcaagaaaaagctggatttctaggggtgtatgttcttcatgttttctagcgaaaacttgctgcaaatgattcatcatgatacagcagaatgccctacataaaaacatggccacaggagaccccagtatctcctgcattttgttactgactgaacccttcacaaacgcattattagctaccaaaccctggcagctatttaaaattcgcattgttgctttaactttgacccatcttccaaaatgcctgcgcacgcatgcacacacacacacacacacacacacacatcaatctctcaatctcccgtcctccttgttgtaacattttgttgacgtacttcaaaactgcagtagagcttccctgccctgaccctccattctaagaagcttacagcaatgctggaattaaacaaatgagaacacaataattagctatgcaaactgtcaactagatctaaaaagaaaaacaacccagaaaacacaacaatcagcagtttcaagccctaacaagaatctgcattgaattctcatttattttaaacaaaaatagattaggccttttgaaaaatattcagtgaaatttctatggaaataggacaaattagcctataggtctttacatctctaatttctgtgttgctgatacagtagaaaagtccaacactctttccaaataaatgctcttctactctttaatagccagatttacttccaaaggtgagtagcaccaaaaatatttccaaagtggatatgaaacaggttagtggatcaaattatatggtgtgacaccgcagttcccaactctgtccccacaacctcaccctaatcattttatcaatggtaattaaaatataaagggaaactgtaagggaaaaataattcttgaaatatatggtgtggctgggtatggtggcacacacctctagtcccagccacctggaggaggccgaggcaggagggtcacttgagtccagcctgggcaacatagtgagaccctaacactaaaaaaaagaaaaaagaaaaatatctggtgtgtttgtggtatatgaaggggagggaataggtattcaattctttgggtggagagtattgattatataatttgtagctaaatctctcagtttcttcatagataccaatcaactgcctcctcacccttcgggaaccatcctgagttctgatgaagcaacatggattatctctatgatacagacactttgaatgaatactaatctaatgcttcaattgactgttaaatgttctcttaacccatttgcatcccgtaatagaaatttggatttttttaaattgagaattgtaatgactctgtaaaagttttgttgcttcaagtcttttatctttaaacttgctgaataactgcctactttataaattgagaatgtaatatgtaatgcctgaaactagtgtaggacaagaaatagtaatctaagttttgactaagagttctatgtaacccattgacctggggcaaatcactcctcatcctaatataagtaggttagagtagatgacctttcatatttcccatgcaatgatggagagtaacacaagggagtcctgtggtaacggtagagggtaatatcttgattgtggtggtggttacaagaagctacacatgtgataaaactgcatagaggccggacacggtggctcatgaggtcaggagatcaagaccatcctggctaacacggtgaaacctcgtctttactaaaaatacaaaaattagccgggggtggtggcatgcacctgtagtcccagctactcaggagcgtcaggcaggaggagcccttgagcccaggatatggagacagcagtgagctatgatcatgcaactgcactcagcctgggcaacaaattgagagcctgcctctaaataaataaataaataaataaataaataaaatgaaaacaaaatacaaataaaatgaaactgacaaaataaaacaggaaatatcacggattcactaaaaattaaatatccatatttatatcccgaggatgctgccatttctgcccagttagctacccctacaatgtgtaatcttatttttcaatcctcaaatcctgcagaatccttatttatctgataattcaattgtgctcaatatgcttccttttaacgtcacagaattcggtgaattttcctgacttccatgtggtcgaaaaataatggctggtgacttagaaattttactgctatgtattggcttcaaaatttgtctttcaagtgacaggaatggggcagaaaaagacagtagatgccactagcagagttctggtgtaggcaaagtagaagaaaagaggcaaaacaaacaggaaataactaagcaagagaatgagcagaaggaaggagaaaagctaagaaaagagttcctccacctatgtttgggcggtggcagagtgtctctgtccattttacaagtgacatctatgatacagctatttcatatttaggaaagtagaatgaatcacgcaatgagatgtgaaataagtcttgattacagtattctagaaaggggcttaaaagaagcaaaagactttactcctggtaaacaccaaaccttcagacacagaacagaaatgtgccgttagaagatccctctcacccccatcctttaacatctttcaccaaacaaaacagggtaaaacaaactcaggcagtttctcaattactttcattaaaatgtctatgaacggtgaattaaatgacgaatctctttcagaacccattaatactttttccagagctaatactatcagtaaattttaaatagtgggaggaattattataaaagaataaaatatgtaacagatgctgaatcggtcatatgtcccagagctgctgtaacatacccaggcccgtacttcatgtgtccataacgaaaagagctggctgagaagttatgaggccacacctcacaacacctcaccctgctctctccctagtcccacagaggcacaatgcttctaaagctttgaagcctgaagttcagggaatgctttaaagatgaagtgtttaagctattttctggaagccaaatctatcattttaagattacattaaaagctacacttctactgttcatatcaatttacgctccaaactgctggtttctcagagcatccattgaatcctggtgggaggtaaatagtttctgtttagattttgacagaaaattaaaatttaaaacataatcactacatcttccatatactaagaagtcttcggtggctcatgctgtaatcccagcactttgggaggctgaggtggatggattacctgaggtcaggagttcgagaccagactggcaacatggtgaaaccccgcctctactaaaaatacaaaaaattaatcgggtgtggtggcgcacacctgtaatgccagctactcgggaggctgaggcgggaaaattgcttgaactagggaggtggaggttgcggtgagccgagatcacgccattgcacttcagcaaaaaagccaggcctggtggctcacatctgtaatcccagcactttgggaggctaaggcaggtggattgcctgaggtcaggagttcgagaccagcctggccaacatggtgaaaccatgtctctactaaaaatacgaaaaattagctggacatggtggcgggcacctgtaatcccagctactagggaggctgaggtgggagaatcacttgaacccaggaggtggaggttgcagtgaaccaagattgtgccattgcactccagcctgggcaacaaaagcaaaagtccatctcaaaaaataaaaaataataaagtcttgaaatgataaatgtaaaagttctttattttattttttgagacgagggtctcactctgtcacccagggtggagtgcagtggtgcaatatcagatcactgcaacctctgtctcctgggctcaagtgattctcccccttcaggcccctgacaggtgcaggtgcacaccaccacacctagctattttttgtatttttggtagagacagggtttcaccacgtttcccaggctggtctcaaactcctgagctccaatgatccacctgccttggcctcccaaagtgctgggattacaggcatgagccactatgtccggtttcaaagttctaattacgtttccttgtgtctaagaaaaaattttttctgcctaaggtttctaattattatagacaccagcaggctataaatatgtatatatattttgagacagagtgtgcctccgtctcccaggctggagtgtaatggctccatctcggctcactgcaacctccgcctcccaagttcaaacaattatcttgcctcagcctcccaagtagctgggtttacaggtgcccaccaccacgcccagctaattttttgtatttttagtagagacggggtttcaccatgttggccaggctggtctcgaactcctgacctcaggcgatccaccctccttggcctcccaaagtgctgggattacaggtgtgagccactgcgcccagcctaggtttttatatataaattgtgaacagtcataaaaataatttgtcctacacaagtttttgtgcctactatagactttcacactgatagaaaaaaaaatgcttacaaagcctttttctcagaggatctcatttggcagttttgaaatttacttttccacaaatctttatcagtggtaagaatgtttctgaggctgtgctgtcaatcacttatgtcaccactttccttcccacttcattaggaaccacactgtactttatttcttaaaggagaatctgaaactgatttggggaagaaggacttttagtccagagtatgcagcattgtataaaatatgtattgatataaagcctaaaaatacacacagtaggtacagcattcacatacgcaattatttagcaggttcagctggtgtgattttacaccacagtgttcttcttacgaataccagagagaaaatcaaagtttcttgacatatggtaataaatattttcacttacagtaaataatttttgctcttttggcatccattgtataaaagctagtttgaaatcattccaaattagcaaagctagaagtttggtaacacaaggggaacgagcagtataggcccccataccttcgttttcactgaagtgtgcttgcttttgagatacaacactgagaaaacttcctcattttcaagatgaagagatgttatttcttcctattgtgtttctaggactcgaaatgagcatctgtattcttcattatggaaatggaaaatgagtttgccctataattaatgctagacatgacaatttttctggcactaccttcaaaataaaaattttcaatatgaaaatctcataagaaaatctcagatgcagattcatctcaaaatccaggtgacataattcaacaaaatgaaaagcagcctgtttataagaccaattttctttaaagcatttcttttttttttttaaggaaacacatttattcacactctaaaatcatgaaatgttagacctgcgaactcctcaccttacaaacaagaaaatcaggtatcagatgattaagccattaagtcttcaccagtagatacagaactttctccagtacaatgtcttcacataaatcaattaaaagaaaatgctctaaaattagataagctccaaagagtaatctgttcacactgggacatgttgaatttgaggtgaactgatagcagttgtaagggtaaatctgaagttgagaagagaattctgggctggggatcatatagatttcccaacgaaaccaaaagagaaaaggagattctgagaccaccttcagaaaaatccaacatttaaaagggtagaaagaaaaagcaggtacaaacaaagaactgctttcctgttaattgtttttactcctaaaatatttgattgaatgtttccaagtggaaatctgaggagcccagtgaagaggattctcttaggcaattggtggattctcttaggcaattgatcgaacccagtgataaatttcccaaagtagtcttatgacacacagtgcatctatgacacaaaaactgtaaagtaaatcacttttcaaaagtaattcaccttaaaaattgattaaaattaactgaatgttaatttcttagtattgacagatatacaacggttatatgacatattcacattagggaaaaatgaacaaaaagaactctctaaaatatgtttatgacatttctagaatctcaaattattctgaattaaaatatttatttttaaaataaagcatgctgatctgattaactcccatatattacatataaaatgacaaagctgtgatatttataaatacattctcttttaaaaaatgatggagatacattcaacaaagaaaaatacaaccacaaccaaaacaagcaacctacaaattcctccccacttttgttacgtttatagacataaaacatgcattatccttgtttgaatggcatgtctttgaaaatgtcctcccattttagagtttcaaataaaacaagcatatacttttctacttaatctcatcaatttaaaccttcatatcttttcttaaagtactgcaaagagtagatgcatcatttagggattgctaggtagagtgaaataggctggagtcagtatttattttgttattgcaggagtagccttctgtttaaaatgacaccttctcttgcaattgaaatcttactggctatgtggaaaactagaaagtcaggaatctagaaaacacttgttgcagtggatgtcttaagaagtgtcctcagcttccttttctctagcctgaggttttgtaaagcaatcaagagctattcagtttaatgttttatacctaggtatcatttcagtcagttttaatgaatggttcacaaaatatcccataattcttcaccatattttaagctgcttactgagaaaataatactattgatgaccattccagtatcaagagtaaatggtttacataattattattacttattcaaaattgtttcacctaaggccagattctcatttactgcccagacccactcacactcacctacccactccatcccaccaaaaaaaaaaaaagaaaattaagagctggcgaaggaagtagaataaggcaaacaaagaattattgctacagcaatttataagaacgctcaattataccctaagggtctgagacagttatgcagttatgccaaagtgtccaatttactttttctgaagaaaaacacttagcaacaatggctaattttaatgaataaagagaatgaatacaaactaaatatgcagatgacttttaaacaaaaagttgcatccattttgcattacttttatatttcataaagcatgaaaccggcttttaagaaatcagtatgttgtcctgagaacatgtagaacaataggaaacaacccccttgactgattttgagacaagctacttgggtcctctctggatattctagtaccctcggtgtccgtaatgccattttagaagcaggtattgatattaagggatgtgtagcctacctgatttgacctgattttgtgttaccttttatttcgtgactggataactagtgctgctcaaacacaggaaacatacagcgaaataacatgaatgtatctccttgaaccacattaaactctcctttctccaagctaccttgaaatatatagaatacaatgagcaaatatattgacaagacaatgagcaaatatatattaagtaatgctatagggtaaaatagttaggccttcagtgctcctctagttttatgcctatttgtcttgaatcctcaattgaacttttaaggcagcaagtgtctcatttttctttgcataacccatgacatctagcagtgttctggcatagatacaatcatgcagtacatattttaacagatcttaactaacaatgtacaaaagcactgagaggggtgcttagtaattacttatatattttaattttcaacattctggaaagagatagtaaaattcctaaaggctaagaaacctcttggcaagtccaacagtagcttatccccggccaaatttttggcttgctatatgtacttttaagcctattagttaatagctacatgtttaacaatgttttacatagacacacattttatacaaatgttgtagtcccactacaaatctaaagagtagatgatccactcaaatctagctgtgctaatggagggatgcatggtatataattaaaacaatgattttgaagccaatggagggtaactggtccaaaaagcacatctaatcatgcaaaataattcattatgtagacagttcatacatggaaaattgagaattgactcccaaggctgtacatatgcaacttctaaataaagtgctttaaaaaaatcaaaattctatgtaaaaggtttgatctgacaataaaatggttttgaagtcataatggcagccttagttttatatatgtaattacaccttattataaatacattttattacatatatataatctatacatttgcatataaagtatttttttcattataggtaaattcatttcactggacgactgattaggaaagaattttgtctttgatatactctcccatccgagtactaaccaggatcaactctgcttagcttctgagatcagatgagaatgggtgcattcagggtggtatggccgtagactgatatactcctgtagagttttcaacttgaacgatgttaagtcagccaggtaatggcatttccccatactgttaagccttcactgtatccatgactttactaataaatttaggctgtgaacttatgtaatcatgttttccatcaaaaatctgaaataggcttagagccaagatggtggaaccctacaagactcattacattttaataaaaaagcagggggaacaaaggtgagagcacaaagactgcagaactaatttctttcgggaactgacttattttggctccccaaaataatattcaagtcattcccaccatgataaatagtttttgtctttcaaagtaatgaataaagtaatggagactttataacaaaaggctatacattatagtcatgggaaaatagtaaaacaagtatttgaatgttttttattcccaagaagatgaattgtggcttaacccacagatcaaaaaatatatagcacaacactgaaaaaaattatcattgatttttgggaaatctgagctagttacttatgattaatcaaatgaattaaaataaaggtgaaaatttgaggagcaaatggaaacgggtagtgataatacacatagtttatgatgcaaaaatataaactatctctcatatatttctgctttttaatagttgttactcagtttgaactcatattgtctttaatgtgccaaaagaccctagatatatccatgaatgtataattgtctgtgactctctccaatttttctgtatactggaaattgcctacctactccacaatattgtccttagctccattctctatgctagagtgatgagggaaggaggccttcaggagattcaaatatcagctgtcaagtaaatgtaaataagatagcagaaggtaaaatcagtctttctggtcaatactggtaactctagtgtaaattttaaaaacttaaatgctaaagaatgtataaatctaaacttagtgtcattatactatcttgaatttgcacaaagattattgtttatgtctttaataatctcaagttctgaagcaaatggatgccatttttttctatctattggtgtttgagtccataaaccacaggtaaagcaacagaggaataaaacactgggagcagggaaaatgggaggtaaaagagaagactaaataataaaaggcaccacttgatctaagtatgattaaatattcattaacgctgttcagctgtggattttggtagtgctcataatactagaattaacagcactaattttgatagggtgaaatctcatttaaatgtcattttctaaatgggcagagtataagttcttaaatatttaaacttaatatagacaaaggcctaaagtacttggctacatgcttttttcccatttgaaaactaaaaagtgtcagctaagagggcttttcctatcaattagcattctggttactgaatccatcatatagttaattgattgcccttgtaccttatcaatgcacccagatgctgtggtatgaacacatttcataaattaaagaagcatatggaagtgacacagacagtagcatttcatcccagaacatctttaatatgcgatgctacatcactaattattttgtaaatatgtaagtatttccctagttaatgtgttggtgagaagtttgcttggcagttgagcccaaatgttattgtaaccagacatttaataacagttcaggactcttgtagtttcattccattctgcccataaggagaatgtgtctcttagcctactgggcaaccttgattgtgcaaagtcaatgaaaatatttatcctttattactgggtaattttccttaatgaacagcagtctactctccataatataaatatctgtccaaagatcggtctggagactctttctaaaaatgttacagggaatttgccaagtgaggagcatattgctgcttagtgaatttttttccattaatttctaaggatagaatatgaaggaaattgcagcagaaataagttggctttattcttcaactttgggaaaactagtataatgatctgagtatattatcctgaatttaccttaaggtaccaaaagtaaaaatttttttcttcttgtctaagtcataatttcttgtcaagccaagtttcaaaagttaagtcaaaagaactttttttgagaatggaaactttctttggagaatggaaattctctacattaattaatgtattaatacaaaatccactagataactgacaagtgagctgcgggcaacccaaaagattgcatttaaacattttaaatttgtgtttctgttacattttagaagcatgatttttgtcagattaatttgcacttaggactgaaaactgtatctgggttcaactagaattttgtaagagtcattaaaatcagaggattcagaaataagttgattttcatcctccttcagtcctatgacttttctgggcaaaaactgtgtccagttctctgggagctgggggtgacagagggcttgatggaggctgctgagagattaatttcatttcagaatttgaactgggtattggtcaggctccacgctgcatgataaaatcaacaaatacttaaataaaatattcaaaagttattctgtaaatggccatctattaaaaagtcagaaggaaaataatagtagattagtttgcatggctctaaacattttcagaattgaaaacttatttagggaaaaatttggtaagccctatagatgcttgaatcatccaaagtctagtaaataagtttagtattaattgccacttttatatttcgatgctactaactaaaataatacaatagcctactgttaatttctcttctgcttttcctgagcttggcaaagagaaaaatgtgacaaacaccacaaatagacaacacaccatttgtaatctggtaaagcaacttctattcatggaatttcttccctttatgaagcgagggctatctaatttaatgaaaatagttgtcaccacagatatgacattctgtctcctaattaaatgaagatgcaatcagaacttcccttgaaaagagaggccaggcttccttcactattaagcacactcttccctaagggcaccctcctaccctttttctgatatgcaatcccttctgtcctccatctgctccacccccacctattgtctccactcactccaagcatgccaatcccatctggctatactcttgcttctgctagctctaattctccacaggcctagggaatgtttgaatgccaaggcatttttgcttttctcgagaataaggactagctaggagggtatcaaacaattccccaaggaattcacacacacatgaacatgcacatggtctctcacatacacaaacagcagtttagaatcctcctctaggatataatttctttaaaaatgtttttaattatttcatctgggaggcattttagaaaattaaaatcttactattgttgaaataatcaaaattaatatttcagaaataaacactttcattatcccagacacgcatttttttcagtaagcagaattaatgtaagtaaatgttactcatatcttatcatgaaatatttacattaatcaggtttaatcactgatcactaatacgttttctgttttagcaaacatgcatttaattcagacattccatctttacaaatgctcatgaaaatcccactctgccacaaaagcatgcatggtcagaatctaagcatatttaagcaaaaatttcagcaagtcattaacaataataaagcagtctggcaagtactgaaagcagcttttattcatgcttttacttgaactaagttaatacatatatacatacatatgcacacacacacacacacacacacagacacaagttttggttgtttttgccacaagcatgctgataaacccctgaagctcacacaaagcagcagacaaaactagaagcaaccatgctcagggtttaaggacattttaaaatttaaaacaacctttccacatttcacatacagcgtgcataaatttgacatgcaatcttcaagaagaaatattttaacataaatcttaaaattagtttatccaaatgagtttattcttattttcattattattgtttttaggcttctggtatcttaaaccctgcatgctgcagatctaagctgtgctcagcagcggctgtgacagaagaagctacctgcaagttttcacagtgccatctcatatccatgtctgtctggctaccctgcgtgcttagagcttttttcttaattcttaatggaaatcctaggaaatttagtccatcctctgaaatcaatactggtgacaggagagctccctgactcagtgggagatcaagatgataaattgcctgcgcatcagcccggcctatcagtgccctgcacacagatgggcgagaaaagacacagaaaacgctctgtcagtcacgtgtcactgaggagccaatggctgacgcactacggcaggaagggatgctgcagttccgtctgcagttgacgaggctgttggtacacagcccagcccggcaccactcaaaaagtctcagcagtcgttgcttttcaatttgctcccctaacgagaccgcataggtaaacagacctccctctaacccccgaccgaaaaaaaggcttattttcatgcacgaacattttctgtatattacattcaaatccagtgtgattgctaaacacagaggggaaacttttttttccccagcccttaaactgttatgtgtttttcttgagataattatctttttacctaatattaaattagaagacttaaaactgtgcaattagcatggaaccctcctagtagaatctcctcgaagccttgtaattgtaattacaattttatttgtaagttaatgaatgacattttttgaatgccaagtttataatgagtatttttatgggatgagtttgtaaagacaattatgcaacattaagaaatacattcttaggcttttttttttttggccaattacaactgttgctctttaaagacaatttaagtcccaataaatatgccattttatcaatcattaaaaataaaaacaagcaccaaaagatgcacatcctgtttcccaaagcctgaagaacaaatgtattattcaatgatgaaaatatgtacttatttgctgccttttctctgaaatttacaataattatttggtaagcaaagactacacatctggaataccatatggaactatatccccaaatacatctgtttccagtgatcatactgtaataacagatatgtttacacacttcttcaatgtgagatgattatatatagttatatatacatatacatacaattatatattatatatatgattatatacagtctgacagggtaggctataagtgatgagaccggtgtgtgtttcaaatgacagtatcacggagattttttttttaaagctcaaaagtagcataaaacaatcttcaggaataaaatttctagaagaaaaattaccctagccaccctggcacttttattgcttttcattgcccagttttcatactattcatacatttgaaagaattaattctaacatcttttagagtctggcaacactatttagaaaaaaagtgtattggaataaacattgataggtgtgcctcataagtaaagcttatgagttgtagaatgctgaaattccaaagctcaatttgtcttggcaactatttttttaaactaaacacattcctgaaagattgaaccctgtcaagtttttttgcaaattctttctttcattcaatattgactatcaggaaataataaagcatttttcaagttttttaaaatagatgttgtcatgtgtttttttctatttattcagactattcaataataacgtaattctcaacaaactttattcttaaaaaatattatgactcagagcacctgtcattaaaaacaaaataataataaaacatcaacactaaacctattcattagagcactgtaatagccccaaactagaaaccaccttaatcactgatagtaaactgagtagataaactatgatacagccttacaggtgaaatactcttcatctgtaaaatacaatgtggtaaatcatatgtccttatatgaagagatttctcagatacatttgaatgaaaaagccataaaatttaaattgtgtataggctatacttacttacataatacatgcatgtatacacacacaaatgattgcatatgcggaagaatttttttttttttttttttttttgagatggagtcttgctctgtcacccaggctggagtgcagtggtgggatctagactcactgcaacctctgcctctcaggttcaagtgattcttctgcctcagcctcctgagtagatgggattacaggagagtgccaccacgcccagctaatttttttttttttttgtatttttagtagagatggggttacaccatgttggcctggtgggtctcaaactcctgatctcgagtgatccgcccaccttggcctcccaaagtaccaggattatagaggcatgagccaccctgcccgacctacaggaaatttctgtaaggacataaactatcagttaatagtggccaaatagtggctacatctgaggagactgagttcaaaggtaggactgagacatagttttattaggtatcattttatacattttgtttaagtctatggtttacttttctaatttaaaatgaattaagataatgttatcgatgttcatgtaggtttagaagagcatgactggtatgttttgagggaaaatcttgagggaaaggaaggaagacagagggaaggacatgtggcctgctttttttcatgtaaagaaaatagtgtaggtgtgggcaagaagggaactgtaaaataaaggttctggcaatctctgctgaagaccttcacatctcatatcaacttgaagttcttttatctatgaatgcaaataataatacagacatggattaagagctttacaatttagagtgacgattaacccaaattttgtctgattcttccaggaacgaatgtaaaaggctgagaagtaaatgatttgtatatttacccagacatgggcaaattaacctcttcaagccttagttttctcagctggatgcaattagcaaaaagtggccaagctaaacttgaatttcaatttagggtattgttcactgctgcttcaaaggcaaaataacatccatgtttttaccaataatggtgtagggctaaagacaaaacaaattttcacgtgtttcctccccagaagcagcttatgttgtccaaaactgaaaacttggcttatagattctattgttggctcttgttgttattcagattcttgtaactttaagagatacaaacctaaaaaaaaaatgaattggccaaattaagtcaaagattacaatttgaataatttaagggttttggggttttacataaaagtgctgtaaatcagtggtttcggatggtgattttgctccatcccaccccccagggaacatttgacaatgtttggtgacatttctggttgtcaaaactggagggtgctagcagcatccagtggatagtggccaagaatgctgctaatcattctataatgtacaggacagtccctatcacaaataattatttggacccaaatgtcaacagtgctgagatagagaaaccatgttctaaatgctaaacttttctaccttctttccgaaagattaaataaatatattctgtattatgaagcatatattgtaacgtgacaagatttagatggagaagagaaggggaccaaggaccaagccctgggtttctccaattttaataagttacagaaaacaggaaaaaacagcaagtgaggatgaagagatgggaggacaactcaaaggatggtgacctggaagtcagtggtaaaagtgtgttagtaaagagattagggtcaatttgttcaaatgctgtgataggtcaagttatctgttcttcataggttttttaaaagaattaaagtgagaaattaacctaattgaaattaacagtatacttgaagtctttattgctctgcatgatatttgcatttttaaaggtatggacagaaaatgtagcggggcggtggctcacctgtaatcccagcactttgggatgctgagtcgagtggatcacgaggtcaggagattgacaccatcctggccaacatggtgaaaccctgtctctactaaaaacacaaaaattagctaggcgtggtggcaggtgcctgtaatcccagctacttgggaggcagagccaggagaatcgcttgaaccagggagtcagaggttgcagtgagctgagattgcaccaccgcactccagcctggtgacagagcgagactccatcccccacaaaaaagaaaatgtagtaattacagggatcacaggaggactagctgaggaaatatataaaggagaggaaacttctgtaactctcaaattataattctgaggctactttctctacaaaggtgggcttgtgagcaagaaagtgaacaaatcctatcttggaccaccctacaccacagcttgcatgggagacagagtgccaccctctccccttagaaactatgtctgcagttcttgtcctcgggctctcacgaagtgtctctatccatagataaggtttctgaaaacagagttctaaggactaacttcaggtgcttttcctcctgggactcctctaatgctaatccccacactgtcaggcctgtggtgttcagggttagtgcagcaaggctcaaagacagagccagctggaggactaggacactggagcagctttaagcaaagctaatgcctttgttgcaaaggaaatgttagaaatctcacagaaaaacagctgggggagggagggcagaggagagagagagagatagccataaaaagaaaagagaggccacaaaaaaaaaaaaaaaaagatgaccacaaacccatggatattattacaaactctatggtgtgggagaaaactacatgtcacaattctcttaaaactagatagatttttacaaattgaatagtccaactccttcgttttagagatggattttaatgtagagaggttaaataatttgttttaaattttaagtgaaagtgacattctttaccattcaaagcaatcagtgaacctgatattgacaaatttcaaggtgctttcaaaaatcatcatagataacaaccagggtaagacttaggggaaggaggtcgggtgcgggggctcatgcctgtaatcccagttctttgggaggccgaagcaggtggatcacaagatcaggagttcgagaccagcctggccaacatggtgaaaccctgtctctactaaaaattccaaaattagccaggcgtggtggcatgcacctgtaatctcagctacttgagaggctgaggcaggataatgccttgaacccaggaggtggaggttgcagtaagccaagatcatgccactgcactccagcctgggtgacagaacaagactcaaaaaaacaaagaaacaaaaacttagagggaggggaaaagttgatgttcagtaagagataaatctccaaagccttctctttcccatgctgatgctgtattaaggcacggagagcctttgctatcagggagaggaagtattatcttccaaaatattccaatgagtatttataggttatgaaatacaaaagaagaagccttgagtattctcctttcagaagaatttaagtggctgctgaagttttttttaaatgaaaattctcatctctatttgcactacagtcatgatgaataggatgcatggatgactttcaaaagacatatgtcagaaagtaaactccagttgacaggaactatagcatagggaaatattttggactgttttcagtttttaagagatgggaaaaatagaagtggtggaaaatccaagcagattgtcttagttttttattatttttcctttttctccttataattgaagcactactttgagactatggagtaccattaaattcctattaactattaatttaatatttgcaagtatggattagagataggatggaaattaatgtccaagtgagtaaaattccacatagtcttatattgtttttttggttttttttttctgctactgtattcttgtgggttttgtttttcttactctggttgtttatctaggtatatatgctttgtaaaaagcaaacagaaacaaaacatctgtggccccaggcaatcttttcattaacattatatcctaaaaattattatgctaatgttaaaaataaagaaattgggactcagagggattaaataacatatatatccatgaagctagcaactgaaagtctacgactacattttgaatgttctctccaaatcagaactagcgttccagaatagttgttgttaaagtttattatgcataagaaccaacaaggcacacgttaaacatccagatttctgggcccttccatggagactgattcctactctaactcagatggattccaagagtctgcattgttaacaaacattccatcttccatactttaagaaccttgggaccatattggagtttcagcttcggaattcttctttgggaaaagccatatcaacaagatttcaatgaatagaaatgggaagctttaaaaaaatagaaaggaaagttggtaggagtagttttttaccaagagagaaactggagcagagaatagcttcacagcagagaggaaaaatgcagatgacttagagccatccattaagggatagtttcccatattgagttagataaagtatgaagtattttagttgaaaatatttttgagcaaggaagattaatgtgcatagaagaaatgtacaaatcatagcatttagaataggatgacccttttgaacctacaaatagggcacttggctgaattggttcctacctccactgctgcaattagaaaccatgaatgtgcagatatacaggcaatgtcattttgtatatgctagaaaataatttattttcagaggggttttcatatgatgggtttctagacctctagagagaggtaaagtttcctttataagatgagaacctactgaagtcagatgaaaacctccccaattgcttgacaataaatcttcccagagaaaagtcctcagccatttcatgtgaaatgatgactcatgaaaatgaaatagtacactgtacagaaatcttgcaattctagtttttctcctagctgacttctaggttggaaagcttaaggtcaaagattagtggtgccaaaacatgctcattttaggctaatctctacatttcctactgccagtctctgaccagtttttaaattttctgagctttttggcatgctatgtatttctcttactttgacagaaggatgacatactattcactttgatccaacctcaagacccaaaggataaggttaataaggaactgaatctttcaggacaatgcagtttaccaaacagtagtcagtgactaaatatttttggtaactgattgatgaaagcactcatcaaaaaaccatagtccatggacaagtccatcagaagaaattaaggaaaattggaaaaaaggaagaatgaaggggagggagggaagagggaaaagaactaaaggaaaaatgaacataaaaccttacatgtagttgaggcacaacaatggactatacgagaaacttttggcttgtcagtgaatacagcttgtcaggcattatcaagtgtaaatcctcttcccccccacttttcccgctcttgataatgacccaagcaataatattttatgcaacaagaatgacttaaataagacacctatgaagaaggccacagatgacttcataaccctatgcatatgtacatacagaacccacatggagtgaatgttgcctattaacaaaactgtgaaatctgagttagaaacaaagctcagcttggactgaatatataaaaaaatcagtgaacagaagatattttcaaatggacacttacataaatacagcattccaagggaaaattccagcctcagatgcacttatttcatgaagactcaatattttatagcaatggttttccaaagttaagttgcttaagatctagggtgcttattaaaaatgcaaagtgtctggacccaccctgatctaaggaattataatttccagggatgagagtgaaaatctatatgtataacatgtactccaggtgatcctgacgtaggttgttttagactttatttgagacacacactctccaatgtacataaagtcaagaaccagattcttctccaaccatttcctgcagatagtcacaccagccttggacatgccgggtcatccaattcaattattaaacacaatgtctttcatttggagagatagaagattgataaatctagaaaaagattaggaatgatgagatgaatagattatcaatagatttcatgaaacaggttcgattcaatttgggccttgaatgatggtagagttaattattttggcaaaggcattgaggtataaaatgtttttctttaaaactgttagaatttattattaaaatgataaacttctttatcttttcagctggagggcttagcaatgcttccagcacatatgaaatcaccaataactcttagttgaattagtaaattacatgaccacaaaaaagtaaatctacttaaaaaaaacacacaaaatcccaccaccttgacaaaacttcatgatttttgttgatgatgctgttgttttgatttttatttcaaattcttcatttcttatttgtatagtttgaatagttatagtaataaagatataattttctttggttttataagttatataatggcacatacattttccatcttgatttagaatattcataattattctagtagcaaaagaataaataaaatggatgtattgtaatgtacatacctattctgtgttttttagataatggacgcatttctattctgcatttctgctttgtaaataacaattttcttcctttgtatttttttcataacataagtgaccataaatgagattactagactaaagacatagtgtttttatagatcttgaaacaatctgttaaactacttttcaaaagacttgttctaattttcacattgtctcaagcatgctatgttctataacatctttactggcatgaacatgctgtcttttctatctggggacgcccttttcccatttaaataaaaaatcttggtaaactcctacacattgttttgtactaagctcaaatgctattctttcttgcagcctttccaaatcctctaggaagagttagtcattatttccattgtgtttccatagtactttgtaataatactatttgggacacttattcaaatagctctgtgtttgttatagtttgtatatttcttttctttttcctagattattagcaactcaagggatgagccgctgtccacttcatctttggaacatcagcttctagcacaggggctggttatattagacattcaataaatgtttgttaagcaaatgaggaataaatgagtaaatgtcaatgtgatactcaagtcaaaatctgtggctgtatgttgggtaaaaatgctttctttccttaagtcttttataggtcatttagtactaggaacatttatatttttacgggtcttttaaattatatttttatacttttaatatttatatattttgtaggtctacatttttaatacctttgctgatgactttcaggcttagatagcacaattctatgatatgctgtgagtcagatctttgagtcctttagataatgacttttaggtattctggaatcagaaaatgtctttttctagttcatacagaaacaacttttgttaattaagtgttaggactagtaaataagattagaaaccacctgtggagaacacagcatgtacatggccccactgtagatggaataaatgttttaaaataactgctgataaattatttaacaaaatataatcaataattattctaacatatatcactgtgcattttgttgcattacatatattctctcattttctctctaccaaaactggtaagaaatacaaagactggacactgtggctccttcctgtactttgggaggctgaggcaggaggattacttgaggccaagagtttgagatcagcctgggcaatagagtgagatctcatttctactaaaattaaaaaaaaaattagctgggtgtggtaatacagcacctgtagtctcagctactcaggaagctgaagtgggaagatcacttgagcctaagaggctgaggctgcagtgagctgtgatcatggcactgcactccagtgcggtcaatagagtgagacctggtttcaaaaaattaagaaaaaaaaatcagaaaaagcaaatacagacaaagcaagtataccataaatgtaatttgaaagataagtaatctaacacacagaaatgtggctagcaagtggaaaaatcagaaccagaattcacatattttaagccacattttagccttcattctagtaaaatcactacacccaactgaattttgctaatttcaaactgagaaaatgagatctgacgtcgtataaactaaacaggtgttttaaaaacaaacagaaacttctctagcaataaaaactttttttccaaaataatgcttatgaataattcaatataaaaaacaatatcagaggactcatattgaagtgagtggccagtgaaggggggctcctttctctcctcttttatggctcttggtagttcctagagcttgcactcaggaaagcactgtattgggccatttctttacttagtcattcagtcattaatacatcttacagcctaactaggtacaaagaattgtgggaaagataaatacaagacaaagtcctttgagaacacacaaacacacacacacacacacacacacacacacgatagtatattataaatgccacagaagttatattgcatagtagtaagcattctgaaagttcagagaagaatgatgtctagtcccataccctggattgagttccacatgtccacctaaggacacacagattttgtttcttatttggtgacttggtacaaaccatttaatctgcctatttgggcatccattcctgagaaataaaagtgatcaatgttgccaatccaatgcatgtaatatgtgactatagggagagaataacttagtggagagaatggggcagtgaaatcagacagatctggttttacagctttggcacttagattgagctagttagttcaacttctctaagtcacagctgtttcacccataaaatgagagtaacagcaatatataccttttgaaaatttccataaggtatcaataagataaaatataacacctagcagagaaactagcatagattcaatggtcaataaatagcagaaatccttattaactattaagatgaagaagttacatctaggatttgcatagactattttgattctacgattcaataaattttatttttgacataactcattcaccgtggaagaaattagtgttctatatttaatgaagaccaaagactttggcttggtaaatactattcttagaattttcctccttttcaagctgtatagattcatgtgaagcctggaaaagacgctactatgttttattttgcaatgcactagattttgcttgtactctttagaaaatgttaggctttatttcagtcgtcatttgtgcataaactctagtcagatcaagcaaaaacaatgaagtcattagtgtgcactgagtttagtcacttctttaaatgctacattaattgctttgagattctctacttccactgtgacaagcaagacaaatggagtttacctgcaggacacatcaccagtcaccttcccagcaagctggctacaacctcatctgctccttttcacttaagaaggcatactgtcatgcaaatgagtgagaatgataacacagacaaaatcttgaatctacattgcttgatatttacaacaaaaaaaaaatattcactcactttggaagttaaaccattattagtaatactgacaacacatttcacattcgatggggccataccaatatgtaacaatttatggtacagaatcacttcatggtatgacccaaggaaatgtacttcatttgtggaataattaaaagtccatcctttctgtgaagaaaatgctttatactctgaagaccactatcatgaattaaaaaatccagtatcacaaattgtagacaacctaaaagaatgttaacttaataatatgtgacttcgatctaaatgaagtgataaattggccagaaactcagatgccacagggcacatatgttacataaataatcacataaataatctagcatttctctaaagcagcgattctcaattttggtcttagatcttattgtcactgttaaaaataattgaaaactccaaagacatacatattgtttatgtagattacatatgtggatatttactctattagaaattaaaggtgataaaagttaaatatttaactgatttaaaaataacaataaacccattaacataaatttaaaaaggaactacattttcaaaaacatacattttaaagaaaataatactgttttacatttttgcagatcttttcaatatcttttaaattagaagactggggctcatatttgcttctgcaatctattgcaatatttcatgtcatgtagtctttaaaaaattccactgtatccttatgaaacaatgagaatgaaaagggtaaagttttttctttttttgttgacatataataactacatatttatgagatacagagtgatattttgatacatgcatacaacatgtaataatcaaataagtgtaattagcatatccataatctcacacatttatcatgtctttgttttgggaacactcaaagtcctctcttctagctttttgaaaatatacattaggttgggcatggtcactcacacctataatttcagcactttgggaggccaaggcaggtggattgcttgagcccaggagtttgagaccagcctgggcaacatggcaaaaccccatctctacaaaaaatacaaaaaattagccaggtggggtggtgcacacctgcagttccagttacttgggaggctgaagtgggaggaccacctaagctgggcaggttgaggctgcagtgagccactgcgttccagcttggctgacagagtgagaaaaaaaaaagaaaatatacattaaattattattaaccatatttaccctgcagtactatagaacactaggacttattcctccttatctaactgtaattttgtatctgttagccaacttctccctattcttacttccccctttacctttcccagcctacaattctgctctctatttcaatgagctaaatttctcttagctcccacatatgagtgagaacatgcagtaaaattttagtattattttgaaaataattttgacctcactgaaaaggtcttacaacactcctttcccctgtcctaagccttggcctcccaagacttctagatcatattttgagaaacactgctctgtttttataatatttagagcatatattatttattattttttgtgtctaatttacatatatgtcctattgttgtttccctatttgaaattttcctgatggagatcatcattacaaaccttaggtatcactttacagcatgtggtaagcctgcctggaaccacagtgtacctcaacatgtaatattgattcaatgacccattgatagattgaagcctatagtgtcttatggtccctttaatgacctttaaaatatgtgatatagtagtatttttatagtttgtcaaattttgagcccattatgtcaacattctacctaaatagaaggatgagctaatcatacataaatttattctagatgaaacaacgtttttttttttttgactcagctgtgacttttggaaaagaaactagaattctagagaagttattattatacatttttttcctataaaatttatcctaacatatcaggcaatattttaaggtctaatcaatttatatatttagttgtaatttcacaattacaaaacaattgaaagcaaaaatatgaaaatcatcagtttgaattgatttgaagctatagtttcctatgtctatgagtggaacaaaaaaagtaacaaatattacttttatgtgttctactgccaaatcagatcctttgaaaggcacccacttagtaacttggaaatgaaacatttatacattcatccctgctaaattgctgcaaaatgtgatggttgggaaatatatattaaagagtgaaacagtcctcctaaattaaaggttttcttacataataaataatttctttgactctttgaaaatggttccattatctcctgatctaggaaacccacagagaaagacttagtgtctgccattaccttggtaatcagataattattctgactattctatcagaaaaaaaaaaaactgtacatactgaaaagaagactctttcctgctaaaatctgggtaaacaaaatagctgctagactgggaaacaaaaagaggggtcacagatctgagttgactcttcctttttcatgagtcataggacagcagatatactagttgtcttttgctttcagaagagttttacattacctaaactcatggctgaatcacaaagtacatggccagaagacttagtgacttagtaacagagttctcttagacattttaccctccttaaactaattttggtcttgacacagttaactattaaaaaaaaaaaaaaaaaaaagccctgaagcctgcctattcacctctgatcactgagaatgaattgaattatcaccgtacaaataaatttgggaagcaagataatgggagggaaaagagatgattaatatttgaactgtaaaggatatatgtctgaaatttaattattaacaaatgtgcattgatgcaattatgtaccattacatagcagagttaagaaatctaaattaagtaaattgcaaatgctataactaaacttataacaagttattttaaaaattaaaactctcatcagttgaaaactatatccaacagaaatcaggcaggaatttctaccacctgttcatatgcatgtacagtgggaatctgaagcattgcccagcacaatgtggcagccagactctagattattccatttgagttctgagtaactgtaattgtatgctattttaagcttatgaatgctaagattgtttaattcttaataagctgataggtagcccttaattgcatgatgaaaatccaagtccaatggcttgtgtgccacttgcctataaaaagcaaataaaggacttacatttctggttcaggttgtaatccaccaagtgaaaccttggggtctttaagctaaggatctttacttgaaaatcactgttttatagcttattaaatttccatgtcaaaaatatcaaagaagtcattcaacaaacatgtattgggtctactaagtggcaggtctctttaggactctgcagatgcagtagtagcaaatgtgataacaaggctctaagtgaattcatcttctatttgaagaaagtcagaaaaccaacagccaaccaacaaaccggtcaatgcactccagggaaagaccatgaggagcatacctttacttgaacaagtgagtttattaattgttgtagcaaggaagaacacacaccacacggagccatgaagtatcttagtaagatactaagtaagggcattagtaaaggcatattaaaaagaattcaggcttattcggtgattctggggagggtttaagaaaacaggactttgttctgtactggatgctgccagaaagtagaagcaattctaggattggatagctcaataaatcttatctatagcaagagcagactagagtgagaataaagttatgattggtaggaaagtagtattcaacttaaccaataagatggtttgacattttgtgggttatatagtgacaccaatttttatctgttttttaatgaaaaaatgacatagcattattttcactcactttattatggtcttagtgtgactgtgtttcatgttggtactctatgaagttatttctctctaatgggtgaacaatatcatctacctgtgggctccaggccagcttctaacaatgctgaggcctcacttacggattagatcagttcccagacaacaggggctacttttccctttcaatcatgcaaccagccaagcaataaatttaaaaaaaaaaaaactatcaaagagtgatagaacatagtaaaagggatggccctttatattgggtgttcagggaaaggctgttagatttgaacaatcagaaggagccaacatatgactacagggggaaaaacatttctgtcccagtgaataactactgccaaggccctaagataagaaagagtctgagcatcaaaagaaagacagtgtgatctaagaatgatctaagagcacagcgaggaaagacaaaaggaaggagggagagccaggtggccagatggaagttgtgtagggtaggtagggtattgtgactttattctatatatgataggaaatcattgaaggttgtaagagcagaataatgacataattttatttatatatttaaaagatcatcctgtatgttccatggagaagcagagatgtgagtcaggaggttttgcagtttaggcaagagataatagtggcttgccacaggtattggtggtggagaaggcagagctgactgttctgaagtcagtgttcataagacttactgataacatatcagtaagtaatttgggaagtgaaaagcaggaagaaatgagtgaaggatgatcttaatagttacttggttcttaatgtcagtgataatcttattcatcatgttattcctaatacctgattcacagagggcactagatatagaatgaaagaataccttttgtagctaatgttggcactattagcaagcttcaaaagtatctgcatttattaatctccagttggggtttggttcctaatttcttctgttgatttgcagttaactcagtggtggtagcaaggtacaaaataccccaggactacacagaacaacacaatcaaggtagaattgacacaaataactcctaagaaaatgtttcctacatatagagtaaataatttactaaacatgcttaaaataaataaatttggaaaaaaataaaataaatagaaaacttcctcaaattgataaagaacattcttaaaaacttattactaacatcatatgtaatagtgagaaacttgacacttctccactaagactagaaacaagacaaggatatctccctttcaccaactgtttcaacatcatatgggaattactagctactgcaataagacaagaaaaaaatagtaggaatacagattcagaaggaagaaataaaactatctttgcttgcaggtgacacaattgtgtatgcagaacatctgaaagaatcataaaaacctcctggaactagtaaatgattattgcaaggtcacaagatacaagtttaatatataaaagttaatctctttcatatataccaacaatgaacaagtaatattcaaaataaaaaaaacataataacatttacattagcacccccccaaaatgaaacacatagatgtaaatcaaacaaaatatctaaaaaataagtagttttcttctatataaggagaactacaaaaccttgaggaatgaaatctagtaagtaaataatggatagaactaaataaatggatattccatgttcattattattgtcaaaatgtcagttcttcccaacttgatttatagcttcaatgcaatcccaatcaaaatcctggcaagttattttgtggatgttgacaaactgattctaaagtttatatggagaggcaaaagaactggaatggctaacaaaatattgaaggagaagaacaaagttgaaggactgacatcatctaacgtcaagccttactataaagttataacattcaagacagtgtggtattaatgaaggaataggcaaatagattaatggaagagaagaacccagaaacagacctagataaatataatcaactgatctttgatatagagcaaaggttacataataaagcaaagatagtcttttcaacaaacggtgctagaacaactagacatccatatgaaaaataatttagagacagacaattgacaaacattaactcaaaatggatcaaacccttaagtgtaaaatgaaaaaccataaaactcttagaagacgacacaggagaaaaacctagatgaccttgggtatggcactgactttttagatacaaaaccaaaggatgatccatgagagaaataattaatgagctctacatcattaaaataaagaaaaaacttttggaccgggtgcagtggctcatgcctgtaatcccagcactttgggaggccaaggtgggtgaatcatgaggtcaggaaattgagaccatcctggacaacatggtgaaactccgtctctactaaaatacaaacaaaaaaaaaacaccccaaaaacaaacaaacaaacaaaaaaccaattagccaggcatggtggtgtatgcctatagtcccagctagtcgggaggctgaggcagggaaattgcttgaacttgggaggcggaggttgcagtgagcccttcctgcctagcaacagagtgagactctgtctcaaaaaacaaaaacaaacaaaacaacaacaatacttctgttatctgaaaaactctgttaagaaaatgagaagacaagccacagactagcaaaaaatacttgcaaaagacctatctgataaaagactgtgatccaaaatatacaaagaactcgtaaaactcaacaatgataaaacaaaaaaagggccaaaatcttaacagacacctgaccaaaaagagatatagatggcaattgagcacatgaaagatgctccacattatacaccatcagggaaatgaaaattaaaacaacagtaagatatcattacacgcctattagaatgaccaaaatctggaacactgacaacaccaaatgctggcaaggatgtcaagcaacaggaatgctcattcattgctagtagaaacgcacaatttcacagccattttggaagagagtttggcagtttctaacaaagctaaacatacttttaccatacaatccagcaatcactctgcttggtatttactcccaaaagttgaaaacttacgttcacacaaaaacctgcaaagagatgcttatagcggctttatttataattgccaaaacttggaaccaaccaaggtattcttcggtaagtaaacgggtaaataaatggtggtacacccagataatggaatattaatcattattttaaaaaatgagccactgaaccataaaaagacatgaaggaatcttaaatgcatattactaagtgaaagaagccaatataaaaaggcaataatatggtataattccaaccatatgacattctagaagaagcaaaactacagagacagtacaaagttcactggttgctaggggttttatggataggatgaataggcagaacatagaggatttttaggtctgtgaaaatactctgtatgacactataataatagatccatgccatgatatatttgtccaaatccacagaatgtacgacattcatgtaacctctggcctttggttgattatgatgtgtcaatgcaggctcaccaattgtaacaaatgcactactctagtggagggtgttgataatgagggaagctatccatgtatgggggcagggagcataaagaaaacctctaccttcctcttaattttgctgtgagcctaaaactgccctaaaaattgtcttttgagaaattaaaagacatttagaaatcatggaaaaaatagaaaaacgtaaggcaattgctcatcatagcagataaaaaatccaaaggttctgaattctgtcccaaaataccctcaatagggtgtccacctttacctcattaacttatttgaatggtacatttgtatctcttgaagaactcttagaagaactggctgtggtgatgttttctgccttctgtcaacctttcaaaatcacatgcccatcagatggcattctcaaatttcctgccctgtaccccaagagaactgtcctcaggaacaatacagaaactgcctaactaagtatagtcaataaaccactgcttcagaatcacaccggggatcctctgtttcccttcacaagcagagtctctcaggaagcagtaatgaagcatagtacgggggtgctcctccttaatgcctatgaagactcataattggaacccaaacttgctcttcaatgtgttgatgactctgcagacaaacctgggcttctctggtgtgctttcttattgtggaaaccaacaggtcaaaatattaatatgtgcaggcagaaataggtgtagaatataagcaagaggcctctttctttctctattggtatgtttgaagcaatatgactaatagacgaatccagtctgttttagaggtttagtttgggaaagtccttgtaaggcattaaaggagtagttttaattcacagataatacgacactcagatacaatgccagaatatccaaaataatttattgcattctacacccatggattcctgaaggttagagtatatttaaactacaccggtaagagttgttgggaaaaatacaagtatctcagagatcacatggtcacaacctacctataaggacctcaagccatgtaaaaacatcacagctgagggaactacttcaaggaaacaaagacagaacatggtcatcctaaaccccagaggcaaacttacagccattaaatagactcctttggccagtcatgctcattcattctcatttaaaataattatttgatgatacagtcaaacaagaaagtattctgctttttgtaaggcaaaaggtgagagtgaatttctagaagttaataaacaggttggtagttttcttccactttgctcataacatcatggaaaaatcactgaagtgtgagaaacaggattctgtcacaccagtgcctcacatccaatgctgcgagagaatgaaatattgacaatttaggtgtagttctcataatttcacccaactcaaaggaatgactgaaacactccttgataacaagaaaacacctgaggaagggagagaaaataatcattctctccaaccttctttgcacctttcgatttcatatagctaaggatacacatttctcacagtgattgaagagggtggcaacatctgtcaaatctgtagagtcaagacatgaaattcaattttaaattctcagtagaggagaaaaatgagagaaaggtaacttgtaatttcttccaattagatatacaggaataactaattgaaatgaatgttttataaaaaaccttcttttactttttaaaaactgaatttctacattttaataacattgtcatgtgtaattataggggtgttgaaattttgtttcctcttttctgagccctaagtttgccttctgagagaaaatcttgaaaatgtagtcatattttaaaaagtggtaaagcctactactgttcatatcattttcaaccatcagtagaccttaaagataggaaaagaggccgggcgcggtggctcacgcctctaatcccagcactttgggaggccgaggcgggcggatcacgaggtcaggagatcgacaccatcctggctaacatggtgaaaccccgcctctactaaaaatacaaaaaatgagccgggcgtggtggcgggtgtctgtagtcccagctactcgggaggctgaggcaggagaatggcgtaaacctgggaggcggagcttgcagtgagcggagatcccatcactgcaatccagcctgagcgacagagcgagactccgtctcaaaaaaaaaaaaaaaaaaaaaagataggaaaagaaagaaaatagcctgtacttcaagtatgaaagcaccatgctggatagtaaaaaaaaaaaaaaaaaaaaaagaaaaaaggatttagagagcctaagtgtatgccccttgggtctcatgactctgtcaaaatgacagggtgatttccagaaattcattaatcctttcaatgaatatttactgagcatccacagtgagcagtgatctgcacaggaagctaggagtgggatggggtgagtatgatgtacaatgataaatgagacacagaaaatgcctttgaggaccttatggtgtagaaggggagaacacatactttctcctaccttgtattaaaattatttgtgtgtgagagtcatgagaagtataaataaggtattatgaaagttcacagaggtaaaaaattaattcttacagggaggaattgcagaagtagaaataactgtctttgcctggaaggatgaaaaatctcaggacatgtagagaaggtagaagaacattttctttgaaagggatgggataagcaaggacattaaaaagatagcatggtgtacccacaaatcattcagtttacctgaatcaagaggaggacaggaatggaaaggaagattggggatttacatagtatggtaggctaaatccatctactttctaatctctggaatttttaaataagttaactgacatggcaaagtctttgtaggtataattaagactcttgagttggagatattatcctggattgtctggtgggcccagtgtaatgacaagggtcctttcaagtgaaagaataaggcaaaagaatcagagtcagagagagagctatactaatggaagcagggatcagagtgatgcaaggaaggggccataaactgaggaatgcaggtggcttctagaaaatgaaaaagacaaggtaacatattctcccctaaagcctccagaaggaatgcagctgccctgcccatccatgctagacttccaacccctagaactgtaagcaaatttatttgtgctgttttaagccactatatttttggtaaattgttacagcaacaggacacagatatagagtggaatgttttgaatatactacatcttagtccaaataattatttatccattctctcttggtgtacctcaacttttacttattatttcattacaacatttatgttgtattttttatttttataaaatatatttgcctgtctgcttcgtttgagttataaagaaggtgaaagtactactaacagaatacagaaaacccacaaagagaaaaatatttaaaagcaagatgctgaaatctttttcgaacacagtacgtttgaaataccaatgggtcaacacggtgggtggacagttggagatggaaattcatgcctcctgcttgaagataagagcgcatatctcttggaagcaattacaaaaatttattatagctcacaaaagagaatcattgaagtgtgactattgaccattgggaaaatttaaatagtatgtattcatgagaagggaattatttaatcagggtattttgacataggttgctggaagaagtgattttatattaagtattattagctaaaatattatcattttaactacctgtgattacctataggcaaggcataaggcaatctactggagatgaattcacgaatggagaaaaagaccttttaaagaaaagtatgtcatctacaagtttcttggtttttgaaatatctctagcaggacattaatccctcaacttctcaagtattttctgagtatctactagtgcaaggtaaggtcctttattcatttttatcctaacatagcctttggctttgagaagcttattgtctccttgccatgtaaagttgtgtacttcctcaaaatactagaaatttagaattttcctaaattatgattttccccaagggtatataagttttaagtctcaaaagcatacatggcctatcttacagcctgttcctagagttcatctctctaagatgagtctgaggtcactctctgcctgggaatctgaggaagctgggccgccggggtgcaagggagacttcacatagggaaaggaggcaaggaaggcttaaagtgagggcaataaaaataacctttacctgtttcaagtcttgggttggcccagactaccaccacttcagggatttttataaaatgctgctgcattgcttttgctaaaagagagccaggtcagcagagtgggatgacctttcccaacagaaatgccatgatgtttagccatcaagcagaaatttcagggacaataagatactgtagtctgcatgcttttatcccaaagtgaaaaccatagaggtcaaaaatatgagttaagggaggaaagaattaaaacttttacctgctctaaactctgaaaagatgatggtgtgttcatccctgaaccttgtctcaacacaatttcagagaactataaatgatgcctcctaacagactactatatgacccgtgactcctgaagtagtacaatgagaaggataaccttcaccacttgcaaatcttaatgcccatgtatatacacatgtacatatttttaattgtaaaatgtgtgtaatgaattcccttcaagatagggaggatataatttcccataatatgtacttggttgctttttatatttttttagaaacgtcaaacttttttcaaaactttttttggaaatacccagtatttttttgctacccaaaacacatgtgaattggagcatacttctttatgtaacaattaaaatgtaaaatgaaccaatttttgctgaaaaaccaatctgaaatgcagtattcacttccctgccttcttaatcaaaggatgatggacataatttaacctttttaaaaaaaataatgtcatggctttcattattatgaatgataattattctacgtcgctgcgatacacagagacccttagggattgctgtggtgtatggagcttcttgcctacacgaagtagtgtaggtgctttttgttttttcattttgagccagctgttcataaatttttctctgtcttttctcactggcatgctgtatgtgggttgccttttttactactgtcgttgtagtcagtcttcctgcttccatcaactcctagccaaacaaagcaagacattcccagtgtgccaaagctcaggcaaattaccttgtactagcattttaggccgatgcttctcgtactttagtgtactacaattaatctggggatcttcttaaaattcagattctgctttggtagctctggaatgggaactaaaaatttgtgtttctatcagcaaccaggtgatgcctttgctgctggtctttgcaacacaccttgaatagaaagatattagctatcatgactttttagaattgtgtctagattaaaagaaaatttgttttgagggagtgattggctactctcctataaataagatctaaaaatttagaatatgaattttaaatatgctatctccaaaatgactttccttatctttatatccctgacaccaccacataaacatatttcccttctctatactaatatagcatttaatttcttcctctcttatggaatttatatatttataacttattatttagatataagtcaagtactgaacatgaagaggaaccaagtcttacatatctgtattttttgaaactataccttgctcaaaaatggttgttgaataactgtagcaattgaaagctataaggttctttccgtataatttcatattctttgttgcatcaatttttcaaataagtaatcaggaaatgagacaatagtataataaatcagtataaatttcaaattaactgttaagaaagtaaaacatgttttcagagttcctgcctctttgtcgtatacttatttcttcaatttgcctcctcccaccacacctcatagaacacacaaatagatataaaagcacatacaatctaaacatatatcatcttcatattctttaatttctaaaaccttatttcaagaaagggcctggaattaacttacactaaaatgtaatgactaactgcagcataaagtatatttcctaccttcaccccaagaagggcttaaacgttttaatagaaatcaaagcctacatagtggaatgaagctgtggaagaagatttttcggtttttaatcataaaacaaaaggtatattaaatagaacctctcctaatactctcacattgggtgatgtttgcactgaacttcccctaactgagaattgctaatccacagctttcctgcacctgggctgtaaagttgctacatagtgataaactgcttgtatcctgatatgatgaactaatatgcacagaaaatcctcactaaaagtgcaagctatagaaacagtcaaggctaaagcagggcaaacacaaaagtcaatttggcagctcatttgaatctacattgtgcttctttccaatggcagacagaatttatcatctactggaaaagaataaaacaaagccccaatttccattaaacatttgtgtaataaaaagaaatggaaattatataactagagataattcaaatatgtaaataaaattgtcaatggaagcagacatcatcatagcttttgagttaatattatgtgatatccattttactaatttcatccagcacacaaatttgctacttatctcacacctctaattaaattagtggccacctacatgaaattcagaatgcactcaataacaggtgcttagaaggaaaaagtgaggcataaaataagatagtcaacataatttacacagatttatataaagttgctctgcatcaacatattcctaaacaatagagattaataagaatatgactctagataatagtcccagagtctagagtcatttctcttgttaacaggatatcaatgtggtgaaaagtgtacaaagggtatctggatctgcctttcctgactctgtagattgttcgctgtgaaaatggctaggatcagctgagaaatctgagcataaaactggtgagcaaggcaggctggaggtacagatgagttctggctgagatgcggtgcagacagctataaaatgaagttcttacagtatttgctttcttggtcatccaggggttgttcaattgtgaaagtcagacaacacggccttaatttcagataagataaaagtcataaaattgttattttcttcccacaacaaaacaaacccaacaagtcagcatattttgctcaaaaggaaagagagaataggtactagcttggcagtgccttacaaatctcagaccattgtagtcagtggctttagcatcaaagggacctgggtttgaagtcacagcccaagaaagcatggctgagctatttaacatctctaatttcagatttcagtgtccttatcacaaactgtggatggtaatctttatctcacagagaggttataggataaataaaataacatttatggattgcttagcaaaatgactgctcaataaatagtatttataactgcttacattgaagacaatcatactgaagtacaaattttatgatcccttccagtttatctgaaaattaaggagatgaagtgaatgcatactaaaattctttaatcaccaggggcttaaatattaaagtatgtaaagcatttagggggtatataaaagagtaagctattatcacagtgagccacagaatgtgttaagaagatagactctggggccaaattatcgcattcacatacctattctgctgctgcccagctgcgtgctttggatgagtaacttaaatgctctctgcctcagttttctcatatgtaaaatgagaataataacatttaatttttaaataaggtaaaaacgaaatgggttaataaacataaataagagattggcacataccaacttctacgtatttacatatatatgttttagagcacacacatactgttgtaaacagaccttagactgataagtaatttctgcctcctatatctacatcttattggaattttctccctttaagcgtggacatgacctgtgacaggcttctggccagtataaaatggcaaatgttaggctatgttataaagactccatcttaggagaaaggagtgccagactctcctgctggccttcaagaagcaagcttcttgatgcaagctgctaatggagagggtcctatggcaggcagcctctaagagttgagggcctcagttctccaaccagaaagaattaagttttatcaacaaccatgcaagcttgcaagagggccctgagctctagaaaggaatgcagccctgccaattctgtgattgtagtctagtgagagccaagcagaggacttagttaacctgtgccccgacttcagtcagaccacatgaactgtgagataacaaatgtgttgtctagagcttgtaagtttgttgtcattcattacacagcatagaaaactaatacacatacttccatatagaattcagagaaaagaaagggaggaaacgaaaaagcttattttctcagtgctctgtcttagtttcaggctgagcagccttgacctggccagtcattgctgagtctatcattgtaaagtacatttaggacagaaagatcttactctagtcaagatttctcctataggccctattttagcctctggccttcatgaatggcaagaatattaggatgtcagtgatagttgtttttccagcttcagattccagttaaggaattttagcaaaacaatatgaactagaaacctttttgagagtgggaatgagagatcaaaatatttgtcttttaacgtcaaagtttactaggttttgctgacaaaactaatcttatgtattactggctttctgatgagcttctgtcatccttccctcatttttctgccctgctctgtccgccattcccgagaaatagactaggagtcaagggatctgtgtacaagtttaagcttggcttgtagttagttgtatgactaaagatgataaagatgagccagctcaactctctcttctgttgacctgaaagtgttgggatgggggaaaatagatgaacaataaatgaaaataaagttcttgagaaaagttacaagggcagaacaaatacatgacagtaatgttacaaaacagtcttgaaacctcagaggaatctaggcaactcttaaaaagcctcaagccctttccaaagtatgaacctgcttatgatttagagtctgggccaaaagatttataggatttgagaaatgagaaataagtttttctctcttagacaactcctatataaaagcagtggttttcgagatagttatgttctaaggcttggtggatgagaataccctgattaattatgcatcaatatggaatagggtccatatataccacttctgtcattagtcccttctgtacctacaacaggtacagagatgagagatcagaggcttggggaagagaaatagcttgttaagattatagagctagttactttcagctgtgggacataattacaaaggaaatttgtacatttggttattcttgttaagtatctctatttgtaatgccaaacacaaatttttgctacttcaaaagctgttttatttcttaaatttgtgatgtctctattatattttgccaatgtgaggaaatgagtgtctaatcttgtcaatgtaatatttattctcaattcctgctatattcattcctcctaatttgaaagttgataaaatctgttggcaacctccttgaagctgcaaagcagttactcaaaacaattttcagaatgttcagtataaatgggcacatgaaccattcttgaaaaccgatgtgcctttttgcttcacatgtttaactaaagtcggttataaattttaaaattatttatttaactttttcacatccttgttttaaaatttccataccataatacagtgttctttcaggatcacatgtgaaatagataatatttccaacatttcatgaggagctatggggaagaaatgatgagcaattccataaggcactgatagacataaaataagagtacatactttcatgtcattccagatagaaatatcaaagatggaacattttccttccccttgacttaacagatgcccactctcatttagaactatttcctgacaatgaaatctagttggagagatacaacataataattcaaacacattgaaataagttttgcactgaggtaaaaaagccacagggtatgaaaaggcatggtgtagttggtgaaagggaggtgaggtattacttgagtaaaaagtttacattggtggggtggcagagataaaagaagatggagatagagataggcaggagttagatcatagtgaaagtcttgtagttattttagggaacccaggaagcttaaatctatcaatcaggatagtgacagggtcagatacatattgtagagacactcttgtgagtaaggaaagactcatttataataaaatatttgtggtagtccatatgatttggtcattctgcaatacatttatcaatatctcaaaactcacaagaacatgtaagcaaaagttaaggtatatatagagagagtggaagaatctttagtattctctggtgtcaatttgtatgtgatttttaaaaattgtttttggaagcattttattttctgtttagtggttgctgtagttttcttgagtcttctccctactgctaatttaggctatttggcatattcagcctcatggttgcaaaactggggttttaatattaaaacttccattgttcatttagatttttccttctgaaaatttgtagaattattcaaggcaatcttttatatacactttctaccttcctttgcctcccaaatcaacaacctgaaggtaggccgaattaatacacactagttgtggtaataatgtagttaagttgacactgtgagctgtggtctaggcagagaatgttacgtgcagagcttctattgtcttctttctcccaaacacagtggtaggttattcacattcattccttgctacacgcatctagttaaaataacttagactttttcaggaaagacaaactgaggccaaaagctattgctcatctcattgctaaaactctggcaacattttctgaattccacagatccacagtttgagaagatgattgtttaacttgtggcatcatgagggcccaacagtttagaaaacagtgggacagcctgttgccctgcagccaggtgataatccacagtaaccaaaataataacaaatattcatgaaaccactgtctttctttttcagctcattattgaatatttgcactgtatttattatttctgctgcaaagaaagtaagaaattaccaaccaatagatcatgttcttatcaagtgccaggcaaaaataattcttataactacacactaggaagagagtaggaaactggtaggaagggaccaaaatgttatacaacaaaatactatgcacgacaaagatatggtatactatagaaagcagattatttttaaagaagcgatatagacttttctgcaaatgttaaaaattgattcttattacttgagaggaagacaacttgctccaattctaaaatggctttaaatcattttctctttttaccagtcaactgctttcctacaggccaataatagcattaccaaccgggacaaccatgagagtctccttactcacagttgtccaaagcctttaggcttcatactgtggaatgtatcatctactttttaccagcattatcttccagaacctagagcaaataacttctcattactactaaaaacaaaacaaaagcacaaccaaaaacaaaaacacactcttccagagcttcccattacctagagaattagtctaacctcttttatagagtttttaatattctctaaacatctgctcaaaattattcacttccctgcattctaattaccttctgcaccaaattctacagttctcaaacacactgtgcatcttcacaatctttgctcatgctgaagcctctgcctcagacgcatttctgctaattctccatctgacgataacttactgcccttttaatgttagcatttttgccacagttagatctattaattttattggaatcaactttgccctatagagaggtttctgaaagtataacttgccaccggtgtccgtgctattaaaaacactcatgcagagaatgcatgttgacacaccttggttgtctacctcatcagtgactaccattgttcttatataacataaatcaatcctcagtaagtatttgtagacatggaacttcctcagcttgttccctttctctttggtatctcttctctccatcctcaaagctcataatcaatggccaattaattcctcttgtttcggcaatgttcctcttgcctacacaatattcccacttccattaccctagttctaattttcattacctccttcttgaactaccgcacttgcttccttagctattgctcagcttctagtctctcccttcttaggccattttgtagtcagctggtgaagtcattttcccaaagcacagctctaataattccattccctggcttaaaaaacatcaattgctctctaatgcctgcagaccaagtccaaactccttagcaggttttctatcatctgcccaccatttgcctttgcaaacttttgttatacattcccattatactcattctgcatgccagtcattccctgaggcattctgtggagtctctcccattccctgacctgatgtatgaattctctcctttgatctcttaggttactcttttcctcaacattgcctgttgatatacccacctttaaagaaacaaatgaaatgcctcttccacaatgatgtatgtcaagaatgtaattttagatttttttgctcctagagtatattcattgtattgctaaaaatgtattactccactttactactattgcatacaaaactgtgcttgtgattcaaatccccctctctgcagggataaatcatgttttgtttacttctcttcctggggttgggccttaaacagtgcaaacacaaagcacaacttctggatcatcagaacgatttagcaatgaaacaggctatctcgaagatgaaaaatatttgaagagaggctagatgctcatctatgaagatgactgaaggaaatgcatgcactaggcagatggtgagattgcatgaccttttaagtcccttacaagtgtaagtttctgtgctatcaagggaacaggccaggtacagtggctcacacctgcaatcctgataccttgggaggccaaggtgggagaatcacttgaggccaggagtttcagaccagcctggataacaaagcgagaccttgtctctacagaaaataaaataataattagccagacatagtagtgcatgcctgtagtaccatctcctaaggaggttgaggcaggaggatcatttgagcccacacatttgaagtcgcagtgagctttgatcccaccactgcactccagcctgagtgacagagcaagaccctatctctgacaaaatgtggtggtcacattttgacgtttgaggggtcaccacccctcgacaggccctggtatgtgatgttcccctccctgtgtccatatcttctcattgttcaaatcccacttatgagtgagaacacacagtatttggttttcggttcctgtgttagtttgctgagaatgatggtttccagcttcatccatgtccctgcaaagaacatgaactcatccttttttatggctgcatagtattccctagtgtatatgtgccacattttctttatccagtctatcattgatggacatttggctgggttccaagtctttgctattgtgaatagtgctacaataaacatacatgtgcatgtgtcttttatagtagaatgatttataatcctttgggtaaatgcccagtaatgggattgctgggtcaaatggtatttctggttctagatccttgaggaatcgccacactgtcttccacagtggttgaactaatttacactcccaccaacagtgtaaaagtgttcctatttctccacatcctctccagcatctgttgtttcctgactttttaatggtaagtgttattctaactcccaatgctgtctacctaatgtgaaagttcaccattctaagtaaccagtcctggctttgttatgaaatttggatgctgaatccaagagattaacaacatgatgacaaaatttacttattctctttaaatgtgtataaccatcaacaagagagacaagattatttatacatcaagatccttgccttattaatttcgtctccccaagtatctagacattcccaaaataggaggttcaatgttttaaatagcattgatacatggttttccaagtgacttgggagtatgatgacatctcctaagcaagagtgattggacccatgatgaattcagtttctaatgaacagaacactagagaactgggtttggatctaacttttggttcttttctatatcctcttggaggtagttagcttcctttactgtttagatgtggaaagggccttgtttgctaagtttggggaaatacaaaaagcttggcagtcaggaactaagcaggaatccaatggactgaaaactcctttggagaaggatgccattttttttttttttttgagatggagtcttgctctgtcacccaggctggagagtggcatgatctcggctcactgtgagctccgaggatggcatcttatggttctttttgattccttcctccctagaaaagtccagaatatgactctgaacactatgtaagatatgcacatagtaatgaaaattaattgacaaaattttctgtggaatctcaattgccttgcaagaaataatacaagtgcagatcgagtttttaaaaccctgcataggaaggagaagaaaatgaacattctgcttcaggattggagttttctttctgatctgctaattctacaaagtatataagattactcaacacgttttaagtggaaagcaacaagcttactctacattatagtagccataatgtcactagggggtgtatgtttggttgtgagagggtgttatcaatgttaattacaaagtttttaagagttgataaatttcttcataaaacaatgacataaaatatctcttcaaggtaacaaatcctgagagtcaaaaagctcaggatggtttcaatcaataactttataactaccaactatttgtttttccaaaattattaattaacaactaagaaattgctgaaagcctccttggagcatttttacaatctttgtatagaagtaaatagtatttatgatagtatcgatatatttggactagactttaccatggctatgggacctgctatagttcttgatgatcccttgtcatgaatggaacttaggtagctattgtcacaatctctgcagtcactaagcatagaaagtcctcactaaatgcactaagcatagaacgttctcactaaatgcacaagattcaaataagatggtattttccaattccttcactcagtcacttatatgagggctaaagccatggtaacatagaggctcaagtaacttaaaaaataacatatttgaaatttacttgctggaaagggacaccccaccttgattttaatgaatttcagagcaaatacaagctgtcctcagtggctttcatatgaattccctgcacagtcttcttcctttagaaatgcaaaaactatttcaagatttttatgcctgcatggagaaaattgctattgtgtacaattagcatatttactaaggtttgtcattacttttggtaattaaaatcgtacaaaaagagagacatatccaattcaagaaaattacacagtacagtaatatacaatcataatagtcgcctgacaattattaaaatacaccaagttctcccttacagtaaaagtattcaccagagtagcttctgaataagatcattgcagtgctttctatttaaatgtttttctgcacagaaaattataattacatttgcataactactgtaatcaatctagaattatggctgaaatttttattcttgaaatcactgttctttctaagatagtaggagctctgaggcataatctaggtttgtgggccattattctaatttgtaataggattaaatatatttttgcactctctttacaacaatcaatcactctagagacatagcagacgatacaactacatcacacaatttgttttcttctgtcttgaaaaaacaaaccaggctttaatttaccaaatccattttgtccaaaaagcaaaacaaaacgaactcaagttaaaaaaaaaaagtcaaatttataaaaggagaacaccaaatattatttcatgaaacagactcaataagaagtcaagcattcatctctacatttagatgctctgtacttactgagattagctgggatggccgagataatttctgtcccatcatggaaatactggctaccataaaccaaagatttcttttgaatgttctcctttactcctgctgtattcaacaggcttccttggagcctgatgttattgtcttatctttttaaaatatccaagtcagatctgatgaaaacgataagcagacctaaatacattaatctgcaaccagattctggtagagctagccttttgcaacgataactctaagaaaatgccctgctagccccttcttctgaccaatgagctgataatgtaagaccctcacagacaccatctgcatgcattctctctcaggagtgcagagactcagacactgtagcaggccagagaatgaggtgttctaaaatcccctctctctggtcctgctgcaacttgtttttggttacacagcccagctcctcaagagaatgacatctccagggatcaggccataacaaaagaaattctcaatagcacaaacaatatatatttcctgagaagcacaacataaagtcactacagaaagctaccctgaagcatttctctaacatgtggtttcaaaatcatttccatgttatcaatgctaattataaagtttttaagacttgaaaaatgtctacatgaaacattaatgacataaaatatctctgcaaggtagcaaatcattgagagtcaaaaagctcaagatggtctcaatcaataactttgcaactaccaactatttgtttttccaaaattattaattaacaactaagaatttgctgaaagcctccttggagagtttttacaatctttgtatagaagtaaatagcatttatgacagtatccagataagttcggactaggctttaccttggctatgagacctgatatagttcttgatgatcccttgtcatgaatggaacttaggtagctattgtcacaatctctgcagtcactaagcatagaaagtcctcattaaatgcaatgtctttttaacaaagatattaaactgaactcaatattttcatacttttttactttggaagatttggagctgtgctcaaaattgtacaaggaactgttttaatgaccaattaattcagattggcagatacacagaaataaacatgttcagagaataacagcaaagactacatagatacccatagattatgattgacttttggtgagaaactcagataagctgaggacaaacattaaatcagcagtggaattataaccttacttatctttgtgctcaagtgtttgtttataagcatagataatacctacctaagaaaaatggagcccagcaggcagctagatttatatttatataattttataaaataggttcttgcctcaccatcagaggctggtcaagttgccagcctctagaaaacattgagatctctaggtatagatatatccttatttggaaggtgtatgaagccaaaataaagacaattccaagattcctcttctttaaataaggtgaagacccttaaagatggagaaaaatagtcaaagaagaaggcaaagaatcatagaaaattggagataggtggatgttaagcacattttattttttattttcattttatatacataaaaattgaggctcaaacaaatgaatattcttagtcatgattacatagccagcaaatgcattgatgaatatacagctaaatcactttccattatacaacactgaatttgaagaaataagatcacattatggatgtaaggcaaacataatagcccagggtcaatatggcagagaaataaaagttagcatttttctatcttaaaagtattctggattttccccccatcttcataaggttggtaacaacaataatggttcatggacaacctagaatatttcatatttaaactagagtcttttctcatggaaaacaaaccatccatgtcttgatcaaaacaggggcatgaattactagaagaataagagcaaagaagaaataagcataaaatgtttttcaaggaccatcttgagataatactattataactgcatttacaacttgtatgtctttttaaatctgatatttgtagtagtgtatagattagcatacttatggaacaaatgtgtttctctttgtttaagacaagtaagttataattcatacaaaatattagtcatggtgtcatctcttcaccaattctattatcatgtataggtcacaagctatttctggttttcatttttctttaaaaaagaaagaagagcttgaatagatatagcattttgaaaattttgtcctgaaagacttttccacctccattcatcttacagatctgataatttttcaccaaggaaacagtctttgtcctggagtctcatatggctcttgccataacagtatatccaaagattcattcatttatttactcactgaataaatgaaactctacaaggcaccaagttctgtaccatggctatgtatactgttaaaaacaagaaaaagaagtagttgaccttttagaatttacactacagtgaatgggaaaagtccattttttttataatgtagttttcatttgagtattgttttgtattattaatagttaacccatggaatggaatggattgcactcctgaagtattacttctgtgggaccttcaatgcttgtggctgtgtccttctttgctgtggcacatgctttgctagtggaaagaatttgcaaagcccttttgtgggggagaaaccctacctgcttgggatctgatctgaaaacaaaacctacatttgttcatcaccactacctcctctctaaatcccttaaatatccctctactaacagtcactcaagatcatgatttaatcatttcatgtccaataaagtattgatttcattttcattggttatcttttatatgatcatttagccattttaggcattatatcttcaagaagaaggagatttgtaaatactacaaaggggttttcgttttgtgttgttgagatattactattaaagtttctttttttttttttggatacagctgtgtaaaataaccaagatctatttctcattctagcatgtggtctcagcattctgtacaaatgattttactggcttcgtaaactcccaagttaaagaatctctttaggaagaatcttaattgacctcttgaattgttggcctggtacccagagtaaaagaattgtgttttaataaggattacttttgtcgtggtttattatgctttagcaccacacgctaattgatgtagttgcaggaaataaggtaagacatgccatggtttggttaaaagcttcattacatgtatttatgaagagtcttatggatgaaataatttacaacatctattacatatattgaaatgtatgctactgcttccatttcttataatctgcggaacccaggtctgaaaccacttggtggaaaacgtttttaaattttattttggtaccaagtggcaataacaaaagttcaatgactggctgagtagcaatttggactgatttctaaatgtgggcacagcattaatgaaagacatttcttatttttgagataaagcaaacctacatgaaagagaaattacatcatttgggtactagtttcagtgaatgcctgacaatgggggagtcggaagagtggtgtaatgacggaatgctaaagctaggtgagttaggaagggttatttggagataagccttgagtaggacctcaaagaagggaagcaatgtggataagctagtaggaggctgatccagaagttaaatattaaaagtatagcactagagatagcaacaaccatgtgtctagactaaagagcttgttttttttttgtttttgtttttgtttttagaaatgagtatggatggagagaggggattatagcagagcgaatagtgttgaagtcttggtggggacattccgatttaataagtaagtatagtttctttatcaagagtaaccattcgaaaatgctatttgaggattagttaccaatgcaactaaacttcataatgaatgatgatcatggttagcacccactaagtgcttactatgtgttatatactattttaaaaacttcatgtatgtccttgtgtttaatccaggattttgtaaccatgatgcaattgacatttaggattaggcaattcttacttgtgggggactgacctgtgcactgtatgatggttagcagcatccttgacttctattcaccagatgccagtaatcacaccaaaacatccccacacaaccacaagttgtgacaatcgaaagtgtctccagacattgccaaatactcgagggcaaaatctccctagttgagaaccactgatttgttcttaacaccacgtttcagttaaatttcattaattctttttttattgcctctttttgtagttgaggacatggatgctaaataacttgcccaatgtcacatggttaataaacaaattttaaagcctccctgtgaactccagcgacttaattctagggcctggatttgtaaccactattgtctattacatccccataatctttctaggcaggaatctagcataaacaaaaaaagaaatagcccagtgtagtaagtctcgtttgaactgatatatgaaaaaaatggcagacatttaaattttaggtaatgctatcacagccggtgtagtcaagacttctgtcttttgttttgcaatttatcaaaaggctgactttctcatctaatcctatttcagtggtatgttctacataatttttaagagattttgttgtatctaaccttaaatcaatatcacagcagttttatgattttttagtgcctctctcatcatttcttctaggctttggctggacaaggggaataaaagccctgtgtttttccacaactataagaaatgcaattatcagagcatatcttgtactttccaagtatccctagattgtacaatatgcctaactgtcctaacacaaggggacacttgctgcacactttatgattagagctgttccatgttcctttaacgatatgtggaaagcaaggaaaagaatgctaggagggaaaaaggtctctcctttctttgatgtggaagttttgcaaatcatatagtgagacctcctaagagttcatctcactctaggcacacaggagactgtggctggagtagggaggaagaaatgagaataacatagaaatgattataaatggtcacagcctgtctttggctagaaaaataaacagggatttctgccaaaaaaaaaaaaaaaaaaaaaaaaaaaagacctgggcttgggaggaggcagcctggccctctgtgtgtggcctctgtttacccttctgtataatattatgacaggtccttttcaatgataatgttccatgcatcagtaataatgaatgaaaaacaagaaagcacttgcagggtttgcctattaccttaaaccactgaacatcatagagaaggcagcagatgtgacagacaaaaagagattcatagattaatatagctgaaagcacactgacagccaaaagcatgttttttttccattccagaaagttctacctgtgaaatctgagactctgccttttcatctataaaatgggataaaactatcttgcaggattttgtgaggcttagataaaaatctccaaggagatggaatttccaacagtatccatcaaaatacaggcactcagtaaacttacacgggctaaatagataaatagttttcaagtgaaaatgtaattgtgaagtgcagtttagttctctttgcctctctagggctttgtagaacatgaaaaaaagaagtaaggatctttttattttattttttattttaacaagacccatggactaaaggtaaagagtaatgcaatttaaaggaccaatgcaactaggtaggtaaagtcctacctagactcagaaagtccagacaccagttacaggaaacaagataaaatgtatgagtctcaggataagaccgagggtttcaacattactcacagaaggcaagatgccattttctacaaacttaggggcctttctttgcgtttagtcaactaaacttgaagtgagagaaggaactcaaataggagaaatggctaccatttctttgccggtgatgggggagaagtgaaagcagtggggctatgtattattctgttctcaccctgctataaggaactgtccgagactgggcaacttataaaggaaagaggtttaatttactcacagttccgcagggctacggaggcctcaggaaacttacaatcatcgtggaaagggaagcaaacacatccttcttaacatggccgcagaagagagaaattagtgcccgcaggggaaatgccagatgcttataaaaccatctgctcttgtgagaactcacttactatcacgagaacagcatggggaaaaccacccccatgattcaattacctccacctggtcccactcttgacatgtgctgattattacaattcaaggtgataatcagagcgcagacacacagccaaaccacatcaggctatatggaaaaaaataaatcaaagaagtttgtcctcagacacagaagcaacatttcacgttccaagacattctacaatgaagtgagaagcctggcacttccttcctccacttccagacttaataactggtagaacaataatatccgtaagtaacaaagagcctggaatggatgagtctgacaaagcccatccatcctgccacctcacaaactatctatatttgttcttttttctccagctttggagacagaggatgtgttccagctcacagactttcaggaataatactggaaattgacatctaatcagcattttatgcactataattgtgtaaacttttaggcctgctgtacaataatccttccctgctgtgtggtgagcactttggggccctctggatgctagatgtgatatgaatgggaagcattattattatttatgccttataatatgtcaactctatgtcctctgccacaacagacacttatttcaaatgtgcagtaacagcccccaagtgatgtattgtcaaaatatttttgaaatgaaaaagcaaaattaaccataaactgcccccttgtctccatgaaaatggcactgtaacactaccaaggaaaagcaatgttaaataataaaagctacaacaaaataaaagtcaaaaaaaattggaagagctctgtgtttggaagaagtatgctttggtaaatcacaacaatgacaatttcgctttccaattaaagtgtaatagtgaaagagcaaaccatcaccccagggtatcctcaagaacagctcaatgaattctggcttacttaaaaagaagttttcagtggagctgtttttcttgcaaaagattttagaaaaaaacacagcctttttttttttttttttggatttacattacgcgaaccctgatattatcagatatcatctaatgactcatcaattcatacagacctttaaggttggaaagcacatatttaaatatatagtagacagcaagtaacaaatgataggaactacattttagtgggtaaaatccttctgcaccatcaaagactttctaagagctatgggtttattactcaggtgattcagtttccattttgggacaggtcatattaattttcaggatcttttcccagaatgttatttaattagtgtgactaaatatctgaatcaggatgctacggtatttttaaaaaggaagatgtcgatttaaatgtgatagatacttaacagtttgataaacttttaacagactgtaaccttgatgctttccctggtgtagggaggcatccaagggaccctggtgaactgaaaaagttaatgcacttctctaaacattttgagtctggcagaatctggaactataaaataacatttcttcattaacatacaagtcacaatgctattcccataaagcacctctagcatataaggctggacgtttttcagaccatcatttatagggcgggtttatttttctttgtcttgacattaatgagctatgtattcagggaaatagaagatttcaatgcctgtcaaattacctttcaaattaccaaagcttgcttttctcctactcaaagagcaagcagggacttcttttagaatgggggaccaatggaatattcagtaaaaagggtcatgaaaataaatgtgaaggcagtaatggatccattccaaccatgacttcatgacaaaatgctgtgacttcagcatttcattacttgccatgttctcatcctttgtattattatcacacctcccctctctcccacgttattacatctttttgggaaaagaagatatgtgaaaatttctgtagttgtatgataccttgttctaaaatttagactgctgatttgatatgaaacacataatgtttttatagatcaaggctgccagttatttgtaaccattctgttacaaaaatctttcctgagcaatcttggtatatcatcttctgccacatccttagcaattaactgaagctaactgtttcactaacatttccttttccatttatgtagaatgggctgaatgtgttaatgcaatataacaagagaaataggcacagaaaaatcctctttcatatcgatctcagaatcctgtctgtgtctcatttgggatgaagagaaaaaataatcaagaaaatatgtgttggcagggttaagaatacaaaggaaatattactggaaaatatttaataggtaaatatagatgagggaataggcacaaggttaggtaacaagcagattgaatttcaaatttcctaatgactctccctgttttgcaaatccttccaaaacattacctcatctgtgctttcatcatccctagggtatagggttcgattactcatcctatccctttgcacaatggagaaatttacatgtattcagccctagccgtccttctagtcattctctcagtttagtacttacttgttttcttatttgggttttggcctgttctccataagtttgaaagctgtttgaggacagggatatgtttattctgtacttttctggtatcctcgcttggaaatttagtacttaagagctaggtcgggctgggcgcggtggctcacgcctgtaatcctagcactttgggaggccgaggtgggtggatcacaaggtcaggagttcaagaccagcctgcccaagatggtgaaaccccgtctctactaaaaatacaaaaattagccaggcatagtggcgggtgcctgtaatcccagccactcgggaggctgaggcagagaattgcttgaacccgggaggctgaggttgcagtgaaccgagatgctgccattgcactccagcctgtaagaaggagcaagattccgtctcaaaaaaaaaaaaaaaaaaaaggaggctgggcgcggtggctcaagcctgtaatcccagcactttgggaggcctaggcgggcggatcacgacgtcaggagatcgagaccattctggctaacacggtgaaaccccgtctctactaaaaaaatacaaaaaattagctgggcatggtggcgggcgcctatagtcccagctactccggaggctgaggcaggagaatggcgagaacccgggaggcggagcttgcagtgagccgagatcgcgccactgcactccggcctgggtgacaaagcaagactccgtctcaaaaaaaaaaaaaaaaaaaaaaaaaagagagagagagagacctagggagctacgtcctcattaactattataaggtggtttcagaggagcatgtagtgcactattgaagctcaggtttatcttaataggtgtatttgtatacattcattaagtatacgcagactaggcactcctcattttacactcaaaactcaagtagctgtaggactaaattacttatgattttgatttataaacagcagaagaacaatgggtaatccatattaaaaatgattgtgtatcatctcctaaagaaagcattttgaatacgtgtttatcctgttcttaaatggttttactctttgttatattcattctaattaaactgttctagtgcaaaaatgctaaagcaatttctgtagtttcattttttattctaaaattcttaactgtatactgaaagtgagcttatgaaacattcttgatatgaaaactcacaagttttcaaacataattctttatctttaaacacaatacctacctgaaattttgccagacaggcttatcctcagagtatgctttagtaggttaatactctgaagaattaaatgtaattcacatattaactactggtagaaatccatgtgcaatcatattgtttacttgataattccatatacatctttaaaatcaaaatgctctgtttcacttctcaggagcagttctgacacattttatactttttgcagattcaggattagccaggtagagctagcctgtgttggcttcccagttaaaaatcaataaattttaaacataaataaaaagaaattctctctttaaaaagtattttgaatttctatatgtgtgtgtatgtatgtataattacagtagtaaaaattttattaaatctctaccaaaatctctcctgacacattcctttctctttctacttttgagtaactataataatccttctcaatttttctagaaaaagaaacatgcattcaaactgatctcagaaaagaatttttctcatgccaagtcaaacaagttagcaatggtaaaatatatttcattaaaattttaatctagtcattaggtagggaaggttaaataacttaagccttttcttaactattaatagataatgtcaactcttgcctagcagcttcaataagcttttgcaaagtgttgaattccagtaagcactttcagaaggggtaagatgtatacgtgatcatctacttaggtcataatactgcacaaatagtgctaatgtgaaatatctgctgggatttttagtacaggttgtttttatagtttaaggatcaagttgcttagagagtgttcacttctctaagacatacggaaaatatctatgaaactttactatctgaatgtgtactacctgggcacactatatatagctagtatagcaggatggaaacttcttttggttggaaaatgcgtagacacaaatgacaaaatcaagtgtaagcaaagacagtaagcatattggaaattatcttggacaaagagaattttgcatttcttttgaatatctcctatggaatatatcacatagttactaaatgcttcccgttgagaaatagtgaagaagtatttttctaagaaataaattattagagactcaaatattaacccttattagccatacttacaagagacaaggatgttagttaaagccaggagaattctttagtgctgtctttctagacgttagaatttctcaaatgtattcagtaattaaaaacattttgaaaaatttttaaaaatgtaatatacaatcattttaacacatattttgctaaatcatctattcagaagtcctctagtttctttatgaccctatacagaagataattcaaaaccatggctacaacatatatgttaatggtaatatttatttatttatttagagatggagtctcgttctgtaacccacactggactgcagtggcacgatctcggctcactgcaacctccacttccagggttcaagagattctcctgtctcagactcccgagtagctgggactacaggtgtgtgccaccatgcctggctaattttggtatttttagtagagacgagatttcaccgtgttagccaggatgatctcaatctcctgacctcatgatctgcccacctcagcctcccaaagtgctgggactacaggtgtgtgccaccatgcctggctaatttttgtatttttagtagagacgagatttcaccgtgttagccaggatgatctcaatctcctgacctcatgatctgcccgcctcagcctcccaaagtgctgggattacaggcatgagccactgcgcccggctacaggcaattttttaaaacctgataaatatttattccttattgttccagtcctggatattaacttctagaatttaaaaaaggtgataccttagtactttctgatttaaaaattttattagctcttgtacttaatgattagatacatagaatgacagatcttctaatacaattaactctgtaaatcaagaatcttttcttccccaaaataatataaaaagatataaataatttacaaaagcaggggattacatttagcaccaattcaaagttcttgtgaaaacaattaaagaatgtgtgcaaaatttcaaaactgggatacaaatctgaaattttatagaatcattgtcaaacaattgcagatgcaagaatagtatgtttgatttatttcttcatactttggaacagaatcaagtttgtataaaaaaatcaaattctcaatttttacaaaaagagatgttttgtatttagttatactccataatttcctttcactctttctatgaaatctgtgatgagtagtcactgaaatatcaagacacaacaatgttagactttcattcagtggcctgtaaatttactggttgccagaatatcttatatagtaggtaaaaatagagcttctaggaagactgaattctatccttagttaatgctgaggttcaggctacatatattcccaattgttgctgaaattaagtagtactacatcattctgtcacctgccaagggagtatgtgtccttccttcctcactgatacccagggaagaaacaagaatgcactgaagatagtgatttgcagcaggtgctgaggctcccttgatatatgtacatatacatgtctgactccataatatactggaacccataagaaaggcataaattactaccaagtgtttctctcattcttcctggaaagaaagtcctactactttaccttgcttagtaaatctaggtgctgctctttcctaaatgaaattttgattaagaattattatatctgaaactcctttaacctccatcacttctctttttcaatgccatttgcaaatatgtgctgtaagatataaagaaacactgataagattacagttcccctggtactgtccaactaaaaaggaacccaagaacatttaagagcctggtgtcattttttttttctgggaaaatacatcccattttttctcctgtaaatgctttcaacctggtgacctatgacagctttgcagtgaaaatcttgaactggtttttacttactttgaataaaaggttaatacaaggcttcatggaggtttaatcagcaccacattcaaaaatgagggaagcaaaggcaaagctaatgaattgaccttttaaagagcaattcaatgggataattgccatagcacaattcacttcggggccgaatatgtgtatatggctggtcttccttggatccaatccaaggacatttaagtatgtaagtaccaaaatcatggtgggttggatgaggtggacaacaacatcacatacaacctagtggacctcaaatacatttttcataaaagtaaagctgtgctttcacgcataattttaacctaatcaaccagttcatgtatgccaccaagaaaaattaaaacattattaacattatctgccatctgtgctaaacactttatatttgttattttgtacaattttcatagcaccccaggcattaggtgtttttattcctattttacagatgaagttggatgtctgtctagatacattgccagttcttcctgaaatcaagtagttattcatccttctgttcttccaaggaattgtgtgtcctacctttctcactgatacctagggaagaaacaaggatacactgagaacagtgatttgtagtaggtgctgaggctggcttaatataggtacatatgcatatcagaggggtttaaataatatgcctgatagaccacggtggatgacattaggaactgagactgaactttatctaacaagaccttagaccgtgactactcacctactcttaacaaaaaggacaggtttttgccctgagtgtttttctaaaacatcttacatgtagaagtacccccaaggttaaactcaagataataaaaaggtttccccttggtcttatgccctacttttcctacctttatatttatgagaaacattacaatatatgtgctatcttataggagaaagctaacagtttcctttaaaggggggaagattgggcttttttctttaaatcaattatggctgtggctaaagaattaaagtttgagtgcagagaatcaggttttagtcccatttctgcaactagctttgtcaccagagtaattctttttttttttggagacgaagtctggctcttttgcccaggctggagtgcaatggtccgatctcggctcgctgcaacctttgcctccaggattcaagcgatgctcctgcctcagcctcctgagtagctgatattacaggtgcacaccaccactcttgactacttcttgaattttttttagtagagatggggtttcatcacgttggccaggttggtctcgaactcctgacctcatgatctgcccacctcagcctcccagaatgctgggattacaggcgtgagctactgtgcccagacaccagagtaattctttaggttactcacctataaagtgaaggttctgggctagctgatgaatgagattcacagtagttttcagatggtgtgatttcagtactgttcactcagcctatatatctacaaacactgcactagatactgtgaagagatacgcaatagctgacaagacacaggttaaattctgaatgggtttataatttggcaaattgggggtcggcagtgagtgaggtagagagtggaggtgcagcaacaaaaaatgttcttttatgaaagataatctttactaacccactacacctgcgatgttccttttaactgcatattcctacaatacatatatacaactctatccaaccacggctttacaatcagtcccaggagatgatttgtaaacaagatttggggaacagtagcaaatatgagtaggtagagaaatgaaattttaaagtaagaagactggcttatacggcgacaaggagttagagatgaggagtcagacatgttgaaatgaatggaacttatatttagataggcacataaatgacatgtgcaatgtcatatgaaacaaagctgctataggtcatggaagccacaatcttcaggaaagtagctaaagaaattgaggtggcagtgggaagagtaaatcaggaccagagcgtatgtaagaaaaatatgacaatgtcaagtagcagaaaatttgaaaatgctttggggtatctacattttaaaacacatttctggaagtaatattagtttcttaagcatctatagtgccaggaatgttgcatgcatcatctgtcataatttttacaatcatcttgcaaactcagatatactttcctattttatgcatgcttaagcaggttaagtggcttgataaaggtctctagctagtaaatgagaaagccaggaagagatcacaagtgtgccctgcagctagtaccacgtcaagtcttactccccaattaattttgcaaatatgaaaagtaatgactttagcctatgtggcccaacttcaggccagtcccaactgggaagattttataataacttcttagaaactgctactggctctttctcactggcttagtagtggatattaatctctttattttccatatacaggcatatggcttgcagacatggcatactgtgtgcataaaaaacttccttagaaaatacatcatccaagaagcaggaattgctgattatttcattactgcagcaaactcatgtttctaccatcccaagtccggactctgtctacaagagtagaaaaaatccactagatttttaattcaacatctattcaagttttgaggcacatgctatctgaaacaccgtaatttttgagtttgaaacagagaatttttctttagcaactttggccctgaaatgtcctccaatctcaatgtcaggaggtttgctacaatggtctggagagtgtagtttttcataaaaatatgttctatttttcaacaccaaatgaatatctctttcctgcatattgctcaaaatagccatttccttcacatggttatgttttattactcatgtcatcagatctggcaatgtgagatttatttagggggaacatttcatcaattacaaaacataaagcatgtgctgtctctcaatgagttcagttacatcttaaataagttctgagctgttgggagaattacaaagaacacacttttcctgaaaaccattaaaattgcatactcatagaattttaaaaaaattctatgcctgaagttttaatatttttatcccagggaagtggattttttcacttcctttttagattatggccctgagaatatatcacccgaaaatgaagcatgaaaaacaagacaacttgagagcaactcacagaaattagctgatttcatgatatttatgtgctactcacttgcattgtttaagtcttttcttttctttttttttttttttttttttttttttttttttttttttgagacggagtctcgttctgtcacccaggctggagtgccagtggcgtgatcttgattcactgaaacctccggctcccaggttcaagcgattcttctgcttcagcctcccaagtagctgagactacaggtgtgtgccaccacacccagctaatttttttgcatttttagtagagacggggtttcaccatgttagtcaggatggtctcgatctcctgacctcatgatccacccaactcgggttcccaaagtgttgggattacaggcgtgagccactgcacctggccctgtttacttttttcattgactctccctgccttaagagtaaagctcaagtttctaccctgtcctgatttatttccttctttccttccttccttccttcctccctcgctccctcccttccttccttctccttccttttctcttttccctttccttcctttgttcgttcccttccttccttcgttgcttccttccttccttcctccctcccttccttccttcctccctccctccctctctcccttcctccgttctttcctttgctccttctctccttttttgagacagtgtctcactttgtctccaaggctggagtgcagtggcactctcatgactcactggagacttgacctccgtggctcaagcaatcctcccaactcagctcctgagtagctgggactacaggtgcatgccaccatgtcctcctaatttttatattttttgtagagacagggtttcccagcttggccttgaactcctgggctcaagttatcctcccgccttggcctctcaaagagtgggaatatagatgggagccatggcaactgcctgagccctaccctgtttttgcagggccctgcatattgtagtctctgtctcctaaacaggggaaacttctatcctaacacctttgctcaaactgtgcttgccacctagaatatcttcccacatgcacagttatgggaagcctccttataccttaagggccttgctccagttgtaaataagccccgattcctattatgttgtgttagttttctctgggctaacattctgtcttcaagatctttgtgtttagatcctttgtatgtttcaatgtgtcttgggcataagtactgagagcacaggttaaatgcaaaggtgagagaggctgtggagaaaaaattaaaaaaaaaaaaacttttggcatatttagaagtcactttgcttctcttactgtcaatgctcttatttctgccctagccataactgtaagaaaatacttaccagttgttcaaagataggttgttcaaagtaaaacattaaaatgttgctctttaaaattctttttgtggatatactgagggagcttttataatcctataaatatagagaattgggtgcacatttcttctttaaagacaggtttttacccactcttcctaggtatctaacaaggagacatcaaggcattttaaaacaaaagacccagattctaaaataataatgtctttttttacactcaagattccaaacacaatttgactgaccttcaacagtcttgtaaatagccatatctagtctcactccctatagagagaaaatcaacagcatagtgtgtcctactgaatattatataagttgttagtatcagcattaaaacaagggagtcttactccttaggtgctgctacacatcatctggataggcaatctctcagcacaccacctaggccttatcttctgcacattgctcaggctaaggccatgcctggcaggtagtcagtatgcaacaaatgagccatcaaatataacaatataatgaaaggccattaggtagtctctagaaatatctgtccttaatcttacatttgttttttctcactgtatgtctaaacattgctagtttatcccagaaacctagttgcttcttttctgacagtggttgtattaggtaagatgggattgataaaataatcttggaatcttaacatgtaattaggtgaacaataaaactatataaccaaggaaatgtgctgggttcaagcataatcaagatacaaaatttgtcttcatggagcttgcaatgctgttagtgagtttgatggtctgaatgtttgtgttttccccaaattcatatgttgaaacctaatcctcaatctgatgttattaggaggtgaagtctttgagcagtgattaggtgttgaggatggaggcttcatgaatggaattagtgcctttataagaggctgaacaaaccagagttcttccttttcaccatgtgagagacaacacagctaaaagacagctatctgtgaagcaggaagcaggccctcaccagataccgaatcagctgccaccttgatcatggacttctagcctccagcattgtgagaaataaatgtatgttgtttagaagtcacccagtttataccattttgttatagcagccctattggactaacacagtgaagcagtcactacggactgaattaggtccctgcccaaatccatatatatcaaagccctaactcccagtgagtttgtatttgaagatagcatctttaggaggtagttaagattagatgaggtcttaagcatgggatcctaatccaacaggactggtggccttataagaagaggaagaggatgcacacacacatgctctccatcctacacgcaggaactaaggaaaggccatgtggacacacagcaagatagtggtttcctgcaagtcaagcaaagaggtctcgaaatgaaacctactttactggcatcttgatcttggacttcttagcctctggaaccgtaagaataaatttctgttctttaaatgcccagtctgtggtggcccaagcagactaagtcagcagtagggcacattgggctctgaatttaatatgaataggtttcaccacttgtcaactatttgactagagggactttcttagccttatccttaataagcccaaaggtcttttgaatgaaccttataagaatatctatctacctcaaaatattattgtgacatttaaaggagaaaaataaaatataaaatgccagctccatgccaaaatataaaataaaataaaatacccagctccatgccaaaaatgctcaaagatgcaaatgcaagcaggcatttaaaatgtctgggtaactatgtgtcaagtgggtagcagagacaaaaggactgtagaattttggaggagaaagagggtctctttggttggaagaatcaaagaacattcaagatagacttaatatttatctcagcttgactaaaggttagacaggttgcttcctgactataggcccatgaccttcttttccttagagcctttactttagaaaacttgcaattataaattctttctctgccccttttgaaatgtatctaaacctccttaaaagcctctggccagttctatgatctagggagtatctctctcaaggacctgcatgccatacttttcagatctaattatcaagaaagatagtgcccccatctcccagtctctgtggacacataggagtctatcataagtgaacaattagaaactataaaacactttatgtcatgcatatgtgagaaagtttactttctcctcctgtaaggataacaggcaaacacaggtggcctatgattctcctacatctgctcttaaaaactgtccaacactttgtttcttcagagttgagttcagtttctctcccctattgcaatagccttgattaaagtcttccttgcctgtgaaactttgtctagcacatttttctttactttgacaggaaacattcatagagaatatacaacttgaaatatgttgtaaggtatggcttagatattggtttggcaatgtataacttaaaatgaaaagctgcatgcattttcatgttagcagtaactagttatggcatgtctcaatgctttactcaagagttttcttgagatctttttaatatatattatttcaacagttactcagcacaaagtaagtattttttcaggctcaaaatcctgcactaacattgtaagctccctatggcactagagtttgtatatatactttcaggcagctgaagacataggtaaatctttgcaaatggggagagagggggacaaaaaagggttcctggctcataattttaaagcactacccacagtgggactgttttctaaagaactcttaagtatgcagcatatatactaacatgtaaagcacaccttttgcactaatcaaatgtgaagttatataaatttaatatccaatgacttaagaaagtgggatgccaacactcatctttatgactaaagtatacaattttatgaatcaatgtaaagaagccagcatgcttggaaggaatcttttgctcaaactcagattatgttattacactgctaatcttggtgtgtttttttaaaaacgtaacatccttctaatcaagcatgattagttacaaatagaatccaaagaaatatctcaaatgactatatatctaaattatcttgcttattacttatgggatatttttcttatccatatccaggttaattacaatttcagaaattatctgtacaaatgaataaaattcaattctcttagccaatgagttactttttccagtgtaaagtacagtcatttaggcattcacaatatatggaatttagaaatcttttaacatgatgaagttgaaaaaagtaaacaaatattactttgccaattctccaccagtcagaagcttgtctatatactaactgtgtatttagaaaatatcaatgcataaggaagagaaatgcaatttgtctcatccaaacgcatcatataaaatgaccaagtgctgttaagtgctagagatgtgtctcaaaagactctcaatgtctgtatcattttggggttgtttggaagttaaacccttttagtaagaagtattggaagataaatctagttctcagcccttaattcgccattcactggtgaggtgttcttattagagagcatgtctcctggtctcactagttcctaatgaatgtgtctggcctttcctagcaatatataaattctgagaaattggaagacatgattgctccctacccaattctgaaaagagtgaatatatcattctttgtaacagatggaatgtattaaaaatatatcaatatgtgttttcataaaaaagaaaatatctaccattcaattagaaaagtattttggagaataataaaaatgatagatatgctattttactgttactagccagccattattgttagaaagaatatgattctaaatatactgaaagtctggtgacatgtacaagacaggaaaagcacctttattcactcgtaataaatattttcctgttcattccctacataaactagaacaattaatattttcctcagctttcctggagaatgagatatttgacctgaaactttctctattgtgatactgctagcattaattaagtggcagtattcaagattaattggagacaagaagactagttgggaaattgttttgtcataaagtagaaaatagtgccatgatggaaggaatggaaaggaaattcaatttcagaaatttcacaaaggaaatatggttagatcattgaggttgaatttgcagaatttagtaatatacaccaagattgcaatttgagagctaaaagctgtttcaagttcagtgttctatggactaaactgtgttcccggaaaattcataggttgaaaccctaacccccaatgtgacttatttgaagagaggaactttaggaggtaaagttcaatggaattataaaggtggggccctaatccaataacactggtgtccttatgagaataaaaagagacaccagagctctttttccctgtacacagaggaaaggccactcagagagggtggctgtctgcaagccggtaagagagctgtcatccaaaattgaatggatggacactttaatattggactttccaggctcccaaactgtagcataataaatttctgttgtttaagctactcagtctgcagtgttttcttttatacacacacataatacacacatacacacacacacacgcccccatatttatatactgtgtatacacattatatatatattttgttatatatacatgtatgtatacacacatatatatataatcttattaaaatcttatatatgttatatttgtctctattaactaaaatttaagtaccatgagggcaggaattttaatctattgtgttcaccactgtttctacactgtctaaaacagtgcctttcccagtcctaagcaaaaagaacaaagctggaggcatcatgctacctgatttcaaagaatactacagggctacaataaccaaagcaccatggtactggtacaaaaacagacacatggaccaacagaacagaacagagagcccagaaataaggctgcacacctacaaccatctgatctttaacaaagctaacaaaaataagcaaagaggaaaggactccctattcaataaatggtgctgagataactgactagccatatgaagaagattggaactggaccccttcctcacaccatatacaaaaattaactcaggacagattaacaacttaaatgtaaaaccccaaactacaaaaaccctggaagacaacctatgcaataccattctcgacataggaacaggcaaagatttcatgataaagacaccaaaagcaattgcaacaaatgccaaatttgacaaacaggatctagttaaaccaaagagcttctgcacagcaaaagaaattatcaacagagtatacagacaacctacagaatgagagaaaatttttgcaaactacgcagctgacaaaggtctaatgtccaccatctataaggaatttaaacacatttacacacacacacacaaacccaattaaaaagtgggcaaaaggacatgaacagacaattttcaaaagcagacatacatgcagccaacaagcatattttaaaacgctcagcatcattgatcgttaaagaaatgtaaatcaaaaccacaatgagataccatctcacaccagccagaatggctattattaaaaagtggaaaaaaaaaaaaaaaacaaacagcaggtgctggtgaggttgcaaacagaagagaatgcttatacactgttggggggagtgtaaattagttcaaccattgtggaaaaaagtgtggcaattcctcaaagacctaaaaacataactaccattttacccagcaatcccattactgagtatatacccaaaggaatataaatcattctattacaaagacacatgcacacatatgttcattgcagcaccatcctcaatagcaaagacatggaatcaacctaagtgcccattattggtagactggataaagaaattgtggtatatgtacaccatggaatactatgcagccataaaaaagaatgagatcatgtcctctgcaggaacatggatggagctggaggccattatccttagcaaaccaacacaggaacagaaaaacaaatatcacatgttctcacttataagtgggggctaaataatgagaacaaatggacacatacagggaaacagctgacaccgggacctagtggagggtggaggttgggaagaggtagagtatcaggaaaaataactaatgggtattaggcttaatacctgggtgacaaaatagtctgtataaccaacccccatgacacaagtttacctatataacaaacctgcacatgtacccctgaacttaaaataaaagttaagggaaagaatagtgcctttttcatagtaggtgttttacaaatatatacttagtaaaggaatgaaataatgccaatatttgaatgtggttttgtatatgactcaaacccatatagatctgtaccctatttctatcatatttccattcctttctaaaaatgtattttctatgttgacttacctgaatactgttattctaaggtccacttggataatttatatatagtttcataaatgagtagattttagcagaggtgattggcccatattagaatgtaattcaaaacttgaatttattattttaaattgaatataacagcttggttctatgtgtcataagtagagttaaagtcatatacctttcttatatttcattcttccgtgtcatcacacaacaatgaagggtacataatgctaaaatgagcacattcattgactgcacatctcaggaagaaataaaagaatataacctgattatttgaagttacagaggctagatatggggacatctaataaaaagtttgaataatttcaaaacatatctttttatctttgtgagattttctctggtatttacattttcgtatcagcatttctcatgatctaggagttcctactacttgaattaaactatcatgttttctaattcttacaagctagatttttccttcccttacagagtctcatttctctacccacttactgaaaaggtagtattttctgtgtgtgtcttaaaatgtttttagattgcaaaacaaacaaaaaaactctcaaaaacatgctgttaacttctgccagctgtttaattaagcagattttataggaatgtgaacaataaaaagcaaaattctggagctatattgcaatccagataatattcttatcctcagaggaaaaaacaatgaccttcacttaagttctgctatattattggctatgatttgaataagaaagcttagtatgacaactgcaaaacatatacttggagaaaaatagcctaaaatataaaactaaggacaatgtaggagcatgtgtgttaatgcataacagacccacagacacagtgggtatcacaagcccttttaatcaagacagaaatatgcacatatatatcatgaacattaatgaaacttgtggaactcctccatggttccaaattatgtcctgtctcaaaatacatttatgtaccttatggtaaagtgatctttgaataatgggatcactgaccattacagttcaccgatgaatacttctaaggaggaaaggagagaaagctaactataagacttaaacagcacctgctgtcagctaaacaaattagctgccctgaaatcacatgtacccacaaggaatgaatagcacaacctttacctaggagactgccttcggaggaaaatgcgcagaatagaaatagccagtatgatatggcttggttgtgtccctacccaaaatctcatcttaaattataatcccggtaatcctcataatccccatgtgtcaaggaagagaccaggcggaggtaactgaatcatgggggaggtctcccccatcttgttctcatgatattgcgtgagttctcacaagatatgatggttttatgtgtgtggtagtttctcctgcattcattctccttcctgctgccttgtgaagaaggtgccttgcttcccctttgcctttcaccatgattgtaagtttcctgaggcctctccagctatgttgagttgtgggtcaattaaacctatttcctttataaattaccctgtctcaagcagtgctttatagcactatgaaaatggactactacaaggcttctaattgttatcccaaatttgttcagcttttgacaaatctgtatacacatttgtctttgatttttagctgtttgtttgactttttaactttttagctattaaattttatcatttactaggctagagcagaaatgataatacaggtttttcctcatttcttaaggtgtgattaattacaaacatggccaaaattcttgcaattcctctccttgaatttgggctgaccatgtgacttgcttaatcggtgtggcaaaagcaatgtaacgtgagttctgtacctgagcctcaagaggctttgcaaaattccattttcactcatgggattctgtgattaaaccggccttttggaggatggggcataagctgttctaactaattcatcttagatagccagtctctagctagcatggcaagctgatcaccaacatatgaactagtccagttgagatcagctaaacctagcccagatcagaaaaaccacctactgaagcccagtccaaatggcagaaccacagaattatgagctaaataaaaggctgccattttaagcaactaagttttagaggagcttggaacacatcaaaaactaaatgacacaaaaggttagctgagaaacattttttaaagacaaaatgtattttaatccagcttaaacagaatatctttattttggttaactttaaattaatagatgaaataggtaatgataactatacagggctaaaacattttatatatggttaggtttgagtgtaaaatttttatctcctttgttcttttttttaagtcagtttctgggcttctttttagcaaagcaaacagttatttggctctaattacaatcaaaatttataaaaaaaatttttgaagtcaaagtaaaaaatccagaatattggaatatggctaataaccaaaatcttcctctccttctaacactactttaatatctcactaatatttctattccttactccctggaataaattgaaataggataacaagataaaattatacctggtttttcattctgggttttcttcattgataaatagagggttatgaagtcagaaatataagactattttctcctgagatttcattaaagatacgatattaggaagactgaaggctattgtgctggcttaccacatcatatacttccaaccatcagaagtgaatgacaatgcaataatgcaaaagaactcagctcttatcaaccacagaagcatttagaatttctgtgactgctctttgagtacaaacgattattactaaactttgtcaaactgggaagattaaaagatttttcagggttgtgtaagtgcaataccataaatactcaaccaagtagaaactgcttcagcaggttaaactaatgtggggaagacactagaaatatcagaattcagaaacactgactccaatgcattgtttttttcatatttcagaatctgctaaaagttgaaaaccagattaattgcggccatagaaaagccttctcatctgtcatttgaatgtgaaaagaaattacttgaaatgtagtgggcattctacatttcaagaaagaaagagggtcgatgaatgaaataagcagaaaaaggaacagcttagaatatgatatgtagagatacctgaggataaagaaacagtgagagcgaatctgtagatagtctggaaggagattagcagaaaatatacataaaaaatcacatcagttgacatccctctactctgtgacattgtggtggcgtctaagaaggtcatcagtgtttctcagtatctggcattcctgcccctatgtaatgtccttcgcttgcatgtgggctagacttacagcagccaggaggaagtgtcacttccaagattaggttataaaaagcctgtggctcctatcctgggctttctctctctctctctcatctgtcctggaagaaaagtaaattgccagctgttgtgaggatccctgcacccacatgtaagataataaggcatgctaacaaccatgtaagtgagcttgaaagtgaatggcatcctacacacacagctgaaccttccagtgagactgcaggaatgatcaccagtttaactccagcctcacaagagatactgagccacaggcacccagctaagtttttctgggattcctgacccataaaaactgaaataacatgtttcttattcatagctgcctaatttggggataatttgttatacaggaacagatagctaaataaccacctaaaatatagaaaagaatagttttctccgtccttccctccctctcttcctccctccctccctccctcctttccttccttccttccttcccaccctccctccctccctccctcctccctttctttctttttgccaaaaaagcaaaaccaacaaacaaactaaaatctagacagtctttcttttaaaagcaaagaaaggctgggagcggtggatcatgcctgtaatcccagcacttttggaggcagaggtgggtgaatcacaaggtcaggaattggagaccagcctggccagtgtggtgaaacctcgtctctactaaaaatacaaaaattagccagtgtggtggcgggtgcctgtagtcccagccactcaggagcctgaggcaggagaattgcttgaacccaggaggcagaggtggcggtgagctgagattgccccactgtactccagcctgagcaacaaagcaagactccatctcaaacaaacaaacagacaaacaaaaacaaagaaacttcccagcactttgggaggctgaggagggtagatcacctgaggtcaggagttcaagaccagcctggtcaacatggtgaaatcctgtctctactaaaaatacaaaaatcagctgggcatggtggtgcacgcctatggtcccagctactcaggaggctgaagcaggataatcgcttgaacctgggaggcagaggttgcagtgagccgagatcatgccactgcactgcagcttggacaacagagtgagacttggtctcataagtaactaaataaataagcaaagaaactgtgcaaagagaggtaaggctctttctgtggatgttctctatttgggcattagtttgtctgctatatgcctgctacttccaaagaaaagcctgtagctctccatactctgtttattctcaacctgacaagcagtccagactggtgctaaagaacagaagatacacatcgagatccctttggaggtaggttgttgagggaaagagataaggtttgatagaattaaaactgtgactgggaatttaaaatgatgatataataaaggcaagagattcaatacaagaaaaaataagtatgttgagtagctcatggaaaaacaaaactatagaaaacaaatatgattcaaatataacgcaaaataaaatgtcctgatttctgagcaactgataagtgcaagggaatccacttgaccttgatcctagaggtggaaaaattctcctttgagtagtccaggtaatatgatatttaactcataaaaaaagaaaggtaatcttaacatataactgagattagtattggataatatttacacagtaatggtaatctaaatggtcttcattgttttccactttagaatcctcataatccaaataaaatatgggagatttagttgtggttggttgtcagacagaatgttaaagttaacatccctggaaataaaatgagatcatgagatgaggaaaagaagagggaagctagaggaatggggaggagcataaaaaatatctttagcttactaatgtggatacttaagagataagagatattcttgtaaattaatggaacaagaaattagatgcaactatattacttaaagcaacaaaatttatatataatttacatatagttttatctaatatatatcaagtattatatatataatattttatacacatacagacataattcacaggagagaaaaaagcaaaagaaaggattaaagcctgagctaatcctcaattttcatatccaggattgtataagtattgtataaaaggaataaataaacaaatggaacataagcatattatttggagatatggagctaattaccaaaaagaattattaaaagacatttactctggggaataagactgggagtgatgaggggataaatgtggtatcgttgcttttttatataccatcttctaaactatattgatttgtttttatgtgcttgctttatattaatgaaaacaatgtatcaattattcccacttacatatgtacaacaaagcaaaaaagtgaattctgggagtaatctgttactagtttcaggaatagttttaaaaaggaaggtataactggtatttgcaatttgagttatcatccatttaaatatattgtattttctttttttttctatttccttttgctttttttaaattacactttaagttttagggtacatgtgcacaatgtgcaggtttgttacatatgtaaacatgtgccatgttggtgtgctgcacccattaactcgtcatttacattaggtatatctcctaatgctatccctcctccctcctgtattgataggacgtatctcaaaataataacagctatctatgacaaacccacagccaatattaatatattttattttcaaataagccacatagcaagaataaattcctttgacatttcctaggctttatcaagatctgtctgttgtgaggaattcattccactacccaaacttcatttaagtctttgcatccaattagtgttatcccaacatgtccctctaatctcttcttttgcttctctagttctttgtacttcattcccatttttatttgcctataaaaaaatcatagtttttacatgcttaaactctgcaatgagtgtcttttaaaaatgttatacattttccctatttcgatctggttttctagatgtctaaatatcaaccttatgcacagcttgtcttgtagccctgtcaagagtcactggtgcaaactggttctgtaatcattaggcttcctagagattttcgcctgtttcttccactccccctaactggctgaagacatcaaaaaatcagacaaactgaaaatgtgaattctcgactctttgaaatgggcaagctacttgcaaaattgtgaagtaagttttagctatttgtctgtggctcaccacagacagcaaggaaaaggtaaactcctatgaagacaataagagatgatttcctgtagagaatttaaaaacaataacaaaggtgactgaaagtcagactgctttttattattagagtgtgtcaacaagtctaaacaatgtcagtgataaaatattcctcttgagaggggaccattaacaatgcccctcctccaccttggtacggcactataacccaaaatgatgagactctagtaaacctctggaacagggttttacacatgttaatctgtaacctggtaggcaaaattatgccactttgggcccgtctcttttccttttagggacaactactggtgcctccttcctagtcttatgagaagaatgtcagtagcataaattgaaatgggaattttgcttcctgcatatcgcatccacccctttttcttaaataaatatgcacatgctttttaaaaaaccaaacaactgtaatttcaaaatgtctttatactgcataagaaggaagttaattcttttaacatcttgttatatataccatctttattctctgcaaatattgattaatctaggaaaattcaggactgatacggtttggctgtgtccccacccaaatctcatcttgaattgtagttcccataatccccatgtgccacgggagggacccagtgggaggtaactgaatcagggaggtggtttcccccatgctattctcatgatggtaagttctcatgagataaggggcttcccccttctctcattattctcctttctgccaccatgtgaagaagcatgtgtttgcttcctcttctgccatgattgtaagtttcctgaggcctccccagccctgcagaactgtgagccaattaaacctctttccttataaattatccagtcttgggcctgtccttatagcagcgtgggaatggactaatacaaggactgagcaatacacaacatttatcttagcatcattttatgcattctgtgttcattatttattcaaaaaccacttactaagtgtcctttttgtatcaaacactgcattaggtgctgagcatacacacattaagacaaaggtcttgactttaagatgcttgtcaaaaaaaaaacttaaggttataatctctaacaggtagatcattatctatctatctatttaaatgaatctctattcatctatcttttccaaagtgctatgaaaacaggaaacaggttctgcttggggttgttcaggaaatcataaagtgaaatgcaaagtctaaaatcttcctgtgccattaacactaacaaagctttagtatttttcaaatggagaagtgtatcattaactagatcacaggtacagtcgcaaaacaagaaaaggaggaaataggaacactgctggcagatgagtcagtatatcagaaagtgggaagttgcattttgagtttaggcaatgtgaacagtttactaatagcataccaaatacaaatttcagactagattctttatacatgtgtttttttacttttctgaatcaaattcccaaacaatgtagaatgcaaagttatataagataattgacaaagttacataagataattgagccattaaataaaaatggaaaactccagtcacaaaaatgtctgaaactacagtgaaaattctctctttggacagtggaaagccctcagttcagaacagaacaagttgggcacttaactttcctgcagtgtcttatcttctatcttgtattagattgccatgtagaccctgtcaagaaacattaccaactgctagttaatgctgtgcacggaaaagtcagacttggtaatgtcaccacagaatttgaaaggatattaatgggtccttttcatttctgaaaaaatagagattagaaccagagaacttcccttcaaggacaatttcttttggaagaaacttatattccctttggatccatgaacacaagtacctacatcattttctagctgtggactcactctttcaaaacatactcagggacagctgatgcaaaggtaagcttggaggtgtagaaaatataaaaatcagtttttctcaagtgtgttccagggccaaatttttactgctgaattttaaatgctggtctatgtttaaggaagatcttataacagctagcatagcatggcacaacacatagagactcctcacttggttcattctccaatattttggggaatctatagttgaatatatttgttacttggtcctggagtaatgtgggccaaatggagaatcatttctcttatttgagatttgggtcatcatgtgtgaatctgtagtgtctagaataaggcctagcatatggaaggaagaatgaaaaaaaagggagaaagaagagaagaaaaaaggcaatagcacagtggggatgaggatactaaggaagaacaaatgagcacctgctatgtgccagatgctatgccatgagctttatttgtgcaagtttatttgatactctcaaagaatgtggcaaaacaaacatgattttaaagttctcattgttattgcttcatactttactccatgtcgcagttaaacattgaggttcacaattataacagtcttggagttttctcaatagcatataatttattccatgtaaagatgaagataaaaaaatgtagcttcccccatatgcctctagggtactctgtatgtcctgctgaagtagaaaagtcctagaagggagctaagggggccgaggctaccaactactctattaaatctacagacttgatggtaatgtctattttagaagaagctttccgcaaatgcaacttagattttaaagacatcagcaagagaatgtggataattccagagtgagggtagtgtctagcacattgccaacacttaagacgtgaaacacttaagaagcatgtttccccaatatgcttgttattaaaaagagtctaaaatatcttttctcctttaaatttgtctctgagattcaactgtgttagtgatgctgttaataatatactctaaatctgtcatgtacaaaagctttgctattgttgatgtagggcactttataatttatgtatagattcactagtaatctaaggtgtgagaaatggttcttcaaaaaaatcctgaattgctaggtatttatcctcaagaatagcataataatacctagcaaagtgtgctacatatattagttgcacataagattttgcaaatttgtaattctaaatgaaaattttgtggatttacaggcaacatatagcatggtaaaaaaaatacacacgtacatacactgcctattttgttttgttttgttaattaccatttggaatgcttactggataaaccattggttaacacaagtgctatttgtctgcttgagatttcatataaagagaatagtgataacaagaatacagtgaaagctgtttggtaaatgctgaataaaggcagagaaattacctgagccttctcctgaggtcccagcctaatggtgttaatgtattttttattgctggagaacttttcagtgataccaacaacaacaacaacaacaacaacaacaaaactaacataggctctagatgataaaacatgtaagaaattaacatagagatttaaaactaatattgacttagttttttgaacaagcttaatgtttacatatatcatgaaggagaatagcaagtatggttaacacacacatacacttgtatacacaaaattatcttttttgttttgagacagagtgtcactctgttgcccaagctggagtgcagtggcatgatcttggctcactgcaacctccgcctccgcccaggttaagcaatccttctgcctcagcctcccaagtagctgggactacaggcgcgtgccaccatgcccggctaatttttgtacttttccttcctccttcccctcacagacaatgattattatatgtaagagatgaataaatcaacaggtgtaacacaaacataggtatgtattgaaaatcagaagttcacaaagtattacagaacaatttgtagagctgataaaaactaagacaattaaactaggttatattcttgctacttagacaagaactaattatttaataaaaagatattactttgtcctaccactgagactagacattttagaggaagtgccaacttcaccagtcctgagaaaattcccactgaaatcactgtcatgtatcgactaggtacacagacttcattcaatatctccaatgctgatacagaatatatcaaaagagatatcgagaatcatgagcccaatctagtctaactcacagctggaagtacttgaagtttttcattctcaagttgaaaaattagtatataatgaattcttaagctccttaatcaaaatatgttatccaggatagatacagaaatcatatttgcaagattcagtatcacaccatgaattaccttctgtgtgtgacaactggggaacagacacaagaaacttcctgagtgctcagtcaacaataatttgaagttggtgaggaagtaggggaggttgcataaaacagcgcaagttatgggaatccttggacagctcttcgttgtccaggactgtcccagcattgcagtgtgtgtagtcctcatggacctcacgataactctctctttgtgttattacctgccctccactgccgcttgcttcccatacatacatcccttaggggaatggtgctgcctcattcaacagagaattcagcttggtacatgccacacaattgatgtgctgctgaagaaacataaattcacagctactcttcaagggcagagaaaatagctttaaaggtaagaaagatgctttaatttacagtgtgtacctgaagaatgcttctcagacatgactttcagatgtatggtgctcacctgtgacaggtactttgaacatttctttatattttaagatgaacatatgaaatttctattttttatagttaaaaactggtgaagtggccatcatttcatatggttcctatactcttgactcctataatcctcacaataaacttatgaggtaggaaactgaggtctaagtaactcacagctagtacgtggtaaacacaatgctgggatataggtgggcattttggcttctggagtcaacgcccttgaccactatgcatagtgccccaacatcccacacaagctttcagaccttagactcccagaacgcagggcctcatcatctgatcatgttaggtgtccagcatggaaccatatttataggcaatgcctaaatagatactattagaaggagtaatacatgatacaaaactcaacttcactcatgactcaaacacttactgtgtgaccttcgacaaatggttcccatttctgagggctaaacttttcagtctatcacatagaatgtatatggatgcattaaggaagggaacaatatgactgtatttgcattttcaaaaggatagtctgacagttgggtggagatcacaatggaggtggttaagactatgagaaagcaggaggtgatgagattctgaataaaggcaatacgtaagagcagaatatagatcacctcaatgtatcctgaaaaaaagtgggcagcatagccttgggtaagttagcttttctatgcctcaatttcctcctttttgaggaggaataataatatcaagttgtactttttgagtttccatctcttcctcagacatatatatatatgtctgaggaacacacatatatatatgttctgcaggatatgattacacttctgatttaattagcaaaatatttattagaagccagaggaccacagaggccaggtccttctagaggttaggagcaggtaaagtatatcttggtgttgcttttgatcttttctctggcttccagtttcctaagaaagctaatgctgccagtggcactatccatacagggtgcagtccttctgggtctgaagaaatgcctgaagattaatataccaaagttttatgaaattgatacctacatctcgaatactttacgcacatccattcaaaagagatttccatttcatggttcccttccacacacaggcatccccctcttccttcctctgtttttttttcttttttcctgcagcctttgacatcccacactattcgttttcttgtctattgcccatcttctccaactagaacataagttcggtgcagaaaagtctaattttgatcaatgctgtatttctacagactagaaaggtagtagaaaggtacctgagatatagcaagtgctcatcaaacttggttaagtgaatgaatgaatgggtatatgaatatatttatctcggactagctttgtgagaagacatctcaaaaccaagcttgcatctaccaatagagcattttgtcatctagtaaaacctccagaccccaaagaaaatgcaccacgcagaacttaaaaaaaatcctttaaaatgcattactctagtactttttcttgccagtaatgagaggagaaaaacaaagtctgaataactgttgcttacacgcatttaaaattacaatacattacactcttctcaccaggcaccattaagttcaggagaacatgcctttgtatatattttaaaatacacatcaaagtgtttttctttgaaatatgcactaaaatttgctgtaaaaatgtacattaatttaagtgaattcagaagattgattggactagggaaaataaattaattattcatgtcaccagtattttttaaatgcacagtggttatcaggaacatatataattataagtaatgctattattttttaatagcaaagttacagctaaggttaattaatatttttaataaaaataaaattttgttctttgaagttgcaaaatgtattttgttagctctaaatatttttcaaggaaatgtgtgtgaattctgcttacatttttcaaacaaataatattcatttttcatgagtacctccaaagcctccaagcaagcaacagaagtgtccaatatattcaaacattcttttcttgcataaacattaattgggttctttttcagaaaacccaactgggaatcaaatgctactgactttaataggatgtctcatatgtgaaatgaatgtctcttacaatctaccaatgatatttcttgaactctcaatagttcctttccttgagtaggtttgctaactctaccctgaaaaaatgcctaactgaaaccatggaactgctccaatacatttcactcatatttactgattctgtctcactttataatttaatttcttcccaagagttgcaaactatagtcaaaaaccagaatctctcaaaattttattctctctcttttctcaacattgttgaaataagataaaaagaaaataaaaaaggttatggattctaaaaaccaggcaaggataccacagacaaattttgctctgaatataaagaacaggacataatatgtattattcttatgaagtatgcttttcttgcaaaggtaaattttggatatgctgtaaaagtagagtataatataatttatagaccaaatggcatacttttgagagtcaaaaatatactattaataattacactgaacatcaggtatgcacaggtactatccaggccaactgggctgcatggccacatgatggaagacagaggtgaaatctatgttttggtaaataatcatgagaagacctaattaagagcatcatcactagaatcaaagaaatcttagagctgagtacaacttaagagtttcctagttcaacctacttattttacagaggcagcaaggccaaagtacaatgatgtgacccaagttgtccaagtcacatgacgagataggtggttgtgttgaaagtggaaaccaggtctcctcattcatcatgctctttccattatactacaatctctctacagtatgtatgtattctctatagtatgtatgtagcttgtaaaatattctcgaaggaaagaacaaaaagatcgtaaaatgtgctataaagaacattccagaaacgatgtcacaagcttgatcgtaaaagaaacagcacagttcaattttcctttctttgtggacaggcaaaggaaggaagtgttgtcctcttcatgttggcttacatgtactcatctcataagacattgcaagtttaattagaagagggggaacatttagcagccaaaaaacttgcatgatactcctgccacatgccaagaagctctcagaatctcaaagaactttataccaccaatagtttttgtgaatatttgctttctgagattagccttctggaaagtttcataaaatcaggaggccttatggaaacatttaaaaattaaatattccaagtaaaatgaattttataaattttataaattttatgtaatccacataaaaagtactatcaatattgttatattcacattaaaaaggaacaattcgatcagaagttttggtaaatgtccctattatttcttgatataaatcacatcttcctaaagtaaacattgggctgaaaattgattatcattcaaagcaaaacttcttttttttttttttacttttaaaaggatatttactttaagtaggaatataaacaggactttatggaggatattttgatgaacactactatattctctgagtctgtgaaaactgaaatacatttcttccctattactatccctgcaggatggctgaacaaacctcatctcatctatttgaaatgagtccaatttaattctgcctgaccaaaaatctgtttccatagttttaaaacatgcaatcaccccaaggtacattgccattgtagcttaagtggctcagtgttatcactgagaaaaatgcactttgattgagaaaacagtccagtgtggcttttgaaaaatgaaatgaccctttctgatacacaatttagtaagacagttgataaaagcaggcggatatggccactatagacaacatttaaaggaagatgcttcatccaacctgtaaaaataggtcaaagtttacagtttcgaaattaacattagaaatttatctcatatttaaacttcctggtttaaatattactgtatttagaggacaattgaaaagtcaattacgaattatggaaaattttcaacaaattattctgtcactcaaatataaataaattgctttcttccctaatgttttttccccatacatacatgtgttgttatctgtattcatatatatatctcactacttaagagacttttaaaacctattagcccaactttaaaatactgttgctactactgaatacttgtaacatattaagtcaaattctttaattactgtcactggtttattacaaagctaacaattttaaatatctatttttaaatgaacctaataatcttttatttaagtcaatatctcctcaaatgaaccaagtattcactaattaattagatcatttacatctataaactgctgctgtcttcaaacatgtaatagcttataataaaagaggctcttttcattggcaattaaggagcagttaactctttaccttctgcattttaatattataaaatgcataaatctttatttctgcatttctacgtatttagctttcaaatgaaacagctgttttgtacttaaaaataatatttcttaatatatgttactaattgacaaaatacataaaaccaatgctgataatattttcttcttttgggacacacctggtttatataggagatttggcaactgtaatctcattaatgataaaacaagactactaagaaaaatacctgattatttcaaattatattcataaaagcattcctaactctgaatgtcctcttgtgaattattttagataaaggaaagtctatcaatttatttgtttcatttttcctgtatcagatttactgtaataacttgcttatcagtaagtgaaccataaatctacagcagtaacaaatcattaatgaaacattagcaaagaatgttaaatggagctattgggcaaacataaatctttctaaagtcacaagtctttatccaaggaactaagtgctatgatgttattggcaaccttataaatcctaacgagagaaaatcaacaaaaggatcacattgcaggcaaacagtcctactaaaatgtatattctttgagggcaggggtttcgtttgctgttaccaatatatcctcatgcctagaaaagtatctggcacatgtagacagtgatcaataaatatatatttgtgaacaccctataagacatcccattttattttgtagccacatgcaaataggaaacgaaaagaaaagagagaaaaatgaaaataagtgcacatgtaggtacaatatatccaacactacatttaatttgcattttttgtattttttgcccatccctcttctaggacattttctcttcatctattctgttcctctcacccttttccattcaaagtaaaaatcagagtcaattttcttcattttctgggaaacatgttaattcatatttggggtgctgatacaaacagaatttgccttctattattttccttccaaactggatgcaggtctgtttcaaatgcaagaagtaaaagcaaatttaaatataattatcattcttgcttcttcagaatgcatttttctggaaaagtagggatcgtgtatttggaaaagctttaaatggcacctactgaatatactcactatcagtaaaacagaacaaaacgaaacaattaattttggaccaaggataatacacaattctgaaaaaattaacaactggatacatacaaaggctgcaaataccaacaggaatctaatggcatttgaacagcatctaacagcatttcgaataaggtttttttttccctgtgttcttcactgatggaacaccaatattcaaaccagtgcctgaaatgtagtaggcaatcaataattatgtcctgattgaattaacatacttccaagttgtgcaaatgccacatttaaaaatcatattcttcaaaaattttaggcacaagattgaaataagctaattagagttaattgtaggtgagggcaattaatcacatacacaaaatacctcatattttgggtttgtgtgctcagataaaccaatagaatgtttttttatttttaaataaatagtgaaagagtatacccatcattcaccaagaaagccacatggctggctatcaattcaaaactttaaacttcaaaatactatagaagtattgtactattaaaatatctcttttaagattaaatttgccttgattttattttgaagtgctgagcttaaacagacaaggttttcaaatatttcattaacttgttcatttaaactaaaaagtgaaaatcctatgtaattagcagacgatctactcagcttgggccagaggagggttatggaatcaagactatcatttagcatctaacaaaccaaaacaaaatcttttgtaaaagtccacaaacctctaatgaacaacatacacacatttcatattcaaacggaatgcattatgttaagctagtttcaaaggaagctgtagtgcctaagatcagaaaaatgttccaatttagaaaagacgcatatgcagaaaagcccactatcataaataatataggatgaaaatgaaggaataaaatccacaggctcacctggctaatgggttcttttgtcgggggctttcctcttctggctgtgctagtagccagggtcgtggtagtctccataattgatgtggacatctctgattgcatggcagtggctgttgactcagttgtcatagaggaaggcacttcaccaaccagtctcacatttcccactatggcgatgttggcatcgttttcggctgccatattcagaactttcaagccattgtagtacagcccagagagctggccctggaagggctggccctgctctttcccgccaattattatggttgcttggctattgaagattgtgagctgacgccctgtaaaaataatattacatacatgcaaaaatgttgattgtgaactctatatctacaatggatgataaaacagatcttttatggggtgaataatgagagcaataaactataagagaggcatttgactcataattcattgcttataaatgaggtgtccatgaaatgcataattattggcaaatacttgtaaattctcaacttattataaatgtagtgcttttgctaaaagaccaatcaaagatatgtattacaaatcagtttttagtggatcccttttcccttttacatcaagatcttatattgttggtgtctaaagtctaaattgttaaattttaaaaatgtaagacaacatttcaagtatttgtcattctgaaattaccactgacagaaactaatacatagcagctgaaatctaatttaaattttatggtaaaaatttcataattcacataatgtccacatatatctatatgttattctttagtgctgtttattttttgaaggcaattattcattgttatttgaattattctatttttccggcaatcacactgaaaagaaattcatggtttacactgagcatgtcagagacaaaaaaattccaaaaatatttttctgattggctttcagcaagtctatcaaaacaaaacaaaatgaaaaaaaaaaatagcttcagatgtaaaaagcggcttcaggaatgatacacaaaccgatggagaaattatggcacatttccatcaaacagcaatccttaataacagtaccattatcatcaaattgagtatccagttttagcagattgctctctgctcataaaagcatgcacacaactttaagttcagttttaatatgggcttgttcccaaatcctcttagaaggttgcaaatgttaaagggacttcattatgactggcaattcatattgcccactatttaagattcctagagtttaaacaaagagtttttgtttttttcaggaccataataaagatatcagaactacatatattttagttaataatttagaggctggaacatgtaatatagtctatgaatgatttatcattttgggttaatgcttgctgtgagtaccctcatagattgagttagtggattatatttaacagtccctttaaccttaagttaactgggtaagattattaaacagctggtacgtctaaaaatgtatagaaattattatacaaggtatgcaaatattactatctacattttactgttttaaagttgtttttaatttagttttacggaaaatttattttttatgtttattagtgttacaatgaagtactacttggttatgttcaaattatttttttatttgaagttttaatcaatgttttttacctttgtcgagtagccattcatcaactactcgaccaagtcgatatggaattcgctgtctagcaatcgccaggcgctcgttatcattgtttcctttaaagtttaaagagacatttcattggttaaaatctgtaaggtcaaaggttaaaagttaatacttaaagattgagctatacagttgccacatgattttttgaaatttggaattttaaaaagttctacctagaacatttcatgtttcagacttgtcattcattcatttattttattttagcaaacaaaattattcctatgttaattgaaaattagaaatctgcatttgagctaggttattaaacttatgttatagacagacccgaacaaccaatttaaacagcatataatagctttacaaaaaatgaccaatgacctcagggttttgtctttttgatgtttcttattaactagttaaacatgttcaggtgaaacaggtttaagttttcaaaatacattcaacctcttattccagattaataatttatgatcaccaaacttaataccatatttggcacactgaagcatctacaataggcctagcatactttatttcctagtcagaaaacagaaattcttattcacctcatttaagaaaacaacaaagtccaaatagttcttgtgtatttcacacaaattgatttatcaatcacttggacatcacaagagaatgcatcttgcatcatccagatacgttattacaggaaaaggctttgacaaaagtcactttatttgagtgtccttgagtttcatttaaagcttaacatgttgaagcaaataacatttgaaaaaataattatatgtatgtttttatatagtcaaatatctgctttttattaagttattctttaaaagcatgacagcttaaggaacgaatataagccacaaacagtggcccctattcatagatctaacctaagtgagagccctgcttctttgcataaaaaattatctgctagaaacactgtttaaattgaccttgaatattgcttgcaaatagatgagtgttttcttgatctgtagagcacttacgaagaatctgagacaccatctcggtgttgagttgtgtataatgcaagaagagattttctattccattagagttaactaacatggaaatttaagccaagacattttggcattagctcagatgaggactcagaggtgaaagaaatgttgaatggtagcactatctgcataaaaagactggagtgttttgttagagaagataaatgaatagatttacattttattcctctgatttacaataatttataagtgctttcttttgctactcttataatacattatacttaccactaataagcccagcataatactgattacacacttttggagagatagaaaagaactatcttttagacctcatcaatttgtcatctgaatgtctatatgactgaaaatatttcacacattaatatttaatttaaaatgtaaatatcaaagtcaaggcaaatataaagtttaatgaaaacattaatatgtatttctctgtattctgtgatcactaaaacattgtaaaataatattttataatgtgggaatatagttttgttaaactaataatttttttaaaaggacacaaatggtacaaaattccaaccctgtcttcattttttaaaagtgtacaaaatttgtgttctctgttgtgtgtttgcatatatgcatatttggaatttttttttaatgtaatattagttactttaggacagtgtgattattgatcaattacatgtttttggcttataagtgattttatataataagcatgtttgacatgtgtaatttgaaaagcaatcacaaaatattttcaaaaatacataccctttgctctatagtcttatttgtcactcaatactcataccaactcacattggcataacacttctgacaactttatgattaggtggttcctcatgtttttcatgctagagtcttccaatcatcaggcatgacccacattctctcagacaccatccgaatctaggtcgcaaatccctcttgcccaattactactacagtctattgacagacctctctacatcttctctgtgattaatcacacccattttccatataagccaatatctaatcatgtcacttgtctagtataacccttcccatttctcttaggataaaatctcagacccttagtgaaatttgtaagtacttccacaatctggtcccttcctacctccctgtcccctctcacggccatcactgcctcactctgctctttttatccttatgagacttctttcaattcttccaaatcttttctttcttctctctgggactttgcacatgtagcttcctttatggaaaatactctcccttgttcccacctcatctctatctttcattagctaaccattactaattaatggaatcttcttggtaggaacattgcttccccagaaggtattccctgatgtcatcaggttacattaggacacttgactatattatttgtagctcctgaaacatgccctttagaaagaagcattgaacctgtaatggcaaatttgatagtttgccttcaaactctgaatatccctccatgaggccaagtactatgctactatgtgcagtatttattatttcttcagtgcttacttgcacaatatctatcacatacaatcctattaatatctgtagaatgaggtagtcaagaaaaccttgtttttagttctggtagcttctgttgcactattaacacattcttacaacctaacaacattaaaaagaaaaagaaagcaaatactagtgtccagagaataaaccacttgtagctaagcctccctttgcactttccaaaggaaacaccataaacctcacttataattttattttttgatgaattgtcactgatttgaacatctctacaatcagttcattatttgtttaataataaattccccatgtcacaaaattggtaaacatagttattattagtagggaaaggttggggaaaaaaaggtctaaacaagacaggtagagaaaaatcaaagctttatagattattttaatgacttttaaaaagatcacataaacacataaatacattcacacatacatacatagaatttgtcctcaaacatttgactagtactaataaaataattgtgtgattgatatagtatgacagtatgatgtaagtcaacagaagctttggagatccttgctgagactcagctaaagcaagaacataaacactgaattcccaatgattaacagaggtcacctaacaacaacaataaaacaatttagaaaatcgaataggcagtagacacaagttatgaaaatatgtgataatatataagaaaggtagccacacaagggggtcatatcttcctactaccccagaatatcagatgcctactaattcagtgagcactgttttaaactgaagaactttttaattacaggacagactttattcttgtatgggtaatgaatggaaaatcagatggtgcttattcaattcaatatatacctactttattctctaaattctttgttctcctactagaataaaaaactaatgactttgttctcctattagaataaaaaactaatgacttttctgctgcaaaattatatgcagatacattgtgatatggtttagctgtgtctccacccaaatctcatcttggattgtcgctcccataatccctacaagtggcaggagggacccagtgggatgtaattgaattatgggggtgggtttttcccatgctgttctcatgagagtaaataagtctcacaagacctgatggttttataaatggcagttcccctgcagatggtctcttgcctgtcaccaagtaagacatgactttgctcctccttcaccttctgccatgattgtgaggcctcccaaccatgtggaattgtgagtccattaaacctgtttttctttataaattacccagtcttgggtatttcttcacagcagtatgaaaatagactaatatagtaaattagtactggtaaagtggagtactgttattaagatacctgaaaatgtggaattgactttggaactgggtaacaggcagaggatgtaacagtttggagagctcagacaaagacaggaagatgtgggataatttggagcttcctagagacttgttgaatgatgttgaccaaaaagtctaggctgaggtggtctcagatggagatgaggaacttattgggaactggagcaaaggaaattattgctatgttttagcaaagagactggcagcattttatgcctgctctacagatctgtggaacattgaacttgagagagatgatttagagtatctggtgaaagaaacttctaagcagcaaagtgttcaagacgtgacttgtgtgctcttaaaagcattcagttttattcatttataaagatacagtttggaattggaacttatgtttaaaatggaagcagagcataaaagttcagaaaattttcagcctgacaatgcaatagaaaagaaaaacccttgtcctgaggagaaattcaagccagctgaagaaatttgcataggtaatgaggacccaaaggttaactgccaggacaacgaggaaaatgtctccagagcatgtcagacatcttcacaacagcacttcctatcacaagccaggaggcctaggaggaaaaaatgtttttgtgggctgagccctgggtcttgctgtttgtgcagtctcaggactcaggtgtcttgcatcctagctgtggctaaaaggggcaaatgtacagctcaggtcgttgcttcagagggtgcaagccccaaaccttggtggcttacatgtagtgttgagcccgtgggtgcaaagaagtcaagtattgaggtttggaaacctctacctagatttcagaggatgtatgaaaacacctgaatgtccaggcagaggtgtgctgcagggacagaaccctcatggagaacttctgctagggcagtgcagaaagaaaatgtgagtgggagcccccacacagagtctccactggggcactacctagtggagctgtgagaagagggccactgtcctccagacaccagaatggtagatccactgacagcttccaccatgcacctggaaaagccacagacacttaacatcagcccatgaaagcagccaggagggaagcggctgtaccctgcaaagccacagaggcagagctgcccaagaccatgggaaccttcctcttacatcagcatgacctggatgtaaaacatggagtcaaaggagatcattttggagctttaagatttgactgccccactgtatttcagatttgcatggggcctgtagacccttcgttttggccaatttctcccatttggaacagatatatttacccaatgcctgcacccccacggaatctaggaagtacccaccttgcttttgattttataggctcataggcagaaaggatttgccttgtctcagatgagactttggactgtggacttttgagttaatgctgaaatgagttaagactttggggaactgctgggaaggcataattgattttgaaatgtgagggcatgagatttgggaggggccagggatatggtttggctgtgtccccacccaaatctcatcttgaattctagctcccataatccccatgtgtcatgggagacacccagtgggaggtaattgaatcatggggacaggtttttctcatggtgttctcatatagtgaataagtgtcatgagacctcatggttttataaaggcagttcccctgcacatgctctcttgcctgccaccatgtaagacatgcctttgctcctccttcgtctttctgacatgaatgtgaggcctccccagccatatgtaactgtgaatgcattaaacctctttttctttataaatcacccagtctctagtatttcttcaaagcagtatgaaaatggaaacattgtgaagacacatctaaataaagtacagcgacaatgtctttttaatagatgattccccaaatccttccaccattaggtataaaatagttcagaatgtttaggttctccagcgactaggcctatatttttcctttacctcatgattttcataaaaatgttgcatactaaaaggggtaatggaagtatattattttaaataatttctcaagatgtattttatttctttacaaattcatggtgatatttacttgtaaaatatcattcagtagctttgcatgattttgctgattatatttaatactgtccattgttcaatatacatctagaccttacatgcaatataaaggatataaaccatttgattgggaaaggtcaaaggcaaaaataatttccaatgaccttttcttttctttggaaaggttcaggatctaatatcaaatatgctgggatatagaagctttacatacagcatttgtgaatggtcagtgtaagcaggcttaagctggtaggtgagatgaaaaacaagtggaatgtccctgaaaattcaaatcaaaacaaagttgaatctttcgaagaagacatttttaccttcaagtattctaaatcagaggtaaggataaagcaataaatgacccacttttcaaagatctatacattccgggctataaaaagggtccaaaaggaatttcatctctttctaaaagcataaaactctactatagcaacatgctgagcaaataggcttgatttataaaagcagagccttctcattgaatagttaaaagataacaatttagtctcacacttttcccatgataaaagcaagataggattttcctttgatttctttttcctccagttaattttgtgtggtttgatctgttggtaccttcactgaaaatgtcagtgacaacatacatgcctctgccgaagtaattttcaagcaatgaaactgcatgtaaaatttggttttattttcctttgaatttcaaaaagaattaagtatttttgacaggaggaaagactcccttccccccaatccctgtagtaatgccattgcaacaaggtacaatctctaattgtaaggtattaaatgtcattgtaaggtattaaatatcattaatacttcaaacaagtttcctggggtgaagaattcaaaggaaaatctgatggcttatatttggaatgtataccctctattttgattaaatcccagataattttatttgcctatttgtatagactgaatgtttgtatctcccaaaattgatctattgaaaactaattccaaatatgatagtgtcaggaggtaaagcctttgggagctgattaggtcatgaggaaagagctctcattaatgggattagtgcccttataaaagaggctccagaaaactcccttccctccttctgtgatacgaggatacaatgaaaagatggtcacctgtgaagaatgaagcaagccctcactagaaatggaatcttgtacttcctagtcttccgaattgaaagaaataaacttttattgtttttaagccactcagttaataatattttattatcattgcccaaatggacaaaaataccatgtaacaatatttggtcacattttagtctatttattctatatgaacaagcagacttccgggaaatgagagtaattacaaagaatcaaggtaagtagcacaaagcaataaaactcaaatccttgacttggagttaaatttcatggtgtgactcagagaacaaagataaatacaattttaatcatattgttataactatcgatcagtagagacaagctatatgaacatcactgatgtatagtttttctcctttcattttagttcttcactcttgtgtaatttctcctcagaaataaaagtgtcagcatttgatatgacatattaatatctatggggaaaaagtaaagaaaaacaatgctatgaaccaaacatttgtgcagaataatatgaaaataaaaataacaagaacaaaaagagacttgcttctttggaaggcttcttatttcttgagtttttaacattgggaaaagaaacacaaaaggattctgaaagtcatctataccacaagagaagattagtaacctgtgtacagactgatttttaaatgagaacaagacatttggatatatctaggcccagaaggcaaagtaatagttttgtaaacatactctgattttaagtgcagcataatcacataattttcaactgaatgcaatgtgtattgttgtcatatagaccctgcaaataccataatgcctcacttggctgataatgttccaaataaatagattttgaatatcgacaccttttgagaaacaaacttttgaaaaatatagctattctaataaaacatttgtcttatatattactttatttcctatatcattaaaatgtaaaagccgaatacacatatataattggctccagcttactccagtttcatcttgaactacttttctctgactctttaaattagtcactttgtaattttttcaattcctttagctaagccaatccactttgaacccgacattctcctttgcattgcgaatttcttgcatccctgtgtactcaacatctctgcccacctcaacagacacacacacacacacacacacacacacacacacacacacatctaaggctggctaaattttttcttttttaaatatcagcttatacatttctcaaggaagcattccctgtgtcccctactgctccaccaaattattctacttaatgaattcttccactatgcattcttaaaatacttagtagcaatatctataatcatgatcaaagaagttcatgtaattgattctagattctagattccttgtgagcaggaaccatgtctgtcttgttcaatgctgtacgccttatgtataacacaatggtgagcacatggtaattgcttgttaagtaatttctaaatgaaaactgaacccatacagttatgcaaaaaataccacttgaggtaattttttgcatgataacatagtggtatttcttgttcaagatccataaggcagtgagattgttagtgtccacttacatatatgtatatatagtcacaaacaccattggattgtgagaggaatagaactttgcaaaacgttatagtaaattttgcttggacgtcagatttccttttttcttcttgaccatttagtgtccactaattacatatgtgtgcatgtctatttagtttattcagtttaccagacactaaactaaatagagataaaatatgtgtctctatatataatatatataattactgattcattatatatataaaatgactcagtaactctgcttatctttcatcaattttgaatttgccattgtagtacacaataggacaaatcttttaaatcttatttttatgattaattacaagtcaatgatttatagtctgaggtgagctctactgtggtgcatacacattagcagaaaaattaataccacgtgggatcttctttttttttttctaattgtgtagagagctgatcatgacaatctttgatttggtcagggggaaatttctgcaagtgcttcaattctctaatgactgtgtacaagaaacagtcttggacttgatgaaccttcaaaatatgtatcatctccaagactatattttctagatgaattttagtggtgaattctttcaaataaattgaaatgttgatactctggtttctcttcacatcgtattaatcttttactaaattgaatcttttactaaactgaaatgttaaccctccaaggagcatttacttccaaagttcatcaataaatacatcaatgccttgtaaagaaagcaacattcatttaaccaaggcaaaaatgatacaaagttgaagcttataaagtcaggtagtagaagttatggatcttctagcctttgtaacatgagggcagagggcttctagaatttgcctgatttgtggctgataaagagcagcgaggggcttggattgtcttctggacttttaagacctcactgaatgatgaacacacactaccagaatcaaaggatggtttttgtcagacagcaggactagaccagacagtaaagctacaattaagtttcatgcatgctgggaaatccagtttttccgtatgaaagtggtctgtaggtaaagaaactgaagaaaacaaaggaccaccagaaaataagaaaataatgtattgagtagcttcatgttttatgcattgtgttacttgcttatttaggttatcttgtttaatgctgatattgatcccagaccataagtaccttttattttactgatggaaaaactgaggctcaaagagatgacataaaactaatgctgcatcatacatcatagaaagagggaccatttgaatcaagataaagctgactcgaaagttgttccatggaatagttataaagtaatatctcttaataccgtgagtcataagggccaacatcttctccttaatccttatagcactcttttgtataatgtaagatgtcattaaggcttgtctacaaagtttctgtcttctagattctggggtgagatcgcccttatggacacatgaaatcagtaatcttccctaaatcctcaacgatttatcaggaggataattttatcatctccattttatagattaagacagtgaagcagaggtaagtaaagtgatcaaagacctataacagtggagatcccagtgagaagcagtattttgttttttttccttttataatgatgccttgtatgcatagctactggaggcataaaatgttccagacattccttgtctttacctctaacctataagaaaagccacaagcataataatccactaacttcagtgctttttggacgttgaacctctccagaaacacgttggaaatggagagaggatcctagttgtgacacaaaagaccactgtacttcattgacttgtcagagaaaaagaatattgtaacatgttacagtaaattttgcttggacgtcacatttcctcttttccttcttgcctatttcttatctctgcgtttccttttacacagctccagaaacccagtgctttcatgccacctgtcaacaactcaaggcgtatatttacaactgcggttcctacacatatctcatgttccaaaaatacttcaccttccttcttctctagtgccaataattaaaccctggtttctttagtatagctcggctagatgttagaaaagcaatcggactcaataaagtcaatatataagcagtgcccatgtactctgaaattattgtactctgaaaggcacacatcaatacatcacatggattctattgttgaagagcttacacgttgtctagggagtcaaggggacaaatgaggaaagttaaaaaataaaagatttaagtaaaagttcaagataatagataatgagacataagtacgcaattaaccaccatgtgaagtgtagttgccatagaagttcagagagaacaatggattagagcaaagaaggtgtgatggaacacaaacgattgcacctagatcacaatcaaaatgtcattgaaataataatgagctaaaaatttttcataatgtgaatattaatcctcaaaaggttgacaattgatcattatcctgaacttcataatgctattcacccaacatctatttttaaataaatagactctccaataaaacatatttagtctcaaaatataattacaagtatgaccaataatggttaaatattcatgtcacgaaccatgaaaaaaaagaaaaaactctcataaaactactaagtaaaatgcactgaaaatcggcaagaatttgagggcaatgtgtaaaagtgaaatatttgtgttaggatggagaaattaatggtgaccttttttcaaacttcaattttatattattgatactgcatgtatgcacatttcaactttgttcccactgcttccttaaacacatacacacacgctcatttctctaaattaaatgcgatatattaatgtaatgctacaggaagagggggtggtgcaactcaagagttctgtcagtcattctcacagctagaaagagcacgcacagctcaagtagggtgatgcgctgttcgtgactaatgcttcagatgacatcccagctccttatgtgaaacagcaggcttttatatccagttaaacaatatattcatgtgagactgctgtgatgttgggcgtagaaggctgcaggctgtctactgcagagttcaatggtgctttggggaagaaattagaatcttagtgcatgtctaactagcttaagtaatttcttccttcacatccctctcttatgtggatttacattaagatatctaagtgttttacacaaagatttgtacaagcacttgttcccactagctacttacattcaaaaattttggtttggatattgtttcatcagattaatttgaaataaatacaggtaaccttgtgaattttggatctcattgcctgtgtggaatgaacagtgatttaaattttcttccctacacctttaaatgctgtttgtttcccattgcaaaggcactggagtatcatatcaaaaaccagcagcaagaaatgaaaagcagcagggacaagcaggtaacaaaatacagaacttactctgataaattaaaggtcatactctgttatcatgcatactaaagagttattttgtgccagttgtgtagcatttaagacagaagaatggtttaacagctacaaaaacaggcagagccattgatagacatcactaaatactgagaataagaaaaatgaaaagtaagagcagccccacattaccttacaaatggcattttgccattttcccagatatgagaatcttgagtactttctaaatcataatgtcataacatttaaacctatccgctctaataaaaacctaaatatatattttttctaaagtgtcttttcccagttcttgttttttgaaaattggaaaattatgtggttcagctgaaatttctacactccattatcagtcttgacttttaatctagtcttcttaatattcaaattggtccacggaaaaaaagataggtgaatgtttcatacacagtctgatgtggcctataaatggaactgcgaaagttccctattctcaagtggaaaagaaaagtctgattattatgacattctgatcttattttcaatggacttcaatctctctcttccagttgtaactggaatgcaagatttttttttcaattagaaagatgaggtttgtccattgtatgcaaataatttaagattaaatggtctggaattgcaaaggaccaagagttggataaaggtgctggataattgctagccccattcaattttataaaatgtaaaaccactgaagtaaaataaccatttttttctttttgtagataaattgaatactatggatatgaatttaaattcctaaaataactttcccctaatacaagttaattttctctaccaccaattatttcttaaaagtaattatcctgtggtcagaatcactgaggaaagagaacccttgatggttaagataatgagctctaattcctaggttcaaatcttggcttcaatattgactagctggatcagtagcataacatcttttaacctcagttttctcatctgtaaaacagatatttgtaagaatagtatccataatatatgccaatctcttagcacaatgcctggcacatggtaagcactcagtaaatattagcccttatattgtagtcatgtcattgtttattctctagtatgatgtgccttacacaatatatctaagaatgtgtacatcacaaaaaatattttttttacccatctgatcatagaaagttgaagtaaatgtgaagaagagtggaaaataaatctattatctttcccagaatgagtaatggccaaagagtgagccttattatgagtgatatcccgaacgtaggtgctttatcaaaatcactgcactttctcccaagcaatgtcatctttattctcagaggtttatgcatgctacttttaagtcaatgggaacaactgaaaagaggtcattagctggaagaaaccacacaaaaagaaaaagccaacagcccctgccctgagggaaaacagaattcagggtactaccatgtgttctgtgacagcagcatggtgacaaaagctgttcccagaataagaatactttggatagcaatgaagtcttaaaatgacattttaatccatatattaatgcttcaaagggatccacttcaactagaatgccttaactcttctttttgcccaataatgctcctggcaaagaagggccacagaaaccatgaacaggagtggatgctgcttgatccattttctgcaaaatgagatttggggactggatggcttctaagctgaccctcaatgctaatggcccatggtcccaggtatcagatggtgttgttgtaaagacaagcattaggccaccttgttaaaacatggtgattgtggattttcatgaggaaattaattttagagccattaaaaataaaataccataaatgttttttaactcagcaaatatcttttaaaaagcagtgaaatatttggcttgacatgttcttttcttcatctctctctgtttttaaaactaacttatggtgccttgacaattttatgaagaatttcagttggcatctgtggagatctttataattaagccattacatttttctgaaacgtttcatgttttaagcttgtcttctttccactttgtgctatacagacacacccacctcttatcactgagacatttctctgcattctttctacccatttaccacagcatgtcatggttttgacagccatcttaagaggaggaaggcagacataggttagatttcaggagattttgggggtttttttttttttttttttttgagacagagtctcgctctgtcacccaggctggagtgcagtggtgcgatcttggctcactgcaagctccacctcccgagttcatgccattctcctgcctcagcctcccgagtagctggaactacaggcacccgccaccacacccacctaattttttgtatttttagtagagacgggttttcaccgtgttagccagggtgatttcgatctcctgaccttgcgatctgcccgccttggcctcccaaagtgctgagattacaggtgtgagccactgcgcctggccgagatttcagttttatacagagtagttaagacaatgaaggacaaggcattatgatactaggaaatagagaagtttgtctcctcttcatttgaaatttttagcactaaagagattagatcagaaaaatttaagaagaaatctgaggacttcaagtcaatggctgctctttgcaagccctttttgtccaaagtgtatcaaaataaaccttttcttggattgctgaaacacctgtgatcatgggatcagtacttttggagctatttctggttcaagagacattctcatgagagttcctttccaatcaaatctgtcaggggctgacttaaaaacctgtaagtgggccagacacggtggctcacgcctgtaatcccagcactttgggaggccgaggcgggcggatcacaaggtcaggagatcgagaccatcccggctaaaacggtgaaaccccgtctctactaaaaatacaaaaaattatccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaacctgtaattggctcagtgtaactcagactaagtagagatcaccaattaaaacccaggcatcctaaataatgcagtaggtacagaggagaaatagttcattgcataaaatatatcagaataaaactataaatttctctacttccttcagtatttcttcttaaacttaagctacctgttatttctagtgatctctaaatgcagaacagaatgaagacaagataaaaactacaaagatatcctatcaaatttgagctgatgctccattactaaggacaattggaattgatgcacacacatgttcttctccatcttttttatagcccaatagatctacagttaggctgtgtcatatacaagaagaagcctgaactaactaggccgtataactctggcctgattaacactttatctaatactttttctgaagtcttttaatctaagtcttgttttgacttcattgaaaataagcagtttgttggtaatcgccacacaagaaccctacacatacttaaagactgttatgagctcaattgtttatcccccaaattcatatggtgaagccttaacccctaagacctcagaatgtgatggtttctggaaacagagactttaaggaggtgattaagttaaaatgaggctgttacggtggatcctaatgcaatctgactggtgtccttataagaggaagactggacacacaaagagacacaagggatgcacaggcatagaggaaggactatgtgaaaacccagcaagaaggtggacatctgcaagcaaaggaaacaggcctcagaaggaatcaaacctgctgactacttgattttggacttccagcctccagaactgtgagagaataaatttctctcatttaagctaccactctgtggtattttgctatggcagtcctagcaaactaatacagagataatttaaacgtagtttgaaataatatattgttagtttattcacagatctttcatattaagatgtgatagtattttgctgccagttgctaaaatagtctaaaagcgagtactcatggatttgcacacagaataaagctctgtgttaatgtcaaaatcatgtccattttaattattaattttagttaaaatgtattttgtcctgttctggttttgctgcaaattgtaatattctacattacagtcctggtaattagtacagttaccaaataaactctatccatgtacattttttgcatgactaaaactataaaataatattattttcatcatgaaatatacatgattatatgtagttccattaatgtatatagaacaacttttccaaaaggaactacttaacctctcataccattaaatgaattttcttgaagaaaacaaagtattttctactaccattttcttcactttgtggctccttataacttccctccttgtaacacctgctacgcggatgactgcagcactattaaaaatttactgtcagtgttagctttccaagttatggaaaaagtctcagtgcaaaacaaacaataaaagcaactctgcataagacaaatccttacttatgttaatgattacatgcggtgacattgtcttatttaaatatgcttatattttcttcaatttggaaactactgtgagatcccaaaagatacactgtgtccacttcaaaaactctaaaattctaagtaccaaaggacaagcacatatttattcacactaatttttatccttaggaactgcctaagaaatttaaaaaaaaaaaaagaaaaagtgattttgagagattataattagttttgtgaggcttgctaaatagtcatggcaaaaaaaaaaataaaacagcaactttcactgttaatttggaatgtttatcttctactcaaaactgaacgaatgtcttacattgttgtgctttttctttggtgcttatcactgaagaagaatgccaattccaagcccaacttggacatatacctcagtaaagctgccctgcagcagggctgaccacctccactgaaaatgcctaggcacagtgaaggcccagcaagtggatgacggcatcagctggtcctaaaacaaaaagacttgagtactatatggatgtaatgacctcaagatcccctatatttcctaagaaattagacatagcttcatcattttcacctatgaagacaaacttcaaaatatttttggcctgctttttacttaaaaaaatgcttatgaaaagggagtggacaaactttgtctatgcctttgtcttctgctctcttttgatgttcctggagcctatacccttaggaagaacttgatcttgaattacaatatcagtgtccttcaaattccacttcccgtgttatagtaagcaatgcctggactgtcatgtcacctagcttagctccagacatttgcagacatttattctggcccctttagactattccctgcactttagccagaaaaattatttgaaatcatgtgttatctgcaacagactatgtgttccaagggggtagtgaccattcctgcactccatgctgtatccctagcataagtccagacacatagccggtcttaaataaatatttctgaataaattactgaattcactgggattacctctcctcagtctcttctgtcttccactatcctttgttctaacatggcttatcaatcataattaacctctagaatacttatcaggcctcactcatgcttccagtttcttttccatgatccagacttactgaatttgccttctattcctttcaaatcctgctttttgctggcgaaaataggtagtcacagtagtgctcactttttttaatgcagtagaaaaagagaagcaatttgacattaatatttagatatggagttaacttccttcttgaaacttgacataatgactctctgctaatcatttgtagagatagtcaacaattctagtttaggtaggaaaattgagaataaaaaaaaagcataggcctgttaatctctttttaggaagagtttgagcattctgattagaaacagatgtcatataagctcttacacataaatgagtgcactattagtttgatattttatcgagaaagaagcaacatgaagaaaaataggcatattttatagcaacttggtacttaatagagtttatgccaaaggaggtcagtgcaatgcattttcttttttagtttttgtttgcacattttttaaggcctggaaagtatgagggtatgagtaggatcccagctgtgccaattaatgacacatataaccatagatgctttatttggctagtctttaaaataaacaaaaaaattataggttgccagattttttgaggaagaaattttctttgatgactgagctaagggaccccaacacagtatattatcaagagtacatcatttttaaaacattttatattatcactataatttaggtaaaattatagtatattagcactagatgatgtattcttcatcaaaaatgaaaagtttccttttagtagccatagaaggaagagttcccaatttaaatctcacgaaatcttgctttcttaaatatgtaaaatataacacaagatttatggaaaaaggtagtcaagtctatttgatttttatggaggctagaacattccagattcaaatatcatgaataaactcataaacaagttactatatcttctgtaaaatggggataatttatgaggttacttttaagaataatatgtaatgtctgtaaagttgctgggaacagtttctggcacatatatatgatggctactattgtttttatagattacatagaatcacagatccttagaaataaaaacaacttgagctagaatctggtgtaattcccatccaatgcaggatgatttgataatcttgacaaattggtctcttgagctctatagaattagaacagagtctaaaagttaccatagcccaggaagagttgaagtacattatcttataaaactactcttgttcatgctatttcctttctaaagtaaatgtaaaaagtatggaaagagcatcatcacaaattgtgaatacaatggagcttctcattttggtttgttttggtttggctatacatgaaataccttaattccattcagtcattatgcttagtttatcaagttagtggccttctggcatattcaatacatacaacggtaaagttcacagtgtgaaacttaaatgacaatacaatgaaaacacaaacagatctaatcctagatttcctattgcaagggcaagaaattgagaacactgtagtcaggaaaatgtatatcaggaaaatgagatttacaaacaatttatatgtatagaaacaaaacaattaaaatctgaaacagactccaaaatgtaaaatatctgacctcacagaaggactttgaaccctattatacacctttcttcatccatgcaaattctatttattctattagtctactttgacgagtcactgaagaattgagaggcaggaaaatatatgatgaaagcaattttaaaaagataaacatcttggctgcacaccagatggattaaaataatggagactggggaggaatatttattgtttatagctgataacaggaaaagaggcccaattgtgtaaaaagccttagatcattaaaataatgtcagcccaagaataaatgcctcaacaggaataaactgaacaccttatcataatcactaacttagactgagtctagtttctccaggtaaaattcaggcagtagtctcagctctaccagtaggcactgcatattacaggaggtgacaaatgttccagattgcctcaaatatcttggtttgttcctattatataggagtaactatcaatagtgcttctttttttatcagaattgtgtctgtttgaatgataatttttatgatcttctaattatcgaatgccactgtggaaatttaaaaaagaaaactttcctggattgttatagcttaagcaaaaggcttgggcaatcccaacgtgcttggtgacaaaggaaaaaaaaaacagctctactttcaggaaatctggctatgtacatgcacatgacttggagacccaagcacagactgtatttcagcctcgactcatcccctccgctgggactctggggcagcacccgagctgtctaactctacacagtgccctgtccaccagctagcatggtttctctaatgttcatttaccaaatttcaaatgaattccttagcacccagcccacattttactcttctgtgatatcagccttgattactgaacaccattctgttttctaaaattgtacagaacatatattttgtgccactcatttgaactatgtctttcttagtaatgtcttcatagtgttttgcttggagtgggtttggggacagaagcggtactgcacttaatgtctgccagggtcaggaggaacaatcttaagtttttggaaaggtttgtctccatttatgtgaactgaagtctgacagccaagagaaaataaatttgttcccagaaagaaatacaaactaatacggggaggttagtgactattgcagttgcaggattgcaaaactaaactattttgactaataatatagtggaattaacttttactcagcacttactacttaccaggtttttaccaatttctaactgttttgaaattaataactcatttaaacatcaaacaaccttatgaggtaagtactgtcattgtccccactttttagattaggaaaatgagattaaagaacttggcaaaaaatttcacatctcatcaatgtttgaactaggatttgaacccatgcagtctggcttttgaatgttccctctgaaccttcatgctaacctgcacacttaacttgcattaagtttgtagcatatgtctggtttgatcatttgatgtgtggtatatattcctacagcaattttagtcattaagaggagtattcaagttagacttggcactcacttctccatctagacaaagaataaccagcagacaggaagaacactattatgagaatgcttctaatcacaaaggacccctaaacagcccttacagatctgaatagaagaagtaataaccagtggtatcacaaccttagcacaacaaaggtctgagcatcatctgacctggtgaggaccaacaataacattttatgaattattttttaggggaattaagaattatttattaggcagcattgcataatcctacaaagcactggagtaggctttagaacctatggtgttggcaagtaaatgaatctccctgtgtttgctcatttatcacaaggagatactgtaagctgtcttataaagattctgtgagtgttaatgcaataatgtttgtaaataaggtatgtaaaataattagcatattgccccatatagagtgcccactacagactgcatgtctaacttattgtttcggatactagctcttacaaataggcaggaatttcaaaaggttctatgaatgtttggaattttggatgagttctgttacctcttcaccccaatgctggcgcaacatgaatttcctttattgaatcaatttgacagatttaacattctatttgaactccatttccataaagcacaggcctcatctaattatccccaggtctgccttctactgtgattgtgctcattctgcctttctttttttactaaagcaaatcttttcatttaaaaaagcttccttttgcttgtttcgcctctaaccacaaaatgcactctcgtccaagtcctctgccaacctgagcaataaaaataataaatgagacaactgaagactctacttggacctttaaaatgctccagcgaaggtgaccctgaaaaattattatggcatgttatcaattaggtgacactatcaagaaaaatgaaaccaaaatattcctttattctgcctgattttatatctcataaatcctgctaaaatacttcattggaaatgcatatggtaatatctagacaggcttatgttagatatattctttttggattctcagtggacattttacatattagggccaccaatatagataatatgcccaagatgacaaattacttcaataatacttaacatgaggaaagtctgtctcaactttgcggggaggggtaaacacagctgctttttaacacagttaaattcataaagctaaaaacaaaacagactttaaaatgtttaaaagtctgtctttgagaaatattctacccatgaggctaaatttgacacaaaatattcatcatcataatttaaattttaatatatggcctatttaaaggcttcatacttcaaaaggtttttacatttattttgtcattctgtcttaattaagaaccaactccagtattagattaagttacacctttggattgttagaaaaattaggttgctattcttctggaataaatctacttttccaataaacacatgaacatgtcaaaattttttttaacaacaaatgcatttgacttacaattacacaaaggcattatgtttaattatttttttctgaaatgttatatagaattgagtaaaaggtatttttaggtggaaaccatttctaaactcttatttcaaaaaaaaaaatcttatagaatgagagttccaaatacctttcattcagctttcctcctgttaataattaaataaccattaggcagttatcaaaaccaagaaagtaacactgataataaactgttgactaaagtatacactttattttgttttaccagttttcaactaatgtcctttttctattgcaggatctaacccagctcccacattgcattaaactgccatgtttcctttgtcccttcagatgtgtctttttttgtaattcgtgtagttaacacttttgaagaatactggccattttgtaaaatgtccctcaattttggtttgtcgtagttagatggaacttatggatttttgttgagaatatgaataccaaagaagtgaagagcctttcttagcatgaaggttcatgaagtcaatattttttattactggtgacatttaacttgatcacttaaggtgatctgctgagtttttctgaagaaagttactacttttacttggaggaaatatttttagactacataaattactaatttctactgaaaactttttcgcacttattttggtatctattagggaatcccgacttcaacaatttttacattgggattctaacgatgaattcctatttccatcatccttctacattattaattgtaatttttctgtatgggtgagctgtctctgcttccctatttatctatctgtatatctttctttctatctgttcagttacttgtttatatctctatgggttcatagatgtttattttactcttttggttataatcaaatgacatatctattagttttgttgctcaatttgatctagttctggcccttggaagttttttcggattagctcttacgctcctttgtcatgcttctctctcaggggtcaataaagtatgccctacaggtaaaatgtgtccactactatctatctaatattgtaaataaagatttattggatcacagccacacccattcattttcctattagctattgttgcttttgagctataatggcagaattgagtaattgtgaccatgtggttctcaaagccaaagatatttaatatttggccttctatgatgaaaatttcttgatctttgctctaggcgaattttctttttttaaattatgaactttgaatagtgcccaaaatgtatttaattgttatatctgaggtactttagaattcagactcttgaatgtatatttttcctatattctcctaacttcattagttgtaataattttgatgctagacatttattattttgtttgaagaaaacaaaatggattatcagtattctattgagtttaaaatactaaatcatacagaataagaaaataatggtgagacaaagttgaaaaattatctagtaagaggagcgaaagagaaaaattgtcctcttgcatgatatgttttaaagtttcctaaatacatgcaaaggcctttattaacttcttcccataataatgaacggtaatatggtagtctcctcttattctacagtttcagttacccacagtcgaatgcagtctgaaaatattaaatggaaaattttagaaataagcaattcatgccatttcagtaaatggcatgcaatttaaataataaagttttaaattgcatgccattctgagtagcaagataaaatctctggccatcccactctgtccctcatgacacatgaatcatcccgttttctagtgtatccacgttatatagtcggttagtcacttataagtagccacctgggttatcaaatcaacagatcacaagaagaagggtgagtatagtacaataagaaattttgggacaaggagagagagaggaagaggccacattcgcagaacttttattatggcatattgttacgattgttctattttattactagttattgtcactaatctcttatcatgtctaatttatacattaaattttatcatagggatatatgtatagggaaacacatagtatatataggttttggtactatctgtgatttctggcatccaatgagagtcttggaatgtattcctcaatggatacagggggattattgtactttccagagatgttatattgatagcaatttttatctttatgatattggacacagttatttcaccatcccacttcacaatcatgagatgattcactgagagacctttccaaatgaaactctgaaaccatgcattttggttttaaggatattcattatgtaatgccccaatgttataattatatcaagcatagtatcagtgcttaaaataaatttattagaaggataatggcattcttatgatcctattttggagaacaattgttttaaactggaagtacaaaagttggtcctattctgtgaaaaaaaaattatctgagctagtaaaggctacacccagagggctatgtcagtggttagaaggttattagcaggttagtaaagggcagccacatttcattggaagcatgtttaattaggggaggaggaggtttctcctcatatgttcattacacagactttattttttcctctaatatctcaatatcctcaaagatcacctagagcagaggttctgaattctaggtaaatgggcctaaggatgcaacccttaaacataacatacataattttgtatacaaatgtagatagatgtgtatttttctaaagatagaatgttctactttattggattcctatggaggcagagattcaaaggaagttaagaaaaactgatctagattaatgtctaaaactaaatacagttacctaagctttatactctacataggaccttgacaccagtgtatgatattttatcctttttgatactctgcctcctcttgacggcactttcatttgtttattagaagttaagtgacattaaaaccaacttattcctggccaggcgcagtggctcatgcctgtaatcccagcactttggggggctgaggcgggtggatcacgaggtcaagagatcgcgaccatcctggtcaacgtggtgaaaccccatccctactaaaatacaaaaattagctgggcatggtgttgtgaggctgaggcatgagaattgtttgaacccaggaagtggaggttgcagtgagccaaattcgggccactgcactccagcccggtgatagagcaagactctgcctcaaaaaacaaaacaaaacaacttattcttgagcttacaagatacgaaaagtgggtagacagtggacaaatataaatagcatgaaaatcatgagacttgttcatagttgacattcaaataatgacattaaagctgagaaggaacaaatcacatagtacagttttaaaaattgttcatcatacaccaaaatactagctattatgtattatcattataaaaatatataaataaatatgtctgtgctatttaataaaagctcctgaagatataagaactcagagtgtttgagaaagtattacgagaaaggcttgtcattgagttgggaatgtgacttcttcttccattaaagtcagctatttataaactataaactatatgataaaacaaagatacttttaggtaatagtcaaattataaaagcgactgttataaaatataaatattaaaatcaaccaaatacttgtaaataccatctgaagtttcctaaaaacctaatactctttaatatgtcattttttccggccttcagtgcttagctattcctataacttgtttccacctcatttcctaaaagctagatttctgcattgtagtgacaattaattttttatatctgacatgattaattcattttttgtaaccagtagttagattcattaacctgattacccgtatctttggtgaaaagtccttcaagacaatctcagccaatatctttagccacacttatttaaaatcatgataatgctattctctgtttaacgtgactacttttcaggagtgagaccagtataacccttcattatgataagaacttaaattgctaaacaaattgtatgttggaaacaataatggcagacaagaagttaaagggggaaattttatgaaattttatgaagggctgctatttgtatattacaacataagatatacttggcaaaagttcttaaacacagtaatgattaataaacatttctcaatttgatttgatgggttggtttctaagtaatttgttttcagaatctgagaacttttaaaagtaaaaagttcattaaaaactcgcaaaacagaataaatttttattgattaaatgtttcaaaatatatttaactcatttttaaataagcttaagtttagcttcaaatacgtaggaaactcatgagttgctatcctactttattgagctcttgttttctgatagtgataataaaggcacctatcctccccacacagttgcaaaaaggattaacttaagtgagagacaaaaaagtactaggagaaatcgggaaagaagaggtttgacttacatgtctctatgtcattcccaatagtatccaaatagcagatacccaacacgtatctgaagaaattaatttctcagattatttcaattttgtcagcaataaacatttaataatgcatttgttttgggggcaaaaaatcagcatattctgaaagcagaaaaaaagggcctgtttgggtttcactgagctttcagaattgcctggacaattatcaaattggccctgtgatactctgtatgttagcttctactacaagagaactttatgaaagtcactgataggtctcattgacaagtttcctgggatggaacaaagaacatttccataactacatagcaataatggaacaaaaatggcaacttacagacaaactacaagatttcaatttaaggaatgaagcagttaagcctagttgatataatatcctttacttctgttttaccacaactcttagaaaacatctgcattatctgtttgccaacctgtgtagtttaaatgatgccaaaacccatcaaaccatcagagaatcttgctctctcttttaacagaaaataaaaaaatgctaacatggttgtgtgtccagaattggtgggttcttggtctcactgacttcaagaatgaagcctcggaccctagcgctgagtgttatagttcttaaaggcagtgtggacccaaagagtgagcagcagcaagatttattgcaaacagcaaaagaacaaggcttccacaacacgcaagaggaccccagcaggtggccagggctggctcgggcagcctgcttttattctcttatctggccccacccacatcctgctgatcggtccattttacagagagccgattggtctgtttttcagagagctgactggtccgttttgagagggtgctgattggtacgtttacaatccctgagctagacacaaacgttctccacctccccactagataagctagatacagagtgctgattggtgtatttacaaaccctgagctagatacagagtgctgattggtgtattcacaatcccttaggtagacataaaggttctccaagtccgcaccagatcagctagacacagagcgcagattggtgcatttacaaaccttgagctagatagagtgccgattggtgtattcacaatcccttagctagacataaagattctccaagtccccaccagattagttagatacagagtgcagattggtgcatccacaaaccctgagctagacacaaggtgctgattgctgtgtttacaatcccttggctagacataaaggttctccaagtccccaccaaactcaggagcccagctggcttcacccagcgtatcccacacggggcggcagatggagctgcctgccagtccggcgccatgcccttgcgcggtggatgagactgggtgccgcggagcagggggccgcacaggagcccgtggcggggggacactggggaggggaggctcaggcatggcggactgcaggttccgagccctgccccgcagggaggcagctaaagcccagtgagaaatcgagcgcagtgccggtgggccggcactgatgggggaccctgcgcactctctgcatctgctggccctggtgctaagcccatcactgccggggcccacagggccggccggccgctgcaagtgcagggcccaccaagcccacgctcaccaggaactctaggtggcctgcaagcgccgcacgcagccccggttcccgcccgtgcctctccctccacaccccccgcaggctgagggaaccggctctggccttggccatcccaggaaggggctcccacagtgcagtggcaggctgaagggctcctcaagcgtggctgaatgggcgccgaggccgaggaggcaccgagagcgagggagggctgctagcacgctgtcaccttttagttgccttacagtaactgtaaaaattctgatatttaaaaaatccaagtcattgataaagtaagaacaagtgagaagtctgataatatatcatttctttccatctccttggacacaatttctcagaagctaagcttagaattttaggaagacacattcaatatactacttaataaaaaagttcattatgtttcatcatttggaataacctcaaattcccagcaaaattgaacactgtgaaaaaagataattaaacaggaaaagtcagagttttagacacttgtttaatttactcagctactgtatttgtggcttcagatttctcagagtaagatttattacagaaagttagtattagtaaacatttaatgatttccaatggaaaccaaacatttatatattgaaataaatattcatctatgcatgtaagtatattttggctaaaaaccaccagaaaaaaaatgctttgacctagaagtttaaggagggatgttgatttattcaacaactatttattaagcaccttctgtgtgtcacaccctgattattacgtcttttgttagactctactcaaaattggttatttaaacaataattcagatattccatatggtttatcagtttccacaagacttatattttcactattttacttttagaggaaggaaaaaaattagtcaaacatttcccatatctatacatttaatgagaacatgggcaagtcttcttttaacaaactttttctcccaaatgattcttaagtattctaatgttctaatggtccataataatttacttaatttgctaataaagtttctctagtaaagttagaaaataattagtgcttactaacgagtattattgattcaaaactttagtgaaaacaaaatatggttattataagataaattataatttatcatataaattataaattctatggttattataagaaaattttttttatgtgttactatgtttaaatacccataagatagtcttgtgtgtatatgtgtttgtgtgggtcagcagaaatagcagactgtgacatcgactgatacagttaggatcaatcatgtaagtaataacatttagttatgaagaataggctatgctatgtttaaagatgcatctaatgatctttgtatattttactttatgtttcccagactttataaaggaaggtgcatagcttgtagacagcagtccccaagtgtagtttttactctgccactaacgagcattgtgatcttgagcaaaccagttggtctcttcaaggttccattttgttgtttgataaatgaaggacgtggaatagaagaacgttgaagttccttccctccttcaaatgtaatgatcatgtaaggtagattgctttaattacatgatactttgaaaaattaaattaaacaaatattaaaaaatcattaaattaaccaacacttcagtaccaaccctgcaatctctaaataatagagtgacttaaataaataataaattactgatgacttgaattaaaaataaactaatcttagattaagctacactaaaggtttggaatttagggtaataatatgacttcctgagccctgaaatattttaccagatttcatggatgaaaacagagttaaggtttagatctaatactcataagctcttccagacaaattgcatgatcacgagaaaagatttacaccatctctatggagtcttagagcatttctctctttctctcagatcctcttatccctaaaggatctctttatcttaccactccagaccaccattttctattttccttaaacttaacagtaatcaaactcggcattttgaaagttaatacattttatctgacatgttcaggttttctggatcctccttatctcccaatcagactaatctgttggcaaacatgaataataatgtctttgacttctttgttccttcctacaactggtttccatttcattggtacctaatgctgtctggtgacacacagcagcattagaacattgaataattgctggttaaaagagagagagggggagaggcagagaagaatgagagagagagagagagagagagagagagcgagccgaaaatgcgggcatgtctctccttctattaagttgttcattagcttttacagtgtattttgcattcatcttgtttattttctcacattctactttagtactttatcttttgatacctggattggttagtagtttcctaaatagtttgtctgtctctatcatttcctgctaatccttcctaaatgaatgcatgcttgaaaagacctaaatctaatttgctactgatttcacaatcttactgcaccactcacttcaaaatggtctcttcttccttggaacgagttttccttttatatcttattcagaaattagccaaatatgatatgataactctagcactttctcacattttatatttctaatcttgaacttttttttgcctatctctgtaaccagactgtaaatttagtatgttacttttatgtagtatatatcctttaaatatttgttgatttaatatgttaacttgagtataaaacgaacatttgaccttgtgtagagtgtaaaagaaatcttttgacacactgtgataggaaaacaaattcaaaagtttattatcaaagataactgtgatttatctgaagcaatctttagtcagggtaagcaagatgatgttaggctttgtgaattaatgttatgagaaagaaagtctatttttgtggagagagaaaattttcccgcataactgtaattagggacaaatcagagattaatgatgcattatattctagagctttaactgataagcaccaagaaatggctttctcaactttaaatggtttgtaaaatattatctctgtactttgctctctatatagaaaataatggatactaggtcttctattcagaaaattcaatatttattctaaaatgtaaactgttgagttacaggaagatttcatatactcaaaaagagcataaaatctacctctactaattagtttctctatgaaagccttccaggcaattacagagcagtaccattggtcaatgctttggttgcttttcattaaaggtatagtgttgctaccagatgaattgcttcatataaaagcacttaccacaaagacctataatggaggttaagtgctatactaattactaatttcaatccttattacctatattttgcagtacaggcactttaaaggaaccatatatagtctgctggttcccgcttctctgagtataagacttggtggtaaaagctctaatttagctgttcttctaataaaaataaccccaaaaattaataaaaagagccataccacaaactgacataaaatacatatactagactttgctactgaactcgtatttacaatcaccgtgtcacaaaaactttaatcaaggtgacacactcttcaaaatttgtattcagccattatggcaccgttgcagatgaagttccaagagaaaaaggtatttgaaattttcatggcttatttcctacctcagcatcacactgaaatgaacacagagcagatgattaataaaacatctgatgacaatggtgactcccctgagttctttatatattgatcattaactttttatatgtatatattgaaattcttcatatgtgctttattttcttgagggccgactctgtgttttaccttgcgtatatccttcagaataattgcaactttgcccactcttggtttatttatattttctaaaatacatcttggtaaaagggcatttaaaatctctgattaaatgttgaaagttgtatctgaaataactatatgtaaagatttgcttcttattacgatactgctcatttctatttttaaacatcttttacattgtgtttcttattctgaacaattatttaattggcaaataaggtactatatgtgttaaacaaatattaatctagaaaaatatgtacaaatatttttttcaaataattaataagtactgcctcaatctcagctaccagattcaaattggacattagtctgctacaagaacacaggaaccatatcttttttgaactatattcagtacatggcatctggtatgtgcacagtcaaataaaatatagtaaaattggggcatatagacatttttgaaaacataaaatatttactaaaatgcaatgatgtttggctaatatatcctatatttattttctatcatctatgcttgggtaaagcatcctgtatttctcttttacagatacattatgcatattaataaagtccaagtatagatattttaacttagcttaacccagaatttcccaaactaatgggactttccctttctcaccataagtagtaataagctctaggtaaagataccagtttggaaattgctgattaagtgttaaaagttactaaataaagacattttcaagaattaactatgaacacaaaaccatgcctcaagaggcaaatgccacactgcaatagtaacaggatttatcattttgcacgttcaggtccactgttcacagctgacaacatcccatgagcaaagcctagaccttaccctactatatattttcatggcatccagtgtgatgactttctctcagcaaataggcagtgattaatccatattttaggaaaattaccaatacacctttctgttattttattaaggttttagctattacttttaaaagcacattttttaggctgggcatggtggctcatgcctgtaatcccagcactttgggaggccgaggcaggaagatcacttaaggtcaggtgttcaagaccagcctgagcaacatagcgagacccccatctctacaaaaaaattttaaaaattagccaggcatggtggtgtgcacctgtagtcctagctactagagaggccaaggaaggaggatcctgtgagcccaggagtttgaggttacagtgagctatgactgccactacatccagtctgggcaaaagagtgagaccttgcttcaaaaaaaaaaaaaaagttaaattgataaagaataaaaattgaaattgcacatttatactaggatttcagataatgcaataatctgggattagcaggggctatgtaacattgcatgcatattaagttacttggctttcaaatcttccattacttcaccttattgtatatggttcacataattgtagtgtaaaattgtggtaattcccaagacatcgattcagcaaatatttactgaatgcctactatttgccagtattataacaggcactggacatattaatttccttgcttcctaactttgtcatagagcagtttttttattacatttaattcagcaaatattggcagagtactaggcttgtggaataggtttgaactagggcttgaagatttagaattctataaaccagaaaaggtccagaagggtattatagacatttcattccacaattgtgagtcagtacttgggatatttgatatcaattgaatacattggttatgtcattaaattacttctttcaagaaccaaataagtgtgatagaagaatttaaatataaattttgattattatttttattgggtaaaatagaaatgtatttttatactttttctttatactgtgttataaattgtgtgctttgcaaaaaacatagttatatctaaaaggggaagagagaaatgagactgatgcttttagtaatagagacgataatgattgcagtaaaatatctttatacttttaatttatatattacttaaaaagcatatttgttttaaaattgaggatatatacaaccacaagtaacattgtttaaaatttctaatctaccacctttgtttcaataacataatattgataaaactcattcacaataaacaagataatttttattttatcaataacggcttgacatttattttatagacttaaaatgagtagtgctagtgtcaaagaatcctcatgaaactctatggttatatgaaagtgaaaacaaacttcttttatgtacatgttcttataactgctgatttatgctactattgttttctcactagttctctacttatctcacgggatccctacactttaatgtgtttcagctgtgcactaccatctgaggaagcgttaggtcttattttctctcagaaaaaaaaagtgttataatattctttcccttagttttaaattttaacttttttacttttgacaaagcctttcctttgtttaaatgcaaggatccagtaaaaagagctttgatatgttgtgctttttatgtgtgcatttttctgatttcattgatgtcctgaattttgaaaacgataatgtacaccttcacgttctcctataaaatggcatttgtacactgtagcaagaacagtttaggacagcattacattcacatgactctaaagtccaataaatagttgatggtttctcagaaaaccacaatttggtgaaacggatgcaaaacagtgctttttcttccagtttgtttttcataaaatcttcccccgatacatattcacttgcttacctgcagggtagcgctcgatcactggccagctgtccacctgcaacgtggcattgccaccactcctcgtgaaacgaactacatggtatttcccatcattaatgattgcattggattcttcaatggcgatgtcatctgtcccaacattaaacttaactccaatttttccctggtgctgtaagagaggaggggaaaaaagagttgaattaagttgactagtcaccatttaataaagattacatacaaggtattgttttaaaatgtgctttggacaacagctgctttcctccaattttacttctgaaaaactacatgtagtagaagcaagattcttgacatctgggtaaatttaagacatctctttcatggataattgatattccaaaaggcacactttcaagggaattgagccgccttcttcccagaggttgtcacagagaaggcgcacagctgcctgcacaaaggacatccttttgtgtactttaacacaacccctttaatccactctccccatttcacaagaaaaacggggctccaaattcttacttttaataactggtgaaatcagagcaatgatgtctgtttagagcccattgacaaatactcacaataggggaaatcattctaaagggtatggggcatttaatgagtgcagtcccttagtcagtattcacaaaaccatcaaatactaacagcttgaaagttattcaatgtttttattttattgatgatgaaacatcaacattttattgatgataacacaggaaggtacaagacttgttcaaggacacataatagagacgtacgaaaactaaaattcatttcccttattcttagattatatctaagctaagttgaagcaaagataccgttatccaaaatgaacgccctcttcacttcttcatatgcaaagcctcattatgaatcattctaactataaagttgttgctgttaactttagaatttcataatataaggtggcaaagagaaacatgtgctatgtcctctgcctctgagaagcattctttaacaggactgtcaactctaccatgaaatcagttgatttctaaagcatgtggatttgtccttaatcagttgcacagaatacctgtgctgtaggcccttgtcagaacacataacctcaaactgtctgtggttcacccttcttcaaacctcagttgagagaaatcacacggaggaagaagggtttaaagtacacacagtccatcctttcctgtagaagttttaaatcagaatgttagaaacctgaagatttgggccacattctcttgactctttgtggggttctcatcattatttgaactaggcagcaggagtatggaatcagcttacactaagaatccttacggaaaatctttttcaaaattgtattaatcaaaggaaaatatttgaggatgttattttgcagtattgctcattatctccttcatgtagagatcctaaaggtttctgttggttttcttccccctgggttcttattgtacataaagatctctttcttataagttagcatgcttacaattttttttggtttgattagctttaggcttgacggatggtttaacttttttaaaaaatcacattttaacactatatacatgtttgttaaataaagataacttattatgtctcttaaatgagattctttaaaatttttctgtagagttatatcacatgtgttaaaaatgtatgtactaaattaattactgaaaatgagcaaaaagtaattctgttaaaataagaaaataatgcatgcttacaaaaaggtctgagctaaaaaaaaatctttaaaaaaatctccataagtctttgaataacgtttgaattttcattggacttttgctgtttgtttattagctgagtcagtctacacaatactaaaatgccttacaatgacatgtatttaaaagtaagggtcatgagaaatatggtggaaaataataagtccaggggaaaatatatactaaagtctctgcagctattaaaattacccagccagaagtgatggcacacatgtataatcccagcagtttgggaggccaaggtgaagaggattgttcaagcccaggagttggagaccagcctgggaaacatagcaagatctcgtctttactattaaaaaaaaagaaaaagaaaaaaaaaagaaaatctgggcatggtggcacacacctgtattcccaactactcaggaggctgaggtgggaagatcacttgagccccggaggctgaggctgcagtgagccatgactgtgcactgaactcctgcctggttgacagcgtaagaccctgtctcaaaataaataaatattttaaaaattaccctatctacatggaccctgagtttcctaacaaccaaacacatacgtagggctctatacattttataaatactaactctggtattcttcataacagttccatgagggagatgctattttatcttcattttacagatgagaaaattaaggcacagggtgattaagcaatttggctaaggtcgcacagctggaaagagaaaagctatggttcagatccacacagttaggctccagagtctggtccttaatcattacaccaggctgagtttaggactgttgtgccatcctatagctgtagctagcagatttggtaaatctagctgtttttactacctgttttatctctcctgctagaatagcatcactaaggggccttgtattgttctttgaagttagtagacatgtatcaatcaatgtatgtttaaaataattttggaataaattgtaagcaactgatatgtggatataatagaatattaaaatgattctttttgtttcagtttcagctgagatgttaacatgataacataataagtcaaaaacacattactgtttccatcttacaaaatgaagcataaagttacttaagccagtcttgcaaaggagaacactgagaactgcttttagggtcctgaattaattacctacttctagtccatcaaaatgcagaaaaaggcaagaggagactgacaattagaagaggatttttggagacagttgagatgtgatgtgatttccacatactgcagggtggaagtctgcttttccctatctcaagtgcaggagaaagggacattagtggaacatctaagaaaatttgatatgtgtcttctgggacttggtgggtggcagcggtcaaggtagtgagcaaactagtatttgactataactgagaaatcttcaagggaagagactgtggcttgctgatgcccagtggccaagcaaagagatattgatgtaccaggagccacttgtgcattagggtttgttaggacaaaggacacttgtggaccctaggttagagtctgtgtagaattgtattgtatcctgtttagcagggttactaaagggattgggctgagtggtgaagaaaactgagaaaagaaaagaaaaaaaaaaaaagaacttggaattgcagtgatagatgaccagatggtgaggtgggaatcctaaatgaccatctgaaggaagtgcatttactacctcaatggaattgcaggtaaattctaataatggggttaaggtctgtaaagaaccaaatgcttccgaaaagtgcctccttaagaactttaagtataggctaagctcaactagatggctacaataatactagccaagtaaggtcatttctgccctttatgtcttctttcttctgcttcatccctggaggaataagagagggagaggaatagtgaaagccatggaaacaatcgtgctcctcccagtgcaagtgggggctccactgtggctgaagcagggataatgaagaggctttaactgacttctgctattacagaggagtaagctgattttactttttatgtctaaaagtgaacggatgacctttttactatccaagagggagcaaagcactgttgagactccctgtggacttccctggtggttagaaagaaatatttttacagaacaagtttaattcctgttacaccttgggaagtactttcaacacaacaagtacaggaagatatctgttactctagggttgcccattgttttagggtctcgtctattatagacctggttcttatccaggatacactggaaaaaattcttgcagtttcctacttattatgaaacttattatggaagtaggccataagagcctattttcatcagagtattaattattaagaaggtctagattcagtgaatagaagcattgcaatgttaaaggtgaaaaatgcactaaactctgaaataagtccctttaacttaaccttaaaactttctgcaatatgaaatgcaaaatgctcattttctaggtgcagaaatctccagatttcataggatttggtttttttgcaacacaataaaataaacaatttagaaacaatgagcatccgtgatgcttggagaacatccgactttttttttttttaattttatatatatatttttttattatactttaatttctagggtacatgtgcacaacgtgcaggtttgttacatatgtatacatgtgccatgttggtgtgctgcacccattaactcgtcattgacattaggtgtatctcctaacgctatccctcccccctccccccaccccacaacaggccccggtgtgtgatgttccccttcctgtgtccaagtgttctcatatcatttgacttttaaatgacgcccatctcttcttggagatgttcagttgttgcctcaacttcaaatgtctttgacatctcatggatttaaactctagagttagctagaatggaactgaaggctatcaaaataagggttcaaacaacaggcccgaccctaattcagacattatctacttcaccccaagttgcatcaggctttgaaaaacagtttaattataaatgatcgccaaagagttttccctgaaaacaataaatttaaaatacacataaagcacaaaatactaataacaagcatatttataagaccggtatttactatttaattcagaaactatagatattcttacaacacaaccatctcatgtttataggatagcaagtcatttaaattatataagcaataaaacgtgctaaactttcttgccaatgcgtaattacaatttaaaagaattcatttcaaactcttattctctgggattaaatatgattgtcttggcaaattctcatgaatattgcattagcaaaaccagaagtcatttcactggacatgtctttatctccctgtacatgtcttgatctccctgtactgtatattccttgaaatagataactggctcaaatcataatttcaaaaatctcttataagaatatcagtaacgaggcatttataatttaatgaagactttccatggattcattaaataaacagtgacaatggtaattattgatttttttacaaaagctcatttctgaataaagattatattattaaaccaagttaaagggaaacatcatgaaatatgacactgggaaggtccctgaaatttctagcaagtggcaccatagtttaatgcactgtctaattccatatgaaataacatatgcacttgtaagttttatgttttaactaagattaagatttaatggtgtaatcaatatcttgggtatacttcaagcaagatgtctgcatgttacagatgcatatataatatgtgcctatgaaatggataaagcagaatacacgtaagtaaagatttcggtctacatgtggcatacagacatgttacataagattttagtgcactgtttcccctcaccccattcttggattgttatatagaaatgtttggctcaactatgctcaggaacagagaccagtaacaaataaaaatgtctctctctgtgtctgtttactatactcctagagagaaggaccaaacattgtgagcaagtgtgcaactcaggagggcatgtagattagcagggagccctgtttacgttctgtaaacttctgtcatgcaccatagtacagtccagtactccagggccccactttggacagaactcaacaatgtctttaaatgctctctctatgcttgtactcatttcagaatacagaaagactcccatagtccaaatctacattgttgattgaaaccagagttgggtgaatggaatgttttgcttctccagagactaatcctcaccagggagcaaaggttttaaggcatgaaggggagtctggagcctatagtcacagttgttggactatgcaacactgcagacagtatcagagagccatctgttatctcacctaaaaacaaacacactcagataattgctaatttagcccaaacacttttttttttttttgagatggagtttcactcttattgcccaggctggagtgcaatggcacgatctcagctctctgcaacctttgcttcctttgttcaagtgattctcctgcctcagcctccgaagtagctgggattacaggtgcatgccaccacgcccagctaataatgtatttttggtagaggcagggtttttccatgttggtcaggctggtctcgaaatcctgacctcaggtgatctgcccaccttggcctctcagactgctgggattacacgtgtgagccactgcccccagccacccaaatacatttctaagtgaattacttagaggccctcttggctggtagagactctgtttaccaatttagatggcctataatggtaagaagtggttttaatctagttgttttaacctggcactgagatatacatgccatcctctaacccccaaaaagcaacaccaccacatcaaaaacaagaagttcctgctgccctgtctcctattttctccattaaatagcgtctgtttaaaattcattcaggtaactaataaaaagtatgtaatatgcacccagcattttcctactactgggaggagaataaaaacaggtaaagtctgttttctgctcctgggaaaactttcaatcaaattgggaaggtaaatcgtgcatgcaaatactcatacccacaaaagagttgagggagtggtggggaaaagcacaggtgcattgggggaagcatctgaaggatctctggaagcctcaaactgccatgggagcaaaccagcatttggacagctctaacactaccagcaggttctaatgcaactcccagggacatagaagttatgttctgtctaccttctatctctcctttcaggccccacataccagactactcactatgtgccaggtattgagctctatacaatgtatctcatctaaaactcccagcagacctgaaaggtaagtgccattgtctctatctccttggaaactttaatcttgctgaaatcacacagccaataattatgggtactgaaatatgaccaatttggtggggcattctaaaactgaataatgtcagttgtgtcagtgttccaggaaaatgtcttgaaactaaggcacccttagaggatgagtcaagaggagggttactacagggtgcatggttttgtttttggttttagttttttttttttttttttttttttttttttttttttttttttttttttttttggctagttacattttgtagcactacacaataaggaatcagaagtgggcaagatatgtgggcaataccacctcagaaacatctcatttaggagtaatacatttttaaaaaacagccttttcatttccccatcaaatcttcattaaggatagtgtatcttttctaatatgtctccatcctacaggatgctgtagctccttcaatgagactatattctggcagcgatattaacttcctggaggcttaaattcatctcttggtcctaagaatgtctaataaaattttctaagcctgtgccagtcctcctccacacactgccttaggtgttagtttttatatgcccatttcaacccctcaaacctattaaaaacaactttagggtaggaaaaaagcctggtgtattcctcattgtatccttcaccacacttcccagaatacctttctttacttttgcaaatttccaatattctttcacatcaattttcttttttttaattgagatataattcacatatcataacatttgcccttttaaagtatatggttcagtggttttagtatattcacaaggttgtgcaaccatcaccattatttaatttcagaacatttgcatcatgctccaattttcttttgatgagataatgcatacaaaattcttagcacatttaatggctacatagttcctgttagctattagcattattattattattgctacaattattgttgttattcatcactttgaaaaacaatgtttagcttcaccgtagtttgatggaagttaattaaaatattgcttcaattatatagacatttcggttttgctagaggatacatttttaatgattacaacttgtgaagcagggtatctattttgtaaatgggaaagctaaagctcagaaaggctgagacttggccaaagtcagagcatctatctatgacttggatcaagagaggatattctaaaatctacctgtgctcaactgtaagataagtggttctcccgttgattatgctgaggcagagcatgcttgattagacaacatccatgtcccctcccatctcaatattatggttctagggaaatcctaaatgtaaggcaaagcagttctcacggaaaaaatttagatattactagttgagttttttgaaacacattgaaggtgcctaagtttgaatttgagtctctcttagatttccttcaaaatttaaaaaaatagaaaaactctaagattttattgtgtttttaaatcagagattctccaatttaggaggagaaagaggactttgcattaggttgaagtatcagtaatctgtgaagccttttgtgaaccatgtatgtttcttcccaagaaagtataatctctgatggaagcgcttgccattattgggaagagcccctgccttgtcaggtatgtaggatttagtggtcgtaaagtgagaaaaaggatggacagatcttgagctccagtgataacatcaaaacacttcagtgcttctatttcctcattgtctctccttagatgaaattaaataaaaaatcaaaacaatgtcaagatgaatttagtccactaagtgactggctgctggatctttgaatggggtaataatcttgatatcggtattttaagatattctcaattttgtttcactaataaagccaatactggattattctttacacagtatttgagaagacattctcaaaccattatgaagttctccagtgtggccatgggtacagacatatcatcaagccttttcgtgatacttcccccttccaaatagcatacgtttgcagatatcacgatagctgtagaataaaataaagctaccttagcctcttgtgaatcagagtcatctcattgagataattaattctgtatctccatccactgagacaacaactactatgaagttgaaatagttgcctttaaatgtgtccttatgtgtaaagaatgtcttttattatttttctccctgaataatcaatgagcagaaatcaaatagaacaagaaagaggcattgacttggtggcctatggaaccttcttaatttttcacaggtaatactttccatttggatagttagcctagtggtctggcatcataacaaatactttaggttgctgtatgaaaatctcagcgtcacactgaattaagttaagccttttccaaagtgtaatgagctgatcagatgtgtattacttgtttttgttcatttttttatatttaaaaattattgttgctttaaagacccttgttggaatgttaaattactttttcttgtacagtcacattgtacagtaattcaggaaactatgggcaatacattgtgtttcaggtgctgattaaaaccacaatctttgtttattctgcatctgcctgaatccttgtctttggaccattgcactctttgatattacctccaccaggaactgaacaggaaaggggcattctatcaattctgctaattgttgacattttttatgtaaaaaggttttcctataaaagagctttgggattatttgtggatttcatttacttgttatatcccaggatcatcattttccaggagacctgactatataattacaatctaactctaatgttccaaatttccatagcacaaagcccaacatttttcagacaaatagacagaacatccttggattgtaattttagtcctctgcatggcaaatgtaaccttagtaactcggttataggtaaaacaaaatgaaccttcgtattttagaaaatccttaaaagacgtgaaaacatatcaagagattaatgtaattattttcagtgcttccattgatataagccataagctacatacagtaaactgggaatggaaagatcagtttggaaggagcactatttttttaaattctatttgtgaatcatgacttgcaacctaaaaacaagagtgaggaaatgttttcaagtgtgtttgatggactgacttcctaatgatgctatgttagttttcacaagcctcaagaagagccctaccttgaaatgcatcccaagagaaaagctgacagtgctaacttttttcttttcgttttctctttcttattgacttctagtccaggactagctgtccgacatccttaggaaaaaaatgtgtgtatatgggcatagaaatgcatttaccaatgaatattttctaaagaatcagcaaaactctgttatccctgaagtggtaagtaataattcctacagccatcaaaaataaatctatgttcatgtgtgtgattgtggcacaacagaggagaatatggaatctctaaggcagaaattcctaatgattataacttttttcatcttcacaaaacagtaatacctccacaaaaatgaagtaatgcagaaaaatatttatcaagtgccttttagctgcagtgaattttgtaaaacaccataccactcatcccatgactcaaaactgataaaatgtgtgttgctggttatatttatatacatttattttcctcaattgcatggttttctggcataaatgacactaaaattttggaactaccataacacatgaagttcagtattcaccaatatttatgtacttattcaaaaaccacagactttttactatactcctggcactctgttaagttctggataaatatggttaacaaaccagatggtgctgctgtcattatgaagcttaagtctcacattattcgttacacattaaaacttactgtagcatatacagcatgctaagtttcaagaaggcaaagagtaaggatagcatgagaggaactgaataatttaagcaaagtctccttgagaagctgaagatgagaagaaatcaataatgaacatttagcattttccaggcagagaaaacagcatgtgcacatagcccagggagggattgtacaaagacagatccttttatgaacaaatgcagacacagatataaatatgtggactctttatagctattaagatgtgcaaattatatgtgaacatgtacaggtattcaaaatatttgtataagatataaaactaggttatggaataatgcgtaacaaaagtaaaatatattatttgcacaaatagagcaattgaaaaatagatggtgaagcacatttaaaaaattttccaatcagagaacagaaaattgttgaatatatgtagaacctaacagtatgcaacctgacattcatctaattgtttattcctaagtgtcattcatcaatgtgcattatgaaatgcaatttataaaagacttcctgaatcaacagggactcacatctttttcaaaagtcacttacttctacaatgtcaaaaaagattcatcattctacgctcatatttctaaactaatgtaacatgtttagtttctttgtgtggtggaatgtcttgttaacttatttatccagagagcccttttatctcaagatgtagtaaagagttatccataaaatttctgccttaagatttatgtctgaaatcacttgactggtttttcaagtaccctccttaaattggtagaagaatgcaaagttttcacccttgaccctttcaccttcctgttcactcagaagagcagatgaacagggtttaatgcctgtgtcccaaaatgcagtcttccaggcagtcaaccaatcacttcaaatgagacgaaggattctctatccaattctacttccagaaaaattttaaataaatgaagttaaatgagcatttgccctgaaatttggccaggaatcgtgaagccaaaaacacgcgaagtgctcaaattcaagtaactcatggacgttttgaacttgagataaaagttcacttgtaacttctccagagcagtaaccactggaggctctttgaggtcatcccttcccattgtttgcctggaaaagcaagagaatattttgaagacagttgtggacgtttagctcagtaaagacagccgaaggaataaatacctggagcaatgtcaacttagcagccattgaccaaacaaacaaacaaacaaacacactttctctcttactgctccatcacactagcttttcatttccataaatgtctcatgttctgacccatctcaggcccattgctcttccttctgcctggttagctgtttccttgccttccccatcccaaaataattgataccctatattgtttggagataattttgagaacttaaggatagatttgggcattgaatctgctgaataagggatagtgtttgtgaaatatcatttcgtgaagcaaaaactcattagtggtcatctactggagtacaaaagacatctacttaaaagtctgggctgacaatagttgaaaagcaagagacatactgggaggccatttctcttctgattagcagaattatttggtggactctgactatttctgataaatctttaagtactaaatatcatagcaagaaatatactgttgtgatcttgcattccatttatacacttcccctgccaaacatgtccactgttttaaaataaacatgaacaaaacctaatagagaaggtaaaaatgcactgagagattaatcagaaacatcattctaaggccaagtggaaaccatatgtaacttattcagtgtttggtaataccagtgtcagagctctgaaatgagtgtggatattccagaagggcaggatttggcagcagatgcgtgatgatgataatgatgatgatagccatccttcttgccatgtgtcagacactccttctaagcactttacaggcaataatacgtatgaatatatatgattattttcatttaaatgatgaggaagctgagcctcaaaagcttgtcctaaatcacatggctaataagtatcagagctgtgatttttcaagcagtccaattccagattttgtgtgctaaactataccattgctcctctgaggaagtccaacatgcttacaagaggttgcagcttgtttagctgtggtattaataaggctctttgaaaaagagagacactaacatcctcattattgtatatatcaagtaaaacatcaagtacttttcagacctccactcctttaattctcacaataactcattttgccagcctaccaatctccatgttgaggatgtttaaaactcaaagcaaggaggtacttttctgaagtcacgcagctaaaacatcaatctagttacattcaatccaggtctatctggttccaaactaagagctttcaaccacatcatgctactccttctgcagagtcttcatgatcccctagaagtagtaggggccagatgagagtatcctagagctctagacgcttaccattttaggaggtttgtatactgataagttttccaagatgggggtggacagacgcagcaattcctctttcatgagcattaaattagtccagttgtttagaactgctagtaagtgaaatattaatctccattagggccagagcagactttgtcatacttcaagagccagaaatggaagtactatcttttaggtttaattgagattctggagtgtcagcctattttcagagtctgtaagagaggaacactcagagaaatagccagtgtctttcctctacccaaccccttcccacctagtttacatccagtttttctctagtatgttttttgtttatagccaacagatttatttaaatcatatttatcattgcttgctattttgaaagatgtgcctcaagcttccaatcaaatccaaaagaatacataatcatcaaaacaaggttagtcatggagttttctactaaataacatttgtgactgaaataggcaaggaaatgagagatttagttgtagtttcccaaaggtaataaacctaatatttaaaaagaaatagtaataacttaccagcagctcaggtgttccatgtgtcatgatcaataaccaagtaaatatagatctgaattttgtagccactttggttgtatcaaaaaagccactgcatggtactattacatacatagtttatatggtttagaagaaccatataaaccaccattaactattccttttatcataataataaaaataataggtggagttgctgatatataaaatatgaattgatccattagaagtaattttctattataatttttcaactttcttagtcaatttcagattatgattagaaatgttaatgttaatcttgtttctctaccatttaacccctctcttaaaaacataatgaccacttcttagacccttttctactctccttccatgtatatttcaagttttctacttataatttgtaattatttaaattgttttatttttatcttagttgtttgaaatcaacctctacattattaccatcttttctttctccccaagcttataagcattggtctagcatttaatgataacttttaatttgggatgattatatccaagatgctgccccagaatgagagttttatgaatgcttaatgcaaggaatcataaagcttataccagtgctgccctgaaaaattaaccaaagaaaaccccaaaactctttctccttaatcaaagaatatgctttgatgtgaacaaaagagagaagaatatttaatatcagctttggttgcactgcaattagcaattaacaagtaataacctatgattagttcacaaactccaacaaatacacttaatgacaggtgactaagagatgtgggaaacatttaagttagggccaagatgaacaaatgtgaacctagcacaatttggtttggtaacattaagcttttgataaactttcctagtcaaaattaaattattccatattactttgaagtaattataatacaattttctactttaatcagctgtctcaaactttgtgatcacaagttattttatgcaaaaaaaaccctaaaagaaattatgaaagatttttcaagaaagatttataaacttaatctttcaaagtatctcataaatgtaaatgcatgcttagcatttttaatggattatttactcatcatttagcttaaacatcataatgtttccaatctatgttacaagagctaagccatttcaatgctttttgaacaagttactctgttgacattggcacagaccaccaaaatgcactgattatggaagatatacggttaatgcatacagtatctgagcattgatagagcatcaaggcaaaagcaggcaatacttaagttctccaaataaatacacaaaaaagagagcttgatgaccacctaaaataacttttcaacatggaaaggtgagccttgcggcattccacatacagattagctgagcctttcaaaggtattgttgaatttatctatttctgagcatatcttacttttaacccaacttaattctttggaaggacatgcattacttctgatacattaaaaaaaaaaaaaaaaagacccttttcatgctcttgcttgctaaaactctactagaactttcaatgacaccatattgcctctcagactattcaactggaaattgtatcaggtaaactctcattcattattgcactacccatcttttaaatttttaaagagattattaggggctgtttaaaattattactattcttccacttcttactttttttaggtttactctcccatcacaattattgtcacatgctacattccagactacatatatatatatatatatattttttttttttacccaagtactacaatagaaatgtgatacatcaatggattgtaagaaaaaaaaactacccagctatgtacctggttatattcacacattgttacagagctgaaacggattaattaggcagttaataaaactattacaacaataattgcagaaattactaacgtaaaagtatcttggcctagatagtttatgtctcagttaataataatgttgatagtaatactaataagttctaattatcaatgaccatttgctatgttcccaatttagtcttttaaatatacctctgaacagtatttggctcataatggtcacaaaacaagtgtttgctaaatattgactaaattcttatattaactctgtgtgagacagatgccattattaccttcacttaataggtaaggaaactgagtcataaaaatgtcacttgctcacagtcactccactaacatttgaaggatcaggatttgaatccagatctgtctatctccaaagtaggtgttcttaaccactactgttttatgttgcctttggaaaaatatccaagaactagataattaccagtgatgaaatctgtttcagaatatagaaaagtataactcccctctaactccataaaattaaaacaaaattacaatccctcctaaatgtataaaattagaacttccttatacaaaagccaattaaatgtagcacacacacacaaatccattgaccaatgtatattttaatcataactcactataataaagatggctgctgcatatattgccatttaccatgagtcagtccttttgtggtgcttatataataaccgattttagctttacaactctgaggtaaccattattaagatcattttacagagaaaaagaagtggcacaaatttgcacagtcactgtgttaacctaaggactcaaacttggtccttttttacttcaaatgctacataaagccagataaagtgtatgtcaaaaactctgagatatttcaaaattgagaaatctattaacatgcatcattaggacaaatgagaaaaaagcaaaatactaagataaattctataaaggtatttgttaagttcactatgcatttttgagatatttttaaaaatcacttggtaaactagaacaatccgttgcatgataaaactatttctacctcaaaccaactgccaacatcatgcttaacactaaaagcgttcccaatgaagtaaaacagttttacattgtcaccaataggtcttagcgttggtttaaacatgtcaatcaatgcaatatgacaggaaataaaaataacagtttaaattattgatagagaagaaaacaaaaacacactacttgctgtaaaccgaaaccacactgttggatgcaaatatagccatttaaaataaaatgagagagctagccttcagaaaaccattctaaaaataagataaacataaatgcatacattctcataaggagtggcaaagatattgagcaaaatgttttggaataaagaattaaaatgtgagtttaatgaaactatataattttttggcaagtgtttctaaatatagactctgtgtgatggatacattaaaaattattatgttattttctttgtgttagaaaatgtccataatggaaagaatgaacaatggcagtctgcgaaacaagagtactgcaatttttgtctctaactatatttgtaatcttgaacaaattacataactcctctctcttgctttactttcctcatttagttcatctttttctagatcatcctttctggttctgtaattctattttattttcagttgccttctcaattttctatattgcaatatattttaattcataatggttcaatttgtgataatcactgctcagccacaaattgaaaatttagccaaaaaaaccccacagaaatggcattgctttgactttaaaatagcatactcttcctgtcttttttgagatctaaaattgtttatcagtttgcggggttctcttgggtttattgtactattagacactgacacgttttaaaggatccttaaaaaaaaaaagaaacaaatgaaaagaaaaagaaaacaaccaaatctggcttgttctgggatgctgagatgtcttgacagcaattactgcagtagagactggtgaataccctattttcacagctgatgttttccttcaaaattgcagctaccttcactttggttgaggccagggtactatatttagatagtataaatgtatccagagagcaatctttcacgtttatttgtagagtgggtttatttttatttattgatgtcacacaaaatgatgtttcctcggtttctgctgtatataacataccaaaaaataaagacggtctagaacacaaagtaagaatatattctgtgtgattatattgacaatggtttcgatttttatgcaattatactcccataatgttgaaattgttaacacaagtctatgtttactatgtaagaggaaactttattatgcataatgaagatggcatgggaataagggagtctcttatccttcctgtcaacctaaggccaatgtgtaatgcaagaaacaagtaggacacagggaaaagcaatagccataaccaagagaacatcagctatccctccctcctcacttagaaataaagaatgttggccgggcgcggtggctcaggcctgtaatcccagcactttgggaggctgaggtgggcagatcacgaggtcaggaaatcgagaccatcctgtctaacacggtgaaaccgcgtctctactaaaaatacaaaaaaaaatagccgggtgtcgtggcaggtgcctgtagtcccagctgctcgggaggctgaggcaagagaatggcgtgaagccgggaggcggagcttgcagtgagctgagatcgcgccaccgcactccagcctgggcgacagagtgagactctgtctcaaaaaaaaaaaaaaaaaaaaagaaagaaagaatgttgagaaagcaaagcattagtttatacaaccttcaaaataaaaaataatttcaagtcaaattctttttccaactttatatgtggggtgtgtgtgcgtatgtgcgtgcaaattaataagtcctagacaataaaaaattgatagcacataaatggaggggccaattctagcacttctttttgtcttttttctccattattggataatagtggttaccaaatagaattcaacaacagaactgattaaatattttccccctaggttttaatttagactacacaacatgtatttcagtacttcacattattagttataaaatttttctattgttcccctattgaaagtttaagagaatgcccataaactgagtttccttttagaaaaaaatcaaataatgtcaacatcctttgcatctcatttcttctctttcagacttatgacttaatcctcattagttataatactttattttcatcttttttatttgattatttaaaactttaaggtgcaaatgggttcattttggagacgataaacaggaaattttaagatttctcttggcccgttattttagattgtcccgtgatacactgggggcaactagcgaaagaaatgataatttgccaatgactcttaaaatactgaatagtaaaataacaaaattcttagaattgggaagtgatcttaggcccaaactctcatgtgataacagaagcccttctaaaaatatctctgacaaagggtcacttaagttcaacttgaaacatgccagtgatgttattagttctcaaagcagcctattcattattaaaatccttttgaattgaaagttactctcatgcggcatggtggtcactcccgtaatcccagcacttttggaggttgaggcgggcagatcacttgaggtcaggagtgagaccgcctggccaacacggtgaaaccccttctctactaaaaatacaaaaattagcagggcctggtggtatgcacctgtaattccagctactctggggactgaagcaggagaatagctatagcctgtgaggcagaggttgcagtgagccaagatcgccccactgaattccagcctgggtgacagagtgacactctgtctcaaaaaaaagaaaaaaaaaagttactctcatgggtctgcactatggatcattttagtgtaatctgcaccctcttgccaaatcacagccctttgaatatttaaaaacagttattaggccacattttccccacagtcagcccaggttttctgctggaaaaatcaccttccattctttaactatcaatccttaaagtttttataaccattcacctttcagctatctagtttgttaataagcttagatgctaatggaccttagcacaatacactaacttcaatgcaacgtgtaagatgggtaccaaaccgtaagatataaaatgggtactcaacagtgtaatatgtttcttaattagggcaccacttttccatcaaaattgtctgagtttttttttttcctttaatagctgcactcactagttgatgatctcagcttttagcaaactaaaattctcagacctttgcacattatgtattagctagatatctccctgtacttattcttgtggatttgaaaatgcaattataggactttaaccaccccctccagatctcccatctgtgttgcctttgcttaaacctttttcttcatccaaaatactcctacctctgctgtgcaaaacactttatcttgggcttaaactcccttgggtccttattacccctgctactgtatcactatgcttaatggagaagatgaaatttacataggaggcaaacaatccaggtttctctcttcatctgtcattacaccatcttactgaagctggtcccttcgttgttcagccttctccggtagacagagacaaatccgtgttacacaagtctgcttattccgactttagtcttgatgagtccacatttactggctcagtgcattctcgctctctctcactcaaattatttttggttttgcaggcatcctttgaaatacacttttaaaatattttgagttgtgaacttttagatggagataggattccatgagggtgcaagggctgtttcatggctttggtatgcagtgtaagactcagagtcaaatgtgtctgggggtgtgtcccaggcccatgtggggcaagccactgtttcctttactaaaatgcagcataaaattcatacctgcctcagaggtcaaggaagaattacataagattaaaaaaataaaatgtttaaaataatatctttatcaaattaagtactcaataaatataatctattaatatattaattatactattctagatataaaatgatcatcaaaagaaatcagaaaatgacaaactctttgctttttggaacacaagacatctggtgcctatgccatttctgttgccaacatttggaatgtgcctcccctctcattgctcattatctccaaatatccaaaccctaccttccctttgatgccaagtcaaaatgtgacctcttcttctgaagccctcattacccctagatttgattcctgctcagtgacgatcttgaaggtatggcatttttgcaacacatccttcaatccctatcatctggcataaacctggatcacagtaggtacttaataaatgtctgttatatgaatcaatgactacctttcccgcagccatcattaatttcttcctctcctgattttgtatatccttattgcacataaatatttaccatgcatcataattatttgtgcatgtgtctcttctgccttgcaggactataaagctttttgagcactccatgtcaaattgacctctggctaccttgcaattccttaatacatactagacactgaaaaatacttttgaatgaattaatatctgcttttctctattgctacagtattttttgtccatggaagttctgtaatctgtaccaggaaaataattaaccataactcacctttgtaggaaaaggattaaccataaactgcctttttctgagacatctgttccataatctaatgaccaacgctatttatacagttgatctatctacaaccccttcaactgtaaaaagcatatggaaaatgtatgttcaattctagaggaggaatattttggctatccttttgtgactccctttatctttgatgctcacgtataatccaccttaaaaggctgtgagtgaggcagaaggaggatcacatcacttagatgagatcttgcctgacaccactagatttgggccttcctatgaaactcccaagtttcagttattattatatcgaaatgacttctattgaacactaatcattcaatggtcagttaatttttattgagtatctctatgtacacaggagactatgtgggatgctatagaagatacaaaacaaactaagggtctgttccctgtttggaaggtaagatctatatatacaagtatatacacaccagtgaaaagtaatatacaaactgaaccctaaaattacagatgtaaaaaaatatataccacagactgggagaaactatttgcaaaagatatatctgataaagggctgtgatccagaatagttgtgagatccacacaaagaactcttgaaactcaacaaaaagaaaacaagatagatttaaaaatgggcaaaatatctgaaattaccaaaatgagatatacaaatggcaaatacatacatgaaagatacatagcatcatatatcattaaggaattgcaagttaaaactacagtgatacaccactataaacctagtagaatggccaaaacctgggacactgacaacaccaaaggctggtgagaatgtagagcaacaggaactcattcattgtcagtggaaatgcaaagcaatacagttactttggaagacattgtagtagtttcttactaaatcaaacatactcttactacatgattcagcaactgaactccttggtatttaaccagaagagctgagaatttatgtccacacaataatctgtacatggatgtttatagcagctttattcaaaattgccaaaacttataggcaaccaagatgtccttcagtaggtgaatgaataaataaactgtggtacatccaagcaatggaatatcattcagtgctaaaagaaatgggctatcaagccatgaaaaaacatggggaagtcttaaatgcatattattatactaagctaaagaaactaatctgagaagcctacacactgtatgatttcaactgtgtgacattctggaaaaggataaactatagagacataaaagaacacattggttgccaggatctagtggggagagagggatgaataggtagagtacagaggatttttagggcaatgaatgtactccgtgtgatattataatggttagtactagtcattatacatttgccaaaacccacagaatgaacaccaggagtaaaccctaacgtaaactatggactttgtgtgataatgatgcaccaatgtaggttcatcgattataacaaattaccactctagtgagggatgttgatggtggggagactgtgcatgtgtaggagcagagagtatttggaaaatctttgtaatttcgctcaattttttttttttgtgaacctaaaactactctaaagaataaaacttacaaaaaaacatatatatgttatgtgtatatatatatatatatatatatacacacacacacatatatataataatacatattttatataccaaagaaagctgattaaaactttgtttagaagtacagtaggaccacagaagaaacaaatttctgggggtactcaggagtttacccgagattacgtaataccaacaggaatcaatgtttcttcagcacaaactgattttggaatgatcgaaacaatgtatatgtactttctcatttaatatccacaacaaactaataaaggaaatactattattatctctattttgtaaatggcttgaaacttattatggtgaataacttcctcaaggtcacagaaccagtgaggggtataagtgagatacgaacccagtcctgtccaactgcacagctgaggttcaccaatatcctatacttccagtcttgggaaaagaaaaaaaataaaaattcagttggacaaaagcaacagaaagagaagtccaggtgggagaagtctgattaacttctggaaactttgcaatctatgacagttttatgattcacttatttttatttaatatttcttcaacactactagtctatctccaatgtgaacagaggcaacagtctttctgttacataagaatcatgtacatatgtatgtttatattcaatttataagcagtctgtctttttaagaagacttattaaggagaagtaatttttcataggatcagtcttggggctaagcaattatatttgctatctttttaatactagtagtcatatttcttccctaattgattattgaacctttctaaatatgtctgaagacatagattgaaattatcctaaggctcgacctctttttttaattgtgactaacaaattttaatacaaggcaaacagcaaaacatggcaggctgaaggagtaatttcttgcacctatagccggagtttttttaaagagctacgcaatttttgttgatcttccactggcttatctacagcaattgaagtttatcagaaagatttatgacatggtattgcaggccctaataaatgactttgggaagctgggaaaactcactaaagttaaagttattatctgaacctcatagggctaattagagatacaacctgaagtgttgagtcagcagtaagaaacacaacacgttatcaattaaagcctccatctaggcttggagaagaggtggggaaaagaaaagatttgcaatgaaaatgaatcatatgtttaaacaccagagccaaaaattagtcctcaaaagcatttcctgaactctctggaaatgtcgatggggtcagctctctgcttaaaaagggacccttccaaggcattctcaaagtaagttaccaaagttgctttgcatatgtataacaggaagatctgaacatatacagatgtgggggttccagaaagcaagaaaaaactctacctcttccccacatctcttcttctgaggaataggcaaaatcttccttccccaacacagctctgtgacactgtcaatttaaaacattttcatgcaaatcaagttaacatttaaaaaacaaacaaacaaaacttgcactatgaatgacgtaaccccttctcaaatactggactttaactactgccattgaaaacagggtggtttttcttaagcatttctgacttgatgctgctgttttcctgagatgcgaccaactaaaaatgacttaaaaatccctgcaccttcctggtattaatggaaagaggtagtggggtgttacagggagctaacttttttcatggttttcttaactgagttacaaaaataacagaaaattgcctctgtgcacatgtgtttaatgtgtctatgcatgaaaagccttggggataaagggagaagtagatattttcagaatgtttgattatgattgtttgtatcagaatctgtttagacaagaaaatcagaactgaaagtagacatatgttaaaacattttcagcccatatccttctgctttcatgttgaaaattgagggccataaaataataaacatgtattagatttattgagttcctttaagtcggcaagatccccagagtgttgtgcaaaataacagcaacttttgaattacaaaattattacatgttcccatgaagattatttaacccagagatgaataaggagaatgggtaataaagagacctgagagggattttccacacccttctcctcaatccataatttaaatacagtcataaactgtgagtaagcaatataagcatttgtgtgcagcatatatttgagcctgaaaggtagaaggcagtgtttaaaaatatgtttttaataaagcctataatacagaatagacaaacaccaaggtaaagatggattagaagaacaagtattaaatgaatacaccttctagcaaaaatcatttcttgttatgtgcctcaaaaaagaacaatcttctttagatagtattttaagcaactgactagtgtgtatgtctttacacagccatagaagagtttcaatgagtacttctcaccgattcagtgagccaaatcataaagcctcaggctgtcagaaaaaaaaaaaaacaaccaactgtaaattttgacaagaatgtgacaaaaatatataagatagattcactagcatttctagagtgaaaaattactagaattggcccacggcctctattgctgaaaaatttaatgtaattactttttttatgatattgtctagactctccagcattggcagaatttttgttctatgtctatgctggaaataaattaaataaagacctaggttttcttccttctattgtaagaactatgtcctcttcaagatgaatgtgattatggtttagcaaatgaatgtgaaggtaaaggtgtttaggagaaaatacaaaagtaagatcttaacgttgtacttaacagaatgtgtccgttagtaagaatactaaaaagcaggattgtaaggaagaaattctccaatgtaaaacagcttgcatgtcttctgggaatcttgtaaaaatatagaatctgattcagtagatctggagtgggcctaagagtctgcattcctcacaagctcccaggtgatgctgatgccgccagtctgcaggttaacaccttaagtagcaaggttataatgtatggggaagattcgtggatagggtcagtcttttaaaaatctttaaataatttgaatgtaaattatatgaaatttctctgtctcctggtttcataagtgttttcttttttttttctttagacaaaattggaatagcagtttgactatgacattctaattggtgtgtgtttcagctagaggaagattataacaaaagagtatttctccaaaataaagttttcctttattttgcttttgtaagtagctcaacaaaaaagagagtgtggctctgtgtttgattttacttcctttaaattcaaaagcaggcactaaaaatacctttgaaaactatagtaatgaactactgtggtactaggctcaagaaatctggggcgttcctatggacttagtggcaattgaagcagtcagattttcagatttagctgccatcagctgtggattggacagtgacatagtctaggacagatgtcaattttagccttcttctaacataagtctggaatacattttaattcaccagcaggaaggattttgttgcatgtaagttagagtttaaagccaggtttatttttgtttgggaaaaattctgtgcatctcaaaaggcacaatacctgtgtgttaacctgtctttttttttttttcggttggtattacagaattgctgataaagctttacatttacattggccagtagactagaacagattcctcacgtctctgtaagagctttgtgctgctcacttgatccaagttaaaatctctccacatcttaagttgaaaattaacatacgggaatttaatcctgacatagccactgcatcaacttttgtctagtttacgctttgccagaatgtcttaccattatgtgtctttatcttttggaaggctaggtatattgaaaatcttttaaaaataattttaagaaaagaatgtaaacaatagaaatttattcactttcttatgggacacatttcctgccaaatgctccccacaaagtaaacaccttagggtcttttttatttggaaaatgtaaggagatacgtaagtgtggatatagattcttctaaaatgtcctaaaagaaataaaattgcaagttttcctttgtctttcatcagagctttctttgtcatgtctaaagccccgcggcagggattagggagatgcaaaaccttactgtaaacagggaagggttgaaagaaaaggttcattaaaaaagaaaaaaaaaaaaactatcatttgaatgtaatatgtgaaaaatgtttcttccaggttgagtgaaaaatatactaaaaaagtgtaatcctagcttaagagattttgttttaaaatcctaattctgctaacaaggcaaaaggaacttaagatacggatgtatataaagcctcccggttcacccatcagtctttgaaactgccacacctaaactatctgttttagtgccattctcctatatttactccagtcatttttatatttcagttttgctcttaattttttttcccaacagtattcaagaagaaggataccaaaaaaagcattcccataagtattgtaaaaagtctctctcatgggtttgtttttagaaaaatgttaagccatgtttttggttcagtggaagaaggagcctgtgatagttttaacacgtgtacccaattagttgttctggacttcagcaaatgttctgcttggagcagctgttaacagattcttgctctattgttaatcaaaaagccaataataaaaaggcaaattaaaaggcaatttaatattatacttgtaattattcactttgtttctcatataagtgcaatctcatttcaatgcaatgctttcaaagaaaacatatataaggtagaggaaaatatcaatataaaattaaaattttaaaaaatggtactatatacacctttataaaatatgactagggaactccaaaaaaatgttcaaggactaagttccaaatacatacgtatgcacacacaccaacatgcacacatgcacacacacataaatgaatgcatatattctcaggcaaaaagtagaccttaggcccagaaacaagatatttgcaaagtattgatcagaatactatttatagtttatttttagggataaacacattaatgtaacttcatcttcaaaactttttaaaaataattacttttcaaaataggcaatgtgctatgcaatggagacgcatctatctacaacaggaaatgaaagtacaaacatccattcccacagtcttagattgttgtttaaatatagatatatatttcattaaagtataaaaattaagtcattgacctttactgatttgataatagtacttagtctctatttattaaatattgtcatctttctggaatttactataatacataccggttaagttattaaaatttaatcttttcacatattattaaacaaaacctctcacttattctgtccttactgtggcaacaactgatgccacaaaagttatatttccactaaagcattttaagggaattttgagtaagttacttactgatcatttgatgagatctgttgactaaatgtggctttaattgctgatacttgaacttagagtgcgatactaacaggatttattattcactaagcacttacaatatgccagacaatgttttaagcactttagttatctcgtctgtttttttgtttattttttgagaccgactcctactctgtcactgaggctggagtgcagtggcacgatgtcagctgactgcaacctctgcctccgggttcaagcgattctcctgcctcagcctcccaagtagctgggattagaggtgtgccaccaaacctagctaattttttgtatttttagtggagaccgggtttcgccatgttggccaggctggtctcgaactcctgaccttaagatccgcctgcctcagcctcccaaagtgctgggattataggcatgagccactgcccactgcgcccagccttatttcacctcatttaatccttacaattactttaaaaagtaggtagaataataaactccattttacatatgatgaaactaaggcacaaagaacaatgatcacacagctagtcagtggtagaactctgtaatctgtgggttccacatctgccagaggatgtatgtaagtgatgtgcaaacactactccattttatataagggacttaaatatcaacactatggattttgttgtgtgtctgtgtgcaggggaatgtttctggaaccaatccttggaggaacaactgtaccttatacactacattgaaggctcacaataaaagtctttcaaccaggagaacatagagtaagatacaaaactgtgggatatagactatgactcttttgattagtatggaagaaaacatcctagtattttgttattggaagaaaacatcctagtactttgttattaaggattagcgagattgaatcattgatgtacttacagcaaatctaaagtaaaccatacaaaatagaactttcctcaagatgactagaggtcaataaagctatgggttatttacagtgtaatatgaaacagcatacaaccgcaagggagaaggacatactaaataaacaaaacctgcaaaggcaattttcttcagagaatctcctcatgtacaaaaatatatttcaagagaaagtagtatagttactgcgttttcataaaaagtctgtttggtgataacatatgctgaatacaactaaaggcagttcttcaagtctaggcagacaagctgcagtacagcagatacacttgctgtttaaatatcccttcaaaaaaaaaattccatttgtttaccaaaatctattcacacttgttgaaaagcatctttcttcacttatctgaatgtgacaatgaatcaaaagtaccttctcttctgttaccagaggtgataagggagaaactgagatcctcaccagaggctgaaagatgtcttttcagtgctcttgaaagcaaaggctaatttttccaaacaaaaatttctccctaaggagctgtattaatgaggtccaaagtaatgcttaacccttgactactctaattaactcaagctgactggccagaagccctctttcctgtggcctatatgggagagatcacaaaagtgcatggtaaccctatccccacttgctgttttcacaaaacatggggctttgttctttgtttggcggttgtgaagacatttcagtctcatctgacatcacctcctcacatggaagaagtgtgcatagaaacacctagcagcaggctgcttgtctcagtgtgttccataacccttgctagcacaaagactcatttccagctcccagaggtagcatccattaacacatgttccttgagaaatctgacttttcttttcaaaaatgggaacgagtgtattcttgctatacttttttccaaatgctccaaatacacaataaattatcaagtaatcaggcctagttatgcgattcccagctttcaatacaggtatattagaggaattcatttattcactcatttgtctagcacatctattgaaaaccttctacatggtagatacaaggctaatttggtttcattgaatctttcctaagcaattaagcccagaaaaatttgtcttctctctgtttgctagagcgatagatactaaagtatctataatactcaatttattagtagtaaatttaaaatgtaattacatttatttcaacttacatttaccaatgagtacctttgatatgccaggcacttttctaaatgccagggatacagtagtgaaacaaacagacaaaaacctctgccctcctgtagctttaattctacaatggaggaacagaaaataacttcaataagtgaatgaaatatataatgtgagagagaggtaaaagaagtgagcaggtggcactgaaagagtggacagagaaagcctcactagaaaggtgaacttgtaaagatgaaaggaggtaacgaaccatgttaatgtctgggaaaaaagcattcagggcaaggaaagactacatagaaaggcttggaggtgaaagcaaacatggtatttggttggagcaaatgggtcatgtggttggaggaaagtaaataagggttaaagtgtgtgaggggtgcagtcaatggtaaacttttggattttactctggggaagataggtactcattagaaggttttgaacagataattgacacagtctgatttagggttttaaaaagctcattctcagagtctttgggaataggttgaaaagcatctaaaacacaagttcagagaacaattagcagactattgaaatactatgaagtgattaaactttattgaattttaattataatcaagcacattatggtagaggcaatgagatttactgatagattggatgtgagatgcaggatgaaggaactgcaccttgaactcaagatgatttcaaggtttttggaaaaggcaacaggcagtatgaattgctatcccttcagatggatattgtggaaggagtaaattttgaaaggaatatcagattaattgttgacaaccaaaatttgtataaaatcaggtaataaaaaggggatgtgagtttagaatataaaagtaaaatgtggacgtatcacatacagatggtattaaaagccgtgagagagaatgggatatccaggggagtggctataaatagaaaaaggaagaggcccagacctgagctctcagggtattgaggaagaaccagagaaggagaccaaggagaaagaacaggaaaaacagaagaaaacccaggaaagtgtatagctctagaagtcaagtgaacaagtgttttgctgaggagggaatgatcaacgatataaaatgctgcttgtagtccatgaatatgaagactgagaattgacattgatggttactgttcaccttaataagaatattgaatacattatttacctaattaaattctagactcctggtagtcaggacttgtcttaagcagggaattgagactgagtcaaatttgaaagttattttatacttaagttgtctagaactctgaacatcatttttcatatcacatacgatatttcattatagattctagtgacttctcaagaaagcctactttttcccattgttaatacgtagaaccagaccaaaataatagaaccataaaatgttaaagtatccagtttggtgattattacaaatgcatacagttgtattcaccatagcagcaacatataaaatatttccatcacccccaaaacttccattgtgccctgctgtgctcagttcccttcctccaccccaacccctgacaatcattcatcagacttacctccctgcaattttgacttttctagaatgccttagaagtaaaatcatttaagaatttaacttttacactattatttaaaaataatttcatcagtaaatatataccaaccataacttaaatgtttaaaatatatcttttcttctcactaccacatctttagtcttaaaatggtcctcagagatcccagttcctcctgctgtgaccttagcttctagaagttctttagcccctttgagtttataaatacattgatttataattcatcatacatttattaataattatttcaaggaatagtcagaactcatttgcatatatatacaaacatagatatgtatgtaagtaatatgtatacaaacatatacatgtacgtacatgagtaacaacagaaaatgagttctgactactccttgaaatagtaaattattaatttattgttttggaactgtctctaatcctttatattctgaacactgagcacaataacagtaactgtaatggtcctataatcaattattgatatgtagaaaatgttgcagctacattacctatgaaatcacaatgttacttctcagtagtcctaaatttcagaagtagcatttgaatgtaaaaattggcacatttgaatacaatctatataatctttgtcgttgttgctgttgttgttgttttaattcagtctcttagtaacacagaaatgtatttccagagttttccctcttatgtgcctttaagcatataagattacacatctggctttgtaccaaaaacagggcccaacaggatatgaaatcctggggataacagcaacctagctatttctttttcaagaatttttttcaaactgagccagaaactgaaaagacagatgaaaatggcacaacccggtgacaagagagcaaagataaatcacgtttccttccataaaaacattaagatcttggctttaatattaatatttttggttacagttaagctttaaagttaatgaaattctcatttgtatgctgatcttgggacatgaataccaagttgtagatgggatagagattagcaataaagaaaattaaggaaaagaaaatgaaaaattcccatagagtttaacatgcatacacatatgcccacactcatatgtgggtaatatgagagaacctgcatattttttggaggttgcctttttgcaggagttgaaactattcatcattttgctgcactttcctgtggtataacctaactaagatttttgagcaaaagatagtttttgtttttggaaaattatgagtaacttatacgtgacctgtttactccattaggaaatatgctgttttattcaatggatcataggaacagaacgaagcagaacaatagcaggaaagaaaaaattacagtcttagaaataaaaacgtatttcatccattttggcaccaggactgaattaaaatgctgccactaggcaggattttaaacatacacccttttcggcatacaattttaatacagaaattgagatattaggcatgcagcgcatattagaacattgctctttctgctgcaggtgtgtttgactgaccctgaataaatgtcaagaaaaacacctttcctatcttttttttctggctataattcaccttctcttaatatttaactattgctccatcattataacaggcactctgtttaagtcgtgggtacaggtaaaattcagcagataaaaaataatcatattggaacatactaaatgtaatggagatttttggttgagaaaaataattggtactgctaatataactgatatagtcatcatatttcctatggatttacaaaaaaaaatttaaaaaagcaagtaagatataatagaagcaaaaataggaggtgaataattttctgtctttggaatcagtgtactttattattacacattcattctaagcctacgtcagaaaatacttgaagcaaataaatagagaacagttttcttttcttttttcgtcccttttcttcaagagaacatctcattaacattaacagaaactgtgcccagaaaaagccattaacattaatggaaactatgcatagaaaaacccctagattagtttttggtcttttaaggagcttatgcattgctgcctgtcccaaaaagacaggatgggaagatagtaatcacatttttgccccatctttttaaattatatatttcattaaattatatttaataaatcctgagttggaaacagcacaaggaaactcaagctgcaataatatttactctcccaataaacctggagctttcacaaaccatgtgtcttactgagagtcactgaacaagttatacgaccatgattctcatgaacatcctctttgtgcttgcaattaggctgcctgccaggagttgaaatgattagcagtaaatataaatttaatagctttgctttgcagttccccagtcactcttggtgcctccattcactagggagataatgtgaatcagaccctatcaactaaacatacgacaatagttgaatctgaattaaatatgagggaatcttaaaagggcaaggtaaaataaaaagaaaaattaaaatatgttctctatttaatagccactttacatttacaccaaaacactgcgctattttttataaatatcagccaaactcaaagtattagtacataaatcatatataatctaaaatttttaaaaacctgataaaaagaatgcttgaaaaagtataggttttcttttttttgtcacttgaaatagaattgtgaaaaatatttacatttcaaatatcattttgcttagctgttagagttccttagagttcggttttctgaaatttaccaatactttctcatcctctttcacatcatcatcagggctccacaggaaactgtcaataggtatcaatttaatgtgccttctttactaggtgccttactatatgtcttatcacttatctctcaatttaggagacacaaaactagaagacagcaatgaccaggaagtcttgtggctatgctgtagaatgatgatgacgtatataaaatatggaaagtctttatgctttgcttttgttctcatcagaaatagtccctaagtcttaaattgtgataaaatactccttcacattttctttcaggtacaataaaggtcagataaataagaagcaaaagaaaaagagtcagggaagagaagaacagttttcggcttagcctgatggcaaagggcttttaaacactcctcaaggaacattaagcaaaaatgagcctactgaaaacaactttccttgattttactccccagttactttcgttcttctctataacttcccttatcctttcatcatagatgtcttccttcatcactattcaatatttaaaacagctgaaagattggttactgggtaagaaaaaaagatacgatagctaccaggttgagcagagatatctttgagctctaccatgatagctgagatgtttgtcctgctcagcactgcctggcacatggtaggagctataggtgaaaagatatctctgagaagatatgagtttgttggtactagggcaaagcatggaggaaaaaagaaaaaagagatagagaaagaccatgagtcataatgacatctttcgtcccttcgaaccaacttttcttgagtccatagtattatatgctccgatgctttagccaattaagttaaatccatccttatgcattttaaagtattcgaactaaaataatatcatcaggaaacatgtgagtaaaagaagggccacctcattaccttttggcaataaaaggcagagtttaaattataaatatttacagaaatatatacaccaatggatttccaagaaaatgtgaatgatatgccacttaggaaaataaaacgatctcccagtataaaattaatctcactggaattgctgaatacacatctgatgctcaaaaagaatactccaagaaaatataaattgtttaaatataagtcttaataagcaggatgttaaaaactaaataaagtgacaggggatgcggtggctcaagcctgcaattccagctctttgggggagctgaggggggtggatcgcctgagatcaggagtttgagaccagcctggccaacatggcgaaaccacatctctattaaaactacaaaaattaaccgggcatggtggcgggcgcctgtaatcccagctactcagagggccaaggcaggagaatcacttgaacctgggaggtgcaggttgcagtgagccgagatcacaccactgcactccatcatgagcgacaagagtgagactccatctcaataaataaataaataaataaataaataaataaataaagttatgatgaataacaaatcaaacggaagcaaactgatcctcaaggtggtaaaactcaagaaaaaccctatgattttgctgatctcttagctgatgccacagaaagccaaacacaaacaaacaagagaaattatcctatctgaatacatcagttttatgatatttatgtaactactaaagcatttttttttaagtataactgatgcaaaactggaggaacgcaaagtcagctttctttgatcaaagctcctataacttctgattaaaataataattggatatagttcggactactccacatacattctttcactgaaattggacataatttagtgaagcaagatgctgagaagtctactgccttggcagatttccactgaaatatgtttaaaagcatagtttttctccacatggaaaataaattgtagaaaattaaatgtgagtttatataggattactttttttaataaaataattatcagatatccaaaaagggaagagaattagcaagttaaagaaattttattttgcttgaacaacaactaagtttcataaaccatgctccatgtgtcctaatataaaaacaaaactattaattttaatgtacagggctatgaaatggaatttggaaattatgttgctagaccaatttggttcctttaaaaaaggcaatctttatagatgcccagcaaaaagaaaggagggcctatttagagccatgttagaatcatgtactgtccaggtattaagaaagccactttggccactccaaaaaacaacaataaaattatttactttaaggcaaggcagaaagtctccacattaaatttttgaatttttacttgaattgactccaaaacaaatcaaactgaattacagttgaaagttaagtgaagctaaatataatttatattttctatatcctattccaaaacaaatattttctatgtaatactccaaactataaacgccagacactatgatcagcacatgttatctcattttttcttccataactaatatataagcaggttattattcccgttttacagataagaaaacctagagactgtaattaagttttcaaaggcctctcacagttttgtcgcttctttccactgatgtcctccctagtcttgttctgatgtgtgcaggagtaaagatttctatttttccatctggaggaatttcttagtggcacactccctttaatctgtgtagagagctcaaaatttccctcaattctcttgatccactccaaaataaggatgttctgaagatggtcacagacaaacaagcagggggcagcttttggtagaaggagcaataatgtccttcttaggcatcctcttctcagaaggaatcaacatgtagcccataaaaaacagaacccccatctccatggctgcttcccagagctcagagaaccaatccacctcctcaagtacaagagcagcaaaagaattggggttaaaatcttaactagaaattaaggaggtatcttctacttaagcagatttcaaaccgtgctccaaggaatgctgttacataatatattctatattctgcctctattggaaagaaaaacatgcaaacaaacaaacaacatcccaagtatccaaaaccaaaacaaagtactctgcatgtgagcaagtttggaaactctagattaaataaagttcagcttttatactgttttcattattaaccatttatatgttaatcagcattatgacctccgaaaaggctttaagttcatttatcatctgctgaagtagttcggaaatcctgcttcatatatcctccaggtgaagacttgaaaagagcagctgcagcccaaggcatttggttgaggattcagggacttggaaggccaattcttttccggatgtaacgactaataatatttaatatacaattttgaccaaaaatatttttgcatgaacatggcctaatgtattttacttaagtatatctttattggtaccatattaagaaaagcttattccttcttgaaaccatgtttaggcatcagttgagcacctctgaaactcattttaattttgcaggactctcagattattaggaagcaaatattcaatggggtcaacttagacaagatttccaaaaatgtgttcctcagcttgggttgaaagctgtaaacatgttcattattaatcttcaagagaataatatttatgcggcccttttccacttaattaatcattaacacctttgtcccagagcatcttaaaaggctagtgtttcaaggactatccatctgtttgaataccattgataaaaccttactgtttaagtttattcaattatcatgaataatgaattagagttttctttggtcagtttatctcttcaagatatcactaagctcagtcttgtaaaccctaacaaggtccagttttgaactagttacaatttaggaggtttaactgtcattaagatgcgaatgactcttccagaggacatggaccttgtcttgtacatctctgtgatctccaaagagctgtgcacagaattgacactaagttcaataaatgtttcttcaatatacgaagaaatgctctgttgccacttaaagtgcagagcagttttcatcttcaaagcactttattcacattaattcagctatttacattttgctgatgggtaaacggctggagaggctaaatgggctgttttaaaggctagagagagaaaatcctgcctgtcaggaataaaaatttgcaattactgattaccagtcatatgtccctggacttttgtaggaaaaaaacagagggacaaacaaaggccacctaggtagtggttatcctactgtcaggacaagtcaatagcaggtaaagaaacaagtacactagacggtccaacagctctattgaacaagtatgggggaaaaaaagttatttttgttgtggttttcagtgagtgtgtgcgtgtgtatgtgtgtgtgagcagtgttgatacacactgtgatgcagaattacctttttccatttgcaattctaaaacaacttccaggtgccatgtgctgtttacaaaggaattgaaatacatttgacctcaagcgtattttgctctggcaaagtgtgctaattgtatagatctaaaggcagcagcaacatcatcatttcaaaatagacattaagacaattaaaaaccccatgtaactctactgcaaagtaaagttctcatggagactgtgaggtgtgtacagatatgctgtgtcatacgtttctttatgcgatagtttatgtcccaaaactctttttttttttttttttaagatggagtcttgctctgtcgcccaggctggagtgcagtggcacaatcttggctcactgcaacctccgcctcctgtgttcacgccattctcctgcctcagccttccgagtatctgggactacaagggcccgccaccacacctggctaattttttatatttttagtagagacagggtttcatcgtgttagccaggatggtcttgatctcttgactttgtgatcttcccgcctcggcctcccaaagcgctgagattacaggcatgagccaccgcgaccggcccagctcttatctttttaaaatgacttttttgatgtgaattgggggaggacagagacaagacttcttggccatgtattgcttcagttctcagttgtgtttctctctattccttggaaaccttgactttcttccagtagcttcctggaaggaaaatttgaggaaacgtctaatgtacatagatactgtgtgtatagagaatagtccagttaggaaagtactctatgtaagttctgaaagtctggatttagggtcttttttttttttttttaccttgccatctacttctttccaccctgctaaaatcttagtaattaagtcataagagacatcttccttttatacccaaaaaaacacttgatgagatagaaaggagctgcgtaacattatacttcgtttgggtgtatcttaggaagagatcctgttcccttaggaagtgcaagggaggtggtgaggacataggcaatcaggaccaaaagtgtaggtgctattctaaaagcagtaatttagtagtcaggtgtcagatgaagacagcaaaaaatgcagttttgagtaactggagatggcaaatccccatgtagctggcttaggcttgaactggcaggtacctgacattcaatgcttgaagatgtagggaaagtggctgaggcagagtgctgggtaagggcaggactgagttggttggaaatgggcgtaagtacagcctccagtgtggaggttgctgacaactcagcaatctggtttcagaggaggtctgaagaaaacttaatgcaagatagtttgttagatcagaacaaccactgaaaattctccagaggaaataattgtgcttataacataggtggagtagatatgccacacccatttgacacccaaatcttcatcagcttggatagtaccagacagactcttctttaggtccacagggatttttttaatttctgacaatttctagattctaatccaaggtgacaactcaagaaaaaaattagtaaactagttgtgttctggaaaagaaaaataaattaaagccacagacaagggagaagaaaaacttctatgcttggccaggtaaaggcaagctttctctaggaagtacttatagtcacataaatactcaagaaatcatagacttctggagcaagaagggtcttggttatcatctggactaacagttgctattaacagattaaaaaactaaagccatgaggaattattttatgaaatcatacatctaactgacaaaatgaagactaggatacatttatttgcttgtgtctaatactcctcttcaatttggaaacctccagtgaagcagaacacctaataaaagttaattaggaacaggtactgctgagaccttctctaaaccccaggagcagatgcatctctttcactcgcctggttacctgaatgtaactaaacatgccatctgattgaacaaacaaacctattcttgtatttcctgggaagatgagcccctggatatgaaaatctcacacttttaaggcaaaggacttcaaagtagtccaagggtaagtcaatcagtaaaggaatataactatagacatgcactgtgtgatctggtgttaatctagaactatgacattttttgaaaagcaacaaaaagggtgttgaggtatagctgccaaaaccaattaaaagtaaccagaaaaaaaaaaaaaaaaaaagagaacactaagcaaacaggttttccctcaccatatttctaacagaaatgcatggccatcattaaggatattctgcagaacctattcaagaaagactgcacgtggtggataaccaaataaaatttccttgtacagtcaatgtcttggcatgcaatgggtcccgaggcataaatgcaaaccattaacaaagctttattaagaaagccttcaccatgctttgggaagatgtttgatacaattcaggttaagtgctgatcaataacctggaaatcaaaagaaccgatcacagaagcaaaaaaagcagatttaggcagattcccagccccatcccaaatgtgagatactgacaccaagcataagaaatcatcgctttttctctcccctccttcccccatcacacataccaatgccttttcctcttaagtcccctagctgcaaatatttcttagtgaagtctattttaccccttttacactcacaaactgagtcgcaggttgtacattttgtgataccatcattgatgaaattgatgaaagcctctaatggcattagaaaatcctgaaatagcacggctgatatatacctggcaggtaattgcttaaaactccagcagagatggatgtctaatctattcttaaaaatatgagcagacagatagcagttcacccctccactgcctctttcttgttctcccccaacaattctgctagttcatttgagtgtttcagacaagaaagcaagaatattatgcaccagaatataatgtggcctttcttgcacagcttctctttgcaatcccaaagctgccatttgcagcttcaagcaacagaaaagcatgcttactgttacttaagattaaattcttgataataagcagatttattgactcatgttttgaatacatatttattgaggcactctactagatgctgggcaaagtgataaccagaaatagccagccagaaacactttccacaagtcattaccagagatttaagccacagtaaaaaggtggaggagaatagacgaaaggttttagggggaaccccatactcaaactctccctcagaaaaacaattattaagtcttttcttacaaactgtagagtaaaagaagctgcccaatcgcggtggctcacgcctgtaatcccagcactttgggaggctgaggtaggtggatcacgaggtcaggagatccagaccatcctggctaacacagtgaaacccatctctactaaaaatacaaaaaattagccaggcatggtggcgggcgcctgtagacccagctactcaggaggctgaggcgggagactggcgtgaacctgggagtcagagcttgcagtgagctgagattgcaccattgcactccagcctgggcgacagagcaagactccatctcaaaaaacaaaaaacgaaaaacaaaacaaaacaaaacaaaaaaagaagctgcccaataatgtctgagcaaaatggaggccatgattattttggctgtagtgttttagactttcatgtaggagagaaggattcgctaattggttttcagtcaaataattctactgaggaaaaagaagtattcctgaaagaaaattgagacataacatggataatgtaaagcctatatttaatcttggtcaattccattgtctcattttcatgtagatgtcaaacataccagcaaggagaaaatggttcaaaaatgcaacccagggaattgccctacttttcctacttgcccagtcttcaatacaatagatctttattctgttctcattttctctaacaaaatctccttgttcggaagagtcaaaggaataaatggttggaaggttaatctcctaattactttctcccttcataaaataatttatttaattgtggaaattattatgcagctgtagagggagagcatattcattttttttcaggaagtagttgagcaagcctgacttacgccaagagaaaaaataaaaattcctgagaaaaataacaaattgttcaaaatgagctgggttaagtatccaaaccaaggaacaagttcatttaaatggttactcaggaaatcttgacggtgatctaaattcaaagttgcttttgtttttctaggaggcctggcttacagaaagaacatgataggttcctaggatatatcttaattttgtacttcatttaatattgttaaaataattttgtctctaatatcacagcttgtaatatctcaaacaacactgattactgattggtaatgcaccatactctaacagatatttaatctctatcctctccttccctagaaaaggtgtcatggaccccgggatgtattatacattgcttatagcattttgctgcaactttaaggcaaaaagaaaaaaaggtctctgtcctaatcaggcataacagccatgaaatcctatgtgcaaattgaatatcaaactaatactgtttttactaaccaaaatccattatctaaaagtttgaacaagtgaaaaataatttatttatttgttatggtcccaattaataagatgagaaacttaacagaataaacatatgactatccatttgtacacatctaggaatggaaaaatgacccactttaagtacaaaaaaatgagaataatctataaaaactaatgaatcagtccctttaactttgtttattggaattacaatatcaaagcatttctaatttgggttaagtaaaacatacaccaaagaatctatagacagtacttacaacactgtcagttgagtatttggctttgatatagctttgaaaggtaaaagacaaaccaagtagatttttttttacttggggaagaatgtgagaatgtgttaagtagctcagagtaatcattccataatgtgaacagataccaaaacatcacaatctaccccataaacatataatatataaaaatattatttgtcaattataaaaagcctatgttaattaaactcagctgaaccctgatatatacaaaccagtgatgcaaatggtgttcaccaagcgcatactcttagttggtgagcatctgtaaacatgctcgttctcagcctacagctactaccgtttggagatcacggtcagtaatgatgaccagtctagggaaagttcatggatagattaagtcactgggctagtatggatttgcactgaaattccaagcaaagcctctttcatttagtccaaatcttgttctacttgactgcaactagatttcccaatagggtctgtcaatcaaaattaaaaagaagaaatgtaataactttaatttctttctaaatctagagtcaggacaaaacttctaagtcattattaactggtactctaccaagaatatagctctcaattattcatttcagttcttaattattccctgtttcaaaaaatagcctgcctgccgctcataaaatcattagctggagagaaaagtgggttcaattttgattggaagtaaaagatatggtaggatgtttgtgaaataatgcttgaaaagtaatgttttaaaaagaaaaaaataaaaactttgttttgttgtacttcttgtttatagctttcatgtaaaacaaactatggttgtttcaagatggagcctcacgttcttagatttggtatgtacaaacaatttctcctttgacggaaaatgagacattttactttgccagttactttggtttacttgactggacttgtataattttaatgcaagctaagccaattgttttctaacaaaagctgtcataaaaaaatttatgcagccttggaaatgtaaacgtaaaaaagaaatgtaaaaaagtaaaacgtattcatcattttcctgcaaattgaagctaattacacttagaattacttgcccttccacatatttcatttacaacccatatgatcttctcagagtctcatacttaagttaataaattcagttggaatttttaaacacatttataagtatgtatatattggaaatagcaccacatgtaaggcatctctgaattttgatgagttgggggttaggtggggacattacacaattattctggtttctaagattaaaaaaacaatcttcctacaagaaaataatgcaaactgaagagagagagattctctaccactcttgaagaaaactttgggccttggggctgagaaggaaaagtaactcaatgagccatttgtaacacattaacactaattcttaaatgctatttgtggttaaaaagagatgaaatagacaaataacctggaaaaatctgtgacaatagaattcaaatgtaaattatcatgtctcactgccccgttagctatccaaaggcaaaactccattatttcattccccttctcacatctattacttattttcctttctcaattagttttaattaattgtttcttaaagtgtacttacacatttaacagtggttactgtgggctgtgccgccctctgattattagtcttgaagccatcttatgttattgttccattcctcacactcaaaaggtccccaaagaacaacctcctgaagttaggaccaatggtccctttagtttgtcataaaaccaaagtgatacatgtgtttaataacacagaatgtgtgccataaaaccctgatttgaatagttcttggaaatgtaggccaaagacgtcagatgaaacgtgccaagttgagaggtgcagataaaaggtaaaggtttattttgtaaatgtgtaatattttgatagtcaccagggaagaaataatgttactgcatgtggacgggcaaggtggctcatacctgtaatcccagcactttgggaggccaaggtgggcagatcacctgaggtcaggcatttgagactagcctaaccaacatggtgaaacgccatctctactaaaaatacaaaaattagccgggcgtggtggcgtgtgccagtaatcccagctacttgggaggccgagacaggagagttgcttgatcctgggaggcagaggttgcagtgatctgagattgtgccactgcactccagccaggcaacagagcgagacttggtatcaaaaaaaaaaaaaaaaaaaaaaggtactgcatgggccatcatgtgaacctgaactaatgttattccatcacgtaggatgatggcagtcacatcattaatctaaaatattcactagtttcttgcaaggacattaagtagacagattcaacaattacttttgctagataaagttagggcaaaagtatgacggacagctgaaaagttccattcttttcaatgtcccagcagataaattagtagcttaccagtaacatcaagcattttaaaaagagaggaaaaaacaaaacaaaacaaaacaaaacaccaccagtaatgatccagtttaataacctcatatatttggcttggggtaaatatcaagtggtgctgatcagtggaattacagatgtaattggaaatgttaaattttcttcttactcgactagtcacatagactattctatctatactaaggaaacatttataagattttttgcaaatcgacagaaaagagtcatcaaggaaaaaatatgataatttataattctgtttgttttaatgaggaataatatatgtgggagctgaaaatgttaaaatatatcaaatatttcaaatataacaaaatatttaatcaaagcaaaaattagttttttttaaagactgatacattctttcacctccatttcaatatatattaactctcctaaagcaaattagttaatacacagagcatttttaaatgaattataaggatagccattcaagaattgtttatcctggaaaaatatcagtcacaaattaaatgtaaaatagtgagcaaatggattaaaatatatacagcatgaaagattgctttgtctcttaggacttcacactttaaaatgattattattaacattgaaatgatttatatcagtgaaggcagacatacacctgacttcagggaccaatacaatagagagtatttttgaaaaatgtatattctctagacttgctgatttaaacctcagcttgtgaccaagaattttcatttttcagaacctgaccatgttactcttcttatcaccgaaatctgataaccactgcagtaccaacttcaggatgttcctagatacctttggatatgttaaaggaatcctaagatggttgagggcactccacatttatctaagcctttagaacaacaatcacaaagtccagtgactacagaggccagactttaaaaaggaatagggagaaataaagtattgccgacaggagagagccttccctgtttcaaggcagtagcaactattcacttccattcgatactctcctacagaaatgtagaccactttgttcgatattctgagcttttttctctctcttttttttttttaatagtagagatgttgatgtttatgtgaaacattctgattttcaaatgttggcaaccagtttcgaatattttcagtgtgcaaccaagcactatgcttgcaaataaaacacaggtatgggaaggctctgactgaaggacaattaatttacaatatctgattgtggtaaactatctgaaagatatagaatattatgttctgcatatatatgtgttcgtgtgtgtgtgtatatatatatataaaacaactacaaaaaattatattcatatgtatatacgtataattttcttctttctgtgtttacatatataaagcacagattgacaagctggcttattaatactaggtgtagatattttgaaagagataaacaaatagtattgaacgtatctaaacagacagccaaatcaacaagttgaatggcaacaagtaagacgtacactctatgacagtgactaaattaaccaagagttacagataagagagtgattagcatgcgataagaacattatagaggactacctagagaaggcaaggtttaaattgggccatgtgctgggaaacctggatatctatatgcagaagaattacattagatccctatctctcatcatatacaaaattcaactctaaaaacaataaagatttaaaggcaagacctgaaaatatgaaactactagaaaaaaacatagggaaaacactctaagacattggtctaggcaaagattttacggctaagtcctcagaaacacagggaacaaaaacaaaaagagataactgggactgtattaaactaaaagcttctgtataccaaaggaaaaaatcaatagaatgaagagacaacctgctgaatggaagaaaatatttgcaaactattcatccaagggactaatatccagaataaacaaggagctgaaacaattcaatagcaaaaagccaaataaacacgttaaagagtggacaaagaatctgaaaagacatttacttaaagaagacatacaaacagccaacaggtatatgaaaaagtgttcaatataactaatcatcagggaaatatgaaaatccaaacctccatcagatatccttacccccgttagaatgtctaccatctaaaagacaaaacagatgctggtgaggatgtggagaaaaggcaattcttacacattgttggtggggatgtaaattagtacagccattatggaaaacaatacgtagatttctcaaacactaaaaagagagctattacatgattcagcaatcccactactgggtatttatccaaaggaaaggaaatcagttcaaaggaatacctgtccccctatcaccatgtttgttgcagtaatattcacaatagcaaagacatggaatcaatcaaagtatccgtcaacaggtaaatggataaagaagtggtggtatatgtacacagtggaatactcttgggtcataaaaaagaatcaaaacctgtcttttgcagcaacatgaatgaaactgaagggcattatgttaggtgaaataagctaggcacagatagacaaatatcacatgttctcacacatatgtgggagctaaaaaagttgatcttatggaggtggagagtataatgatagataccagaggctgagaagggtgttcatgtgtagaaagggggtgaagagaggtaggacagggggtataaacatacagttagatggaagaaatatgttctaatgtttgatagcacagtagggtgactatagttaataaaattgcattttatatttcaaaatagctagaagagaggatttgaaacattcccaacacataaaaatgataaaagctcaaggtgatgaatatcataaatccccctgacttgatcgttacacattctatacatataacaaaatatcacatgtacccagtaaatatgtataaaaatgtatatcaattaaaaaaatcaaaccatgaaagctaattaagtttaaaaaatgatttcatataactttagtaagaaatactttaaaattccttaatgctaaaaaatttatcagaccagttaatatataaattttagttatataagcatttaaaaatttagaaatattaaaaactggaaataattaaaaatcaagataggttggacttaagaggtgtggcattaagggagatcagatacaacagactgagcaaaagcaagaaggtgagaataaagcgaaacccaggcatagaacctacaaagaatacagtaagaagtcaccagaaatgtcaagcagactgtttgccagtctgaactatcaccctatccccgtaacagaattccatgaaaaactaagaaaaaataatatgacaaaatatatgttttatttccttctttatgagcctgtttggttaacattttataccatgcaatgttaggttgagaactaaaccaagaaatatgaacacaggaatggaaaatagaaagaaggaaagaaggaaaggagaggaagagaaaggtagtaaggagggaaggaaggaatgaagaaagaaaaataaaagagaatgaggaaataaagaagaaaaatgtaatgcaccatgaaaaggagatacatatacaaatatgcaaagggacatgcagaaaagaaacattgaccaattaatctcattaatgggtacagctcgaaaactaatgtgcttaagtacagagggaacaatttaggataaataatatgaaagaactttatagttatgtaagaacactcaggcaatggatcatgctatcgagggaatttagagacactcttggctggaagacactaatttattatgcgctgatttaagtataattaaaatcaacctagatattaaacaagggaaacgatatgtaacttttagatatccatttattacctaaggacagagagagcagcaaatgtgcaaatgttctacagccagattaatcttcctttaaaaagctcccattcataatatcactcccttttgaaaatactttaattgactctacatgatccatccaaattcataagtggagtattcaatatccatagtctggctttaccctactgtttcaatcatgcctcccacttcttctagatgctggccatctacactcattaggttgatctactccccatactttagggtgcacaatgtttgcccagcgtaattgctcagtgattttttaatggatttactgattaagcttcaaaggcatttccaactccacagaatgtatgctaattctaacgttacccgtatagaatactaaaaaaaaattttaacattctccaaaactatggctatatttttctcctcttccattttcatccttaggatggttttccaaagtaaaacactggcctgtgaaagctactgaaataatcttggtttcttcagtaagaaataaattattcactatcatccccactccaatgcaatcatagcagaattatctttcaaattatagccacatggtttctgaagactaatgaagaggctcagcccaggagacagttttgggatccaaaaaatacctttcagtttctgctctttctaattcggacagtagcaatgaggccacactgattcaactggtaagcttccttcatatttttcattgttgttttttcccttagtttcaagccctacctgagccttgcccacgctaccaccactctgtctgaatttttgcacctttatttcatccaggttgatactcacagcccctgagttttcctgactgtctaagacaacagtctaaaagtgaaaccagaaagctaggggggagaaacagtgtcacacaaaaattctggcagatactgccacctacagggattataaggtcatccccaactcaatctcctaaaaaatcactcatttataatagagggggaaactgggcatatttgaactacacggataaagaagaagccaatttcatcaaatgataacctttgatttagtgtatggaataattatatatgtatatatgtatgtatgtatatgcatatgtaaatcaatcattaaacagggccaataaaaacagggctgtaagaaagaaaattaaaggagaaatatcaggttgtgccagtcgataatttctgttactagaaattattaaaaatcatattggacgagttgattacctatttttggttctatatgctcttgaaaagtttatgtaacactgtatacaacatgatagaatatttacctataaccaaggtgtctaggggttgacatttttatcctataatatttgaaacttaaaattatattttagttattcacaaataattcattaaaattcataaactaaatgataaactatatcattcctgaaataactaatataaatgtagctatttaaaatatgagatgctggctatttctgtgatgatttaatgccatgttaacaaatatagagaagaaaatagtataaaagcatatttttagtatttactgtttaaaaaacctttagatctatgatttttaaaaactgcatttgaaaataattacaaacatatagaaaaggtgcaaaaaaagcacaaaacatccctttacccaagttcacctattactaaaatttaacactaggatttttctcaatttatttaatttttttctctctctgtccacacaaatacacacacacacacagaaattgttttttttcctgaaccatttgatggtgaattacatacatcatggcgctttacctcttaaatattgtgtatttcctaataataatatcgtcttacataatcataatgttaccaaccaaataatctaatctaaaaagtagattatttgatctcatctacaatctatttccccatttcctgtcaattgatccagaaatatcttcacgctatctccccctccagaacaagacccagtctaggaaagctataatctttgaatctgcttttttaggggagaagaaggaagagattccttattttttagctgcgtaggctcttagctgtgtcaccattgcaaccaaatggcttgagtgtgacaactcccattcatctttttggtctaccttttcctttaatacatcttggagtcagaagatggataataaattattttggaattatagatgggtaatatttaatgcccaatataagaaggactgaagacttctaaggtttgagggcagatgattttttttgcatgcatttgacagctcaattgatttttacttcttcataagttacctaagtgctatggataggtgatatggtactactttaggtgttgataactgaattatgtcagtagtctagggatgacaaatagccagaaaaaaaaaattcattagtttccccaaattggtaaacagtttttgggaaattggaagaataatatgagtgtcatggagacactatcggctaaattgacaatcagtaagaattaggtaactgaaaacctagctctttaagtgtgtatgagaggagagaaggcgggttaaactggcagttataattaccatgattcattcaaaagtatgaactgcagtagttactatgcatttccaagtagattttcaaaactcctaaattggtgggagtctaaattcgttcaaccattgtggaagagagtgtggtgattcctcaaggatctagaactagaaataccatttgacccagcaatcccattactgggtatatacccaaaggattacaaatcatccttctataaagacacatgcacatggatgtttactgcagcactattcacaatagcaaagacttggaaccaatccaattgcccatcaatgatagactggataaagaaaatatggcacacatttgttagattatatagagtaatgctaaatatttaaatcagcaaatcatctgttccattatagttttttaaatgattattttgccactacccaaggatgctgtgaaaataaatgataagatattctatcaacaaacaatgaggctttcaattaaagctgattataacttacttttaatgtatattgctattatacttaggctaaaaaaccagtttacgttaacatagtttttatgttaggctaaacatcaatatacacaggccaagttttctttgaataatcttcttttgttaatgaatggtccaaatctttaccccacctaaaattcctttctttgtgttttttacccattgaaattctgtatcgtcatacttaggtcagtcttctgggaagtcttttctgaaggtttcaatttattcctcttaagaatttattttgcatttatgcattctaacactcattttcacattaccacttcatgttgtaaaattttcaagtaattttagaccctacataaataattccctaagaataattttgttaattttatcctattttgtttcccctgtaacactcagtacaaatgctctctgattggtgggtcctctataatagttggctatttcagatgaatggtaaaagacccctctcacatctgggatcatcaggaggtcagagtttcagcaagcattgcagttatgcaaatttctatttgttactattacaataattgctagcagctagaagaagctagagtaatgatgtattttttcaaataagtgccttagaagattcctaggaaaagctaattgcaaacacctaggagagaaggcatatgcattatctttatctgtatagccagagtcctactagttacagagtggcaaagaagcagcatccaaataacttgtcttaggtatttgtgaataactaaaaatttagataattgcatttgaaaataccatattttagtgcattctatatgtggggtccacctctgaacacttgcatccctagagttaaagagagctagaaaggacaaatggacaacagacagcgtctctgcagacgaggtgattctttgagatgttattaaaatgagtgctgttcaactacgtgattgactgtaatatgaagtcacgtgtggaaaaaacaaaactacaccctgcattataaacaccattctagtgataagacatcctctaacccacttgtaaaattaagaagataaaaaccacttagttagatttggcttaaccatagttaaaacaagtttctaacatgaagtaaaccttaaccacaggcttcttctttcagaaaagcaaatacaaaacagttatagctagaaatcccatggtgtcttttaaagtactgaaagttttcagactatattgctgaagcctgttgcatgtagcctatgcatgtagctgcttgtctcctgtaggaatcctagcttacaaagtctagatgtgaaataggtcctgggttgagtggggcatctataagttaaaaatattttcaactgtgtagagttctacaggttctccagtcttatgattgggagaatggtgcttgctgactgtcagatgcttctattctcacatccatcttaataatatattcacacaagcatatgctgttaaataaacaaaagcagtactgatgatgatctggtatctgtgagtgtgaaactaatttttttttaagttgtaagtcatttgcaacctagacacttacagagattattggggtaaaattgtggactctagaggcaacagctccaccatttattgattacatgactagcaagttacttaacctctgtttatgtcagtttcctcatttataaatccaaagctaatattagcttctacttcatgaagtctctataaggagtatgctttttactcaagcagagcacttgctacattgctcaaacaatattagcttgtcttaataccattacacaaatacatgaagggcaaaaaaaaacaaagtctaatttctccaataaacaaattgctcatgtcatcaatctaatcaccatttgattgagtttagttgtttttcttttcctgaacacaggtccattgctagacatgcacttgcttatccagagggccaatcagatttctgaaaaagttccaagttttggcatattcctctctttctctttgactgactgacccatgattcagaattgcaatcacaaagtgcccctgatgctactgttcacactgtcagaggatagaaacacacaaagtttaatcagattctcagtagcaatgtgatgtcaatcgggatgattaaataccagccattctaagcctgccttgcaattgttgtctgagaattcacctgagtcctaaggaatgtgataatcctaggtctgcagagtacactgacccagagaaagaccactgacaacatctacatctacctttcttttggtatgggggtgccagagagggttaaatttacagtgtgtataatcatctctgggttgaaagtctatttgccaggttcatattaacaatatgttttctctaagagcatagcataaagtagtgaaaatagaggtctttcagcaatgcatggcttttgcctacagcagcagagagggaaggtggaaagtcattgctatgaaagaggctatttgttgtttataaagcataatttttaaagataaattgctggaaacatcgatgccatgaacataagtagacattgttcactttatggaatccattttatatccatttgcgctgcctgcttatgaaaggaataaagggagaatttcagaaatggctaagcaaaaaagacaaagggtggccattttgttaaagttttaccatccaagaaagtgctggcaaagaagtggagatatatccacaccaaattgtcaccactactgataaataactcagagaactgatctatataggtgacaaatcaaaatggatatttgcatacaaagagaagcaaatgatatggaataccatatcatatcctcatgacctagtgtcaatgtgactatgatggaagccataagtgacaccctcagcaaaataattcgaattcattctagtgctcctgggctcccatagcaccttgtatatacctctttgataaaacttactatgttttactcttcctccttacccagctagcttttacactaaactgtgagctatttgggaatagagattttactttccttatctttatatatacatagatttatctcagtgccaagcacataataaacaccaaaaatgttgaatattgattggattctgtgctttcatctttggtgactagtttaattgaaaaaaaaagcagtagttctgactcaagagaagacttgagcccccagaaataggcttgttttcattattatctgtaagtattccagtatgttaaccatgccatttaactcactgcctgtatgtagccatatgcatatcagctgaactattgatgccaaatgaaagtgggattatataattcaaaccaccccttgggtttaaatttggtccaagacttgcactctttatatttcttattttttttccttctattagtgaatttctccattactcctggggaaatagataattctcctttaagtagattcaattactgtaaagaaatcacacttgatcactttgaggagatctaagctttgctcaaactacaattcaatgagctgacctagagttaatcaccttttactcattcatttatcaaagagacaagcacaacaatggatggattttggcatgcagtcttcatgcatgcaccacattaattaattcctattaaggaggttttaccagcacttgcaatgaacactaacacttataaagacagcacagtccacattcttgctgttctgtctacacttagacatcagaactagcaaaggatgtattgtctatttttttctacataaaataaagcttactactttgtgcaaaccacttacctactgataagtccacactctgctagtttcagtgttctcctaaagaagcaaaagtatattactgctaaatgttcctgtaaggactaatttccagtgaggtgtatctgtcattttgtacatctttacaatttctgaactgcagaaagataacaggttttgtagaataaagaagaatcatttaggaattaggtgttagatacctatctatatttttttgtttctactcagtatcacatttatcttctgcgatttataaaactatacctccttttacaggaacatgatgcttcccatatcacatccaaatggagcccatagggattgctatgttcttacatgaccatacacccctggccagagttggtagattgaggagtaggctcaaactgggccaaacacagtaccttacctccctgaacacatttgattggtccaggagtgggtacctcacttagcccactgcatctagagccaagtgtctattcccatctttatcctgggatatttggattttagatggtatcttcaaaaaactcagatttgtttcccacaggggctaaagatttatgcaataaaacttaagagttctcagaaactaagtttttcacctcaaggaaaagcctagtctgcagtgaaaccaaatgaagctgacaagctgagagaggcaaagaggaaaaccagattgatttctgacagtgcctgaatcccgagggctggacttcaccactcttctttcctcagctttgttatttaaggtttctttccattctgggagccaataaatctccccctttgcttaaatacttcaggctgcctttctgacagttacaaaccaaacaattctaatcatattcattaatagtgcacactaaaacacactgtcaaagacagttacatttcagactcttcaaaaaaaaatcaatgaaagtgacagaagtttaaaataggatatcagtatgcaccagtatagcattcttatttccccatgtttcttctctaatcaccctactagattttcatagagtgtttaatatgagggaaacaggggaggttaggcctcaggcttctagtttctaatgtatttatagggaaagaaacaattgtaaactagtaccaaaagctccaaagctttaaaacaagcaaataaaaaaaaatcaataaataatatgggatagaaacagaaagtagattagtggctgcctgggactgggtgtgggaactgagaatgactaaaaatgggtatgaggtttctttttgcctgatggatacattctaaagttggattgtggcaatggttgcaattacttagtaagtttactaaaaattagataactgtatactttaaaaattagtgagttttatggtatgaaaactatacttcaatgcagctgtaaaataggcaaataaagcaaacaaaaatagaaataaagagtatgagcaattctacagattttaagcagctagagaaaatgattaccaataataatctttaggaattaaaattaacaccaatagaagcagcatgctgtaaatgtaaatatagttcaatatttcatttttaattttttcttattgtggtataatatacataacataaaatatactgtcttaaccattttaagtatacagttcagtggtactaagtgcactcatattgttgtacaacggtcaccaccatgcatctcaataactctttctatctggcaaaactctattcccactaaacaataactacccatttcctctctctccagcctctggcaatcatcattctaccttctgtttctataattttcactactctaggtacattatataagtagaatcatacagtatttgtcttttcatgactagattattttacttatgacaatgttctcaaggttcatccatgaaccctgcatatgtcagaatttctttccttttaaaggctgaataatgttccattgtatgtatacagtagtccctccttaaccacagggaatatgttccaaggcccccagtgcacacctgaaataaggcatagtaacaaaccctacttacactatgtttcccgcagcttttatttatctgggaatatcttaatttctccttcactttcaaagaacagttttgccagatataggattcttggttcacagttttgttttgctttatttttttattttggcactttgaatatatcagcccattgccttctggccttcaaagtttctgaagagaaatcttagctaatcttattaaggatgacatgtatgaatgacttgcttctctctcactacttttaagatcctctctttgtcttttgacggtttgattctaatatgactcagtggtttccctttgaattcatcctactttacatgttttgaatttcttggagttttatatttatgttttcattgaacttgggaaattttcaggtattatttttttcaaataatctctgtccctttctccttctcttctccctctgagacttccaaaatgtgtgtgttcatttgtttgatggtgttctataggttccttaggcactatttacttttctccaatcattttttactttctgttcctcagactcagtaatttcaataggtaaaaatcttgacctatcttcaagctcagtagttcttcctcctgtctgctcagttctgtattttattccctctagtaaatttttcatgttagttattttatttttcagctctagaacttgtttgcaatttttaagattttctacgtctttgttgctatttccattttgttcattcatagtttttttcttaatttcttcctttattcttagagcatttttaagacaattgttttaaagtctttgtctagtaagtttgccatctggtttttctctggcacagtttctatttttttttcctttaaatgagtcatactttttcccaattctttatatgtaattttttttttgttgaaaaatggacatttgaatttaatgatatggcaactctggaaatcagattacctcccttcctaaggattgctgttttttggtttgacttttcatttttgttcttttgggttcttctgattgttgcaggctgtctttgagccagggatcagcctgagctataaatttgaggtcttctcaagtttattctgggctcatgcctttccctgagtatgcacaccgactttctaatttcctctgcatatgcagttgcttttgaatgtctaaatctttattttctggctccaaaaaaagaaagaagaaaagaaaagaagaaaaataaagtgtgtgtgggaaagttaccaggcctttaaatcctcctcttagctggagggaagaagggtttgcaacaatgaggagagggtgaaatgatgagtccccacctctgtatctgcacctacatggtcagagacagtagtcagaaatcaaaacacaggtctctggtatttgacactttgagtcttatttgtccatcatggcttctacaagctgcatgcaagcctaacacagtatggggagtagagaagatagatagttgctgctaaactaaaactgactaaaattaaccataatttatcatccaagtcttcccttagaagttatacacctttaatagactccagagattaaaaatagttacttcagacagattgtatcagtgcaattattgtctatataaaaagacagattcctggtgcttcctttttttagatcttcccagactcctctttgaagattattttttatcctaatctacatatagtttcttcagataaagatctgaataaaaaaaagactacgcattgagtacaatgtatactgctcgggtgatgagtgcaccaaaatctcagaaatcatcactaaatcattattaagaacttattcatgtaaccaaataccacctgctccctaaaaacctattaaaattaaacaaaaaaaacagtgtggaaaaaattaagaagcatgggaattgtaaataatcaaggatgtataatatctatgaattttataagatacaatgagataaatagaaaaccttagacagctttctatccggtaaaaacaaatggaattgaccatctattgttaaaaaaaggacagttctaaagatcagaggtcaactgtgagtgatgtgagaatataattagccacagaatattatagtacttcaataaagaaaggctcctatagttaaaaacatacaagtcagacaaaggaagaacaatacatctatgatccataaagaattaataaagcagaacaaaaaggtattctgcagatataatttgcctggatgttttgcaaaaacttttatgaagaatttttcaaaagaaagtcatggaaaataaagaccaaggaggattttgaatacaaattaaaatttcattgtttgagatcaaagagtatacctctaataagcattaagaaaaaaaagcatttaaatgtaagcattttaatgtattaaaattattaagatcactgttgcccaatagattatattaaacaaccttaacttaaaatgaaaaaattgaataaaagtataaaatcattcaaaattgtatctatagtggaatttcatcaaagctgtaaaataactctaattaccaaaattatatctattttttaaacctgttttcctatttaagttgattactccgtgaggtaatttttactgccccagtaatgcgattcaagttttttacatctttccacagattcttttattatggaaagaagacactaaaatactatccagttgaaaatgtaattcctttcttaatatatcccaggttatttttgttagtaagtgaagtattcagggaaaatatctctagcatccccaagtctatagagtagtgtgggtaatgaccaataaggaactattttggggtacattcatttattattttgcttggggccctcaggcatacatatacacttccctatccctaaaatacaaaatctgctacccaagaacaattaagaaaaaaaaaaagaagaaaggagggacgaattatgataatttaattacaatgctgacaaatgtatacatgaagttcaaaggttattctcatatgctccttctaagagtacaaattgttatataatttggtaagatccttctctagaataaaaaacaatacaagtttaaagctttaagattggatagtatttttgatcctgtttttttccaccctgacatttattttaataaatacatgatgcatatgtagaatattttatctaaaaagatgttagccacctttttccttataacagtgaaaaacggaaacctctgcctataagtaagagatgcataaaataagtatggtgtattcatataaactatatgcaactaataaaaatgatggccaaagttttcacagtagactgagcaaaaaactatgagacagtacacacatttctactgtttaaaaaaaagtagacatttgtaaatttgtacaaaaagtagaatgttcttaaaaaagtagaaatttatttgcatatttaagttgacaaatttgttaacttaaaaatctaagttaattcacatgcaaataaatacatctagaattatatatatatcaatatgtttttagcatttatctctggatggtgagattataaattattttactttgttctttgcttctctttgtattctataaagttcctacaataaatacatattacttttggaataaaaaaggaataaaggttatttctaaagttaaagtaaaaaaattaacagtcatataatgtaaaatgaatgtgaagataccctgaaaatacagagtaaagggatctctctctaggtagtaaaaccaagggctaagtctttttagaggccccattaaataagtaggatagcaagtaatacagtgtatgagaaagggcaaaggtctcagcactagcgtgcctgtgttttaggttaggttttaccatttagtggttaaagactttgggtaatcattgtttgacttttcttactttattttttgtccacctataaaaaattacgtaaatggttccttgccttttatcttacgggttacctcaatgttcaaacatgtgcatgaatgtggacacattttataactataaagcaataatgtaagtttattaaaaagttgttaaaataacattaaggagaaaagcagacaaccaaataatagcacaattcagtgaaaaaagaaaaaaataaaccaatacaatgtaaagtttcacacgccatgttttaatccttatctagttccttcattgaaaggaaattatatgagtatgtaagataactatcaaatcctacccttttcctaaaacatcccctttcaagtcagttgcaagtaaactcttaacaacaaccacagtactgctattggtttgaattacctgcaacatgtaaagcatatatgcgattcacaaaccactaaagtgctataagaaaatgtccttttggttgtctcttatgtaccacacaaatgctaaaagaacaataacaactaatattttcattgaaagtctattatgtccctggggctgtactaagtgctttgtatgtattatcttagttaaaccatttaaccatcttcttaagtaggtgttattaagtagccaattcaaagacacatagaggtacacaggtggggcaggcattaaagcctatgtgcttaatcactacataaaatgccttctgttttgcaatatgaatggatattgtggtgaataagatatgggctctgtctctaaggctactgacatttaacagtggaggtaagatatgcatgcattcccaaacaaaattcaagttgagatcatttggacttctctctaagagtagttggcattgtatctgcgtcttaactttaagcgttttcaccagtcattcaggcacagaaagttatatatgtaaagacagaatataaaaaagataagcataggcgtttataatatttacatatgaaattatgtatgcaatatacacattacatattattccaggaatacgtattttattcatgagccaacattatgctacttgagggcagaatgtgaccaattcttattacaagactttcacataatataggacttacacactcagaggcagatgctgaataaatgccctgagctgtgtttttaagaatatttgtttcaaggtacgaacatgacagatttggccatagggaaggtgaagcaggggaaaggctagtaagatagacgaaatgttgtccagcagcagaaatggaggcagtaagaatggagaggaagaaacaatgcaaataaagtccaccagcgttgggcagtctgtagtgagaaaagtttaaagatctcttttaaagtggcactctggatttccaaggaaaacactctattgtcaagtaaagtgaatgtgttgcttggtaggatgatcttctgaacacattgaatttgaggtattgaggggccatttcatgactgggattagagctggggatatggatttaggagtaatcccccgagagtggatagatgaaaccttgggagtagctagtaggggagagaaacaaggagggcaattataaaaaaaaagaaatgaagctgctggagaaagatccttcaggaatatttataagaagttgagtgtgtgtgtgtgtgtgtgtgtgtgtgtgtgtgtgtgtgtgtgtagggggagtcaaattagaggaaggaattaaagggtcacaagaatctatccattttccaccacatctgatccataatttctaaaagcttaaatagaatccacatcattgatagatttgtctttctataagtctgtggagcgttcatcagagcccacaggatgcaaaagtagtacaaaatgcccatcaaaatattctccagcttcaatccatttaacataatttaactaaggtaacataccttagttaagacaatcatcactatttgctgacattcatagacagtacattttcttacaagcatttacttcataaaacaccaagagaaattaaactatgttggaacagagtgatgtctaacacaactggaaaaggaaaaaaagggttctggacattgttatcccaatgttaatgtcctaatcttgatttttcttacaaagcaactggttttctttgaaatgtctaattgatgaatacaattaaaaactaaagttctttgtgaaggaaaaaaaacattatcttcagaaaccaggaagctgagtgttaagccattgctttgtttcaaatgcagctgtatcttgttgcatgatagcatttatggcatcaccagtggaatattgtttttaataagtgcaaaactggtgaagacattggtctcctttagaaagaaaaagttaataatttcttctccaccacatattggctaccctgtttattaaaagatagacatttttgacatttggaaagcaataattgattctacaatattattaggagtccatatagatagtgaacctttcctgtcaggatacgacaaaaaacgcgtaagatagggacatccaaggatcacctaccattcatcacacgcaaggtaactgctttcccctaagttcactcaagcagaaaatgaacagttgccaatgatgatcagagagatagaaaatgctgcttccaggaatgaaagtctctttgttgttgttgttgttgttgttgttttaaagttaaaccaatattctatatacttttgctgaaatagcaagagggccagatttgataagatcacagtcctggaactgatcagttgctccttgatgtgtttacagaattttacaatcatataaccaacagatgctcaaaagtagcctcaaaaccaacaaagacaaacattctgttttcaatctttggtgaattattttgaagtttcaaagcatattgctcagaatggaattttacaaagataatctttagatcttagttatttggaggattataaactataccaatttactgttctatcattggaagaactgcaagtattttttgctccccacaaaactaaatctcctctgaaaatagaaacctatttcaataattcaatttgtattgcaatcaatacaaattgattgggtgcaataaaaagtacagctaattcttagaaataagcatgcttatgtcattaaggctaaaactgctagcatgagaagctcaagtgaaataaataaagtgtattcttataataagcattgccaagccattggtagttgaagacactattcaaagatgcaaccttgtctttcattggtgttctctgtctgcatagaaagggctgtgaaaggagagatgcaaaagaggcaaagaaataggaaaaatgtcttgggagaaggaaggatgttccaatgatatggaataacaacaaaaaagttaacttgggacaagttattatttaataatactggagacaattccaaaaatattttgaatcacataattatgctgtggaagaaaaaaaaattattcaacgtccaagactttgtgtttgtgaaaaaactgtcctctttattttatagcccatatattctaaatgtttacaaagataaacaacattgtttttgtgaccattaaaatatgatatgtgaggaagtatgcagggcttgggacttgaagattctgcatcaaattcagaataaataacctgtgatttagctacaattcgggccaaaccttcatggctttttgacatcaagaactagtacatagtgagggatcaaaggatgcaaaattgagtgtaatcaaggatatatgattttttcttctatcaggtaaggtacaactgctagtattgatgaaatgacaacttaaaaaaaggctttctgggccagacgcagttgctaacgtctgtaatcccagcactttgggaggtcgaggtgggcagatcaccttaggtcaggagttcgaaaccagcctgaccaacatggtgaaaacccgtctctactaaaaatacaaaaattagctgggcatggtgatgcatgcctgtaatcccagctactcaggaggctgaggcaggaaaattgcttgaacccaggaggtggaagttgcagtgagctgagattgcgccattgcactccagtctgggcaacaagagcgaaatttcgtctccaaaaaaaaaaatggctttctgttacaaaaatgacaggtcagtaatctgttacagaaaaatttataataagaaaatgtgagtaggtaaacacacctaaatataccttaaagattgctcaaaaaaagactcaagtggattaaggacttcccaaagtattcttagtggtgcttgtcaaacactatccagaaagccctcggtcaggtttgtaatcttttcggtagtgttcatttgttgcaataaaataagtcagcagttttaacaaagaaaaaaattctataatgtttactgtttaatactaaacacaacagtgtgagattatttcctgggcttttaaaaattatacatatcttttttttagaaacctttacaaggaatagtagcatcctatgaaaagttggcttaatatttgattatatatggtgtgtatgattatctccataatttgagacattaggctattggtcagaaatgtgatctccactgtaacagcattttaggggaacaattatatttgatatttctgttttcaatttatagtgtctattctagaaatataatctgccataatctgtcaaaactgccaagactgtttgtagtacttcaatggtactttacagctaatatcaccaccacccaacacccatctgcataatgcatttaaccttacaaagaatacttttatctattatattacttcattttcaaaatggtcttataaaacaggtagagcagggattttaactgaatttccattatgaggaaaataaggtaacaacccattcctggcaaaatctggactagaattcaaatcatttggctccaaactaacacatgcttctccaaaaagcagcccagtatttccagcgacttaatttaatgaacagattcaagacatgggttaaaaatgttgaggatgtcaggctgactgtcactgagtatacttcttgggtaaggggcatccttactcctgttaagatgatcttactaacagctaaagcagactgggagaattttgacaggagaactactattcttttcagacacagatagttcccttttggtgaaacttgttgcaatgttccacaaagtgttaccgcatctggaaagtccataataattttgatttatctgcactgacagtcagcagtatgttatattcactgttgcataatattattatctgttgatcttcccagtagataatatattcctcaaaggaagaatcttgcttattttttaactctgtttagtgccagccatgttgaagttgctcagtaaaatttgtgggaggaatgaaggcaggaaggcaggcaggcaggaaggaaaggaaagaagggaggggatgacgaagttttggaattttcttttgcaaaacactctgctaattgaatttatgacacaaaagagttcagggacaacaacaagaaaaatgtttgaagtcattgtagcgaaagagtatctcaaaaacaagtaagagaatgacttaatccaaccacttgatatgaaaattaccagtaattagcctgtgttaaagagatcaacttttttacacaactcagcagcaaattggttaacttaaccaaagttatgcccaaattgctccttatccaaactgatttctatgttttggtttcatgaaactgatctatcattcaggacaataaactaaataagaactaggcgttttatatagtgttaaggaaaaaacatcattactggcactagtatcaaataatattgctttctttggcaagcaactcaaactaggaaaatgaatttattaaaactcttcatggaccttatatcaagtctgcaatctcctaaatgtaaaactctgcctataaacattgtcagggtaaaattttgccttaaaacagagtaattgcttctatttcctgtgatgtttacacagcaactccttcagaattactcttaaaaagaaatagaaaagaaaatcaatagcaacagtgcactatgaaataaactttgtggcagaaatggaaccagaagattaagataaaaccataaaagtatgaaataataaaaagggcaccaaattcactccataaaaaagactaaacatgatttcaaatgtatattacacacacacacaatggaatatagacattttgtatttcacaagaacatttttataaaaaataatttgcaaaaattaatccagtagcaattaatactattctgcctaacctcatggtattgacaaaccttaatcagatattatttgtaaaaatatactttacagcattattacaaatgtttcattttccaaataaattatctttgaaatatttttactttgtataaaatttttaaaattcaagaatcatatactctctcttgttaaaaatgtcaactactaattacacaacttactataactgcttttactatttgtatgcaacattcttcttcattatttgtgttctactttgcttgttttccaaagtctctggagatattcttgtaagacaaatttaaaacatttatcaatttttatcttaaatattaatttgagttgaaaattagacatgtttaccttaaatactgagcaaaaataatttcaactatatataacagttatagatctatcaatccaaaatgtatatatatatatatatatataaaacaatactaaatgtagtatcttaagtaattttgaaactaacatgaatttccaaatgcttctttagcctagcagacgtccaatgatacacggttgaaggtaactgcttcaatggcaatcaatcattaaccatcaaatccactcaagactagaatcaaactttcttctattaaattacccgcgcaaaacaactgagttttcccatccaaaccattggcctctgcaacttgtaagagtagagggaaaacagacagatctacttgataatcaatttaaaggttatcaaggctttctttacttttgctaacacagtttctattttgagccttcttggccaatgtgcttctgcctaagtgtcacaatctgttttaggtcttagctaagaaaatgtcttatatggtttttacagttaaggattgacaactgccttttgcttttgttggtaagcactcctctaaagttctcttgcctgatcaaacctcacaaaaatagaaattggtccttattctgaatgtttaaaagtccagtaagcatttactttttcttgacgtgtgttaacatatacacgttttgatctactcttgaagtaattaatttaggaaagtgaattaccaatactgtacaaacacatgatgccatatggattttcagggctgaaccaagttcataagcaagatggcaatgaggagacatctatactttatcttattgcaactaccactttgagctaagtacacagagcttgaaggagaaatcattacttgcttctttggaaaccaaatccatcctctcaaaccctatggttttcccttccctttgttaggccatactgatttacattgtatttcagtattgaaatttacatcagaccaatttcacattgtttagtaacttgtgatttatgtagtattaagattaattccattatgaccaatatcctgtcatatcatttaattacattgacatttattgtaattacatctaataaattagatacatttaaatacattccagctaagaatttaaacaaatgagagccacctggcacaatgagagaaactgtttcagtacagagacggcaaagacactctctgctccccaagttaaaatgatttagtttgacacaacctggaggaatttattctgtgatcacgatattttctcttttgcataagatacacaaagtttgagatggaatttggtggtaattagaaggcagagaagaccataagaaatatgggaggtcatgcttttctcttttcattaaaaagttatctaaaatgatagcataatccttgatagtcatttttaattggcaattattgagtacacacagtgcagccagaattgaactgaagtgtcacattgtcaaatgtgacttttcctgttgcatttgctttggcagcttgaacataactattaggaccaagaagaaataaatacttcacattctaaagaatatggggccagatcctctttccagagctatgatcaatagcaacccccaccgcctaatcctccttccctaacacactttctaatctacataaggtgatctgaggatcagaaaagagaaagagacaacgcattcttaatggagaatacagaggttgtgttctccgttctccgtcaaaacacccaatttaagtgcgattgaactccaaaataaataaagacagggacactggcatgtcacttccagggctctgtacttactgtcagtggagtgaagcaaagaacttttaactcaatttaatacatgatccctgtggcttgaggctatacatgaggagagagaggtgtctactcctcacctggaggtttctgaaagcaagagactctccaaacaatctatcctagggtgaaagaacctaaaaagccaaggagaaaagccctctctgatcctcacaaccccctgaggttgctgaagaagacctcaatgggtaactgacctcagtgggtaactgagcttcatgtggagaagtatgaagtagaaggtggaagaagaacgacaaggtggtctagataacagtcatattaacggatcctcatggaggagtgagggacattagctgcttatagaaagtacggtagcaggagcaacagcatgttgtgtttacacactttgacatcatatatttctggatgaagcctcagcactatttttttttctttttctttagacacagtctcactctgtcacccaggctggagtgcagtggcgcaatctcagctcaccgcaacctccgcctgccgagttcaagcgattctcttgcctcagcctcccgactaggtgggattataggtatgcaccaccacgtctggctaacttttgtatttttagtagaaacgaggtttcagcatgttggccaggctggtctccaactcctgacctcaggtgatacacccacctcagcctcccgaagtgctgggattacaggcgtgagccacccaccgcgcccagccagcactgtcaactcatttaaggtctctgagccttactttcctcctctgcaaaatgagaacaatgtgctctacctcacagggcttttatgatgaacaaatcggacaatacttttagaaatgatgtcaaatgattacactatgcaaacaatgatattattacttaacctatatattacattcaacttcactgcttgctcatattatcttactatattatatatattcttaggacagctggagtcttgtactactttatgtcttgtgtattctccaggtgtgctatatttagcataatctaagaatgatttgcaatgacccttatctttgtataattctcttccctttgagtgtgtgtgtaacctgtaaatatgacaatatatctcaccaatgatacaggctgagcaagccaaatctaaaaatttgaaatccaaaatgctccataatctgaaactttgcagccaatatgacactcaaaagaaatgctcattgaaacattttggattttggattttcagatttgggatgctcaacttggtaagtgcaatgcaaatatttcaaaatctgaagaaaatccaaaatctgaaacatttctggtcctaggcattttggataggagtactcaacgtatgtgtgtgtgtgtgtgtgtgtgtgtgtgtgtgtgtgtgtgtgtgtttgtgtgtgtgtgtgtgttcaagaatggaaaagccactaagaatgccctccagctgacaaccagcaagaaactgggacctcagtcctacagcctcacagaactgaatactggtaacattctgaagaagcttggaagcagtttcatcttcaaatcctcaagataaagagcccagtcaactggctccttaatattagccttcttgagaccctaagcagagaagcaagttgagctcccacagacatgtgatctacagaaatgtaagctaaaaaaatatatgtgttttttggctactaactttgtagtaatctattatttagtgattgaaaactgatacagatgctaaaacctatttattaaatgcatactatttattaaatgaaagccattgattgaatgttcatgaagcaattaatatataatatctgagaacatttcatgtgaggtcttgtctgaaaattcttctgaagaattttgaatccttattagaatctgaaaaaaaatctcagaggctaatcacaactaggattaattggaagacatgaataagcacccctggtgatgtttaaaacatttgttgagggtagagtggtagagtttagcaaaacctgtagtcaagtaggatggaggctcggcaccaatataatttggccaaaaacttccatggtttactcataggctgatggcatgtagattacatacaatgaaatgataatttttatgttaaggagagaattctcaaaatatttgtaaaaatgggcagtttgggatggctttatggaaaagtggggttcatgttaagtctcaacaccgagtactaatgactaaagtaaaagaacactgatgaggaactaaaagaaaactacagagataatcaaatctgctcccctgcctcaccccttatgcattataatatgtcatcattccctgccaaaaatagaattccttttattttagtatatctctagggaataagatcgaagaacactctcctaggaatttaattatccttcgttggaggaaatcctctcgctcaacatgaaggcaaaaagtaaaggccatttcatcttgtcctgcctcccccccgcctgttaattttaaaacacatgtttagatactagaatattttaagaaaacagctaccatactggcatctggtgctattggcaaccagtgcaaggataagctccagtgagaatttaaaaatgccttttcctaaggagaaactgttaaaaaaaaaaaacaacctgattatcaattgttccccaattcatgaggaaaaagaacaagtattatcaaagagctaatttataaatacctggatttacaactcttttccactaagtatttccaaaataattgttctcaaagttaactgtacactagagttaactagggacctttaacaaattttgatgcctagtttctatgcctttaaaaattctgaactaattggtctggagttcagtttgtttattgtgataatttcaagagctcccaggtaattctaatttatggcctctgagctatggtccaggattacatgcatagtagacttctgaagaaagacaaccatgagttcagtttatttctccactagaaggactggattttagagatctctgaagtaaaatatccatgcatatttgctctgaaataaaaatgttacagaacaatgcttttatttcaaggtttgcatttttccaaaggttttttttttcaattcctctgtttgcaatgcagcaatatcttgtttgaatgcaaattaaatcttcctcttaataagaaggatgtgtctctgcctcaggaccatgtacaaacagtctggtgatggcaggcagtgacccagggatgttcatgatggactgagagagacatggcaaacattacaagcatgcattgcaaatactggactgtggaaaattaatagttttaacccttaagccaacttcacctggcacagtagcatattttagcaataatttacctacattttacactaacttgggggaattacagacacaaagttggaaataaaccatactgaagatagcattatactttaccttggctgaaacttgggaagcaacacaatttggcctttatatttaaaaatcacggttcatttgacgtcacataaatgtagagagaagagtggaaatttgagtgagaaaagctattaggaagtatatttactagagaaggaatagaattaacagaacttagtttttttcatcttacattttcttttgttgataacgaatcaattggaacatttttgaggttgccagaatcttctgattctggagcctaaataaggttttttactggcaggttgaccgaataatagaaatttcatggccagaggccaaccaacactttataaaagccctctggaccaggtggttgacaagcccaggacttacatgaatgcaaccccagaagaaaaacttgcaagtgcctcttcaatagccatccaagactcttgcttgaaattcaaggcagctgatggtgatttcgtcttccatttacaacttctttattcttataaaaagaatgctgtatccttttctttcctccccaacaccaacagttcactcgttcaaaaactctaaggcattcagttaaaagtagatgaaaatattgtttgccagaaacatcttcaaacagaatatgagttttcacacacggaatgctcattagaagcagaagcaaacgtatcactgtaacataataatagctcatattgagcaagtactctgggctgtgtgcctaacatacaatagctcatttaattaaccataatgttgggtggaagctattattttcatttcacaaattaggaatctcagacacatagaacttaaatcacttgctgaaagccgtacagaaagcagtaaaagatccagtattcaaaagtaggtaatttggccaaaagtgtccactcttaattataccactctattgtagctattgtgtaaagtggcccatgagaacaagcaatgggtaccttgccccagtggaaaaagataaattcagggaagtttcttgggtaagtttatttctgcactaagtgaaaatgttaaataaaaaaatatatggatgaggtaggcagggcccagtggctcatgctagtaatcccagcactttgggaggccaaggagggcggattacgaggtcaggagttcgagaccagtctggccaacacagtgaaaccccatctctactaaaaatacgaaaattagctggtcatggtagtgggcacctgtaatcccagctactcgggaggctgaggaaggagaattgcttgaacccaggagcggaggttgcagtgagcggagaatgcgccactgcactccaggctgggcaacagagcaagcttccatctcaaaaaaaaaaaaaaaaagaaagaaagaaattatatggatgaggtagatggaggacgggggatggaattcctggcataggggatagcataactgaaatcaaaaaggttgaaacaaagcaaaacaaaaaaacaaacttacattgtgtgttgggcagtttggtacagtaaagagataatataaaaatcaaggagatggcactggagaggtgaactaggagaagatcatggcagtcttagtatcacaccaagaactttgactttgttctacaggtcagaaaatctcaaatatttctgatcatgacccacagaaaaaaatatattttacttggtgacaaatacttttttaagcatgtattttacttctatataataaaagtttatatatctttattatacatgttatttataatacgtcatattatagataatatcacacacacacacacacacacacatatgtacactcaaactggttgagcaccctaaatccaaaaatttgaagtttgaaatgctccaaaatccaaaattttttgaacaccagaatgatgctcaaggaaatactcattagaacattttgttttgttttgttttgttttgttttttttgagacagtctcactctattgcccagtctggagtgcagtggcacgatctcagctcactgcaacctccgcctcctggattcaagcaattctcctacctcagcatcctgagtagctgggactacaggtgtgcaccaccacatccagataattttttgcagttttactagagacagggtttcacgatgttgaccatgctggtctcatactcctgtcctcaagtgattcgcccaccttggcctcccaaaattctgggattacaggagtaagacacgatgcacagccatcattagagctgggctctaatcatcattcatattttatattttcatatttgggatgctcaaatagtgcaaatattccacaaacaaaaaaaccctgaaatctgaaacacttccggttcaagcattttggataagggacattgagtctctctctgtctgtcgtgtgtgtgtgtgtgtgtgtgtgtgtgtgtgtgtgtgtatgcatctgtatagttggcccttgaacaatgtgggggttggggtacccatacactctcagttgaaaatctgtgcataacttttggcacccccaaattttaacaaccagtagcctactgttgaccagaagccttactaataacaataagcagttgataacacatattttgtgtgttatatgtagtatatactgcattcttacaataaagtaagctagacaaaagaaaatgttatttagaaaatcataaagaaaatacattgacttcattaggtggaaattaatcatcataacagtttcatccttgtcaacttcacattcagtaggctgaggaagagaaggaagaggaggggctgatcttgctgtctcatgggtggcagaggcagaagaaactctatgtataagtggacctgtacagttcaatcctgtattgttcaagactcaagtgtgtgtgtgtgtgtgtttgtgtgtgtaagagagagcattttatatatatatatatttgcaattgaatgaaaattttcaagaaaattaatgaatcttactattcaaatattcatattttctattctatttcatatcagttctagactatttaggaaatgagtaggcctctcaattcatttttaggccccattaatgagctataatactgtttaaataacactgttatgggtgttggaaatatatgcgctatcatcaaaggattttgattacaggagacatagtttagagtgttacttcaactgggtcactctgatagcagtcattagctgtctgaagatgattttgagtcatttgccaagctcaggcaaaagagaaaaggggagacaaaatcaagtctacttagatgccacaaaaaataaattgaataacttagagtctccactaaaattataattctttattagaagaatgttaaagaaatgatccgaggaccactattcttgaatatccttaaaagtgcaatacaaagccagttagattagcagggttactgacatacccgcctgaaggaaaggaaacaaacaggcgaccactggtgccctccagctctagatttatttccctggtcactgactatctgaaaactaattttggttgcctgagaataaaaagtcaaaagtacatgagattgctctgaagaggagtctacagaaatgtattagaaacagatgaatagtcatgaccctctttactcaatccactcttacacaaatgtctatgcaactacagaagagaattcagtacctatttatcaataaaagaatatgagaatgtttctgcaggctcctaaaaaaaacctttcctatgaacagaagataatggggttattatagacaaggcaacagcgccttctgaaatattgcaaactaattaagaataattattaataacatttttggtggtattgtcttatgcttgactaatttgtaaatattctggtatatttgaactttcactattttagcctgtaccctattttttagcacagattttaattagaaaaatagaagtaataacaagggaaatcacatgttaactaatgaactgagcctaacaacaaaaaagacacagggaggcccttgaaggactctctagcttgatgttcttcttggaatctagggcagggcaaaagtcctaacatcactctatggacaacagagatgaaccacatgagccaggtgctagaactgtgatatttatctctgtttccctgtgtgtaccaccaccccacaactccaaaaaagaaaaaaattataaacacatccactaaaattggcaattctagagaaactggatggcctgttaacatctggctttcccaaaactcaatttttctgtaactcattcattttttagcctttgattctgaagaaattacttgcctcctggccagccacagaggctgacgcctgcaatcccagcactttatggggcaaggcaggtggataacctgaggtcaggagttcgagaccagcctaataaatatagtgaaaccccgtctctactaaaaatacaaaaattagccaggcgtggtagtgggcgcctgtagtcccagccacttgggaggctgagacaggagaattgcttgaacttgggaggtggaggttacagtgagctgagattgtgccactgcactccagcctgggcaacagagggagactccgtctcaaaaaaataaataaataaaaataaatgaaattacttgcctccttccaggcttgctatagataaataaacatatacgcgcaatctatatttctccattacactgcaatcatttccttgtcactagaattgtatcttgtagtccaagaggtaagtaatcggaactgtcaggacaaactcttgggactgtaaatgtgctatctggagcataactatcctaagaataaaatccaaaagcaaaaactcatcagaaaagatttgaaactcatttcagacaagatgcagactataaacaaataaatacacaatatgaaagcaacttaagtctcatgatggaaagattttgatccaactgattattattgttcctagttcaaaatattttaggccttatcaatggcaatgcataacaggaatgactaaggttagcttttcagtgaatcatcagagtagtgattaaactgatgacatacaagactcctaactggattttgaagattgagtacagtatccaaaactagcactggaacaagacaacaacgttcattcagcccacaagaaaaccagtttaaaactctgaaacaatgacaccatgagtatatttgtgataattatttgccatgccaattatattaaatcatgaggaggtagtacacatctacatgcataacgagcccatttttatgttagcatatctccaaggactttcctgctgtgtattttatactgctactgccttatattttatgttagcattaatgttttaattttcatatacatatccttaggccattttacgaagggcgtggctttaaaaattcagttgatatattaaattaatgttaaaaaaaggtcatgtaacaagtagtcctaaatcagttctttgtgttccctctgtacattcaaaccttctaatatggtttatttattatgggtaatacagaagtaagatctgggctctaaactctgaccatctgtcaggttaacatgcatatgcactaagtgtctttcttcagatgatggatcctaccacaagtcctccctaaaacaatatatcaatccccttccccacaaaaataaaaaaaattgatttatatcaaaataaatacataaaatagagcttctctctaaattggccttctgattagaatactacttcatcacctcagaaaacctgtcttaatattatacaggtagaataatttaccaaggtgtaaagaattttttaaaaaatacaaaaaagagacaaaatagtgtagtgattaggaataaaagttctagaacaagacgatctctatcagacccagttcggccattgactgtcttgtgagtctggtccagttatttcaccttttagagctttagttttctcaattcaaataagagtattcaccacaaggtttatttaaaaaaataaaagatccatgtaaagcatttgtatcaaattcaacatatttattaatattactattgttactaatacacagatgacttcaaaagctgctattaaaaaccaagtaaggatgtgggtggcatgctgtattttagattcagattcaacagccactatactagttacattcatatgacattcatatcacattaacgtcatagcacagcacagcaattaagaataagggtctgtctggttttaaaccttagttctatcacttattagctgtatttaattcagtaatcttcttaacagttctataaaacagataatagtattacataccttataatgttgttggaaggattaaataaattactatatgtcaagctcttagaaaaaaaaatttgctgttgtaattatggattttatttcagaacggaaaatgtccaaatatttaaaaagccagaagaacaacagaaccagtcttgtagtcactgaagtaatgataatttaaaaaatcataataataaccattaaaacagtaacatgctatacttagctcaagcgtagcatgctatcatttgcctacaatttcactatattacccacatgacctctcaacaagcctgtaatgtgggtaggctatagattattgccttcaaattatatttcatgaacttgaggttcagaaatcagtgacttgctaagccacataatagtaggtgttcgagccagtgctagcatctaagcatgggcctcatgatccaatgccctttccacttcactccttcacaatggccgaagaaccaaattcaaggcaaggccatccaacaggccatcctgataagaacccctcctgaaataagacaacacggtcacacaaatcaagtgcacatgctttctaactcaatggttataaagaagttataggtaacaactgatacatctgcacaaaccataaggccattaacacaaagatgcattttaaagctaaccagttccagcagattatattcatgtaaagagaatttggttttcctttccttctgacacttcattttccctttgtctcccaaatctgttaataactatttttaggcagatggagcatttcatgaatgggtcactcttaaaaatctcatttggtttccaatttttcttcaagcattaagacttactacttttagattttttggttattatacacaaaagaatatatgtggatagaatatacacacatttatgcaaatatatatatatatatagcatgcatatatatgcacatgcatgtctatctatacatatacatttacaacaaagaaaaactgcttaattttatgtataagagattcagagaactagaccaggtaacactcagaatatacacattattaaggagaaagcaaaaaataaaagagaaatcagtaaacacacaaatcttcccattgacaaggttccctttctgagcttcctttcactttacttctgattttcttctcatattatgtgcttcaggtaattctgcacattttcttctcctgaagagaagccatcaccagaagaaaaagccatgaggtctttttagagagaagaaattcacaaatactgttaggcagggaggcagtcaacaagcacttactgaatccctagccccctaagcactgtactaggtgcttagaactgagtccctcctgctattcagttagaaggatggaaaagctatgacttctagtattagcactgacctagttaagccatgaataaagaattaaaaggttttcatcttccaccatacaagttaagaaaacaaaaccagaaaccttgatatatgtttttcagcccaatgcattatggtttcacatatgtttcagctcttattgaaattttttagctcaatttcttttggtctagaaagttaaaaaatgtccaagtcaacaactcagtaagaaatttagaaagtttccaaacaactcagttttggaaactttttagttcagcatttcccaaactctttgctattgacattttaggctagaaaattctttcttggaaggagcaggggcctttcctgtgaattttagagtgtttaatggcatgcctggcctcgactcattagatgcctgttatcacctctccaaccgagtggtgacaaccaaaaatgtcttcagacattgtcaaatataccctgggagcaacataattcctgagtgaaaactatctaggccaaaacttcacctaacacataactctattagatggatagcatgaaaggatggcatataaaggtctggaaatagaatgacattaaacttaaaataatcagcctttttcctaaaggtatttttattcaccttgtacataacattgagaaaacatcacttgtccaatatcaaaaattggggaccttaaagcaatacacccctggtcttcccaaatcactgctctggcttgctttagtttgtaacattaaggctctgtttcctagaaagtccagagctaagacatacaggttgctttcagttcttcagaggcaaggaaactaagaaaggtggtaatcataagaacaccacacataaaaagaaagggaagagtaaaccgagtttctgttcttaaaagaaacagtgggaaaaaagagaagacatacattatcatttcaaagcaatttatcttaacaataattgggcaaaagacattgtttttagttgtgttcttgcagaagtaatgtcaaatttacttgaaagttagagttttagaaaattttagatgcagggagtacatgtgcttgttacatggatattacttgtgtaatagcggggattgggtttcttgtgcacccatcacccaaatgttgaacattatacccaataggtaatttttcaactctcattcccctcccaccatcctcccttttggagtttccagtgtctgtcatctccagaaaatcagataacttaaaaggtttcatgcacgttaaatagttaatagttgttttattacaccaaaggaaaaatgaaaaactgtttttcccaaaacagcataaatgtttattttctgtatgtttactttgctgtcccatttctataatatagaaaagtatattatttgaatagctaaatgtatttatcataaatatattacttttatataaatatagtaaatatatcttttactttgggatgtaaacagagctaaaatattatattctcaaaagccccaaaatagtccttaaaaatcattgaattaatgtggttatttaatcttgctcagcaatttgatgcaaacgcctaaatacaaaaagtggtttagtaggtactacaaaggaaggaagaaggaaggaaaagacttaatactctagaatgtttcctgaaaatcagaaaacaagtagcattcaattgtagctaaactaactaactaactctctctctctctctctctctctctctctctctctcctcctctccctccctccctccctctctgtcacacacaaaaacacacaccacaaccctgattaaatacctgttggaagaaaggaaggaagcatatgaggcagcatggaagagagaaagagagtgacaacctcaagagacatcattgacttgagttctagtcctatgatggatttcagaaagtggtcataatctctttaggcctcagtttctcatatgtaaaatttgagggtttactagaagatacatgtattctcttcaatttaaacagtccctgattcatagtgtgtttcagattagggtagtaggaggaagattctgagtttcagaatctaagaaaaattaaatgatctaagttacattctaaaatcgatatgagctgcaattctgagaacaacttggccagctagcccgaatatttttggcaatgccagcaacagattggctggatggcactgcacaagagaatctttttaacacagtctgctcaatctggtctatccaatgttctgcttgggataactttaaatttgggttgacttagaacttgtccttggtatctcactggctgttaagaggacagtccatgataaatgtcttcttcattaaaagtcaattcttgccaactttttcatgctactttttttctacaataccacatataatttgagacatactgcccacaaaacagaacctacagaaggttggaaacaatattctattctctctttcagagacatgtaacattaaacagggttcaaagggaatgcattagaagtttacagaggaatttggattacaaatggttcacaggaacagtaagtacttttttttggcttaccagctagaagtgggacataaggtaaacaagctatgagtagatttctatagaggtaaaacacctcatgttacatatcaccacacccctgctgtataatacataccataaagtattattacaagatttaaatatttacatcaaggtttgccaatgaaaagagctttgagaaccatgttagcttgtagctgccaaagacacaagtaacagcagtagttgaaatcaggcagtagtctggggaaaatggggaatccaagaacaaagccatgtatgaatttctccctgtcttccatttcaaagtgctctttgtaaagagaaatacctaacaatgcttgagaacagtttatatttataattgtaataaaaaagaaaatactgaagactgtatttttaggtgtcttagttcaaaggagcaaaacactttgtcatcctaatcagaaaagacatttaagataacaactggagaaaagtagctttagaaataagtaggaaacatgtcctaagatattttaataatgtcaagcagctatttgcacaaaaatatggagctgctccacatttcactacatcttccagggagacggtagtagatatgagtaggtaaacatccctaacctgtctagtcacatcagcatattagccacagagaaacaagatacataaattctgggaccacctaaagtgatttgttgatcagctctgtgcataattactgcttttgtttaattacttttaattacctgtttttcttttgtccttatgccctgaggtgagtttttcatcagtaatgggcatgattttatgaatatcacatgcaaacaagcaaattagacccactgaacttgggaaaccatttttccccatcccttctctaaaggttagctgctattttctgaaaatgatattgattctatggtaacatgcacaaaggcactaatcaggagaacaggagcttttgtgaattcagtaaagcttataaaatacctcattataacatgctaccaatctatgaccccaataatagcagtcccaaaattataaataaattagatgtttaaattgttacccttttttatactacatagtgtaacacacattataatttccagaagagctcttaaagaaaaaaaatgtggagaatgaaaattgaaaagcagcagctgcttaggagtgcttaacctagagctagacgtccaggcagatcgaaactgcctgctgctcctccttcccttttcctatactgcctacaaataatcggtttgatttttcataccacgattttgattaagcactgtgtcattatttctgggtaataaacagtttttattattttcagtttaaagcaattattgccaaaaggaatttttaattttaatattaatttatttagagacaggctctcactctgttgtccaggctggctggagtgcagtggttcaatcagacctcactgtagccttgaactcctgggctcaagcaatcctcctgcctcagcctcctgagtagctaagaatacagggcggtgcccccacatctggctaatttaaaaaaaaaaatttgtagagacacggtcttgctgtgctgcccaggctggtcttgaactcctgacttcaaggaattctcctgcctcagcctcccaaagttctgggattacaggggtgagccactgtgccaggctcaatttttgtttttaatgataatagctaattctgatgagaatccttgaagcaaaactctcacaccttgctagtgttccagcatgtataatcccctgttatagcctgaatgtgtcccccagaatatgtgtgttggatacttaatccccagtgtaacagtgttgggagatggtgtctaatgggaggtgtttagataatgagagctctaccctcaaaaatggattaacactgcaatataaagagctttggggagaagggttctgcccctctgctcttctgccttatgaggaaaaggattccttccctctgggggatacagcactcgaggccccatcctaaagcagagaccaaacccttaccatcagacaccagatgctggagctttggtcttgaacttcccagcctctagacccatgaggaaaataattctattctttataaactacctggttttaggtattctgttatagcagcaaaaatggactagagacatctccttttaaaagtcttgcatgcactgataattgttgatgtggtaaattgaattaaataaaagaatctaaaatgactgtcttaatttttttaaaaacagttttccattgacaggtgttcaaaacagcattatttttaacttttgggtttgtgtagtaaattaattaggggttttcttttatatttgtgttttccaatttttctttaaggaggatttagtatttataattacaataatttttagaaaaacattctcatttaaccatgaaaagagttttaaggtattcacaataacgtattagagctcagtagctttaacacatttctttctacaggtacatgacataagtgcatgatgatatttactaaaggatagaaagagaagtcttaactatcttgaaaacatgaaacaatttaatggtgagtttaaaaaaaacctatgtattgcaattaattgacaaataaaatattgagacatgggctttaggttcctctgaggcaaaaaaaaaataccctgtttattaattttttgtccccttctccttgctgttgtagaatatatgaacatggtcttataataggttcagaaccatggatagcagatccatgcttttaggtagatgcggcattatcttaagagacaaagtatctgctgatcttcagtctgctttgtagtggcctcgttatgagggcaaatcagttaccttctctgggcctcctttgcctcactggtaaagcaattcattgccttgcctttccaataggggaaaattagactaaataaattttggccatttacagctgaggactaggacttttttttaatcgttctgatacacaaataaatatgctctgacattattccacggatgagttttactttttttgtttacttgaatgagaataatggataagaaaaacattttcaataaggttaatttatcaatatatctacttccctattgtcttcagtccatagttctagtaatgagcgcaccacaaaattgataattccatcagattatcatggaaaacgagcattgttgtatgaacgtttttgtgactactgcaaaggtcaggaacaggtctgctttgaaaacttcagataaagatagtttttaaaaagttccttaacacacagtcctaggagtacgctattaatttttcaacttaaaaaactaaggtttccatatcttttttggtagcttcaagggaaaggaaaaaaaaaatgccttcacattcctaattattttgaaatatttttcattggttactacttcttaaaaattcattatccttttttttttttttacttttagattttatcaaaaccatatagctatttcctctctgattgacaaataaagccactatcggtttggcacaaaatctagaatatggtagactctcaataaatgttagatcctctttttcttctctcctattctttcctatttctataaggtacatttcataagattttacatgtggcattcatcttctagatcaaaaaatgtatcatttaatggaaaagaataaagtttaaaatcctagattagtgtctgcgggtgttggtaaagctgaatggctcccacgttttggataatctcattcaatttttcttccatatttttccttgaatttgccactttctttctttcaaaagccaaggctctcaatatgtttggattctctgttaagttatgctgtttattcaatggaggcatgaattcaaatttgtccacataaatttgacctcctaatgctacacgttgttattggatttctgttgtttctcttttaagtggccctggttgtcttaaaacctgctcattccttcttcgagctgtcgccatcctctacaatgctggaaattcacaatcatgaatattatacagggagatacaataaaaatctatgtctttataatagagtcaacaggtataaaaagaaagttatttcaaataaaaagtttaatattctacatttcataattattgggaagctttgagagtcgatcccaggaatgctcttatcacattattcattgtggagaaaaagttcagtaaagtaaatatagtaattagagctcatgcaagaccatcagatggtaaaatatctaaattatctcactagaaggctgtttatagcaagggaaactaaaatatcattctaacaatgtatacataccatagagagaatgatattgagtctaaacctccaattaagtataggcattaaggatgcacatcattagaaatatgctgtgacttttgtttcagccaattatagaaggaagttagagctaagaatttcttgaaaggtgattttagatgtgagtgaagaggaaaagacaggaaataaagctatcatttattttttgtcttaggacaacactgaatatttgtcagaagcatctgctccttaaataacacaattgaataaaaattggcatctgaggtttgaaagttaatttcaaaggtttattataccacagggttcatatttagcagctgtcaatttgttatcgacaagtgtaataaaattcagcaaaacttgaaatcttcccttgccaaagagacagctgtttctgaatgttggagatttggggagtttttttttaaaccaacctctatttgaaaaagaccttacttttatttatcaaaaaagtcatttgatgataaaatattgatattctttaactgtgtttgtaaaaaaaatatatatttttaaatgtgggattttgttgttcttgctgattcaatatttgtagacagtgtttcaacctgggtaatgtggaccctccatgggatatctggcaatatctaaaagtgtttctgtttgtcacaactagatactattggcatctagtgtgcaaagaccagggatgctgctaaacattcaataaaatgcaggacagctcccacaacaaaggattatttggctcaacatgtaaattgtaacaaccttgagaaaatttgttttaaggaaactgatacaatggatttagattaaagattagtttgcatttacagactttctaaaccatggttttcacctggtggggagctgcaggcaggcaccggttgtgctttaagtaagtgttatttgaacaacagagtaaaactccttagctcgaaattatagcaagtacattcgcactgatgtaattaagtttgtgtcagttacactgaatatatttctatgtacaacattttgtaactgtgctataaaaataaatctgtaaaaagttcgacaggaagtttctttaggtagtaattgttttctacagatgcattagctaatattctacacagactccataattcatattaaacaaaaaacttgaatattgttttagtcctaccttttaccccattattttctcaacttgacaatactaataagcaaatctatattttcaaacaatatctctagatcacacattccttaaataattattttaagtatgctacataaccaaaacagacattttcagggccgaaataaggaccagggatccacattttgttgaatgtctactcagtcattgagaaaagtactttttatttaatatcaatttacttcaataaaaatgtcacctaacatgtaaaaatacttaaagagagagtactatttaacccatgaaaaataaaagaacagaatgagacagctgcaaaatcaaatgtatttaggtgttttagctaaaagtatacattattccaataaaattaccttttgcaaataatattactaagaagaaatttaaagaaaacatactccactatcataatggtgattttcatttaaattagaaacacatttcaaaattcatgaccttggaaactctcatttcatttgagcctccagagtagtgtgctgtctctctctgtctctctgtctctctcaatcttttaatttaacaaatacttatatagcatttacaatatacttgataattgtagaaatattttacaagtattaactcctgatgaccctataatgtaggcacacatattatcgacattttgctaacagtggaaccgagtcatgcagggattaagtaattggccaaggtcccatagctagtaagtgacagaggtaggatttgaattaaggaagtctggttccaaaagccttcctctttagcgccacgtaggtggcctcccctcttcattacatagtattacaccttttatttatctcaaacttgcccaggtagtgtgaccttggaggagacatatgtgaaaggtttcaagtcaagtcaaagcctgtgggaaagtgatggggagaatgagagaaactgaatgatctcaccagctaatccatccatggagatgctttgttcagaaatctcttagaattagaagtacaaacatagttagatctgagttgaatgcatctgatctataacttccatttgtttatggcacacattttatatcactgacaatttcttttttctctacaaggagaggcagtatagaatggtgtttaagagcacaaactcaggagttaaatctcctgggttccgtttccagatttaacttgctattaccatatttgtattgtatctcttgaatggtgaacagagaaaatatgatgtagtcaagaagttctctccttcctgagcacactgtcagattacacttccccacttcttcctaagtggggccatgtcattagttttcaccaataatgtaagagtagaaataaatgcatgatacctgaagcctcagatgcattgagagccagtgtactttgtctttgctcttgttcctgccttgtctagcatctggatgcagaagatctggatgcagtgaaagactcaaaggcctaaatgatggtggagtcacaatatgggaggagtctgcatccttgaatcatcacagggattaaagcctccaccctgatactgaactatatttgactgtacaataaacatttataataactcactgaaattttgcattatttcttacaacaactagcttttattatactactatgactgcacatcattcatgtgagcaaaatggtcactcttttaaacttcaaattaccttggtttaaaatagttttactcagtgtgtgttcctcttcaaaagagctttgataagcctcattacctataaatatttttctgtatagttccaaatgttaaaataacttagtagagatgcagatatttatagcagttaaatactgatttataaaaccacacaatactagtacaattgatggaaaaactcataaactaagtaaaatatattgaaactatctgccagaaaacctgcattttccatgatttgaatgggccacttcaatgaacagaacaaataaaatggctcttgtggccataactctcacaaagaaaattatttctgataacaataccatccttttctgtaaatgtatactacgctcaactaacaagggaatctttactttgctacatcattaccaaattggtaaataaatctaagtcttcatgtcaacatttcaagaagggctccctaaagcttgtaaattgtcaaagatatcagattttaaaggatatgaacctcttaaaaagtacttggatgaaatgttatgttcagaatctcaaatatgaattcattgtgttcttgtcagaagttacatcatcagggtcctgagctggtgctggttcagtcccaaggaaaagaggaaacttgtgtattactcagccctggcagatgagtagattcttctataaccttttcatcaccaaatgtctcaacgaatttaaaaactaaagattatttcttgatttggccaggttccttgtaatcttgacagtaagaagctcagaaaaatttcctttgctgtgcatcatgtatgctttactcaaaggccgaaaagacatagaatgcttcttctgaactttcatttaaccagcggaatttgtgagggtataatattcatatattttattgaggagatataagcaatatctcttaacatgtagtttttaattgactattaagatacacaatcttttaaaaatttcaaaatgactcaacccaaattatttagaatatgatttatttcaaaacatttttaaaattccttccttccacaattgtttattttgtctatccagttttgtaataaatgctatatatataaagatggttcctggcattaaacaacatctgcaaaacagtgagcaagaacaagatatttctagaggtaagtaaggtccactaaaacaacataaaatcatagttaataacatcataaagtcaatggctgattctatgttttaaaatcagacaaacaaaccaataaagatcacacctaaaacatgtgcaactgtatagcataaaggagttcagaatgagactcaaccaaattattgcgatcatgaatattacacatcctgagaaacaggaactgtcatagcagtcttgaccacatgttcacatactcaagttggataaaaggaaaagtccaaaatcttggcacaccaaggtaaaaaggtggatatatatttaattaacatttaaaacaaattttcccatttctccacaaagagctcattttttaaatcttaaggtttagtgaagaagagatttcaagcccactgcaaaatgaataacattcttttattatgctgttgatctccaaatatgcaaatgcctttttctttaaaaaaaatagtggtagtttgaaatcaggtagcatgatgcctccagctttgttctttttgtttagggttgtcttggctataaggagctcttttttggatccatataaaatttaaagcagagtttttttctaattctgtgaagaaagtcaatggtagcttcatggggatggcattgaatctatacattaccttgggcagtatggccattttcgcaatattgattcttcttatccatgagcatggttccatttgtgtcctctcttatttccttgagcagtggtttgtagttttccttgaagaggtccttcacatcccttgtaagttggattcctaggtattttattctctttgtggcaattgtgaatgggagttcactcatgatttggcactttgtttgtctattgctggtgtattagaatgcttgtgatttttgcacattgattttgtatcctgagactttgctgaagttgcttattaaggagattttgagctgagatgatggggttttctaaatatacaaacatgtcatctgcaaacagagaaaatttgacttcctctcttcctatttgaataccctatgtttctttctcttgcctgactgccctggccagaagttccaacactatattgaataagagtacaaggctacagtaacaaaaccagcttgatactgataccaaaacagatatatagaccaatggaacagaatggaggcctcagaaataacaccgcacatctacaaccatttgatctttgacaaacctgacaaaaacaagcaacggggaaaggattccctatttagtaaatggtgttgggaaaactggctagccatatgcagaaaactgaaactggatcccttccttataccttatacaaaaattaactcaagatggattaaagactgaaatgtaagacctaaaaccataaaaaccctacaagaaaacctaggcaacaccattcaggacataagcatgggcaaaaacttcataactaaaacactaaaagcaatggcaacaaatgccaaaattgacaaatgggatctaattaaactaaacagcttctgcatagcaaaataaactatcattagagtgaataggtaacctacagaatgggagaaaatttttgcaagctatccagctgacaaatagctaatatccagaatctacaaggaacttaaacaaatttacaagaaaaaaaaaacatcaaaaagtggatgaagaatatgaacagacacttctcaaaagaaggtatttatgtggccaacaaacatattttaaaaagctcatcatcactggtcattagaaaaatgcaaatcaacaccacaatgagataccatctcatgccagtcagaacagagatcattgaaaagtcagcaaacaacagatgctggagaggatgtggagaaataggatcgctcttaaactgtttttgggagtgtaaattagttcaaccattgtggaagacagtgtggcgattcctcaaggatctagagccagaaatatcatttgacccagcaatcccattactgggtatatacccaaaggattataaatcattctactataaagacacatgcacacgtatgtttattgcagcactgttcacaatagcaaagacttggaaccaacccaaatgatcatcaatgatagagtggataaagaaaatgtggcacatatacacaatggaatactatgaagtcataaaaagaattacttcatgtcctttccagggacatggatggagctggaaaccatcattctcaggaaactaacacagggacagaaaaccaaacactccgtgttctcactcataagtgggagttgaacaatgagaacacatggacacagggaggggaatatcacacacctgagcctgctgggggttggggggtaggggagggatagcattaggaaaaatacctaatgtagatgacaggttaatgggtgcagcaaaccaccatggcacacgtatacttatgtaacaaacctgcatgttctgcacatgtatccaagaacttaaagtataataattaaaaaagtggtaaaataaaatgaaaatcaaagtatttcttagctagtatatttcatattatgtgtaaggccatagcaaaataaatcagtatatcttggtggcaaatgatcaattgacaaagccttctagaatgagtcatctcaaaactggtaagaaggaagtcactcagtataagcagaaagggaatatggatttgacagagtattcaaactacaccgaagcttaaacaccactttactgttcattttatatacaatagatctgaactctaagaggcctgcaatcatttaaagttattgaattagtttatcaatagattttaagcattaatttggttgagtctcattctgaactccttcatgctatacagtttgcacatggatgatactcagatgaagtattctgattgacttttctacatttcacaaatcaaactcaaacaatatacaatcatcttgaatgaagtggtatgagattagtagcaaaaggctgaaagaatcagaaatgagttctaatactatgtcattgataaacaatggacattttaacttcaggatactaattttgaaaatggagacactacattctgttcaactattgggactataaagaaactagagtaagatcatgaaaatggtaaatatcataagttattatctccaattatcacaggaaagtttgcaattaaataccattttccttaaaagagtaagaatatatttcaactatgaaaagtttttttctatatatgtatttttttcttaaagtggaggtacaattacactacataaattagttgagaatgccacaccaaatattgtatatgcttttctcagggatgcataaaagtttattcttgggtgtgttctaacttcaaagagaattttgtctgaaatatatgggacatttttacatctcaagcatataggcaatcatcataaaaaagttatttagtttctagtattaactaaggctttatttgatagcttaatgatctttaaaataaaaacaaaacattgccattttctgttgatttagcctctcttctatgaaagtctccaagccccattatcacaccttctaactttttttttcttttttttttttttttgagacagagtttcactcttgttgcctaggctggagtgcaatggcgtgatcttggctcatggcaacctccacctcccaagttcaagcgattctcctgcctcagccttctgagtagctgggattacaggcatgcgccaccatggccggctaattttgtatttttagtagagacggggttttttccatgttggtcaggctggtctcaaactcccgactgcaggtgatccacctgccttggcctcacaaagtgctgggattacaggcatgagccaccacacccggcctacacctcctaacattttaaagtgttaacacaattcttttatttacaaaccttttattttgaaatacagaatcacagaaagttgtgaaaatgtaccagaaattcttgtgtgtccttcactcagtttctttctttgagacggagtctcactctgtggcccaggctggagtgcactggcgtgatctcagctcactataacctccgcctcccaggttcaagcttttctcctacctcagcctcctaggtagctgggattacaggcacatgccatcatgctcagctaattgttttttgttttttttttttttagtagagacggggtttcactatgttggccaggctgatctctaactcctgacctcaaatgatccacctgcctcagcctcccaaagttttgggaacacaggtgtgagccaccatgaccggcaatttcttacaatgataatatcctgtctagctatagtacaatatctaaattaggaaattgactttggtctagagattattccgacttcactggttttatatgtactcatttgtgtgtttgtatagttataggtagttttatcatatgtgtagatatatgtggccaccaccacagttaaaatacagaactgattccatcatcataaggatccctcttgctacctctctttggcttacacaacccctctccccactccatccttgagacttgtcaaatcaataatctattctccatctctataattttgccatttcaagaatgtcttctaactggaatcatatttatgtaacttcttctgttggactttttcattcagcatagttcccctgagatccatctaagttgttgtgtgtatcaatagtttattcctttttattgttgcatagtattccatggcataccatgtaatatgttatacactgtgcataacacattttaatacatgtattaacttaatacagtgttattaactctggaaacaaatttttgtttgtgtttcttcaaacatacagcttctaaaactgaaaatattggctaggaagacatatctaaattataaagaaccaattgttcatatgctatataaaaatgtttggagtaagagggcatactttcataaagtttttttttaagtcctaaaaagaggattttatctaaaatagaatgcagcttctaagttctaaaaatattatatatcctattgagtagctcagtttgtagctggaagaattgtgcctgtatcccagaaggtcttataaataatttattcaatttcagtatttaatttaattcatttacaaatgagatgaggttagattattcagtgtaataagaaatctgttagagaaaatagtatttttcatagttgattattatagtatcattttctttaaagcatgaaatgcatcttttaaaatattgattagagactataatgtaactttgctgtaattacaatacttgtcttccagatacgtcctgaaaatagttggattaaacaaattagtgaacatccattcaataaaatactatgtagcaatttataatgatgataaagatatacaatttaatgacatggggatatattccttagatgttagtaatttgcatagcaggttacaaaatagtttacataatataattatatttttgtaaaatgatacctatatatccacacaggcatacaaatcggaagaatatatacttttttttggggggggcggtgggggacagagtcctgccctgtcacccaggctagagtgtagtggtgcaatctctgctcactgcaacctcctcctcccaggttcaaatgattcttgtgcctcagcctcctgagtagctgggattacagacatgcaccaccactcccggctaatttttttgtattttttagtagagacaaggtttcgccatgttggccagactggtctcaaaatcttggcctcaagtcatccgctcccatcggcaggctgggattagaggtgctgggattacaggcgtgagccacccgccccacaggaagaatacgtaataattgtgtagtaaaatacatatttttaaaggggcattctgggctactgttgtgtatattactctttaaaccctttaaaatagtcttgaactcaatctgacaagattactgttctcatgtaagaacaatattttccttttactacagggtcaatattcttgcacaatagtattgcattcctttacttattcagctgtacctaattagttaacaagttcactttaattattttcataaaaataattccatttttgatgatccttccatatcctcatcatcaataaaagcagcagtcacatagcactgattaaagaaattacttcaaaattaaaactacaaaaataaaggcttcaatatcatagtttctctaaatgtatcaaattcagctgttaaatatatttagagcctacgagtgttctggtattgtcccactcacatcttatgatttctttttcctttactttttaccaaacaaagctgctgtgttatcatttaggcatttataatttattcctgcttcttattttacaacaactttcagtgatatttataaactgtggcatattagtgattgatattatgtataaccttgggtagacttctggcagggcttctcttctgctctctctcctgtcactactggcagcatatacaaattgttaaattgccctgagtaaagctttattgtgccactaatatctaattttcttttgaattaaaaactacctttcatatattaagcatcaggattagtacttcaaagatacccattataaaatttctcaattaataagatactcatagaaaaatggggtcaattattggcataattatattcttttaatattttatatccattaccattctgtggtcacaaaactatctcaaggacatactgtcttttaatttggaaaaaaaaaagttgagcaatttgaaagtggttgtatgaactacttacagaaaacaaacgtgaatcctacactgttgataatgactattacactactattactccttacagtaacagctaatgcttgtgtagtagtaattaccatcaattaccatctatctgttatgtaatttaactccttttgtcttaactacaaccctatgagttaagtgacttgcccaccaatttactggcttaccctttggtcatcagataggggaactacaactcagacccaggtggtctggttctgattacataatggtaaaatggttattacagaaatttatctgaatatggactactttgtgactaatattcacttgaattttgtgtccccaatgcttccttcatattcaatcttacccgtgcctatactaatcatcaacagtttagcttgagagctgcagcagttgactagttttccaacagctaaacagaagattctggctatttatatgagcattctcttaatgctttactatattatgaactgaccctaagggctaaatattatttacaaatccaagaatacaaattcataaattctagctatttttatgccaacgtggactgccaatttgctttgaattatattaaaagttcaaaaactttaaagttctttacccccccgattccccaacttcaaaacgtattagctgttacaattcatacatggactagcattctaaagatgtgacagttccctttgaaagataatgtttggaagtctcaagacttgaattccagtgtcatctttgctctatgatgctggataagttacttaaactctctgggttttatttaattcctctggaaatttaaacataatttttatgagaatggacttttctaagatatttttacaagaatctaagatgaattagagattcacttaatgatgactgtctgaaggaacatgcatgaactggtctaatttaaagagatttctttgagtgatctgtcatttttctctcctctttgttcaaattaaagaacaacaacagataacgttaagtatttttatacttcctaaaaacaactttaactgacagagtgaaaggtataaaacttcaccctgtaataaatttgaggccatctttagacagaacaaaattaatacggccctgtagatgaaagatttacacagatcgattttctgtgcccattgacagagcaactggataatctgtggtagtcttttacacttgagcagttaaaacctcagatatatcctggactgaagattggtcagcagttcttttctggtccatgaataattaaaatcattcttattctgtattctataaatatgcagagaatgcaagatttgaaccatatacattccgctggagaagctgcttgggtccaagcgaacctcatcagcgatcacttcaaagatcaattcttcatgtccacagcatcatgtttaaatgattgtgtgtgatccagctgcttcttgtctccttgttgcttcatgcatgatctttactcatgatctcacaaactatagtgcttcagtagtaattctgcattttgtgctaaattttaacagtgattgccattttataggctaataggctgttgttgtgcatatttattataacacttttttcttttcctatcaataacagtgctttgcttagataatgagaagcaataatctctttaaaatatttacaagtctattcatcatgggaaaaaataatcttacaaagacagccttctccactggcattgcttttgattgtcactctcctccctcttcccaagacaggcatttccataattgcatcttatctttttgtatagactgagaaactggcaataactatgcctgggcaactgttttttgaggaaacacacaaatactacctgataatgtgattatatgcaatgatctaacttgctcttacttttaggactattaataatattaatgattttaaaatataatattatcatagtttcttattctgattgtagagtgagaagaaagaaatgtaaaggtagaatataataatagtaatattgtctgtacttaattccttggatggcctttcttttttggtttgttttattttttattttttaattttattttaagttctggggtacatgcacaggatgtgcaggtttgttacatatgtaaacgtgtgccatggtgatttgctgcacctatcaacctatcaactaggtattaggcccaacatgcataaactatttttcctgatggtctccctacccctgaccacccccacaggtctcagggtgtgttgttccactccctatgtccatctgctgtcattgttcagctcccacttataagtgcatgttcttagatatactctcttactaatctgtgtagggtagattcactccctgaagtcactcatggggttctaatttctatagctgagaaatgccttttagatgcccttgttctatcatacaaaaacactgttacttattagaattccagaaaagtttcctaaacaccatcaaaaattgtatggcaaagaacatgtttgtacctcatcaaattttatttatgttttgattatctaatgtgctagtcatgtttgtgactttccacacgaaatgatttcccatgttttctttctaccatgcaccatccttatcattaaggaacacaaatacatttaatatcaatgcaatcagtgtagaagtgaggcaatatgacacagtataaaacaggcagatatacagttatatatttatcaacatgtcccatagataacatatatctatattccttcaactaaaaagatttgtttaatattgccatttattatcccatatttctattttaaaatgttttgcagccataaaaacaaatgagatcatgtcttttgcaggaatatggatggagctagaggccatttttctcagcaaactaatgcaggaacagaaaaccaaatactgcatgttctcacttattagtgggagctaaatgatgagaacttacgaacacaaagaaggaaacaacagacactgagatctatttgagggtggagggtgggaggaaggagtggagaaaaaagacaactgtcgggtactgggcttaacagcttggtgattaaatgatctgtccaagaaacccccatggcttgagcttacctatgtaacaaatcttcacatgtacccccaaacctaaaataaaagtttaaaaatatatcaaatgttgggataatatggacagagtctcctagcaaactttttttcagaaaattatagtccactttttgatgacggtgatttcaaaggaaactatacttgagttcagctgccaaatctttgtttttttttagatgcataacagttcaagtaccattctctcttattttgtcacctgggaaagaggtcaaaagcacagtgggacactttacggggaacctgagagtctaagaaccattcttacatgccattagcatatcaattgatcatgaacatttaaatttggtagttttaggaacttagtttccttttcctaaaatgaagactttggattagtctctgaagcaactttctgctcgaaatgttgatgaatccgaatcaccttttcattcacttgaaatgtaatgacgtttttgatgtctacgttacagagattgaagtaacgcatctttccccttttacactattatattttgtgatgttttgctttaaaaagttttattttttattaatcttcaaatttcatatttttatccttgataacttccttctagagatgaggccagtgataagcagtatcttaattctcttctgtaagtattttttccttttgcatatgttctcccattcagtacagatatcaatttagctatttctttattccagacacaattctcctctgagattttcatcaataaataaagagacatgctaatatcacagctacttgacacctaccaaaaccctcattaactagtggactacaacataagagaatgaacatattttttaaaggccttattgcaagtcaagtcacaaagttaatacttccacatgtatttgccactcttttccttcaacagaaaaagaaattccagttggttgtaaagtcaaatctcttgtcttttcagtttaaccagctgcactctaagtctcaagacaactccctccttattctatgtttaattgactaccttccctatgccattatccatctgcatctttatgaacataatcaaacctccaacccttcagatcatctgtggggcattgctatcaccaaatagcaatttaatgctgagctttatctttcctggggattttataaagccttgaaagaataaagaatctagcagttggcacactcacttgcatgcaaacttagattgttaggaaaagaaaaaaacatttagataattaaataggatcatttaatagttcactcatttcataggatgagtgaggcaccaggggaaaagtggattgtttgagataacacagctagccatgatcccatgtaggagaataagactgctctaatatttcactctagcaccatccctattacatcacacaacttcccacacttccttcgtattttcccatgataaattataccttctgatttttccccaacctctcgaatgcccataatgtaactgaagaaatatagttccttaaaagtagctatggtttctaaaggcaactcaatgatttttaaaatacaatacaaattgttttttaagtgtttgttttgctttccagcttcaagcagaaccatcgatgtgacaaccgaagacaccaaagaagcagtcctttattattcaagatgtcattaaagtgcagggatcctaaaaccccattctagattatcccttagtatggatcaggctaaaatatttgcttcatgtgaggccctaggtcttgaatattgcatggtttcttgtactctgcaaatttcttctgaagaacccccttgggtgagtgactgttgtcagtatttatattaatgaacttttggagcacaggtatatctccaaagaggaaaggcctaattttgtccccagagctacaaaggtgtatggcatggctgacactccccagtagctgcccaaggatagcatggtggcagatgcattatcagaacaaaaagccaagagtgcccagagctgaggacctgatcaagtgaaacaatcagtcctctctgtgctactttgcaaatggttcatatacttttcaattagcacctgtcatctggatgcaccaattttcgcagaaatattttgaaaggacaattttatttcacgttagctggatgaaaataaaaccaaattccttctagtcagaaatatgtttggaaagattgaatccaaaggttcatatatccatcattggctccagatttcattataatgactgcaggtcaaggattcctgcaaagattttttaaaaaaatagtattttagaaatcatattttgaaaccaggtttgcttctgtttagttaactcccagagaaatatactgtttttggaactcccaaccccaccccaccaaaatataatttgcttttaagaatgtaaaaggattatggtttacacaagaaactaaaacaaatataagaagaaagtgcatgtatgccaaagtaatcgctctctctcttactcattctctctttcttatacacacacacacacacacacacacacacacatgcacactgacattaataagtcagtaatgagtatattagtgtctctatttaagttttctggtggaaaccaaactcttaatgctattttaatgaaggatttgtcagtgaattgtttccaagagtggtaagggagcatgcaatcacatttttataatgtttggcatcattttggggtgtaggaacaagcagattaactaactgaatgatacaaaatggtccactcctcttttcttaaaaagacacattgctccctgcaaggctgcatgaaatacaatttattctttttggacaatttcataaaacaaaagtggaaaattcatcctagaaaatcagatatatagaacactacaattttattactatttctggacaaattttcctaacatccttgcagccttctattatgattcacaatgtctgcaatgagagattagatgacagagtaacctattaaggaacagttactatgctgctggatgcagctaataattcctttatttttcatttttattactttatagtttatgaatgtacaatctactcattacctattataaatattttgattcagcaatggaaatatacaccagtaaacaaaacctacttgaagctttatgtattacatacccacccataaatgtatatcatagcatttgctgcctactagacttatttcttgagaatctagatgaactcttaatcttagctgtaataactacctgcaaacttagtatcatctctgctgctttcactgttttatctactgtctggagtcataattaattggcctcattactgtttctactatgaaatacagtcttctaagacattaatattttatcagagatactagtcttgacctaaaacagagaagaataaaaacataattgtgagttggaaatttttttaacaataacataaaataatcgatgttttggcaagaattatgacaaggctgcagatagcgacacacagctcactgagtgtaaatggagagaactaaacaggctctcattggtgtaacccttctaaaactctctagctaacattcatgccaaaacatccaatatatcaaagactttgtagcaatctggaataaaatcatttggtttcctctagactgtttctgcaagaagtaaatataacccagatacaatgaatgaaatgaaattttagtgcactgagttatggttttcaaaagtaagagcaactttagaacactaaatttaaagtcattcctaagaaccttctggaacctatgaaaattgtattaggttggcaaaaccttctctcgtcttcctatttctttttttcatttttcttgttctttttatcagtcaatactaaataagaatgtgctgcccaaaaagtgaagctataaatcgacttctgaaaagcttccctttttctccatgggtctctatttcattaggtcttcttttattttacttctgttgcccactgtttaatttctgaggccagtattttaatatcctttcaagtattgttttcaagatgtattgtgtagcagatcagtaaacaaatagttatttgcctcttactctatccaaggcaccgtactaaatgctatgcagaggtgaaaagtatgcttactgctatgcaataaattacaatctaatgaggagcataaaaaacacaataataataaaatagttcaagtgattttcaaccttggttgaacgacggaatcacacatagagttctaaaaagacttgacactaagaccttacctcaaaatccattaaactagaaactactgttgtcaatgtttaaaaactgaatgatagggacaatagtatggttaggatccagtggaagatgttctaaatgagtactcgttgtaaatagcacatcaagtgtccctcaagggcaaggatccagtggagctttaaatctacgtaacatgagggaaagtaatgcattagtactgttctaaagttattcatggaattctctcttctgatagcttattatcttctgagttcatagtagatattccatatctcaatgaactggttttattaggaaaagaaggtgtactggttatctgttgctgaataataaattaccacaaaactaaatggcttaaaacaaccatacacacgcattatcctcactgtttttaagagttagtaattcaggggtacttaactaagcagttcaagctcatggtctcatgtgattgtcaccaagtttctgaccctggctatagacagccaaaggcttgagtagggctggaacattagcttccaaggtagtgcacttacagagctagcatcacattgttcttagtccattggttttgtatttctccttttccttacctgtatttaaaagttttccttaagttctattttccccactgtgatacctaggactatcaagtctacttttattcaatacattgttactgagtatctctcctaatcaagacattatgccttctgtctttccaagcttgaatacatcacaagttaaagggggaaacacatttgttcacatgcagctactatgcctactgtactgttttaatttaccataatggacaccacaaacaaagggctacagcaaacgaaaggaggaatgattagttacacaggagtggtgtataggaagaattaaaaaagtaagctggggctgggcgcggtggctcacgcctgtaatcccgccacttttggaggcagaggcaggaggatcacaaggtcaggagatcgaggccaccctggctaacacggtgaaaccccgtctctactaaaaatacaaaaaattagccgggtgtggtgctgggcacctgtagtcccagctactcgggagactaaggcaggagaattgcttgaacatgggaggtggagcttgcagtgagctgagatcatgctactacattccagcctgggcaacagagtgagaatccatctcacaaaaacaaaacaaaacaaaaaaaaaggaggcaatggacttgagcagtaatgataaatttgagttttgagaggcaagaaaaggaactattgacttaagcctcttttctgggaccactggtactttgttatcctgcctgacacttatagcaaaattaacatatgtctaggctaaataaacatattaaggaggagatgatatatgaatataaagtatattaggggaggcagaccaaatagcttcaacatttatagtaaaacaaaatacaacatcattggtagcaagtgagagaggagggtttgaaaattcttaagatgtgaaaatgcatgaattttacttggaactgatccacatttttttttgtttagacttttaaaataactctatagcaacattcaataacttgggattgtactggaaaaagtaaacagtgaaagggacacagaccagaaaattaaaaatggctagatgtcaatgggagaagaaattgaaggtcccagagagggcagcctggaaaacggtaaaaaagatctcctgaagtctgagagggtataatgaatggcaaaactgtgaagagcctggagaatcaaggtcgtactgcaggtgaagagctagcaaacctattgccaggtcttctgataactgaattaaagtcataattcagttcttggggtcaaagattgaaaactcagtatctttttagcctgaagtcaaagaggaatagctattttcctcaagttttacaaagctaacaacagcaaggtacattggtctaactttttcttaacaacctagtgtaggaaacaaactctgaaaaaccaacagtcaaatgagctctacagtttgtgacatgggtctttacattcttgaatgtgtttctgttattgctgaaccttatttttgtacaagggtccatgtttgaagcatttgaaagatttgaaatgttggaattccatttttagctgacttttttatatactgagttttctaggcattactttggacaacaggttaatgcttgccttgctctctttggatgctgtctactccacacaggtataatcatacatacatttctatctagacatcatgaagattccacttctgattcacaagagctatcacaatgttgtacaagtccatattcttaggataaaaaggttaactctgtgtctcagctttgtgggcagaagaaaagagaagacatatgccctattatttgtgttatattacatgcattatattttcgaaatggcatttcaaagaaatagctacaaaatcaatagttcttttcttcttcatttttttcttagagctgaaaactgttcaacagctttatcgtattaaattaggctttcttaatcttaagcagtgactgggtgagttttcctggggaaaaacaattctgaattccacagtgtttaggaaataatacaatccaaatctgagagaaaaatttaacgccaatactgtgtaaatatttcacaaaatatttgttctcaaatattcaactttctatgtatacattatacagttttgactcaaagatcactaaaatgaacctaaaataaacccaccatggaatagtaacttccaataatcagtctttcgccttaagtgaataaggatcacaataacataaaatgcagaggctataaagtaaaaagcagcactcaaattgtagagctgggataatacaactaggtgaagttaaaatttgaaagaaataaatgggttggttttgagtgatggtactgcccatgattttttactttaaattttttgtcactattaacaaaaaataaagttatttgaaataaaaatataagaaataccgtgtgtgtgtgtgtgtgtgtgtgtgtgtgtgtatgtttgtatgtaagacatagaggaaaagacctaaaagatacaaaatgctaccttccaattcaactgtagctattggctctgtcagttttagccttccaagttgtttatttccatgagctcagacaaattataccactgactcatgtgctgctccctgggtgcagtgagaatattaacctttagaaggggccttaaaaatgagaagtgttatatgaattgatattttagttgtgtgttgtgtataaacttttctggatatggcttgccatttggttgggtgcttatttttggccactcaatgtgcataccaatgtgtgtgacttcatatatgggaataaatgttggcatttggattatttttggccaaagagtgggtgagaaattagacacactcaggagccaaaaataaccaaatggcaagccaattacataaatgttttctggcataccaaaaaaaatctggattagttatcataaaacaagagttttagttccagttattattactattactactactattacttctggtgttattcctactaaagccactaatctctattagacacttatgcttgttaaatttataaagtttaacatgaatcattccatttacaccaaacactaatcctatatatgaagtgaatatcagtactataaatacatggatatcagtcccacacaaagacaagaaaaattatgcttagaaaggttaagcatcttagtagagtcacacacaaataagtgacagagttgatgagaacccagacatactgaaattaagaatcagacaattcatctgcatggaaattctgctactaatatatcatgtggccttgagcactcatgaaaaactttgcattttagttttatcatctgaaaaatgaaaatgagtatatgtgctgtagaacatgagtgtaagtgctataaaagtagaaactgatggaatgtgtaaagtggatgattactgaaatattttccctttcctataaacctaatagatcatttattcttgcatctgagaaaaaaatactaatgatcaacagaagactacatgaaggcagtaactctaatattttcacggtattcttcaaagtttgaatatacattatagttcatttgaattctttcaagaatgccaagaaataggaccttcaaagtgcaacatacggaatatatgttataaaattctatgttgtataagtcacacagatgtggagaatggaagaaaactggacatcaagcagctaagcactttccacacaaaatcttgtacatgattgcttataatagcattactcatgattaccaaaaggtggaaataacccaaatatccatgaattgatgaatggataaataattgcagtatattcatacaatggaatattattcagtatttaaaataaatgaaatactgatacatgttacaacatggatgaaccttgaaaacactatacaaatgaaaaaagcctagtcacaaaagatcacgtattatattattctatttatatgacatgtccagaattagcaaaggaatatggagaaaaagtagtagttgtctagggcttgggagaaggagagagaagggatgtctttcagggggttccaaatttgattatggtgatggttgcacaactccgtgaatatactaaaaatcattaaattgtacacattgagtaaatcacattgtgtatgaattatatcctcataaaacaaatgaaaagttcaccaccacctcccaaagaaatactagaaaacttatttatttgcaaaattttcaactgcaaaaattatatgtgtgaattcattaaacacttatacagtacaataagttatacatgcatacacacaaatacacacacacacacacacacacacacacacacacaacaatttttttcctaactagacattttgaaaaccagttttaggacaggttgttgtaaacaaaagtattcacgaggtggtcagaccaatttgaaattatccaattggcattttcaccatgtctcatgcaaatgtatgtcagaagataataagatctcagaggacatttttttctttctagtcagctgcatctacccaggcttaatttcaatctattgctcctcattatatccctttggagagcctaattccattccccacttgatggccataccctctgtctaaacctgagcatcagtataccacatcctctgcagtaatcacacctcgggacagcacattaaaaattacctggaactcccaaggagctgacattatggaccctcaggttgacaatctgaaacaatgtctggaaggttttgttttgttttgttttcagctttgctctactattgaagtaatgtttgaaaacgtcatttgttaaaatgttaacaaagcaaagttatatataacatatatagtatatatttaattacatatgcaaatgtaatatatattttatttattatgaattacacaaacaatgtgtgtgtatatacacacacacacagaaatgggcagtacacacacacacacacacacacatacatatacacacacatacaaacccagtgaatccgaatctgagtactgcccattttaatatcatgtcataatattgaaattaatatactaagtgtacattaggttaaaaacagctgctcttctagcactcttcttcaagaaaaaatacatagaagaaattcataaaagtatgttagatgctaaaatctaaaattcagcagggacttaccgatggggtataaacaagattaatcaatacgatgtgctagatttcaggagaggtaagacacattcaccaaactatcttcacattttatctacctgatttaaaatacaaaatctttccatgttagaacaggtgtatgaatttactaagagtataagtagaaactgctattaaattgctgtggaaatacttttcatatttacctaccttgtcacaagatgaattttttaaaagaatacctctgtaactcacctcttgaataatcccttgtggtcacaatggaaaaaatatttttttattttgatacttactgatacatgttatgccttattatagtaacttaatatatacaattaagaaatatatatttatatatcttccccttaatcttcttaaaggaatttggtattattaatctactcttaccaataaggaaacagaaggttgcagatgttagataatttgcttatgattccgtagctactatgtgacggaacttgactttgaatcaaatattatacttcaaaggccatctatgttctttcaagcatagcagttgcctccacaaaagcattctgatcattgaagagtctaaactcaagaaacaaaatatgatcggctttagttcttctaataattgttctaatccatactattctgaatcagctatcatttgggaaagttctcttaatatcttggcccaaagtttacagctttttggccatttcaaatctcttccctgctattcagtaccacaagttagggcctttgttgtttccatgtagagtaggagggacacaagcctaggttggtatatggtttgaagacctgcttttcccctttcttctaggcccagcctcttcttagcccttgggtgaagaagaggagaaaaaggcaaaccttcccttcctggacttggtgagctgctgtgctccactagttagttgtggctggcttacagcctgcaacggttggcaggagaacccactgtctggtgtccaaatgatggtgttctgaaatgcactgctcatttccctccagtggaagactgaatttccactcaaccacttttgcaccttctcagccagtaactcacactaccagggtaccctcatccagtgggcagacctcttatgtactagcacaatgaactcatgcccagcaactttctgagatgtccaatgtatcaatgagagatacagacatcttcatctcacaaacagtgagtgtacaggttactgcaatgctgctacccttttgtcagccctttactgaccaagcaggtatcaaatgaaggaaatacagttccggtctccctcctctgaccattcttgcaaatctttgtaaatctttctcacagggtatccctttccagttttgaaaaggggatatagcttttcttccagcatatgacattcactaaaatgctatttgctccatttctcggattattttgatttagagaggaggtggtggtggagggtcttggctcctgtccatgagcctgcaggggctgtactccaccctgcttcccagaagctcttagaaaatgcaggtcctgaatatccactgtcctcagtttggggtctgagctaacattcagggacaacaagcaaaagctcatcccatttaattacacttgaaaataacacgagtcctttaagttgtagcccaaattttaaaaaatcaagctatctttcaaaacgtgctaacattcttgcgttaacacatttgatgttaaaacatttgggtcttgttcattgtctctttgaataagctttaatagatatttctcacacaaactacatataatatagagactgtatgtaatttccatttcatatttgcagcaaatgtgacattttcctttattgcacacctcttatttcttcattctcaactctttgaactctgaaagcccaagccttaagtcaaaaaagtatgagaatccatgtccacactttaaaaaggaccaagaacacaaggttgtgaactactctaaacactgaaagaacaatttaagtatttctatagccttcacccctggagtactccacttctttgataaagtgactatttttgcaaaaagtctagtgaagttcatgagtttcacttctctcaggttgagagaatgagttaacttggactctagcgttcattataaacactagagatttaatatatggccaaatgccagagagtctaattcaaggcattaacataaaataataacagttaccatttatgcaatacttgtggtgcactagcactatgctaggcccttcacaggcctagtttcaggattacagtctaactccatgacgtgggtagtattggagccttcattttacaaacgagaagactgaggttgaggaattaagtagcccaaaactgtaaaggtggaaataattggggccaaaattcaagtttatcagttcaaaatagtttttgaaaatctaccatatccatggcataggtacttaaataaaacaaacaaaattataccctttgagaatttctatttggttctgtcacaacacagtgcctacattcttacaactaaagtatgtatgtaaataagacatgtttcaataaaaacatggaaaacatttaacagatatctgatttattttcattaaacaaataatagatataacttggtgttttcaaattatttacacttgttgcaataaaaaataaaatgagaaatgtcatagatttaaatctcagttgtacttaaagcctctgcaataattcactttgtaaccactgtatatatttattaatgaagtattaaaaaataattgtgctatactatatatgtactgttctatgtattaacgataatgctgtattagtgatcttattaatgctgtttatctctcaactctctaacagtatattttccattcaaaaccaaaattataattacttgggtaaatattatcatttacaggcaaataataagaatttgaagaaaatcaaaacagaattggtccagtcaagcccaggcaatgagacccaatcacaaattcgtgcataaacttttgcctaaagaatagccttgttttgttttctccttgtatccaatcttaaaagtgttttaatgaagatttgaatattaagaattcattataaaaataacaactcatcatcgcactgtgtttggtttattcaaaaaactctaaagttattaatttcagcttcctaattagaataatccaattttaatctactggcatttttggagatgaatggattggtggtgcattattctaaaagttaaatctcattaatatttaattgcacccacattcacaggtattaattagaagtgttttatgagtcatagctattattggaaaatcaggtacaattttataattagcataaaatgaactgtaattttgaataatcactgatagtgatcatttagtagaccttgtgagattattaaacttgttgatccatataataatttatatgtagactgcatatcaccattatagtgatacttttgagacaattaaaaataacattccctttcagccaagcaggaacacatatttcattgttgttttgactatgaataaaaaccctttctgctgaatacattttaaagcagtagtagaaaatagataatgtactagttatgaaattgaataaagcacaatcaaaactataattttattgatatttatatattattatatgtttatatcaagatctttcaaataaaagatatatttagcttttaaaaaataaaattactttcacatacataagacttgcactttgctcaaacacacactatttaagtggtttaatcaagtctaaataatggatagttactagaaattcccaaacaacaaaatgacacagtgatatataagttaagttctattaaagagaaagcttttgaataatctctatccatttttctggctttcataataaaatgtggacataccaaactgacttgaaaaaaatttaaaagtggccactagattcaagggaaactttattttaggagaaaacttgttgagggaagttcctcttataccttatgtaagaaagcccaatataagaattaaccataggaactgctgaaaaacctccccttaaatgggtagatgggttcagtgaaaaacacacatgcacacatacatatacacatatacatatgttatatttatatcattttgatatcatgcttagagtatctgtatcctaaatttaatagaacattgaaaataagaatccaaaatagtacttaataatcaactatttcttcttaagatgaaaatattcatagtccctaaaagatgattaaattcctatatcaacagactattaatttgaattataaaccttgtaattttcatattaaatgataataagacaaatataatatgcctgtgatttccattataacagcaaaagaaatgtgacgattcaataatcaaatattttcatatatactggagtctataaagcatttcatataggtaaacttgaatgaaacctaatattatatactaaatactaaggaaatatcgtcataatgaaggttaaagtttagagataactaaaaacaacagtatagtatattctgtaggcaaatgtttaatgtatcaattatacatattacactcttggttataaatactaaatatctcttagtcaaccagactccatttgatgtgtaataattttgcctcatcaagaagaagacagggtaaaaaaagaacaggaaatacgtgttcttcgttcatttaatacatataattgacaatttcaggaatatgctgtaatgtactctacacaaatcttgcatttcctttggctcattcatgggagcaaatcaatatgaattcctaatacatcttaagagctacactagacagaaaatttttgcttattggcaaactaaatccactatatattcactattaaagtttcctgtccttaaaactgtcccctcaggatttaatttaaaagcatgggattcactgaatatgaagtatatttttccaaatttataattgaaaaacaaagtttgtgagtcatcttttttcagttttaaattctactaacttctttataaatgtcacagaaactctcagaagtagaaaatcaacaagataagcagtttcatggtagtgaaaaaaatatgctttgaatttgcaaaaaaaaaaaaaaaatgggtttgcctagaaaagatatcaacactttaattccacagattatttcacccattaagttagcattccctcttcacctatatggctaatattaaaggcctgtgtgtgaccctacaacttaagtcttgtaagagcatcgatttgagtctggttttttttttctctcttctatacacagcctccaggaaagtccccaaacttagaagtttttgataaataactgttaactgaataaatggcaaagtttgtcatttatatgtttatttaaatctgtagcctcaaaattggtaaaagaagttgaaggtggtttgggacattacagttcctttatctgagtgaacgaggcagaggaggagcattcttaggaaacaaataaaccaaaaatattactcaggtcagcttgaaagaaaaaccaagggaaaggaataagatgcctttgtcaatcacacacagcccctttaacctttcacagtttgcttgcattatatgaaacttcaaggttaaatgcaagacaaatgtgaactgatatttctgcaagggtcaggtaggtaccagttgcaagtcattatgattgcaaagtggttcttcatcatgagaatttccaaactgcaagaatatgcctgcaggctttagtatgggaaacactcattaaagtagtaataaaaatatcacctttgaaattgtttcccagtttctaattcccctaagatgtgttctgtctttataattgctcatagaaattaacattggtaccatggcagacaggagctggttgttgtctttgacattaggagggtgctgcacattctggagatcccaagagctttaatttgagaaacagtggtcaagtgaacgaggtgagataatatctttattcattcaacaaatataaaatgaacatttacaataagctaggcacggttttaggtgctggatatacagaagtgaaccagacagacataataagttcctcacttatacagtttgcattctaatgatactttaaatattgaatacattttatagaatgaaggaataaaagctatgtgactaaggatataagaaaagacaggaaagaaaaaattgggatgaatatattgtttgtaaaaacaatggcactatggattgtatgtgaacttcagcttgtgaatttctgctataattgattttcctatacaacataatagaatgataagactgtataatggatctggaagtttcgttagtccaggcagccctctgatgcttaatctttccacactctacacaaaggaacttgtaatactcatgacctcttgaggtagcccattccatttctaacccaccgaaatttttaggtatttctagtcaattaattatcatgcctcctcgagtcattagctagtggttcaaagaatcttgtttggactcctaaccaagaattctaatcacttttaatttctttgatgattttataatttaacttggtttcaacttttttcatcaacttcttgttcaactctgaaggtattccatttaaaaagtgtgacaagcagagcactccacaaaccccagcagagtcaccactgcagctaagaggaattcaccacatccatctttctaaatattaatgcatcctaaaattgattagttttacttggcaacttcgtaaaactattgacttacattaagtttatgctgattactaaattgtaacagtttatttagttgttgtttattttgtgctttacttaaatgtgtccctcagttttagagttgtcagtcttatgttcttggatttgatacttcattctagcttgggatactcatattagtcataactttgattttcagcttatctacatactgagtaacaatatcttcttttattttaattcaagatattggataattttcatcaggccagggcaaggataaagccctgtaggaagaactagcaatctcactctgtgatcacaattcctgaacatatccagtaattgtccctaaatgggaaagtctttagcatacgtctttctctttttcaagtagattgcataaaatatgtatcagcaaatctctaatgctaaatattttcggttccttctaatccaatcagcaactctatattccatactttcagcatttaatgagtaaattaccaaataatttgggtcatttttgtccaggtagagactgatgtcaacattagtatgactaatgtaagcaacagaaacaatattaattccagcaggcacagaaaaaaatctactgcctagttataaaacagaattttaagataattcaaatatagtctgtattctagctactttcaactcttaaatagagagcttgacttctgatttttctaaggagtttactgataatttctctctagatttcatgcagaagtcataacatatcctacattttattttttaagtgactataagataatgaaactgctttcttgtatgatttttggaaaccacatagctctgtattgcaccatgatgacttcaatgtttcaaagtacattcacatcctgtttcattcgatcttcagaataattctataaggtggataggaaagtattattatctcgactttataaactgatgcagggtaaaataaaatatgtagcatctctaggactcagctcactttaatatagctaggtccctgatttgcagccacattattacctgaattgtacatatcacagaaatgagacagatggcggcaaccctcacaaaattcattttagataatatgttatttatctaattaccttcctattcctctgagagttgaattattttatctgatacagacttcctttacgttttcttataatggcattaatgcccctttacattccacctccattctaatcctactcccattctcctgattaatgtgctcctgtctttcttgtattgcattaaaagaaaaaggttattataaggctctgaaggtaaagaatgttacatccttattacacccctggggcacattttaaaataaaggcctattataaataaatactatatgttatgtgtcagtgcgattcttaaagctcaacaaatgaatccaattcatattaacatgacctgctaccaagtataaatattacagcttcctgtgtctaacattgtctcaatcaaatattactgggtgaaaacatttaatttataaataaaaatacagtaaaaaagtaatgagattgaaatcagaaaacctaaactctgatcattgcttatccttttattagtcatgccatttatccacaggccttaattttcttattcatgaaatatgcacagtaaaaagaatttctgtaccttttgaagttgttttaaaaagattatgtgtataatgctattaactttaaaacaatatttaaaataagacatcatgatattaataataatattaaaaaatcaggacaatctaaattaaggaattattgttaaatagtcaaacttctgcagagcaggcaattatttttatccattcttcagctcaacaacatgtatctcatgctttgcccaaccatatagccttatgcaaagtgaattctccaaagaaaatttaagcaagtacataattggcatttttcagctgatttcacaactgaatgtggttaaacctcatattcagttggtgacattggttaaatatttcaaggaactaaatatgcttataagtagataaagaatggagggagtgaagcaaagaaaagatggtgtcagaaaagttatttttaaaatactttgggcctgatacagtggctcatgtctgtaatcctaacacttagggaggctgaggcaggaagaatgctggatgccaggagtttgaggctgcagtgagctatgatcccaccacggcaccccagcctgggtgacagagcagaactccatctcaaaaataaataattaaattaaattaaatacttcagtgtcaaatgagttaattatctcaaatgtttataaacatcttaatgtttataattttaagatacttgttattgttttttcaaacttaatgctctactttgaaagagcaacacagtatgagaagaagggttcaatttaagatatttgattttgaagttgaatgaggatactgtatttaaaggcattgagccatacctctgaagtatttaccaatcggattttgaaaacagaattattacttcctttgaaccacttttaattttcattacaccaaatgaagagattctacaagatctacatttttcaaataatggaagtgagcagagactgagacatgccaacagatagagttttttctttcttatttttctgttttcaagccattatttaaaaaaaaaatcagagtgctttattgagcttagaaagacacagccttagggaacaaaatgactacactaattttctgcatatgctagttgggtggaaagttcaacacaagttttaatgatcaatgatgccacgttagcacactttcaaaaagtggatttcagatttgggtgtgattccaaacatgcacctgccatcctcaaagcagagaattcaggtccagaataatcacaagttctaaattatacacagtgtgttgtgaaatatcattattatttttagaaagtgaaaaaatatctgtgatagaacctatttaatgttttgtcagcctccacagatgtggctaaaaacagcttcccagtaatactttcaagggtcaaaagcaatgaccttgtcatgtttctgtgatcgtggtaaaacacctgggtcaagacactagtgaagattaataaggtaattataaaggaatcagaaatgttattgtagcaaagcagatgtagcaaaaacagcacctcctaatactattggtattgtcctcaacttttttcccaatccttgattatgaggaccaaaataaatatgttttacataataaaatttgctattattaagaataacaaagactatttaaaaagcagtagacttattctcaatcacatctttaaaaatcacctttgaacaggatgttcaacatgcatatcagagctgtgggagaatataaagcatgaccccatataccattgttattgctgtatctgtgcccattgacagttgagaaactaagtgattagaaaagacaaagcttaaaaaaacgtaaacttattggaccttcttttatctggctggatctataattacatgctttaaaactctctaggtatgtagttttttttaaaccctataagtaggggttcaactttcaatttagatcatgtttcagaaatgcctaaagagatggacagaccgaattataacaggggacctaaagaaacagtcctaggaaagcgtgcattctgtgggtctgtggagcaagtctgtcaacagaacgcctggttgaaggtcatctttccaacccagagtcctatgcagaaagaaacttaacagcaaagctttagactcttacttgaagtctctctgcagtatgacatcacttgcatacttattaaaatatttttgccacttctcttttcatctaacttattgttattgaaaaactagataagatatttcccatttagccattcatccagaaaacatttactgatgcctagtaatggctatgttaaaaggcacataattagccagacacaccatgttgtatctcaatttagctcattatttctgatggcctcctttgttttcttctgtttggcacactcctctcccatacatacctgaactacctcctctgcaaaggtgctcctgaggcatcaaggcaaaattcactcttctttcttatatgctactattataaatttcagtgcttccattattgtctttacatcattttattaaaattatttcttcaaaagtcttaatggagagttttcactattcaagtttattgaagcatatgcaatatctcatccacatttctatcccaagaagctaacaaggttctgttcactttaaagccctcaagaagtgattcatgaatgaacgaaaaactttccaccttcagtgggaattgggtgacagttagctcccagacacgtttttgaagagatctaccagctcttagtatgaataccatcctttctgacaaatggtgatgattctctcaaaatggaagaatatctctcacattctactggagatttgaatgtgttctccttaaagttagcaccttctttttttttttttttttctttctcagaatctaaacgtctttggtaaacttcatatttagccacagtgattatagccccctccccaccacatacccacggttttggagaaaaataagtttgtttatcttggagtctaagacagaatctaaactttcagcaaggccatagcttatataacagcattactcatttacttttttaaattagagtatctttagtctttgattaggggttggaatacaagtgagcctctaagggaaataactgcctttccaggtcctgaaacttatctgagatagaaaaacttcaactttgtacccagtgacattttagttaaatataatttaagattctatggattcctgttatacatatgcaaaacaaagtaaaggtgtcctttccaaaaatattcacttttattccatattgtttaaatagttttcaagagagatattccaatagcctttatttttttttcttctctattgccaatggatttaaatgtttgcttcattgtggcattccaaacacacaaaactccagtggctatgggttttattcctttgagtgaatagttatcgtacttcaaagactgctttggattttaagttagggtgacctgttttcattatattcaaacaggctttgatccatttctcaattaggtattgcagatgacaaacaggtacgtctagctttcctgccatctaaattaccctagaattctatgaagatgataatttgttctgtgagtacactacttctatgtgttatccacacaaatttcattatttcaagtattgtctttttatgtatctcttttgtggggagactaatattccaatacaaaactgtgttctgttttggggaaaaaaaaaaaaagagctcttagacagtcagaacatgagaagtttaccaaaaataatttgtcctcaagtctagttgataaaaaggccctatgaggttagatttatacaattttattggcaatgacaaaatctagaataaaatatataattattgaggtacttacatttttagtataaactggaataacaaacacatcaactttacaaacctctcatactagtgtctcactttaaagatattcttaggtcaaatacagtggctcactcctgtagctgcaacattttgggaggccaaggcaggaggatcgcttgagcccaggagttagagaccaacctgggcaacatggtgagaccccatctctacaaaaaattcaaaaaattagttgggcatggtggcacatgcctgcagtcccagatacttgagaggctaaggcgagaagattgcttgagcctcgggagtgtcgaggcttcagtgagctataaccacactactgtactctaatgagaccttgtgactatatatacatatatatacacacacatatatatataaaatctctctctatattatatatattatatattatatatataatatatatattatatatatataatatatatattatatataatatatattatataatatattatatatatatataaagaaaatattcctaaataagtggctctcatatgagccacaatttaaggaatattttcttaaaggcagacttagagagaaatatgagtcacactaacacaaagcataatcagcctaactcctcagtcaaacaccctgaggttcacattaccaaagagagaggtttgaacatgagggaaacatattattttcactatactgtgatggaaggaaattaattctggttgtgcaaacctagagcatttctctgaattctctgaactagggtggattgttaagaccaagacagagtgtgcataataaccttgatgttgggaaaagactatgccgtgagtcttaaaacagatcctagttgatgattatgccaaccctgctgaagaaattctgaaaagatgcagaatgccttgaaatacaaatgctttttctggcccagataattgatattgcattagaacattccatgggatttgaaccagcctctttcacactttagatttcaggctagtataattccctcaccacacaaggcagaaccgaaatccctgaagttcaacaggacgtatccaatttcaacaactttacaattttcaatatctgtacaggatttttgcaaaaacccatttcaaatatcccattatcagttccacgtctttttgtgaataccaaaatatattagctagaccgtcatcttattttagctttagaatgtatatcagattttttttccagacacaagcaattaaaggattggaaaatagctcatggaaagctccaaagaattgatcctcagagagcaaatcttgtaacaccaaacaaccacaattcccctaagccactctgctgacaaaagttattgctagttatgcaaggtaactagaagatatgcacacaaatcattgcaattaaatatcctgcccaccatataactgatacttgccgagcagatggttggcagaattttcttgctaatctcgtgttatcaatgtccatattgcagagcatccttgaaggtgctcctctgtttgttttgtattggatacacctatttgtattgttgtatagttatctgtgctgtgtgtcttacccagtctcacccagttattttactttagaatctcatgggctgtgtatcgtgaagacaaacaacctgttggaaataaacaacaaagaactgaatccctcttatctgttcgctgcctaacaaatcaaaacacactgaaatctgggattattagagaagttttggggatatagaaataaaataaaaaccagcttgtcaaatggggctgcctgctgctcagtaccatgtgttaccacagcaagttgcatctgttcagctattaaacctgttagtgaatataatatagacagccacggcattaacaaatattcttaatgcctattaaactctacagctacacattttaatttttacattgtattagtaaaattcaagactatagcacctttaggacaatttaaaagtgcaatgaaaaaactataattttggttatatctcacatgcttaaattatatttagccatcattttaagaattggccatttaaaaaaaagttctttaatttttaaatgtggttctcactgctaactgtaatttagctcactatagatgcaataggactgaagtaattaatcacatgtagaatttgaaaaactcaactaggtacatcttttttccactactgaacatcttacttcctttcgatttaatattggctattagcaaatgccacagaacatatgagttactcccttgatataatccaccctctgagctcaggctcaggaacttcgtcatttaaattggctatcaacagctaggacatgtatgttttactaaacactttatagcagaatacatctgttgctactctgtttgttatattaagattaagcacaatgatgttgacagtattaatacatttaaaagcctgtcacgttccatggtgttcacgagtcctggggactgcaggattgaaataaaaagtgactagaggcaaaattaagaattatggaatgtgtagaaggtgaagaacacagaggtagactctgaaatgagtactgctacccaggaggatattaacctcttgcctgcctggcttttcccataatattgtgaagccacattttactgaaaagagccgcatgcttcatgaaatagttatccaacctccttggcctactgctgcttcatgaatgctgccagaataggggaaagtttgtgactgaagttaaaggggggttggtttcaccgctatactagtgtaattattaaaatgcgaacacactcaaattaaatacaccagaaagaaaatcattctatggagctcagtttcctaagaaataatgagaccaatttgcttttatatgaaaacactccagtttgtgatatcttcatacactgctggtgggagtgttcaacagtacaatgttcttagaggacaactcagcaatatatacattggttcggcttgtatgaatttgtacataaaaatatgcttttacacatgtgaaacgatatttttacaagattttaaaatgttatccatttgtaatacttaaaatgctgaaaaaattaaaatacccatcattagggtctgctaccctcataacatgtagcagatgcatgttatgaggtaaatatgagatcatatgctctaaaatgaaaagatgtacaaaatatattaaataaaaatactcaagttgcagaatagtatgcacatgataatatttcatctttttaaagaatgttcaggtatgttagcatatatacaaatccttgtacctatactatacacaaaaaagaaattgaatgtatatgcataagattaaagattagagttttagacaccacagtaaaaaagtgggtatattatatgctgtttttactttttactcccatcattgttgtattatttaaatttttcaatacaaatttttatgatttaaaaattaaattgatttaaaatatgggctttcctgaaaagtaaatactttcatccgtaggcaacaaataaaattcaattccttctgaacagcctgtcataaaatattattggccttcaagaccctacagtatgcctcactagtctattgaatctagtttatgtctggatgcttagaagaataccaaaaaattagtaagttaaaaaaaaagttaaataatataaatacagtctactgagaaggacaaagttaaggaaaaactagttaaatatggagttgatggttatagcatgttcctcacataacaattaacaatatctacatagcactctcaaattccagaaacatccccagccactgcatttatccaacacccttctcaataaccagttacaaataatcaaataaccatcggtcttgatttaggtatttggaggcggagctagaatttacaactttttcttcccaccttatgaaatatctttgcaatacctgttttttaaagatcaaatgaacacagttctggagcctagacgagtagctgtctaaccttactctgcgtaatagggctaaaatttcaactctatttctctgctgatgctctatgggatttggagcccccaaagcctgattttattcctaattaacagtaatgaacagatgacatacttttcctttgaacacctctgtcgggaaaatgtccaatcagcaagagctacaagcaatagacaaattccctttctctgacctcatttacatgcttaagtacacagagactccccctgcctttagtttggggtgcggggggaaagaagtaggtcaagacattgaggctttatgcattacctttagaatgtggtgaaggctgaaagtcatggctccaaccagagtttccagagcaatgtgggttactttcatattcatcacacataaggccaataccctcctagcagtattagtttagttctacatttaggcacaactcacaaagcagcaaagatacctataattgtacccattaagagacttataatagaaaatactatgtgctatgtcatcacactttgttgttatttagtgcattcaccttgagggtcacagaatctctggaattccatgtttaaggaatatcataaaataatacactacaaagactcactggtttcacatcagtagttgggattttataatcatttgcaaaataagctgggccagcctgaaattttcctttgtacaaagaaaaatgaagctttgaagtcatatacaactggttcaaagacaggcagttatttactatctgtatgattttggtcaatttatttataatgcagtctgctcattggtaaaactgagataaaattcatacctcaatgaattattgtgaatatttaataaaatctaattttatgcaaaatgtttagatcagtgtgtgttccacagtaagcaatcagtacactctaaagagtattgtttagttaccgttcttctgactaagccaaataatagggtaagcatgatttcagagggggaatttaaccctacttcagatgattcactgatagtacttccaaacatttaatatatattaattaaaataatttttacaactcaacaaatggagaaccaattttacctccctcagctaagccaagtgttagaggttggcacagcagaagattaaagagagagagagagggagaaagagagagagagagagagagagagagagagagagagagagaatggttaaattgccagggtagtggagattgatcatctctacattcctaatcaattagggaggattactacaggacagttttttgtttgttttcattctcctagtggattcttctcttctcatcaagtcaggatgcagggaaatatatcacataagtttttgtgtagatattagaaataaaaatgatacagagaacagacaagaagcatacctagactcagagaaatgatcacctgtgtgtagtatttgaatctgaaggtggagctagccattaacaaaagaaaagtcttcctttcataagaaaataacacaggaaaaatgaatccatttcatgacaggcctcagtcctcaggcctctgacttttgtttgcctcaggaggttgtaaatgggaagtcccaggagaacatcacgtgctttcacgattatcctttggtactgtacctcatactatgctccaaggagagcacttctggagtgagcgcctgcatgacaatggaaaactaccagcaggagggcaagagaggccacagtcaaaagtaaagcagcaagagttcacttatttctccattcactcaggtatgcattgcttcctctgtaaaccattactatgcatctactaagcaccatgctagagtatgaaaatacggacatgtaaagatacatagtattatacattgtcagtgaccctgaagagtttacaatttaatgggctacaaggacatataaagacatagttataactacagtaagtaacacaataggattaagaacaaagtattatgattgtaccaagaagggcataattagtcttgccctaggggacaaaggaaggtttcacaaatacataaaatatataatccaggcctcaaagatgaataaaaaagcaccagactaggaaaaagagaaggacaggtaggaataagaggaagtaggagtactttaaagaaaggaacagatatgaacagcggcactctggaggtctctttttgctgactctcattattggtacatttttttaaactgtgtttctcggtctttaaaattatttatgccccaaacttacaaatcaaactagttgcaaatgctagctagctaaccacaaaatctttggggtaactggccagtcagataacttcctatgtatttatttaactagagaaaatgctttatgtagcagatatctgaaatgctccataatttatgtgatatgtggtatactaaagggtagggttgtttgacttcataaaacttcattacacagaccaaaaggcagagttatctcgttcagcctgatgagggattgtctcctgaactctcacctgcatcacagaaggcacagtggttaagcacatggatttaggagtcagactgactgagttcaacactggttttgcagctcactagttgtgtgactttcatttcttcattaactacctgagtatatattttttccttttgaagttttaatgcatattagatggacttacatatgtaaacttagaacagttatgagactgttgattgcttttataaaagccacacttgtagactgcttcatagtttaaaaacttttaagtgtgcttttacagtgtgaggatttgaaatatcagcctattttctgtggctaatgtgccagtagaataatgattatgtagtaaattataaggtacttgaggtcagaagccatgccacatctgactgtatttctagtgctttggaaagtgcttagcacttagaagaaaaggaggtagaagagaaagaagaagaaggaggagaggagaagcacaaggaggagggggagaaaattttgttaagaacatgtattaaagagtgaatgtgtgtgaggtagaatgtggagtagctgaagatgaggctggaaaataagtctagattgtgcatacatcagaggtccagctaaggaagttggcctttgaagtatttgcagtagaccactggttctctatcagaactagaatcttgcttcaagataccaatctataaataggtaacacataaactggaaacatgctgatagttagctcagatttgtatctctaacccccccaaaacacatttaatataaactggcttctgatattgcctttaacctgagcagcaccgacctattgccattgaacattttcagaacacacatagtttaagttggtagaacttccagaatgcaaagattatttcaacaaatactgattgctcacttgctaaattctaggctcatgctgggctctaggaatactaaagtgcacgaaatagataaaattccctgctttcatgacacttgctgctcggcatcatgctgttcagtatggatgaagatttgccatcagagtttaaatactttaacctaattccaaattttgtctgcttcataaaattgccaacaaaaaatgcaagagtacacaaagacgggaaaaaaaaaaaaaaggaagtttgttgttgttattttgccaattttttccagacgtttgactttgctttgtcctggagaagtaaattactaagtgtccgtgtctataattttaataaataaaaattagtttctcttcatatgctattaaatacacattgggaaaaatacttaaagaatactatgagggggcttcaaattgacaactgaacagggagcccatgcccatctctgaccagccttgctaccaggtgagaggtggaaacacacccttgcagagcagtgggagaaaatgggtgaaaggactgatagagtaccaggatttgtgctttttttccactgatgagcagctcataagtgagcaaaattactgctgaaagtgggtgaacattatcagccaggtatgtcttgaactaaaagaggttgagacccactgtaactgaacatttgaagccagaggttgaaacaccacaattttattttataacaatcattctggtagcagtgcagaggatggattagaaagggaagatgctggaggcagagagattagttagaaggctattgcaacagttcaagaagaggtcattaaactaaggcaataatagtggaataaaaagcaagcagataccttctaaaaattgctgttcagtaggcaagccagtagccatatgttgagcatttgagatatggctaatgtgaccaaggagctgaattttaaaatgtatttaattttaattaagtttgttgtaagtttaaaagatactcaaacttttaagtatgtttagaataacttgagtatgtgaatctacttttacaactgtagatataacaaaatataaaatgcttctgatggaaaatttagattctgaaatgagaggtgttgttaagtgtacaagaagttccttgttttgacagcttggcataagaaacagggtttgctaaatgttaagtgtaaaacacacattggatttgaaaagcttattatgaaaagataatagaaaacattaataatttatatcatttatatattaaaatgataatattctgggcatattgagttaaaatatattctcaaagttaattgtatttagtaaaactaattccatctttttttccttttatatgagtagtagaaaattaaaacttacaaacatggctcatatatttctcttggatggtataggttgagagacatggtagcaattcggtgacaaactgattagattgtaaaggcaagcacggagtaaaagatgtcaaagatgtagcctgtgatcgtgtagatgagtgggtgattgggagatgatgagttcagttgttaatgtggtaagtttcagtcgcctgtgagacacccaggtagagatgctgagtaagcagttggaaatattagtatggtagtgacagaagtctgggatggagatgtgtctttgggagtgagcagccggcacttatttgatagctaaaattcagagtaaaattttaagtatatgaagataccctttttcataggccaaaagccttactaatcaattaaatttgatctttcaccaaacttttttgtctgtcaatcacgaatttccattctttattgggcaggaaggatttaagggctaaaattccaggaagagcccaccattaaagcatttacttagaagcctagttgcagtgtgatcttccagggcagttgagcgtcccccattcagggctgtgctctgttggcaaaaaggttagacagttttccagtttgttttgaggaggagagaggcctcctctgtgttgtcgatataagaatccctagttctggtctagcacaccatctcctaaagtaactcctagagacatcacaaattgttttcatcagaagaattttctcagaccccataaaaattatgtctagtcctccgattctaatttataatttggattatttatgtctactattaacttgagtaccccctatctatgcacctagattatttccttccattgtttaaataaacttgcccatgtctagagtgggccagcatcagcattaataggattctaatgctgtagaatcaccatcatcatcttgttttctggtctttggctgacatatttacaatgctgtttctattttgtaaccgctactgccatgcattttgcttatggctttcagcgcatttttttttgtgtgtgtgtgtgtaataaaagtaattttcctgatcattgtgcaaatgacccatattcagtatgtattccccaaactggttcttaaccctcaagcaatgtctttgtttctttttttcttccatcaatctatattgtgtttagagttctgcaaagcctccttaataacgtgcttgcatatagtttaaattattgctcatcatttcttcccgagacacacagactctgtctggatcataagggtaaacatattggatatgttctaaatacaggagttcttaaccattacttcttctaaaaattccagaataactaagatgctcctggattcctaagtcagtgtaagattataaatgtttgctcttttaagcttctaaattatggaaaaattggttacacaggaactaatcacacacattataaattgcattataggtgatcaaaaataatgtgtttattttgcctaaaatgtttcttaaaggtacgcttttgaaaaatagttagtagctatagaagaaattgtggtatagtcagtagtcagaaagaattcaacaagaagttccttgttttgacagcttggcataagaaacagggtttcctaaagccactcatcactggctaacttaagaatagatttgaagccattctataaaatagcttggggcccaccacaaagcagtgggtcaaaaggagtagtgatcacaggatggagcagaatcaatggacatgattttctccagctaggtaatgtcctaggaattgtttctgcaactcttccaaagagattccggagacctaacttctttctgctagcttaggaggtgaaaagatccaggaccaaccctgaaaacactcactatttgaaaaaactgttcaatgactgagtcaaatctatatagtgagagagaatgggaagaaatcttttgaacaggaattagaaatagagagatgacaagaagctcattttttaaaaaaagttaatatgtttcactggagttgaaagataagtagaaaaatgggaaaaatggacacgaaaagggaaagagatcaaaatgctgaagacattaaattttaggtacagaatttgcctttacccatatataattgcagcggcatcaatgtgttttaacaaaggaataatatgatcaaagaaccagattagcaaattaacctgccataagtatataaaatggatagaaaagtactcagaatggagacagaaggatagctgagaaagtgaggcagcagtacaagcctctaagtggtaagtatgtgaaccgagaagaagctagaaatagctgttttgttctcatttcttaaatttcacagcaatagaatttcagatgaggaaataactctagaattctagaaaccaaaaacatagagattaaatgacacactaaagatgatgaccagtaatttagaagttgagaaattgaattaacttccaagggaaaaggatgaaggtaggaatctgtattgattcatttacctctcctacctcccacataataaactatttagcacttaagccaatagaaatgtgaccatcatttctcacattttccccaaaaatgacttttacacctcagaagtttggacagtaattttacaatacatggtgaaaaggcattatttaacccatcttttgaaattgtagtaaaataggccacatgttctctaattcatataagaattaggaaagctacctcgtgatacggcaatagaaaaaataaataaatgaatgtaaaagaactaggaaagcaaaaccaagcaatatatatacaacatatgatttacaggactgaatctgaatactatatggcaaagttaaacctctataaaatcagtgcatctgttgattagaaagagtatttcaaatggaacataatttctattcaaggaaaaccctgaggggaaataactgggtttatcttgttgatataggtgtgcatctatgtataattactgactttaaaaaggtatttctgaatcaaatcttaatagaccagcaagataaataatgtataatggagagaagcagagaaagatgagaaagacttgacacgtcaccaatattggtgttattttgggacatgtaatatttactataaatacactgtttctagtctacactaaaaccaatgatcaaaaggcatatttctaaatcaaaatcaattaagagcttggtttcaaaataaggcttccggcccagcaaagtacaaagaagcaacacttaaggcaaaaatgtgcaacaattcactcatcaaatttgcaatgctcttttatgctcccaagatgaaaggatttcaaaacacactcttcactcatcccctcctccaccctcagtgacatttcctctggtcagaaccaatgcacatgttaatatttgtggtagtgaatgcatccagatttatagtgactttcttctgtcagagaggcattaagtaatttccaaatgacatcactaaactgctatatgagcgcttttctctagaagtgacaacattggtaaaatttctagatatatcttatataatataaaaacttgagctaaatttttcttattgcttctaagaaattatttaagtcattatcagttaaataatcctcaacacatcgtaacttaaacatgtcttgtgtaacacttcacagtttgcaagttatttctttatattctttatcttaaaaatctattatttgttaactgtccacacaaatactatacaagtaagaaagttaaaactgtaaggaagagagatgaagaaatatcaagacagaaaaataccaagaaataccagtcatttggggacaaaatgtttgctataaatcatataagttaactggatctcagctagcttgttcattcattcatccaacaaatatttattgaggtggttactaaacaaccagctcatttatttttgtatccacagagcctaacataggcctgggtcatattaggtgctaaataaatatttctggagaggcttctaggatgtactgaagtaaatgatgaaaagtcacattactgtattatttttctttcttttcttttcttttttttttttttttttgagacggagtgtcactctgttgccaggctggagtacagtggcacgatctcggctcactgcaacctccaccttctgggttcaaacgattctcctgccccagactcccaagtagctgggactacaggcatgtgtcaccacacccagctaatttttgtatttttagtagagatggggtttcaccttgttggctagcatagtctccatctcttgaccttgtgatctgccagccttggcctcccaaagtgctaggattacaggcgtgagccactgagcccggctatttttcttattaatcatcaccattattataaatcatgttctctgccatcagaaagtttatttctatttgtaaataatggacagatataaaataactagagaataattcatgataaaagtgaattacaataaataaggcaattattaacaaaaaataaacattcatccaactaaaatttcaccatagactttctttaaaccaccaatcaccataaccaattcttagttgaagatttctgaaaactacctttaagatttgaagcttctcaataatatggctgcttatatcaagttctatacttttctgtattgtaatcaggaacctggaggactttctcagagttatatagaaattaaaatgtctgtcactttacttgactgttaaataattgaagatctacactcatcctaagccacagtattttcaatgtataatttattaaatctattaaattctttcagaaaatatttattgagcactcatattctaggtactatactaattaattgctcttcacttcatgtcttaccttctcctcaccccttcataaaaccttaacaatttcaatagtaatattatatgactttgaggttaacagtggtagcatcaatattaatatgacaaaaaaatccatctatcaaaactgggccacctgactcaaaaaccattttattccaagttgttatgtttttaagagtacagttaatcaaaatttttaaaaatccaacatttttattctgaaaaattggatgacaaaccatgtcaaatattcaaatcttcattaaaattatatgccaatcagattttttaaattatctaatttaaatagcagtatatatttcagcaatgatggagcatctcttaatgcaatcaactttctaatttattggcttactctatcaaataaggatgaaaatattaaatctgatcagtacatagtatacttcactgactttgaaagcttacacaaattttccttgaagtttaatggataatgaataagtctaacttttacagataaaaatgtatcattgatagcatagcaccaattaggttaatttttaagtcagttatattcacaaacctaaatcataagcaataatctagaatttataaatcttatttttccttttaaatttcaataatgaaagaagtagaacaatttattgggcaaaccaaaatggactcaaagatacctaaataatttgataaaacagcctttcaatattctcaaatctaaatattaagaacagttctgcttctatcacccccaggcattatcttgtgttgctttgcactttctttgttcctttcttccctccctttctttctttcttctttccttccttcctttcttcttggcttcctgtctggttttcattttttcttttaatttctaattcctctttcttttattattccatgcacccaacattttgggaaagtgctggaggtaaacttaggtagtaaaaagaaaaccactggccttgtgttaatttttattatatgcttaaaacatggaaaaaggccgggcacggtggctcatgcctgtaatcccagtactttgggaggcagaagcagttggatcacctgaggtcagaagttcaagaccagcctggtcaacgtagtgaaaacccgtctctaccgcatatacaaaaattagctgggcgtggtggtgggcacctgtaatcctagatatttgggaggctgaggcaggagaatagcttgaacccaggaggcaaaggttgcagtgaactgagattgcatcattgcactccagcctgggcaacaagagcgaaactttgtctcaacaacgacaacaacaacaacaacatggaaagaaatgacttatctccacatcaaagacttgttgagtctgtaatgtctaatcacctcttctaggcaatgggagaaagaaaatttaatttgaccagatttgaactcagactgagtcccattagttgataaggagtgggtagggctgacaataaacagtatttgagaagcccaggaggacacggtttacgagcaagggagattttgaagatatcaagtccaagagaaagggtgtgtagagacatgcactgaatccaaagagaacgaccaggcaagaccaagatcggagattcagaaagaagaaggccttcacagtgcagctatcagaaatccatggctcgtaaaggagatatggagggtattacgctagaatggacgccgagaaagtcaattctttacttatgacaggaccctaagaccacatttgaccagaattggaaagaaatacctattcttgcagtctaaaactctttgaccataaaataaacaacagtggtttgagtaattcaataacacagccccttgtgatttgagagtgatcattgtagaaccttttctcagagtaaaagtgtaattggttatggatcaataagtaatttattttagaaggaaaaggcccttgttttcatttttatttatttattttttgaagtagcaaagctcttaaatcagaacggagcaaatacattttgaaagttgagcttactctaaacagcaagattccttactgtactagtaaaatttatcttaactgatcatttatttatgatgccataaaaatccagatgttcttaattttgattgttagaaatttgctaaaaggcacctgaaattacttttccagagttcccctcttgagaactacattttaaattgaaattttactatggttcaataatggctgtgctgaggggttttgttgtgtttttcaagcttatcaatgaattcagcccttgtggtcagtgtaaactcctacacagcttattggaaattccagaattctaaggcaaaattaagattaagaaaatagtttaataaaaacagagaattaaaaacttgtaaaagtttgtgctaatgtactttggtgtttcatgtttttcttaattattttagaactggtacccgatgaccactttctaacaggaaagaacatgatgacctaatcaaatgtcctttggagagtgagcactgatagaaggagaacttatagggaaagacaaaacaaaatagaacaaacttccatggtcgcttaatgcatgggaaataaacagaacctcaaggataaaaaagaggatggggagacttacctgtttcttctgaaatcttccaaaagatagactttagaccaagaactatgataataagaaccctttagaaaagtttttgaatatgtgacacactacgattttttggatatatcaataaaatattcatatctcttaataaaagacactgtgcttctttacaaataatgcaagaaaatgaagatttaaagagttgcaaacatactcattaataatttttaaaatgcagagaaataagtgcccctgaaccctaaagttaattatggcaactttcaaaggaaaatgaagtttttcattcatgactattctttgctatctattatatgctgagtaaattactgtgggaggcttacaactttagagaaaagagaatgggcccaggatgtaagtggtaattatgaattaaaatgtattttcctgacacgtatcaaaatgagtacaaaatggcacagaaacaatctttttgccatcttgtttcacatccccaagtatccttaaagtatactttcgttccttttatttcatgtagcttcagataagtactttctctagtgagcaaagaaataaagacagaatccagatctttggatgtcaccagtattacaacctcctgcttccagccagatggtgtggtatctactaggcaataacttattttattcatttggcaagtctgcctaaagacactaaaatcactccaaaatttttttaaaaattattttgaacacagaattaagaggaattcacactccaaaaaaaaaaaaaaaaagtttgcattgtaaagaacgcgattaactacagcaataggtatatggtcttatttcctctagattgtattcatatttcctataacaaagtactggtttctgggggaaggaagcatccaagaagcaaaattataaattctttacaaaaagttaacagtaaaaagtaaaagctgaatcttatgcaaaaagtacttactatatgcagttctaggtagtcacccaagcctgaagaactgtccactcgcaccaatacggcttctttctgaacagtgctaaaacctatggccagtctgtctgctcgtgtactgggtcggtcattaggaggccacttatacgtgatttgtccaccacctttgctaaagatatatgtcgtcccagctggaaaacaaaaaccaaaaccaattagtccaaatacatcaagtctgcacattagcaaggcatgttatattgatatatcagtaaagtatcaactctacacacaaaactatggcaaagtaaatcatagatttcaatcaaatgtgctcaagaaagtggaccaagttgttttaaaagaaatggagaggtagctcagtttttaatacactgattcaatttaccagtaggtgtttcagaacaaatagtaggttattgtgttttccattgagttggacaagaacggaatgtaatgaggcattatctcttcctgccagtttttaagaaatagtttagtagaaaacattgactggatgcttccaaaaagcaacagcagcacacatcaacttggtattgaaataggagctgcatgcagatgtgacagggtcatacagcacagtggagaaagtcgcaacaaatgtgctaggaatgtaacttttatggaaaaaggatctacttacatgtgacagataactaatggatgaatagccacaagccccagtagccatgtcaagaaaatacagataatagatgtcatccctagaagtcaggttttgtttaacaagcaacatctagtagctgtcaaactattcagaatcataaaaagacccacatcctctgccaccccaaggtgaatacaagccttatagcactgagaataatgtcacggactcattctgtgagtgttcaaattttaccttatggttgtctggtcagtaaattatccagcttaaatgaaaagagtctttttcaaacaaatttattcagcatttgatatggtttggctctgtgtccccactcaaatctcatctgaaatggtaaaccccataaaccccatatgttgagggcagggcctggtggaaggtgatgggatcatggagtggctttgcccatgctgttctcatgatagtgagttctaacaagatctgatggttttataagtgtttgacatttcctcctacacacacttctgtctctcctgctgccttgtgaagaaggtgcctgcttccccttctaccatgactgtaagtttcctgaggcctcctcagccacacagaactgtgagtcaattaaacctcttttctttatcaattacccagtctcagggaagttctttatagcagtgtgaaaatggactaatagagcatttggtgcactagtcttacctcaatgcatcattcattggccacccattttggttctattattttgaggtcctgaatagaaccaaaaaagaaagaaaaaagattggattttccctctgtcttcttctgactgcttaaaatgggacattgttgttttcctgcctttgcagcttcttgttctcatgccttcaaacctggactaaaatctacatcgttgtttctccagttgtcagtcccataatcgatacccctagcttttctggttctctaacttgcagacagcagatcatatatgatttgatcatatatacatgattatacataataagagaaaatatgaaaacttaggccacaaaacttcttgtatttatagaaaaatagcttgtaccaagagtaacatttatgtgtaaaagttgtgtgtacagcagtatgttttgaagaaaactatacattgaattgccatgattaccaagtttaccagttaaatggagttgacctactatcacatttgtgtacatttaattaaacagctgacaatattgattttgtggccatttttggaagcaactcttctttgttttctgttacagacatttccacaggcctttgagaaattccaaagacctctgcaatatgcctattgtacctgatgcttaaataggacttggtatatagacctcttccaagaaacatgttaggagaaaattgaatgcaaaagtgataaacatgaatactgttaaaatgcaaagctatagaggctgtacccttctctattaattttgcagataccaatgcatgaaaacagtttatctctttcaagagagaaaaggcaagccatatttcaaaagcaccagtcagtgcacaaagaaaattcagaatatacagagtgtagatcagaaatcccagggctttcctgagccacttatgttctacatcctcagaagcttgttcatcataatctttataggcaaacactatttgagaaatatttttctgcctggtaatttttgcaaatgattaagtattaacttttctagtgaagcccattgttgataaaaataggacaagaacataaaaaagtggagatggctttaaaaggaggatgtagtggttatctctgagtgctgatacttaataattaatttttttccttttttaaattggctttgttctctaatgactatatacattatgtgaaataagaaaaatattcaaaactagagatgctatttaatgatataaaacaacacatatctaagaattcagatggtttaagaattatataagtgtgaggtaagcattataaaacaacattgcatattaatttttaactttaaacatcactttcacaattaaaaaaaatcttatctacttattatggaacatagggcagacattacttccatgctatatctgaggaaatttagtcataaagattaacgtgctatctaaagttgcaaacttggttaattggcagagttggtataaaacccatatcctgatacctattccagtatatatatatatatatatatatatatatatatatatatatatatatatatatttatgacagaaatatttctgttatcataaccaggcagtcaagaaaaagttaattggatgtcagtctgaatttatcaaggccaactgttatcatattctaatgtcttatatccataaagtgacatttgctcttcattatcatatactttcttctcacctcacaatacttttaaaaagagaaaaataacatctaaatgtaaaatgacagaacatttaatatatgtagattaacatttagttggggtacacttcccaaacctatggaactatgaaagtttctagcacaattatagaacttgtgggtaataatttgaagttttacactttcagtaagataagtgtcacaatacaaataccattactcaagatttgatttcttctcagattttaacctttttcaatgaatctaaaacttgatgactagaatgagattagctaatctgtcttgtttagaatgactttacagttttttaggtttcaccaaaacaaagcaaaaaaatcgcaactactgtttgtcaaacattgccattatttctagtttccttttttcccaccagatatatcctgagagcagtctttcttagtttttcttctgtatgcacagtagtgcattgtattgtactcatcagcacaattttataataagcgagacaattagatatccagtccttcctcagctctcttctacatacttctataagcactctggattttttttaaaaaattaactttgcatcaaactttacaaaatctcctatattcttaaagccctcttttcactgagctagaaaattactctcataatcaaatatagtgggttagatggcttaaagtttcaaaatctacctcctttaacacacatctttctgaaccaaggacatgatgtacttactgaagcagaatagcttagagattaagaatgtaaactctagactcagagagatctgggttcaaattccaactgtgtcatttactagctatgtgaccttggtagccatttattctgtattgggattcctatttgaaaaaagatggggatagcaacactatcttatagagctctatcagaattacatgagatattacaaagtaacatttagtccatttcctagtatgtgataaatgcctaataaattttagagagaataggtgtcatgtgtgagggcagttgtgtgtgctgtaaaaatataaaataatgaacactgtaacattgttttattttaatatgaaagccttcagaaaagttggacatatttcaaagttatgtccaaatcaagtgactttcaaaaatgacattcctacctcgtaatttttattaatattttcaatattttgtagcacagattaggacttttatgtaaactcattatatcattatttatgttcagtaatagttgacaatggaaggaatattaaattgtatcacatgggagctttcatgagaaaaagaatattagctcatcaccataaaacatctagcatagtaagatttatagcataatgcaaaaaaaaaaatcacttgaccattaaataaagaccaaacttaccaaaaaaccctgccagctagctttttaaaaattttatctttacagaaacatgttttattttactatataagtgagttaaatatgcagtggcagtacatcttaatcacagttccaatatagagaggaacatagaggaatgtgtcacctttattatttatgcatgtttctatatggcaagcactaccacatcagtaccatgactactaatggatttactgcaaattaaccttgacatccatcagatcgctgaatgtatgaatgactgaaatttaaagtggttttcagcaatctccacatttaagctgtgcagcaagcctctattactcactctaaattcattaacaaagctggctctatcagacacaaatttagcaatgtcaacatactttacactccaataaatgtttgtaaaaaatatacatgggctcccgtatctcttgtttaaactgcctgtgatgttataatcagggaatatttttagatcttattgaacatgctatttacatatagggctctctcccttcttgttctttcttgccaactgtcccttgcctaagtgtgcccacttcagcctcacgtcaattctgcaaaggctaacatattcccttacatagattgaaactttctgaaaaagaaaaccaatcagcatgtacaggtctgctcaattattggttgctctggatccttgctacatgaacaataatataattaacttcggagtagattagcttctaactcataacataagtatatgaataaaaggttactttttgaaagcctataattcttcaaatgtcatcttgtagccaacacgaaacattcaggcaattatgtttctattaataaatgtaacaggaatataacacttccttcagtgaaagtttacagtgaaagccaggtacccagatgaatattaaaagtaaagcatttgtaagtaaggggaacctttattctttctacaaccttttccagatgctgttgttaatttgaaattttctggagaatttctacctatatggaggaattctttggcttaaggttcataaaaagcaaaagcacagagaagaccacattgtatgcaaaaagagttttagatcagggcaacatttctaaactgatgaaacagaatcttaacaatcactaaaacaataacaagtaaatacactttattttccttctgaattattgtaagttctttgtagaatcataaggaattatttcatgaagctgagcactataggttcctaattactaaaatttcatataggcatattaaaaattcagaaaaagtgaacatcttaggagaagttaatggaatcaagtaatgagtttctacctataatatgtaaccacttctagatttaaaaattaattacaataattactaatattgagaagtaaggcacagccctcaatgttacatatgcatgtaagggtgcaaagacaaagatgccaggaaaagaaaaagaaaatatggactatatatcataaattaagacttctggtgggaggggcagacaacagaattggcaaatgtgttataactagctaaagagattggagaattagacagatttttaatcacatctttgagaaagagaatgcatatgctctttataaatgaaagaaggcaagaaacatgacatgtcacagaaatggtttaggcacaggtcccatattctcaatcaggtcgaaacaaaaaatgtccagaagaatttagataattcccaaataatgaaagctttatggaaatagttaaggatgatattcaagacagcaacataggtcaacagatacaaagttacggttagataggaagaatgagttctggtgttctgttgcacagtagggtgactatggttaatattattatattgtaaatttcaaaatagctaggagagaggatctgaatgatctaacaacaaagaaatgataaatatatgagatgatgaatatgctaaacataccgatttgatttttacacaacatatatatgtattaaaacatcactataagtgtgtacaattataacatgtcaataaaaacaaaacacaataaataaatttgaaaaaagagaacaatgggaagtttgtcatatatagcaaattgtatgttctgtcaaaactctaggctaaagcattttttaattattaattttttattaaataaaattaagttattaaattttaaaaaatacgttgttgactacttattaagtcaaatgcaaactgagcaagacagggagactcaaacttgtgagcacactattttcttgcattggaatttcatgaaagtgatactgtctaggatcactgtccacacactattccaccaaacaccaatcataaatttggttcaagttaatccaaaagattcttgaactcttgcaaatcagacactgtcatacctccagtatccaggaggactcattaggtgttaacaattaaggttttccaaatttttaaggggatcagaggagggtgaaccagctagactccacggtagacattggaagtctgaaagcagaagagtattcctcttcaataagccagcccatctgagattaggctctagcccagccaagataccatttaaaaaaaaattgtgtgtgtttactcaacaagaaattttaatcaaaataaaacaattgagaaaatgaaataactaaaagttactgtgattccaatgaggtcaagaatcatttctctcaaatataatttcaatagtaattatgcgcttcaataaaaaatgaatttacctctacctattggcccaaaacttttctctaataaaaatgtttttctaataaatgttctacattttctatattctctaataaaattgctatatcttagaaagaattatatattcataaatacattttatcacattttgatgtttataaaaagagtatggtacatgaaaataaagtattcattcttctaaaaacaagtgtataccactctaataagtgaaataattatttaaaatgtaaatagatccatggctgacctatcttgtcaatatcctagacattcattcagaaacaccaccaatagcagcaaagactgcacactggacaatcaaatatgcaccattcatatagaatgagatgttaatgatgttcattggtgtcgtataaaactatgactctacataatcaatgatcaatgattgatagagattgtgctgatttgaataagttattctcttttttttctgacattataagggcattaactaacatagaaaacatttctaagccttcctatctcttgatttgctgataagtgccaactgtgtgaaaggagctaagaatataaattcagaaacagccttttctcttcagcagataggatctgttcattaaaggtaaatattagggcaaaatagtttgtgtgagatgtcagaaaaatggtggtgttctgttgcacagtagggttactatggttaatattattgtattgtaaatttcaaaatggctagaagagaggatttgaattttctaaccataaagaaatgacaaatgtatgaatatttgtcaaatatttgacaaatatatgttattcaaccatgttatcatctattttggatttttaaactgctttttaagaaggtgataatattaaaagcactgattaatgaaaacctaagattatcagaaaaaaatgataagaaaaatctatgtgtgtatatgtattttcttttaggtcaaagtcatgtaaatagttgagtagtttgaaataatgttcaacccaatgaacactacttttaaaaatgtatgcaataagtggtccacttagtggtatctttgcaatatattttcttttacaatctacttattattttcctggcaaatgtgtcatttagaagtatcccctccaggaacagttgagttcaatagtttgagctgcccagagagacaaacttgttttgagatcaaattcaaagtcctgggaactgcttaaaaggctcttggtccaggttacctggctgagtagaaaaacaggtaagtagtagaacttttgccaatcagatcagaaaaaattccataaagacagcaaagtgatctagaattaaaaataaaacaaagcaaagtaatcccacaaccaataatcctaagaacatcaaatgcttatgtcttcccttctgaaactaggctccctccagcagtaggtgaactttattaaaaagtctctggcaagtaactcagtaatcaatttgtattaaagctataggcagcagggataggaagaaaaagaatcacatcatcaggaactttaagaaaaatctattttgaagagcataacctaagtgtgcatgttcccagtaaactcttaaaattattagctggtcggtagaagttgtagttgcctagcaatgtcctttaacttacttatttcaaaggttaattgtgaaaatggctttcattaggattcaagagtcaagaattttctttactataattatggtctaaaaaatgtccagtttaaaaaaaaaaatgacataaacatagaacttactgccgaaatactcttggagaaaagtgagtaaattttccaatttacaaataacaaaactgaggcacagagaaaccaagtgtcttctcaatgtcaaacagatgggtgcaggcttgtacttaactctattcttagtgattttttttttctatacaacaaaaagctaagctcaaatgactaattcttatttagaaaaataaattataattcacaaatcaaggtctcatttcaatcattttagagtttttctaatgatgcttccctagtctgatttggggaaagtttctataatgacacttaacagaaatgattcactcacattctgacatttttagagtctatcctgaatctttaaaaggtgtgaggtatctgcaatgctttattgtaaacatcctctctaagcagccatccaagcctttggcttattctgaagcttctaaattgtggaccaaagctacagaagacaaattttccttatttttaccacagtcacttttactctataccagaaaggctttatgactttttggcagtgacacttctttttgtccttagcaatggaattaaatccttaatacaaaagaataggtatttattttgaattatttgcatcgcatagttaaatagaagggaccatgcaaacaataaaatttgtagtaattttaggctaaaaccagaaccttaacttttgtttatttcctaatgttagttctactcatttatcttcttcctgcctatctgctatacttaagtcattctttacctgactaggccctcgtcaaaaccatttactaattattttggactggaacagaagggaatattagtttttgactcagaaattatctcagactaagctctaactggatttacctaggcattcacaaatgcaatacacattctcctctcaaagtcacttttacttctgctggtttaggcttctctgctgcaccttgatttcttttgtcatgctttccacattcattccagccaaggttaattctcgcctttcaacatccactaacttatttttaatttttgaactattataatatatgagaattgtcttttattgaaatatccattttaaaaagtatgcatcctgaagaaagggatcttgctttaattctaggtatccttataaaaaattatgtgcttttattcacttactaattattaataatgactaatacactcctcaagctaagtcaggaccactgattcaatgatgaataccataagactcctgattctgaaacaagcataggaaagatttatttatgtgatccatcccatgcctacatccatcagcatgatggagtatctgcagctatataagaaattggaatgatttcacctaatacaacaatctcagataaggacacagattgcctaaattattctgataagaaaaaacatggtcgacttagttatacctgggtaagaaataagtattatgaagagacatgggactcctcaacctggtaatggtgatcacatgaaaaggagcaccagatctcacagttcacttgaatagcatagccaaaaattctgcatattttacagggaaaagctggatataccttgctagtcctcaggctttaatgatttattaatactcagagaaatctgacagatagcaccttaaccaggtgatcaaagctagcatcaccagtaatgagacatatcaaattcaggttctccaaatatggtacactgaggacactgcaacattctgtgctatttttggcaaaaattcacagtctcagttttagttttccaaaaatgcatagtctcaatctaatcataagaaaacatctaacaaacccaaattgaaggacattctagaaaataactggcagcactcatcaagagtcgagggcaggaaacagagaaagactaaggaactgtcctagattagagaaaactaagaagatatgacaacttgatgaaatgcaagatcctggctttgatagtggaccacagaagagggcattagtgggacaactggcaaggtttgattaaggtctgactcttacttaataatactacattaatgttaatttcctggttttaatcattgtactctggatatatgagatgttaacatttgtgggagctaagtgaagacacaagaaggctcttttaattttttataacttttttgtaaatctaaaatttcaaaataatttttaaagataaatatattagtcatgaagagcaatttagaatctctctcttttttattgagacagagtctcattctgtcacataggctggagttcagtggctcaaacatagctgatttgcagcctcaaacacctgggctcaagcaatcctcccatctcagcctcctgagtagctggggcttcaggcacatggccaccatacttggcgaattttttaatattttcttagagataaggtctcactatgtttcccaggttggtttcaaacttctggcctcaatagatctttctgccttggcctctgaagtgctgggattctgggtgtgagctatagtgtacaatttagaatcctgaataagattcttggccatgggaatttatgcaagagaggtagcttgagaaacacctacctcttgaaatgaagtagagtttgagattttgtttggctataaaaacaggagagcatttagaggtgggcagaagacatttaacttttgttctacctaataaatttgcttaacgcagagctctttgtaaataaatcattattaagtctttaaaatgaacatattctaaaaatgcaagttaaaatagaaattgcctaagtagagtagtcaactctgggatcagttcacccaaaaagacagacaacttattcattcatttaattcttttatcataatgtcattgtaaatatcattgaaattcttatgaaatgttttccagtcttaaaaccatgtagatacatagttttaagtcagaatacatttttcctgtcttgtaattagaacttcttcacattagtgtgagctaattccttccctaagtttggaatctaagagggaaactagtgtaaacaaatacttgtatgtgtagaaattggcatacgttttgggctgggtatggtgactcacacctgtaatcccagcactttgggaggccaaggcagaaggattccttgaggccaggagtttgagactagcctgggcaacatagcaagatcctgtctttacaaacttttttttttttttttttaattagctgggtgtggtggcacacatctgtagtcctagctacttgggaggctgaagttggaggatcacttgagcccaggagtttaaggctgcagtgagttgtgatcacatcactgcattccaccctggacaacaaagtgagaccctttcttaaaaaaaaaaaaagaatgaaatattgtggttatgatgaaaaagatgattcaaaaggcaggggatggtgataattatagaggaaggactcatatctcttctaataaaacaagacaaaaaaatcctatgagagatcacttttagatttcttgaaagtttaaaaaccagatggcttagagaggtggcagggaaaaactctaactcaaattaatgagtggggcattttgacacaaacaaacaaatcaacaaaaaacaatgcggagacaacagcagaaatatattgctggagacagaatacaaaggcaataaaatagtataatttaagaataaaaacatctgtatactcaataaatactaattaagcatttactatgtataaagcaccatgctagatcctgatgatgataaaaaggtgtgacatagctctgaaatccagctttttctcaactatcatgacccatccaaacacatgtcatttctttcctttctttttttttttttgagatggcgtcgcactctgttgtcaaggctggagtgcaatggtgtgatctcagctcactgcaaactctgcctcccgggttcaagctattctcctgcctcagcctcccaagtagctgggatcatagatacgcgccactatggctgtcaaatttttatatttttagtagagatggggtttcaccatgttggccaggcttgtctcaaactcctgacctcaggtgatccgcccgtcttggccacccaaagtgttgggattacaggcgtgagccaccgtgcctggcccagatttcatttttgaatttctctttcatatttccattcttaataccatccgcatcaagttaaaaataaataaataacttttctaataaatactttactgactgacttgctttactgacctgctaccttcttacctcttaatttaaatctcttttataaattaacatcagtttattttttgaaatagtattgctaattgcttctctattcaaagaccttcaatgattaagtgactgtctcccaaattaagaatttatggtaacttggactaccttatgtacaaaccaaccctgtacttcaagcaaactggagaatttgcttgtctcccaaatactcccaaattattttcatagaagataaaatttaatatggctctgaaaagataagagcaaattttattggcaggattttgatgaggaaaggcaaaaaggcacaaaatttggttttcaggagtaggttgtagatccacttatataaatggaaagtcactttttaatattttttttttttagcggaagctgatgcatttttaaataccactatgtcttatctctttgtctcttgaattaaatctccagataaatacagagcacaaatcacatagtagaaattaggactattcaaggtcagtgttaaaaagagattagataagttctagtatcttagtttattaaaaattctatgaaatgcaaatttcctttaacaaggagtcacataaattcacaaaagtagaaaaatgtaatattaatgtcataagaaagactgcacttagtaagtgtcttggtgatattttgctatttatcataaattgtgtcattctatctttatgagaaataaaatcatttctcattttttcaaaatttaaatttaagtaccgggatacatgtgcagtacgtgcaggtttattacataggtacatgtgtgccatttacctatgtaatagatattgtattacatatgtaattgtatatttattacacattgcatatgtaataaatttattacatatggcatatgtaataaatttattacacattgcatatgtaataaatttattacacattgcatatgtgtaatattacatattgtatatgtaataaatttattacatgttgtatatgtattacatatgtaattgtatattgtattacatatgtaatacaatatgtaatagatgcatctattagcccatcacctaggtattgagccccacatgtgttagcattcatcctgatgctctctctccccctggctccctgacaggcaccactgtggtgagctccccttcctgtgtccatgtgttctcattgttcagctcccacttataactgagaacgtgcactgtttggttttctgttcctgcattagtttgctgaggataatggcttccagctccatccatgtctctgcagaagacacgatctcagtcctttttatggctacatagtattccatagtgtaatgtatcacattttctttatccggtctatcattgatgggcatttggagtggttccatgtctttgctgttgtgaatagtgctgcaattaacgttaagtgtacgtgtatctttataatagaatgatttattgttctttgggtatatacccagtagtaggattgctgggtcaaatggtatttctggttctaggtctttgaggaattggcacactgtcttccacactggttgaactaatttacattcccaccaacagtgtaaaagcattcctctttctccagagcctggccagcatctgctgtttcttgactctttaataatcaccattctgactgctgtgcgatagtatacgattgtggttttggttcacatttctctaatgatcagtgatgttgaacgttttttcatatgattgttggcagcataaatgttttcttttgacaaatgtctgttaatgccctttgcccagtttttaatgtttttttgtttgtttgtttttgtaaatttgcccaggttccttgtagattctggatattagacctttgtcagatggatagattgcaaaagttttctcctattctgcaggttgtctgttcactctgatgatagtttcttttgctgtgcagaagctctttagtttaattagatcccatttgtcaatgtttgctattgttgccatttctttttatgtttttgtcatgaaatctttacctatgcctatgtcctgaatggtattgcttagattttcttctagggtttttacagttttgggttttacatttaagtcttttttttttttaacttttttaaaattttatattttaaatacattttgtccttttttttttttcttttttcttttctttttttttttttttttttgagacagagtatccctctatcacccaggctggaatgcagtgcgtgatcttggctcactgcaacctctgtctcttgggttcaagtgattctcctgcctcagcctcccaagaaactgggaatacaggcatgtgccaccacactcagctaatttttgtacttttagtagagacagggttttgccatgttagccaggctggtctcaaactcctgacctcaggtgatccacccacctctgcctcccaaagtgctgagattacaggtgtgagccactgcgtccagcacatttatatctttaatccatcttgagttaatttttgtataaggtgtaagtacggggtccagtttccattttctgtatatggctagccagttttcccaacaccatttattaattagggaatcctttccccattgcatctttttgtcaggtttgtcgaagatcaggtggttgtagatgtgcagtcttatttctgagatctctaaactgttccattagtctatgtgtctgtgtgtgccatgctgtttggttactgtagccttgtagtatagtttaaagtcaggtaacgtgatgcctccaggtttattctcttcatttaggattgtcttagctatacagattcttttttggttccatatgaattttaaaatggttttttctaattctgtaaagaatgtcaatggtagtttaatgggaatagtatttaaactataaattgctttgggcagtatggccattttcatgatattgattcttcctatccatgagcatggaatgctttttcatttgtttgtgtcctttcttgttttcttgagcaatggtttgtagttccccttgaagaggtccttcacttccctctttagctgtattcctaggtattttattgtttttgtagtaattgtgaatgggagttcattcacgatttgactctctccttgtctattggtggtgtataggaatgtttctgatttctgcacattgattttgtatcttgagactttgctgaagttgtttatcagcttaagaagattttgggctgagacatgggggttttctaaatataggatcatgtcgtctgcaaacagagacagtttaacttcctttcttcctatttgaataccccttatttctttctcttgctcgtttgcactgaccagaaattccaatacaatgttgattggaagttgtgagagagggcatctttgtcttgtgtcagttttcaagaagaattcttccagctttttcccattctgtataagatttgctgtgcatttatcataaatggctcttatgattttgagatatgttacattaacacctagtttattgagagtttttaacgtaaagggatgctgaattttatcaaaagctttttctgcgtctattgagataatcacatagtttttgtctttagttctttttatgtgatgaattacatttattgatttgtgtatgttgatttcaccttgcatcccagggataaagccgacttgatcctggtggataagctttttgatgtgctgctgcctttggtttgccagtattttattgaggatttttgcatcagtgttcatccaggatattgacctgaagttttctttttttttgttgtatctctggtaggttttgatgtcaggataatgctggccccataaaatgagttagggagaagtccctccttttcaattgtttggaatcatttcagaagaaatggtaccagctcccctctgtatctctaggagaattcagctgtaattccatctggtcctgggcttcttttggttggtaggctatttattactgccttactttcagaacctgtttttggtctatttgggaattcaacttcttcctggtttagtcttgggagggtgtatgtgtccaggaatttatccatattctctagattttctagtttgtttgcatagaggtgtttatagtatactctgatggttggttgtatttctgtggggtcagtgatgatatcccctttatcattttttattgtgtcaatttgattattttctctttttttttattagtctagctatcagtctatctgtcttattattttttttcaaaagaccagctcctggattcattgattttttgaagagtttttttgtgtctttagctccttcagttctgctttgatcttggttatttcttgtcttctgctaccttttgggtttgttggctcttggttctttagttcttctagttgtgatgttagggtgtcaatttgagctcttcctagcatttttatatgagtatttagtgctctaaatttccctcttaacaatgctttagctgcatcccaaagattctggtacattgtctctttgttcatttctcaattttttaagtggtggttttatgcttagtagaaacagtaacagcaaaagaaataaaaaaatataactttggtttgtttgtttactcattccttatctcaagcctactccaacagcctatgaagatggcagtaagagtaaagttcagccatttctgtgatttatctatccacatttattttttttgtagacactgtcatgctctgctgctctgtcacccatgcttgaaagcagtggtgttatcgtggttcactgcaggctcgacctcctgaactcaagagatcctcccacctcagcctcccagatagctgggtctacaggcgcacactaccacacttggctaatttttgtatttttttgttgagatgtggttttgccatgttacctaggctagtcttgaattcctgggctcaagcgatccacccaccttggcctacgaaagtgctggtattacaggtataagtcaccattcctggcttatccacatatgtttataataacggttataaaaaacaaacaaacaaaaaaaactggaaagttaggtcacttacattgacaagaaattgtgggtatctgtaagatttataactcaacgatataagattttttaacccatgaagttctttggccaattaaatttaacaaaggaaatggattttcaagtgaaaaagaaaagaaagaggttctctatggagaattttacattttaccacccatgtgaagattataactatgtatgagagtcatttttgaagttgaaataattgaaacacaagagcacggattaaagtaccaaatcagacatggggcaggtaagtgtcaaatcttttttcttttgtatttggttcaaaaaattctatctttctagactaaaattacaaggtggttccaatttgcacatcagatccttgaacactcaggtccccaatctcaaaataacctcacatttgaaacatacgtccttaagctctgaagtgaaaatggtggagaaaaacctataaaacagaaaggatagaacactcagaggtgaagcaggcttccaacttaaaaattcccagttctagggtcattttaaaaattttaattcattttaaatgggttattgtattcaaataaagtttgcatgccatctgttttcaaagtcatttaaattaagttttatgactcatgaggaagagaggccatttttaacacattatagtctgcttattactatcattaactaattaaaattaattattaagagtgattccttttgctctcaaatcttctagatcatttatcaaagaatgacatgactttctcttccttccttggaatactgaagtcacagtcatatgacttttgggtagatgctattgaaatgatgattttagtcagatgtttaacagtaacgctgtctaaaagctacatttaaccaagagagcagtatttttgaaacagcaggcagtataaaactgctttgtgaatattaacatattctagcaaattagtttgcactcattatcataagcaattgcttactgtttagatgcagcttgtattaaattggcaagcaatttgcaagaattaaaacataacatggagagctttctgaaaactcagcaatatcctgggagaaatgatgctactaggttcacagaccatgtaccaaacgtttttacccattaaacatatttagcattagaacaatagttggttggctacataggtttttaatgtaagatcattttctaaccgctgtttggacaccatcaacagaattttatatatcagacatttaaagactttgttttaaaaagcctgaggagaaagtaggaaggctttgttttctaaaaatgaactagctatcaatttgactaaattttgatacttcaataacctattgcattgtcttgagttactttatgctacccaatttgtccctttcacaaagtttctgttgtcttgatcattctttccatttattcctgagttggattctgctgatgtttacccctatccactttactttctttaataacagaacttttgagtgtcagctgagcagatagataactgcgtagagcctacatttcccattctcttttacagcttgaagggtctattgactaacttctggccaatgagagatgagcaaaaatgatgtgtgtttattctagttcagatcctgaaatgtgtctgcattctcctgcccatttccctctttcttgcctagtgatgacaaaattgaatcagctgcttcagacttcgagatggaagccaaaggttgagaactgtacaatcctatcctaggacgactgaaatgtgactattatgtgagaaaaaagaatcttatactgtgttgagagatgagtatttctgggtctcatattgacagcaaagggtgtttatccaggctttgaaaaaaatgacctaacatttccatgtatttttttaaccttatgaggcaagtaaatttgatagagaagctattattatctccattttatggatttaaaagagattaatattcaaagagctaaaattatttgtccatggtcacaaagtaatgtaaaactttttctgtcaaaaccttccacaggaggctaccgataatctattacctttttaatagtaaactgaggttacctaccctgaataattctatgggaggtcacatgtatttatggatttccccattctgcaattctttgctccttaagaaaacaaaatttgcaaaacacagtaaaggatattgcttgtaatatgaaacaaagttaaaataactgacccacacaagcccctcagcttgaatagacagcatttactttagaaaacttttaaatactttctccaccttttgagatttaaatcttctcccagctttttgccagatttacggcttgaaaatgtctttctcaagggcctaggagtcatctatttgaaatgtaatcatcaaggaagacagtgctctgtctaccagtatctgaaagggtaagagcctaacctctggaagtgccaacgagtaattttttctgtactatacatataataaaggactaattaatgggaagttggataataaagaaaagtgtaatgtattaaaatctgtacatcagcaaagaaagataatttaaagagtatcgttaaagtgctacggagtactgagaaaagagactatccaaaaacaaatctagtagctagttttatggtttttcaaatgataaaattaaaatataaaacaaaaaatttaaattttttattgataaagtatctgcacaattttttttttggtttcccagtgcatataaaggttgtttatactataatgtagtctatttaagtatgcaacagcattatgtctgaaacaaacaatgtatataacttaattaaaaaatactttattgctaaatcatctgagcctttagcaagctgtaatatttttgatggtggaggatcttgcttcattgttgatgggtgcttactgattagggtggtggctgctgaaggttgaggtggctgtggcaatttcttaaaacaagacaacagtgcagtttgctgcatcaaatgactctacacaaaagttttctccatagcatacaatgctgtttgatagcattttaaccacaatagacttctttcaaaatttgagtcaatcctctcaaaccctgctgctgctttttcaactaagtttatgtaatattctacatccattgttgtcatttcaacaatgttcacagcatcttcatcaggagtacatttcatctcatgaaaccacatttttcattcatccataagaagcaacttctcatttgttcaagttttatcatgagattgcagcaattcagtcacatgtccaggcttcactcctagttttagttctcttgctatttctaccacatctgtagttacctcctccactgaagtcttgagcctgtcaaagtcatctatgaaggttgaaatcaatttcttccaaattcctattagcactgatatttttaccgtcttccctgagtcacagatgttcttaatggcatctagaatggtaaatcctttccagaaggttttcaatgtactttgtctagatacatcataggaatcactatctatggcagttataactttataaaatgtatttcttaaataaggcttgaaagttgaaattactccttccttgggttataaaatagaagtgttatcaaggataaaattatattaatccccatgtatatctccatcattgggtgacaggtgcattgtcaatgagcagtaataatttgaaaagaatctctatttctaagcagtaggtctcaatattgggctcaaagtgttcagtaaatcatgctgtaaacagcatgtcattcactctttgctgtttcatttatagagcacaggcaaagcacatttagcataattattaaggaccctaggatttttagaatggttaataagcattggcttcaacttaaattcaccagctgcattagcccctaaaagagagtcagcctgtcttttgcacctctgaaaacaggcattgacttttctccttttcagctgtgaaagaagaagatacctacatggcatcttcttcaaaaactatataaagctgttttgtctacactgaaaatctattgagtatagtcaactttatcaaattttagctaaatttttttttataacttgctgcagcttctacatcaggactgttgcttcaactgacctggaaggggagtagaagatgtgccattcactcagataggaaacatcagagaagaaacatgatgcttaagtaatataaggggtttgttatgttagaatttagctaccttcctccaggtaagcataccacatcatctctacattcctacttagcatactgaagtgtacatggaagacttttttttagtatcctgctaattaatcaagtaaataattaagaagacatcttcaaatgaaaactctgccctcttttgtagatttttgccaaactcaaagttataaacacaattaactcctcatctcttttaaaatattctccaaatgtaatatttagctttcaataatacctttccatgaaacacacatgaattggctttatctgaatatttgcagtgttccccttttttccaaaaatgttaagaaatcattttatgaaacaggtttcactatactatattgtcccaggatgtcatttgcatgtttactatttggttttctaaatacatttatcggtacaagttattgtacttagttgatctgcttcctctactcatcaaggtggtttatcatttgtggtgcataggtgagcaataggatctagtgtaacgcgggcttaggttcaaacccctgcatgtacagatgaaattgggttatctgcacttcttgtacctttcaatagtgggaggagagaaggaaatccatcactactggaaaatatgctctgtactctatcaactctgttgaccctcagcataaaatattttaaagcatttccctaacaaacaactctagttagacaatctgtatcataaccactacttttatctatgagacccctctgtctcttagaacatagtggtcatgggtactggtagcccatatgatgcctttaggaaaatagaaaaaaagcaaatctccaaaaccctctacttctgcctattgaaaattttcatgatttttgtcagaacaagacatttgcttgatatttcctagaaaattgtcatattaaatatgcaactccattgtgaaaacagtataaatggtgccaccttaacaagtgtacaacttgcacaaacatccatggcatccttttagtaagatgtaggaaatgattaggttttgggttaagacggagactcaacacatttggaccctgttgttctattggaatacaaccacactcctcagagggagaaaatgcaagagacacacaaaagaaccataattcctattcaatcactttttttaatgcaaagcaaacaccgatgacaaaagaagttcaagctttttttttttccgttttttttttttttttttttgaaagaagccgtcttacagagttgaaataagattagtcacagacctaacctgtagaaatgaaatttctgaaaaggaagacagtatcagagcagtgttaatccaagatgtatgaagaactaaaccatagcagcttaagccatatatttgaagcacagatttcagcaagacaaaactgtgacttgaaaaacgagacactcaaaatcctcaggagatcagtctcttctcctgttcctctacggctcctccaaagtacagattcaattttgagtcaggttaaattgggggctgaagtgggaatatatggttaatgaattttgtacagtcttccttcttttcaattgaaaaagaacagagaaaaaaaatccctcaaaaagacttcatgggttttactaagtctttccaacatttccccccagattgatttcagatcatgtagagacaaccagactgctaattaaactattaactctttcttctaaattgcaaatctttgagcatttacactgtagaagccacctcactaactctgaagccccgaggaatatagactttccatagattgggagggaagtaacatacacattaccctaggccaaatttgaccctgaaaatgaagtcatatgcactaactctcaaaatatttaattatttttcccagactttgcttaacaagtgtatataacaaggaaagcctctaaggtacgctcagagagattcattttctcctggagttaaattgaaaggtgacacaatgaaagctctgttatgattcttttgaaagcagcaagattatgttctcagccaatgtaatgtatagctgacacagaataaagtgttggccaaaacagaggaaatgtgctgaagtccaaagcctccatagacttaagtcacaagacataaatatacttatggaactctaatgccctaggttattgtataaaagtgatatgtgtgttaaatttttaaataaaccaaccaaaacagtgtagcaaattcagctccaaaatagattcctttaattttgaaagatatgttaacaatatagaaatatgtaaaaatactatttcttttatataaagtgaattctttacctcttccatcagagcagtgtctacactctaaattcattaataaattctccttgtcctatgtgaaaatgagtaaaaaataagattgcaaatgtggaagttctcaaccttgaatcaggaaactatagatctagtcctaattccttgctttgtgactttgccaaagttattgaaactatacaataatcctcattttcttcttctgaaaataaaggagtttttccaggtaatttatatgggcatctccagctctattctgagtttaaaatgtcactccaccaaagccggcgttaaccttgaacttgattccagagtacactgagcatgaagtagaaagttaaatttatcagtgaggcaattcagcagacaacatgcaatgacttctttggtttatatttatttcattcttatttgactttcaacaaaattgcacagaatgttttctgtattttatggctgtgaaacaacacagtagaggacattttattttgcctagcaattctttctatgattaaaattaagacataaatacagaagaattgaatagtgtatgggataagcactgctagcagttaactttttaattttctaaaatcatataccctacatggctgttctagcaactccacccaaaatcaatataatacaaaatccatagaaatagtagtctaaaaccagttccaggtttattagaacctagttatgtaattactgaggtcttctctttttaaatctataattactactgttatactaaaaaggttgggttaaatgttattaggcaaaaccaccctggctgatttgttttgtgaatacatgttaagataattcctacttagaagaacagaatcattccaagctgaaattcttatgagccttagtaggttctattgtcataaatatgactcagatccagaaagggattcattaccctattctagcagtcaattttagttgtgaaaatataaggaaaagtcaaagcatattctctacagatgtagctgcagtggtgtcattttcctccatgcttctggttgagaaaaaccaggcatcgcctcaatggtccacagattattaattcccattgtaagataatcctgccaatgttcaccaaaattatagccatttcttcttttgcatgtgttcttatgtgttggagtttttggcaaagaatttaaagtccttcatagatacccagttaaataatcctattactcattccctggtagattaataccttttgaaatgcccttagacctttcacatcatggaatagaaactcatgttttcttctgagttacatgacagtactccacacactggctgaattttgtctatcatctcactttttctttaaagcactaattggagactacatggcaaggtgatgatcatttttaccaagaggaaaacacacatacacacacacacacacacacacacacacacacacacatacacaaacagcaaatgacctgttcagtgtcataaagttggtgagcaggaggaacacataggtgttccttctgttatttattcctcagatttgaaagttctgcccttcatataactgtcccatactgaagcagtagaaccaatgtacttatggtaaggtggcactgtgtgtactctcaacaaatgttaattaaatggacttagggcaatctcccctctcacctatttgagaggtccaaatgacacaaattattatttttatataggtagctattaggtcttcaaacacatatgaacaattctgattgggatcattcatatgttatatataacaaataggcttaattacagttggtcattaaataatatatctactgcagaaactgtggaaagtacaaaattaaaaacatagggacttaaaacaggtgagaaaatttttaagtgatttgaccactgaaggtgaaggaaaataaataaagagaagaataaaaacaataagaacaataacattggttcaagaaatcagagtatgcatccttttagaggtctccaagctgtctgtgccttccatcttaacacctagttcaataacacgcctgtttagagggtggcagctacattcaaaggagtcaacataactttgtatcactctattgattggctatttggcttgggaccagcatagaccagaattggtctagaggttgctctcttgctttggagatcatttagcaagtgacatcgtgtgaaatcaatggcctgttactgctttcatcattctcaagttcagtatcataagggtccttaagatttaatgaacctagtctgttgagtgaagctttcaacctgctatatttcttctaacataccaaaatggcttgtatgggaaatgattactatcttatgcagtaggactgtgcaatctaagacttatcaattaaggataatacggcagtaagataaacatttaaattagtttttcaataagatgtgtatttatatattttccttaaagaaaaacagtgaaacagctctctactggctaaaaaaaaagaaacaaagaaaatcagtcacaattgaacgcacacatacgcacatagaaacagaatagataacattgtagaacagtcgctaggtctctggagattcattaacatttcatatccaaggagactagccattcattccttctaaaacagaaagcattttcaaagcaatatccatgtacaggtaaacgacaaagcaatcattttgaaagaaggtaaattacggtcagatgggtagagaaacaaggaggaaatgtcagacattctcatcagcagaaagaggcaacaaacagcaaaatatatatcatatatatgttaaatatatgtattatatatctatgtataataaatcaatgcaagaggtgaatgagaagtaggctgtcatgttctccagcacaaggatgatctccctaagtggtacaatgaaatgaagaaactcccccagaatattataacacagttatatgtcaattttcttaacagatttttgagtgttctgtacacacggcaggaagaacattgtggaaacatttcagtaaagagttataatctaggcctctgtctcttggagacaagaagtgggaacaagaccatgagtctcatatcaagaccacacatctattttctttggaataatgtcatcactaggaccagcagaagcttgactaatcacatgtgaaattaagtcaggggtcctagattttttcaagaaaacaacaataacaaaataggagtttaaaataattgatgggtatagcgcccaaagcattaattacatgtagaaaggttttttaaagaaaacctttaaaatttccagatgccagaaaattctttttttccaaaaacatttgatatgggagtttaatagtatcatatgaagaagtatagaaacttctccatttctgggggacttttcatagagataggccaactcaccaattctaggtttcctcatggtgggaatatatttgcttactggtaaaaaagtcttgggcaaggacaacaaacaccgaaaaaaaatgtgtactctgatctgatcttgaattcccagaaacaagcaacttcctgttaattaatcctagcaaggccagagactcaggaaagggcagctcttttctacgtgagattaaaactctctctacatatattataggtgcaccatcagaagagactggtctaagggcttatcataaagaggggagagtaactgcactgctaatctctccaacaaaagtgctactgtgattacatcatgacactataaagacctggataagtgttactgtattaccacatgagttactagttcctggacagaatgcccaagactgtttctgattcatttttgtgaaactacttccaatagcaacgaacaaagaagaaaaatacagaaaccaaaagcaagacatagcacaattcttcaggtaccaatttactttatcaagttttcaccttataaaaacagaggtgatatttggacacaagaccagaaaaagtcatcttccgagcatatgtcctcctcaccacactcattcacacttaagcaaatacatttcacccagggttcttggaagccagcattccacatttagaaataatttctttggcttaaagattggctattcttacatcttcaaatgcaagagaggagcaagttaaagctagaaaaacggtcacacaaagatagaggtttgaggaccaattttttattttatttatttctttgttattattattattattattattattattattatttattttttttttttttgagatagagtctcactctgttgcccaggctggagtgcagtggcacgatcttggctcactgcaacttctgcctcctgggttcaaccgactcccctgcctcagcctcccgagtagctgggattacaggcatgcaccacaacgcccaggtaatttttgtagttttagtagagacagggtttcaccatgttggccgggttggtcttgaacgcctgacctaaggtgatccacctgccttggcctcccaaaatgctgggattacaggtgtgagccaccactcctggctgaggatcaattttgagatcacttgactccagtttttccaagaaccaccctgaaatggacagtgtgaattcaacataactaaatatatattatatactataaatgtatatataatgtttataaatttttatatatgcattatattttattataattatatattatgatataactctataatatatataatttttatatatttagttacatataaaatatatttatatatgtatataaatacacacacacacacacacacacacacacacacacacatattttctttctagaagaactaaggtaaagttgcgtttgaaaatggtaataagagtgtgtggccagaaagaaggaagcagcaagttagttgtcaataacactggccaaggcaaactctgaccctgtctactttccagcttttgtctttcctcgatactgctttgcctaacagactcttccctggcattaatgactccgctgtgaagaaggatggtttctagtttagtgacacaaaaagatacgtttggtatttaagaaagcataaagggagcataactccattcacctatgtcaaaattacttggataaacaagtatagaaaacattagttattcttctttattatagaaaatggataaaactaaaactcaacttcatctctgtgtacagatagcatagctacctagggaattaattatttaatttgtgcacaccttatgatcatgcctcagaaaagaactgccagagcaatcccttgtataggctactgtgattctgtttttctgaggctaatgtgctctgtgaggttgtcagaaaagaaataataatcagttatttctttgtttaactggagaggcagatgaataaagcatataagaaaggtacaaggaaaagcagcttaaatataaatacaagctagtcccatttctgactttgtgtctacctttgaccaatggtgaatgaatttccttgtcactgtttctgcattttgaagaaagtaagctgtattcatattttttctcagaaatactatgttaaatgtattagtgtatgtccttgataaacaaaatgtaaaactcagaagaagaataatgtttatggtacatatatttcttcaaagtaagaaagaactattcatttcaataatgccacaattgaaaattgagccataaacatcctgaagggccccaaagttgaaaacaaaaatgaataagactaccaactttttaactttttcagaaggatgaagctgcttgcattctttggggagcaaatgttaggcttttttcctatttaaattaccacaacattgtcacgatctgacattcgatttataacaactaatcaagaaatatttacctaatgcccatagcatatgaggtattatagggaacgaaaatcttacacactggatatttaagacccctattgagggtaagccaaattagaagtaaccgttgtataaataatgctcacattttaaaagcactttatgattttcaaaatatgtttcacattggtcacttcatttaacagacattatcttatttgaagtccaagaagagagagatccagaggtggaagtgattaaaaaaaaaaatctgtgaatttaaggccaggcacagcggctcacacctgtaatcctagcaatttgggaggcagaggcaggtggattgcctgagctcaggagtttgcgaccagcctgggtaacatggcgaaacctcgtctctaccaaaatacaaaaaatcagctgggtgtggtaacgtgcacttgtaaacccagctacttgggaggctgaggcacaagatttgcttgaacccggaaggcagaggttgcagtgagcagagattgtgccacttcacttcagcatgggtgacagtgagactctgactcaaaataataaaataaaaataaaataaaattctgtgaatttaaacctgagctggcatttgaaagaagagttgggcttgaataagaaagagaagaagccaattatgactgaaaattgctttgttctttaattttcataaacacataatttactagttccttaagtacacaaatatatgctttcttattatcctacttaggcttagtactacacccaacagtgacctggggagcacatactgaattaaccaatagggaggatttgtccttctgtatctattttgatcattaacaggacactttacaaagtagctggggagttcagagtatagctcatggctatggaatataattgagctcacagactcagggagtcaatcccttcacttaaggttcattagcctgggttccaaggatcccagggggcgattccttccttttctgaatccccatagcacacatcacccagacaatgtctgtaggacaactttagcacttcaaatgaaatattgtctgtgagatctttgcttttcaattgattcgtgttatctttgtcttacctcccaattaatctccagagctccttgtagataggaactatgtcatccagattctttatctaggccacatagcttctagccaattacttgacaaagcataggtgcataaccaatgtcttctttgtgcctctgagttgcaaacgcagttgtatatctacgttaatgaaacgatgcttcatgcctgtattttaaaaactgatgcctagacaggtgagtaatgccaagcagactatgcaagctcttgtggtttctgattatcagataagagtcgcttaatttggtaattgtgacattgtagatatggaaagtatagtaaaagccaactagtgcagaaccctcattttttacatggggaaacagacttagacagggaaagtgccttgcctaagatcacaactaatattgtgcaagaatctgttgtgggctcagcatatggtaggcaattatttcaatgaataaagaagtaccagatgtgggtcacatggtcccctggcactccagccgagaaggcaacttggtgttatttctatgagtccttgcaggtgtggaatactgtatactcttccctttgctgtattgtttctgccaaaataattgtattttgtagctgtattttcacttaaatataaaagcagctaaaagatagtatgcactgtatttcccaactttgtatttaagtccatgattacgtctacgtatttacacagattccttttcaaaatacttacaaggcatgcaccaaaataataacagattatatctggccaatggaattcttggtgactttaatctgactttttaaacatgtcaacatatctccaatattgtcatgaatatataaacaaacattaattttatagctagaagttaagtccagtaaaaatatgtttttaaaaagaaagacactacttctacacctgccaaaagcctgccgttttgcaaactagtcgagttttctcatgatatataaattagcgcaattttgaaaatgtaaatatcaattattgtgttacaaaaaaacaacttttaggatgtgggaagcagaggttctgctaacatagagtttaacattgagccttaaagaggcggaaaggtctaatttgggaaaagactcgttccttaaattttactctagtttttctttctatttccctccataaggaatttataaactcagactttaaattccattatttggacttacaaaaagcacattctgttaaaacaaaattaaattaaattaaattaaattattagattaaattaaaaagccctatctgcatgataactatcccctccgtttctgaccaaagtctcacagaacttcccccattatgtgttgaaggaaatttgtatttcaaggtacaaatgagaatgactcaaaaccatgtgggagaatcccagatgcattatatagattaagtgggtgtggtgataaaaaagattaggggttaaataaaatggttgctggtcaccatgagcctcttattttgtattactaaaattcaacctaccatcatttgtaacatgagcgtggggaaagtaaattgtgaattgcagactattttgtatacatatgaaactttaataattatagatccactagctagactgagaaacactaagtacttctagaaaatattgagcgttgtgagaatttgcttaccttaagtagtattactatttgtatttggagtcctctaaactatgcaaaaggatttaaaattggagatctttactaattaaattgtttattcatcctttctccagaaaaataaaaggtatgtctcagctcaatatatttcagaactatcagaattttgaattctaaaacagatttttcccattatacacacagtttatcgacaccgtgaaagtataacgtacaagcaaattatatatttatatgtaaaatgcatatagatatagtttttttttttttttgaaacagagtctcatttgttgcccaggctggagtgcagtggtgcgatctcagctcactgcaacctccacctcccgggttcaagcaattctcctgcctcagcttaccaagtagctgcggctacaccacacctggctaattgttgtatttttagtagagacgggttttcaccacgttggccaggctggtggcgaactcctaacctcaaatgattcacctgctttggcctcccaaagtgctgggattacaggcatgagccactatgcccggccatatacagatataggtttttgaataattgtctttcaaatactcatgccatttatgggtatgtatgcaattatatgcacaactgcatagttacaatgatataacataaatgaaaacaattcagaatactaaaaagtgttactcataagtaatatagtaaagtagtgtgaacactactggacaatattgatacaaaacacaaaaatgcagtatttcacattagcttttaggctacctgattgaaatgaccttttaaaactcttgtggagtctgataattgaacttagctaccaataatggaaagtatcatgatttaaagaggacagaatgttgtattttgtctacaagaaaaaatatattttctgtctacagaggagtataattaagatttagtagaggaaaaaccagtgataattgtcatattcctctctttcactctcagcatccaaatgatcactcaaaatggtcattttttaaattggtgcagtgcaactaagagctattttaggaatggttatttccataaaattctattctattttcttcagtcttactgaaaatggtgctttctgtctaaaccatcaaggtgttaaaacatattaggacaggttgaaacccaatgagagcaagtgacacattttaacaagattttataggtcactgtcttgcaaaaatgtaactcaaagtacatttatgggcacacaggaaaattttaacaactgagaaacctattcataaatcttgtacttattttaaattaatttattagattatatacatgactggcattgctaaaaaatgtaaacttgcctattttggtgaataacagtacaataatggtactttccttttccttcataaacaaaattttttaaaaagacaagagaaaaaaaatcaaataaaactaaagaacagccaatctatgaagaagtatttcctatggactgcactgaaacttggacctaggtaaaggacgaagcactaggtcaaaagccacccgagaggtaatggactatgcagtctgagttcctccaagggggggtcacacaatcccaaggatagacttaatatttatttacagaactcaaagtgcttggaattggggaaatgggtgtgaggacaaattgcaggagggtccctgaccttggggagcaggtctgactcagagaacacacaggctggctgttttgcatgaaatagatgatgatttagcaatgtggcggagaaaacgtagaaaacaagaagttctgtaactctccattttggtcaaccaaagagaagtacattctatcaccacaggtcagacctatgacaccagttcactatagacctaccatctgcaagtggagacagccacaggaaaaggtgttttggtaagggtggagaaagagacagtaggagaaacgtagctgactgcttctttagtttaccactactatattagcattcaataaaacttgatactgaaaacaacagctcccattgaacaactggaggtagaaaaaagtggcaaacagaaaataaataccaaaaatttttccaagatttagccagaaaatattgagaatctagtttcaatgaagtcaaaagaaaacacagattctctgaaacaagagtctgaagaagagatgaagaaagtaaaagtagactaaaagcaggaaaaaatggaagagtaaataaaactatggcataaataaaatccactccaacagttaattcttcctctttcaatagaggctcaatagatacagcataaagtgataatctccccaaaagggaacttaaatatacaaattacaagaaataaaaggaaggatcataaattttccagatttagaataaaactgcaaaaacacacagattgccacataaacacattctaaaaatgcatgctacttattaaaagagaaatttaaaaagaaacccttaatgaaaaaaaatgaatttgtaatacataaagaatttttacaaccaataagataaaacccaaaaattcaattaaaaactgggcaagtctgcataggaagttcatgaatttaagaaattgaagaaacatcttaaaaaacacataaaaattttaaaagaagtggctctaaacatacaaaaacatgtccaaccacctagtaaagaaagatcaatgaaaacgacattgaggtaccattggcaaatattgaaaagattgacagagagcgttgggcaactctcaacactgttcaaaggaagggaagtttggattcaaatacattggaggaaaatttggcaatctaccaaaatgaaaactgcacaacattttccccccaataattacatttttaggactttatcatacaaatgaactgaaacctgtttatataaatagccagtttaattaggccaagcctgcattaaagttagttctcaaatgagttaaacagtttccattttccactttcttttatttgtctatgtcttaacccaaaactcatgcaaaattttccagcatgatctctccccaaaatgtgagtagatgaaagatctggatggtttgtgttttcgagtgctattggtaaatcagaaattttttaactttaatgtgcaaatctcatttttacagtcccttattaaatttaaatttggtataaattgaaggagctcactatatttaaaataacaatagaattgaaaacctgacataggaagggcctgatacatcttaagaaaaatttagtcaagtataaccttaatatttatatacacaacccaaagtccatgttaattccacttggtattactatataaaagagattattatttatgcagccaaaaaacatatgaaaaaaagctcatcatcactgcttattagagaaatgcaaatcaaaaccacaatgacataccatctcatgtcagttagaatggcgatcattaaaaagtcaggaaacaacagatgctggagaggatgtgtagaaatgggaaggcttttatactgttggtgggagtgtaaattagttcagccattgtggaagacagtgtggctattcctcaaggatctagatctagaaataccatttgacccagcaatcccattactgggtatatacccaaaggattataaatcattctactatgaggacacatgcacatgtatgtttattgcgacactatttacaatagcaaagacttggcaccaaccgaaatgtccatcaatgacagactggataaagaagatgtggcacatatacaccatggaatactatgcagccataaaaaaagatgagttcatgcccttcacagggacatggatgaagctggaaaccatcattctcagctaactaacatcattctcagctaactaacacaggaacaggaaaccaaacactgcatgttctcactcttaagtgggattgaacaatgagaacacatggacacagggaggggaacatcatccaccagggcctgctgggggttggggggctacgggagggatagcattaggagaagtacctaatgcatgccgggcttaaaacctagatgatgggttgatgcgtgcagcaaatcaccatggcacgtgtatacctatgtaacaaatctgcacattctgcacatgtatcccagaacttagagtataatttaaaaaaagagactattgcggagactgaaaaagagatagaaggaagaaaaataaactaaaatctgtaaaaatagacatcacttttcaatataaaatgtatctcaaactttctgaagatattgcctccattttttaatctctaaaatgagcataggctggctgccaaagtccacaatgtaaatgttaacaaattatagtcaaaaatgcctttcaactacttaaaaaaaaacccataaaaatgtagttagtagtcgatgttgcctaaatagagtctcgaagcctacaatctgtaggctgtagaagtgaaccaagtcaaaatttaaaaacaggcttctgtacaacagattttctctgtatacttaactcacattagaagtgtggcatgtgttacaaaattgatgtcagatagcttagaagacttcatatgttttgaatgacaaggtattgaccatggtttctgcaaaagaaactaagcatcataaaaacagatactttaaacaccaagaatatcatcactccatttgttctgctcctttagaggtcctgtgtaattggaagtgaggctactggactacaatgttatcttttacaatgaactaccaaatttagatgtcagagtgacagttgaagaaaattgcttgaatgggaaataaatgaacagtcacagaataaaccaagtctacttgcccaggccttgtgttattaactagagggatgattactgcagcaagaagtgatagcttataaaaattctatgaaaatcaatatagatttgcagattgtaacttcaacaaagatttgatttgtcaaatattagtctaacttgctttattcagcacatgcatttctaaaattattaaagacaaatattcatgattgaaatctaaatgcaatattttttagaactcttgtttttaaatatttaaagtttcagacagaaaaaaaaaaatctattcatgggtagttgtcttcacttactatagtcccagaacataattgttgccccttgacttttattcgaagatttggcttccccacacaaaatttgtctttgtctaacacagtaacactttatgatgtcaattaataattattgattcattgagtcccttctaattcacttacattaccaatcagtagttcattttggtagaattcattccttatgtttaggtaaatgtggaaactttcttccaaatacagctccttcaaatttaaaagaaaagtgcctaatctttgtctcctggatttttggcacgtagttatcaatagaacatagtaaacatagcagtgaattgctgtataactatagtgtcaaaagccatgtttgtttaatgtgcctgcattctgccaaataaattaaattgttcaatcactgtttttgatgataataattatcatattattacccattcctaccttgcaaaaaaaaaaaaaaagcccagtctgcaattttgctggttaatttaaaccagaaactaaactgcaaaatggaaatatttaaaggaaagtagcctttgtattcaagcagggcttactcaaccatagaaacgtgagaaactcaagaacaaccacaacaaaaaaaggcttcttgatgcttcttttgattctaagggggaggtttctttagcttaattttttatattattgcagggaatccttcaccttatcaaaaccacacagctgttaaaaaataataaaaaataagaataaaaagcctaacactcattgtgcttgctgtctctttggaccaataaaaagcggaaagtatgagatgaacatgatacaagtatgtttatataacgggaagaacattaaaaggtagagtttctgcaaaaatgaaaatacctcaaacaattaagtttgttgctttaaagcaagattatagtgtagggcttgagataggaattcattagatatttaaaatgcagcaattattaagtctgtgctaggatcaagttttgcaatgggaatacttacccttggatctcagaggagaaagaaatacatccttctccattagagacctcagctacatgatagtaacttttatttaaaattttaaaaagaagagtgaccaaggtgttatacttattgtcaaaggcactttgcttccctagcgaaaacttgacaacattgtaatctttctctaacagacatgttgcaaagctgcttgccatcttgtagtcctatatgatttccttgcatttccagttctttaggaaatcccctgttttaatgatctttaagaggggaaaagacccttcaatagagaacttgctatttatgccaaatttgaaaaagtagccaaataaaaatgggctataaatgaggtctctttggccatttcaatccaatatagtcttacttctagcccccctgctttgactagggctctcatttcatgtaagcatcatggatttgatatttacctgtatgacaaacagttctacagaaggatagccttaccttttaattaacacagttagctacactatgaaagtagaaatattcgttcagaatgtaagaatgtttttaaaatattataactctctctgtataaataaatggagtttaaaacaacaacaacaaaaaaagcctaacatttgtatttagaagatacaaataactcaggagccacaaaacaacagtcgcctgttaagaatcctattaagaattctgactttttctttactttaaataagtaaataaataaatgttaaaaaatggagtataacactctactctgctgcttgctggctttcctaacaatgtgagcagttgacattgcttggccaagaggaactcaaaaaggtccgtccttccttccttccttcctccctccttcccttccttccttcctccctcccttcctccttccctctctccctcccttccttccttcccttctttttccttcctttcttcccttctttttccttccttccttcctttttccttccttcctttctcttcttctctctccctctttctctttctttctttcttagccaggagattttaaggagtcagtgtctagaccatctttgttttgatcaccaagctcagtagtcaatccatagatgaactattttagaaaaatattttcatgtcagtttgtagctggactgctttggtagcacacccattaaagcacaaactcctttaaattcacagtgctttgtgtctgtttatacaattcccaaagcataaaaatttcaggattggagctgaagggtgcacccatctttatttttctgcttttgatgcacccttcaaattgcttcacacccttctatacaatctaccttgatcagaaatatgtatttatcatactattaggggaaaaaagaaacatatgttctgagtggcaattaagttaccagcactgttaaggtcctggttattttatgtaatctaccatataactcaaaacatccaacaatattggccaaagacattgaccatagatagtgctttcttatcttttcctttctctctctctttttttttttttttttttgagatgaagtctcactctgttacccaggctggagggcagtggcaggatcttggctcaccacctgccaggtttaagtgatcttcccaagtcagcatcccaagtagctgggatcacagacaccacccaccaccacacctggcttttatatatatataatatatatatatattatatatattatatatgtattatatatataatacatatataatatatattttatatatatattatatatatatatatttagtagagatggggtttcaccatgttagccaggctggtgaacacctgacctcaagtgctccgccccccttggcctcccaaagtgctgggattacagatgtgagacactgtgcctggccattgatcatagatagtacctttaaaaacgtatctcaatctaccacttctaatctgagtgaaaccgtttgaattgggtccaaaggttaatcaagggcccctgtattttgttaatatgaactctctaaagggctttatatttacgatttgttttaagctgcttactaaagcatggtggaacatattttacctgctaaaaaatattctacaaaagcatcaaaactgaaagatgaaaattaggccttactgagaaaagaacccctttatgtccaaaacggtccaggataggctggaattcaattatagtatggcaaaatattgtgaacaggctgagataagcaacagctcgaagacttcttgggttgattctagtaaaaaattatttaaactacaaaataacttaatgatgtgtcactggcctgacaaaccattaaaataatctagaagtagagatttaattacaaataaagcacctcttaaaatattaattcctaaaataaaaatgacatgcttatccaattatatcacaatccactcatttcctcttcccaccaggctgaagtttctctttttatattttaaggcttaaaataacatgggtttaaacattttgatatctgtggcatcatttgtcagggactatcctattttgtgggaaccactcttcaaatcattggcctgtacaaaatacaaataatggtgttagtgttactacttgtaccttttccaccaaatgacccaccagttgcttatcagctgatacagttatctataaaacagccctaaggtactggtcatcatcaaatttataataatatcactgtcaacattttctgttaaagaggaaaatagatcaatctaaataataacagcttaaaagttacaaaatgcatcactataatgtgtatcttaataatgattagaatttcacataacatgctagcaaaatacttttgacatgaggaaaaaatgtttaaaactgaataagaatgtcctaaaatactgtatgcatttggcctcctttttcaccaaaatttaacttttttggttgtctgccccaggatcataatgaccatgatgattatcctagtttaggtaatttattaataaggtaatgactcattaattacaatgtttacataaataacatatcaaacaactctgatgaagctttataagtaaatcaaactgaaaatgtgctctgtgattttactaaagacagccacaaagctttaaatagtgcttgtttatagaccactttgaaagaaaaaaaattcacttcgtatctcttgttgacaaaatgccaagaatcattttcaaattagtagcgataaaatattaagtgattcataaatcataatggaaaacagaaaagttgaagtaaatataggcttgaaaatattatctcagaggggtacaaaataatttcaaatggcagtaacactaagccacttacttgaattttaaatgtgaatttgtcttgaaattgtagttcaggtttccctccaattaagaaaaagtattctattaaaaagctaagcagggcttgcataacagatatattaacgcctgtaatcccagcaatttgggaggtcgaggcgggtggatcacgaggtcaagaaatcgagaccaccctggctaacacggtgagccctcgtctctactaaaaatacaaaaaagtagcagggcgtggtggcgggcgcctgtagtcccagctacttgggaatctgaggcaggagaatggcgtgaacacgggaggcggagcttgcagtgagccgagatcacaccactgcactccagcctgggtcacagagcaagaatcagtctcaaaaaaaaaaaaaaaaacagatatattagaagtcaactattcactttaaaaatgcattattaatttatgaaatgattattaataagattgttttaaataaatgggatttcaagttgaaaatctcctgagattttctgaggttaccccatatcagaagcacacccccatatagccatgtggcatggatcctgatgaacctcagtctttggagtttaacaggctggggttggaatcccagctctgtcacttgttggccaaatattgtatttcatctattggaagctcagcctcctcatctgtaaagcgggagtaacaaaggcctaccttaaaaacgctttgaggatagcctgagacaactatggcacatcataggtagttaagtggtgattacattggttaacattaaatcagagaaaatactatgattcaggctctgacggcgctctaattgatagcttgggatctccctcccaatattctcccaagtccaaagtggacataggatgctcctattgagcctttcctgagggaagaatatgattaatgaaagggaggttttcctgtttttgtttggtttggttgttgttgttttgtttgtttgtttctgttttaaagtactggagatttgtaatttattttgaacaatgtttcaaaagggtgaaaaaatatacatttcagggaccatgttaaatggaggccaaggaaaactgtatttttattattttttattaaaaaatccataataggccgggcgcggtggctcatgcctgtaatcccagcactttgggaggccgaggcgggcagatcacgaggtcagaagatcgagaccatcctggctaacacggtgaaaccccgtctctactaaaaatacaaaaaaaaaaaaaaaaaaaattagctgggcatggtggcggcgcctgtggtcccagctactcgggaggctgaggcaggagaatggcatgaacccgggaggcggagcttgcagtgagccgagatcgcgccgctgcactccagcctcggtgacagagcaagactccgtctcaaaaacaataataataataataatccataatagtagaacaatggcaacatcacaactttgttctgtcctttttgtttgaaacatgaatgtgctatggagagccttagtgagtgaacaaaaccctctgcttggattcaaattctacctttccataactataataaagtcgcttaactttttttttgtgggattgttgaggctcaaatgagaaaacacattagaaaatatctggtgacttgacaaacatataaatatgagatactgttattattaatgataaagatgtgttcctggtccctgcactaaggaaggaagtgaggaggtccccttccacaaaccaagagctcaaagatgataaactgttcccaattaattcacaaattcagataagtaaggatcgcaaaaatgagacccagtcatctcagatttatttgttggtgcaaaatcttttagaatctgaatctgtactatgatcttgaagtttcagtgctcaagaacaaaagcaaaagtggtttctattagcagtagaaaacttgaactccttcccaaacatctttaaagactcatcatccttaaaataaacatatcaataagacagagttttaaactctatatatttggtcttgagaaaaaattttattaatattgagaaattaattccattgttaccataaaattagtcatttcccaaaagcaaagccctacttcatgcctgcagtatgaggcattgatacatttaatcaaaatgtcttacagttattgctttttagttttatggtctttgctgtgtgtgttatataacaacagttttggagcactacgtcagaagtaggaagcagaagatgtggctggaaagataggtagagcctgtatcataaagagctttatatgccatgctaaggattttgaaatttaccacttaagtgatgaggatctaccaaacagttttaagccaaggagagatgtagttctatttaattttaggcaggtcactcagtcagcaatgtagagtatttttaagacattaatcacagcctcaaactaagatattacagttgacccttgagcaatacaagttggaattgtgcaggtccacttaaatacaaatctttttcaaccaaattctgttggaaaatacaatattcacaggatataaaatctgagtgtatggagggaacacttctcgtatacctgggttccacgggaccaacagtgaaacttgaatatgcactgatttgggtatgatgatgaagaaagaggtcctagaactaatccccccaaaattctgagggactattataattaagtttgacataaatggtatagtttgggtcatactgttgacttcaagtatttctatttttatattatacttcctttcataatgggaaatcagatgaattctttgaaaatatgactcaattccaaagaaaatccaagttaaaatttttttccacaatttgttgactaattggagcagcaaaataattttgagtagtcgaggcaaacagatatccatgtgctttgagtgttggcaatatgtatcaattaacaatattatcaactctaatctcactttgaagtcaaagagtaatcaaattaaaatctttggcacaagttaagaacatagatctcttttaccatggatacttgcttaaactctttgagtcatgaataatttatctgtataatgggaacaataagatatttcacctatctccttttatttttgagacttgtaagctctgtgaaggaacactgtatgccttcttcattgttgattgtcaagctcccatgcctcctggcacacagtaggaatgaatcaagtgaatataaaaaagtattaccaaatgaaataagaatgtgaaattgttctgtaaaccttagaagtatcatacaagcattagtgctattgtttttgtttcacctattctgttattagcctccaactttttaagatgtactaaaaagacaataatctttcttcaacaaaatttaaaactaccatctctgaagatgcatttatgtgttaaaagtatttttatgcaaatgcttaagaaataatgaggagttctttaaaaattgaatctgctgcctttctaaatatctttcttgtttaaaacacaaaatacatatgccaaaatgaatcaataacttccttgtctggtacagaatgttaaggcttgaatttgaacaaagaagctgaacttagctttggatatctattataaaagatatccaaatgaagaacgcattgacacaatcgttaattagtattcattatactactcctcaaatagaacgatatcaggtctcctatatatcagtgattatttctcttagcttatccaagtttttccttttctactgcacataactgttacacatttgaatctgtaaccaggttttatgatttaatatatgctctgactgtaacacctatattttctgactaaatgcctcctgtatttcaatggacatctcctgtagcccctattaaaagtccctctccctatatccattcttctcagaaacaggctcatttcttctcaaggctagatttggagaactctaggtaaatgccaaaacaaaacaaaacaaaacgtaaaacatctttctctctctccttccctcattctctttccatgctatacttttcctaaccagagtaaagttccttgggagaagtgcttattttcttcaccttgccacatcagcaaaagcaaagtgatgcatcacaaatggtattacagattcctatgattctgagtcttcaatgcacattcatgattgagacactgctttctcttggaaattatggtgattctctgacataacactggtacagtgacctttgaggattctctgtcaacagtcattgatgaaagataacaataacatttcagttccttaaaagtggtatttctcttcatgtcttaatccaaggccgatactgtaccatctacttggaatctcttactcatcccttctcctccctttgcctaatgaacactgttcactcagcaaatgacagtccaaatgatgttcccctatggaggcctttgctggcctccctcactaggtcagggtttcccattatgtgacatcacagcatcctaattcttcttctatgacacttaggatggttttaaaattacaacaccttggggattcttttaataatggctgcctcccacaacgacatataatcttcatatggaaaaaggctatattttgctttccatcatccacgtaggggagtgtctaccacagaatatattgtagtcagtaaatgctttctcttctgtttatccttactcaccaaaccaattctagcctcctcccactcttatctacttaatgtagaaaaatcagtggggctaggcaagagattgttcttgatattttctgtttcttttcaaatttatttatttaaaaaattgtcatacaaaatttatatatttatcacatacaccacaatgttatgaagcatattcagtaacaccttgcttaacctcatggataaattactggaaactgcaactttcagcaaaaagatttataacaaaaccattttaccacaggctaattgattaaaaaaagagttaagttcctggtcacaaaaacatcaccaaacttctgtataaagactcaaaacacttctaatattaaacattgaattaaatgtgaaatatatatacatttaagaaagattaataaaaagataattatttatccaatttttggtgaatcaatgagtgatggcagttgtagttgtagtgggttaaatcaaggaataaatgtttgcaatgcaaaaattctaacgagcaccttctaaaacaaacaagaacaaacatggtgtgcccactgagtgctttcaaactgcattccttattgttgtgcatttgaaagattattgcaagctttatgaattttttattttacaataatttgtatttatttattcattcattcattttccaatccactcattctagttcagagtttgggatggttcaagcctatcccagcagctcagggtgcaaggtagaaaccaagcctggacaggaggccattccatagcagggcgcagtcacacacaaccccccacacacactcactcagactgggacagtttagacacaacaatgaacctaatgtgcacttgtttggaatgtgggaggagattggaatacccagagcaaacccctgcaaatatggggaaaacatgcaagctccacacagtggtcctgaccaagaatcattttttttccctcactaatgttataactaaaagactgagagaaacattattcaaggacctgttgtatagattgtaaaatggtcagatgagaagtatatattttttagatttttacttaaataaaaagacagcaggtagtaatttaaatgtttcagtatgcctacaatctttcagaaataacttcatgaaattcaactttacgaaatgatcttcaaaatacccatacagcacacctttcaataaacggagtttcatttgacagtgtataaaagagtttttttgaaaaacaaaaaaaaaacttgaaaaaatagcaatgcatgatggaataaggtattctcaactttcaactgttatagagaataatagaaaattttaacaaacagctacctaagaaaagatatatctctcaggtagatttttaaatatttttaaaattaacagataaaattgtatgtgtttaacacatacaacatattcttttgaagtatatatacattgcagaatgactaaatctagccaatttacatgttacctcacatagttatcatttttgtgatgaaaacacttcacatccactgtcttagcatttttcaagaacacaatgtattgttaactgcagtcaccatgtacaatagatctcttgaacttacttctcctatctaactgaaatttggtagtctttgaccaatatctcccaaactccaccaacaccacctcactcctaccccctagtaatcacaattctactctctacttctgagatcaacttttttcgaatcaacatatgagtgagatcatgtagtattcttctttttgtgcatagctatttcaattcacataatgtcccccagtttttccacattgttgcaattgacagaatttccatctttattatggctggatagtagtctgttgtgtatatatacctttttaaaaaatattcattcatccattgacaggtagaaaatttatgtaaagcagttaactagcaaaagcagttaacaataacatcttaatgtgccacagatattatgtgaagaggtagaatgataaaccaaaacaaacagccaattcatcaaatcaacaaaactagaaaaatctctgacatcctattattgatgtgagtacattaaaaaattgtgaggcaaagtgactgctacaaagttgaaaaaatacttcacataactcataaatatatagaaattcatattatcgcagaataagcattaagataaaattagaatttgcaattaagtgttcttttgataaatgggaaattatttttagctcctaagatacagcctggctttttgtaataataccattgctgctgcttcttcctcttcttcctgttatcattattttacaatatagacatgttgattttggcatttaagtgtaaattattgatgaatagaacttatattttgttgaaggtgctttgtaatttttaatattgtaaacatcatgatcatcaataagtacaggcttgcaaattacttccctacatgacttaactgagcttaatattttttcaacaagtatataaaaaataataatccagggaactatgtgctaaagctacttacgttcagtgctttacatgttttgtgtacctaggtctcacatttaatatcatttcctataatttcctggattgaaaattaatcagacagtgtcttctctttctacattcttcttctcaaaataataggacaaaaatgtttaatccttctttatggattttaacatgccattagtgctggaaagcatgaaaaatattacaggggaaggtaaccacaaatggataggagactaaaaattgacattgttgtcttccaaatgttcatataatttccattttaatgcttttgttttttagatatatttaaaggtatgttctcttctttacactgcccagagatcacattgtctgaatattagcaagtcttatttccctaagatggaaagtgcaacagagggaagatgactaaaaatagcacgtctctcaagatgtttgctttctatcacctgactctaggatgcagtcttcattagggtacaaatgtattataatggaatggtctgatttctgtttccatattttatgattctcatagtctaccacttgttaaatttaaaagtacattttaaacagatgaaaataagtgttagttgcttgctgataagaagatttaatttcccatatgttgcagcacgcttaattcatttaagaggtgatattcaaaaatattacttagtatgtattaaatttttatctttaataacctaggaagtttgctagcctattatttcctgatacatgaatttataaataatctggttatttgaatttggaatacaaagcaccctactgttgaggaaaggacctcgagggcatgtatagacacaacaaagagggaggtgaccaaaataaaagtatgtattattgatgcacaacctaaatacatctttgaggctttatccagtggaaaaaaaactcaaataaatttttctcttggatgttcaaacagcatgtaattatgttgtatcatatgaataactttccatcaaacatttactgaacaccaattttctaggagttttatttaacaatgaagctaaagcagtggttgtcaattggagaagattttacttccagggacatttgacgatgttgagagatagttttgattgccatgactaagaaagaagtgccactagcatctagtaggtaaaggccagggatgctgctaaccatcctacaatgcacaagacagcctacacagcaaagaattacccaccccaaaatgtcagtaatgccacagttgagaaactctcagataaagacataaggatgacttaaagggagataaaaatgaagaaagaataccttttgtattagtctattctcatgctgctaataaagacatacccaagatggggtaatttataaaggaaagaggtttaattgaatcacagttccacatggctggtgaggcctcacaatcatggcagaaggtgaatgaggagcaaaatcacatcttacatggtagcaggcaagagagaacatgcagggaactcccatttataaaaccatattatctcatgagacttattcactatcactaaaaatcacgggaaggacatgtccccatgattcaatcacctcccaccagtccttctcaggacacgtgggaattatgggatgtacacttcaagatgagatttgggtggggacaaagccaaaccatatctccttttaaagaggtgactgtactaaccctaactagaagagatagctccatgaattaaataatggttgaaatgagacgaaaagtcagatgcagagattgtagggaaagagcatagacaggatacaacaattgagcggctataagagaagctcgtaagaaaggtgaggaatctagggcaattcccgggtttctgcttttgatgacctagtagcaactcacagtatattgagatagggaacgtataaggagaaatagaactggatgggaagttagcttggtttgggaaatgacttagaggagaatgaataacatgtaaatggagccagttgcaaagaatataattatatatgggaatgtgtaaatctgtagagccccaaggttaatattaaaaagacaagaactagccatcaaataagttgaaattttacaccatagatattactattgactaaaagaggtagctgttaggtgcccttctcacaatgcaaatgaggagtgtggatctgggtagctgtgattacccccataatggtgaagttcccctctaagtcacttatgcaaattttagtagtaatgcttcccccatctaatattattctccacagaaatatccacttattcactgccttttcatatgaatgtgtggtataaagctggactgacagaaaaggtaccttaatagaaaccagaaactgatatatttgctaaagctctgtattatttggcttctttcctgctacatgaagtaaaggccatttcactgtattcctaaaggcaatttactattagctatgaattttcaggtaggcttaattaatcaaggtcttaaattaaattgaagtatttattacaagtatatgcatcacaaacatatttatataatttataaatagatttgtgtataatttacttgtctgcaaaacacacagtaccttactgctattgatttcaagtagaatcaagacacttggattcagtgcacaggaaggaaatatgatatctgtccattccataatcagctaacctttagcaaattcattaattttttaaaaggaaaaatataatatttagaattccaaacctcaagtggtaatcacatttcctgagacaacccagttattgttagcacttatatgctaagaaacaattagaaattaattttttagtgaaattagaatccaattaagcaagacagtaagttataatagtgagaaaatggctttcagatttgttcagaataaacgataccagacattttatctacttcagacacatgatgaaagtacaaactctgaaagttcacatttaaaaccaagaaaggagaaatcaacaggtgaagctcatttgcgcaaaataattaacgacaaatgagtagtatttctttcccataaaagaaaagattcatgtggcacttaattatttcatttacccaatacttcgcctgaaattgaagaagctctttttcaccagctgctaaacaaaagcaatttattcaattgggtttgctttgcatgagttgttctgtatataataagggaggaagaaaataaaaatgtgtaagtgccacacttccttccaaacatttttgaaagttatttgtggttccttgatacaagtcataggcataacaccaggcctgcactttattgtaatcattaaatttgtgtgatttgagtattctttcttattaataaactgagaaaataatgtctggaggaagagaaataagacagtgctagtttcctacgttctctagccagctaggcaacaagctctccatgaaggaggccaagccactggaaccacactcccactgtacagcagagaggactggagggggctgttctgtgggttcccaatcacctgttgctttggagttagaatgctggtttaggccaacatagaaatggaatttggttttaaagaaataaacaacagtggtaaaatgtccagatctcttctggacaaaacatggggccaagaaaggaatgtagctgttctagaaggcactctgctgcatgtggctgacagtctgactgaataatgagagctttcgtcaaatgcgactggcaaaggaaccctttccaaactgcattttttctcagggcctatttgcctgcagttgaggtgcaattacccgtcaaatgtggatgtaatgtagccacgtgacaccagcatatttctatttctagaaagatagcagagaaaaatcccctagtgtaatcatgttagtgtatgcttactgtcggaaggaaagggattttttattttgctcctggagttgaaccacagaagttgaaaaaaaaaaaaggctctgaattaaggggaaaaatctgatgttaggaaacattggctcacgtgcttcccactttcaggaactgaacagtttcaacaaataacctggtttatttttttcccagatgcatgcatctattaaagcatttctcttcctccaagtacataaatgaaatacgcataactattttaaaacgagttaagagtttaagcttaagattttatccttaactgcttaattgggcacccactctacactagatatcaaagggcatttgggccagatttgtaagaatatgttcaacaggcgatactttgccaggctgagaaatcaaggtggccagatgttcagcagtgcatttgcaacccatgaacccagctctagagaagcattcatccctggaactgagactccctgaaaaagccatcctcccatggatcacaagggaatttccccaataccagctagaaacaatttaacgaagcccgaagcctgccgaattttcaggagatgagtgtcctgctctctcagacatactgttctgctatttttccctaaggacaaagtccctaaataaatccaaactgacttttatttgaaaagagcaagtgtagattggtatgtccaggaacttaagtcacaggagcaataaattctagcaccctgtttcctctaaacaaaggggcctgcaaaggactattggtatttacgaggactgcagaggcttgagtaagcattttcacagcagccctgtaaggttctaatgcacagcagtactactctatagccagcttattaaaccttaatggcactcttttagtgttgtacaccaggacggtagataactcacccacagcgtggcttctggaagctgccacagcactgcaaccattctgcaggttaccacccttcaacttgaaattcctagatactggtttcttcattaaaatcaggagtcagcaaaccaaggtgcttggccaaatctgacccactgcctctttttgcattgctattagtaaaggaggttttttacattttaaaacagttgacaagaaatcaaaaaagaataatattttgtgacatatgacaactatataaaattgacatttcactgtccataattaagttatattggcaagccaccacacccattcatttaaatattgtctagggctgtttttgtagtataacaggtagttgaggggttatgacagagacttatcaccccaaatcctacttcctggctctttggagaaaaagtttgatccctgatttgaaagtactatcagtcattttcatcctttaacaggttctgaaatgcattactatcaacttaaaggaagactccatgtcagcctctttaaccactggtcaaaatgaatcatttcccaacagtcagatccattgtccccacttaagaaaagcatgcaagagctctgggtgggctaagcaaggatcaagactaaaatagtacctttagaaagctctggagttgctccagcaacatatagctgaaaagtagtatcactgatatttttttcaaactaacataatagaacttgttctcttcaaaggagtaactttgaaatttgttgcaaagaatctgccaatgttcaaaacatatttggagtgcacctttgatgctgcctttagaggctctttttaaattatcttttaaacaatctcaataatgccaaatcttgattcattatacttgagcttgattcatatttttaatcttaagtcattcagaactacaatcagtgaataaaagggagaagtacattgcctggaatagatggcgacctcaataaatattagtgaaacgaattgagctggttcgatataaagtgacactaatgcaacttaaaggaataaaaacctactgaagacatacatatccatccattatctgtgcccctaagcgtacataccccaagtctttctgattctacatttagttttcaaatattgctggctttctgggaatctgcatgattttatctgattctccactgccttcttccattcccaagcctgcctcattgtcctgcatagaactcgtctcagcccctgcttgacatctgactgctcgctctggacttcagttgtcacatctcttttccatctctcagaccacttctgatcaacatgcccatatagttatatacaccagtgatagttctcggcccaaagtgcctttcatattcacatacttctctgagggaagtagtcataggtttccacatgcatgatatggcaagccttacatcatgctaccctgtccatgatagactacacggatgcatatcgaaggtagccctgcatagggaagaagcgggggagacagggatctatgaagctatgtagcaaatgcctaaaagaacaaaattcaatactgcttcgtagatccctgtctcccctgttttcccacagcagggctacctttacatggaactcaagtagaacttttcttaggaagacatgatacactggtataagtaaaggagaaaggaaggagacataggaaatgagcggtctgtagaaatacacactgctattagaaagagcagtgcaccctcagaaatcagtcaagacagaaaggtgagccacagaatgatgccttcctggaggcagggggagatagtaaacttgcgagttcaatgaatttgctataatatcccaagtagtgtaaccatgttctagttctttaggatgcctggctgtgtgactgcaaggaaggtttcctgtgttttctcacattcctatttttcacagtaacctaaatgggtctcttcattgtaacctgaataaatctgtattcacagaaatgaaagtggttttctgttcacttactaacttggctatgacttcaggagcagagaattctaaaactgctttgagtaacatcagtgtctgtgcactaagtgtatataatcccagatgacttactaaaagaaccaaattccaatgaaacctttggtaaacttttccaaatagagcttcatgactttaaagctgcttctactggatgtgtcaatttatggagtaaaataaagtaagagcaaaaaattaatttacaatactttagggaatgataagacagcctaaattgccaggtagttatctgtatagcagtgtacattgtgtctaagtcttattttttaggaattgctcaatgtttctgctatgcttaaacaaaaataacaaattatttatttacagtatctgaaaacagtaacaacagagacatttatagatttatgatactttgtattctgttataaaaataaaataaatcagaaatagcaaatagtaatttattcatttatgtgtttattaaaaaagcatttactatatgctaagaactgaagacaggttgtataaaatgacttctctgttctggtgaagttcattgtgaaggagaatgacacctaaatcagcgatacaacaaagcatcaaggagggacacctgatccagcctggggtggagaggaggtagagtttaggaaagattttctggagaaggaatggtatttgatccaaccctgaaggatgaggtacatcctgccttgttgggacaggctgatccatgttgtttgatgagtaaaatatcagaacttgctggccaaaggtgcatcatcactcatcactgaagacacaggaataatggatctgttttatttccagagttactttattaaaatactaaactctcctgggaaagtttaaattacaagtctgtccaggtaaaaccttatccctatcagtcgatggaggaacagacgagacagaataaagagggaagaggaatggtttcttaggaattactgtttggtccagccctggctatggacatgtaagaatttgatttgggcaaactatattaactattggaaacactctgtttgcatgttaaatgcctagaaaggatgaatcatacatatttcctatgttccattttctgactctgttctttttcctgtttctgctttctatgccctggccttcctccctaccctccattgagggtacaatagcatgtggtatcaattaatgttaagttttgaaacttaagtttcagtaaactttgggtcagcactacaaagaacatctttatatctacatcttttaaattcaacctttgattataaggaaccaagagagtttggataggtcaatgaaaatctatcccaagtcctacaaatgtgacacaaggtaaattttttatgaaagatcattagacaatattgttcatgttttctatttttcttctactcaatattaaatgggaatatcacaaaatattgaggaagagtaaataattgtttaatattaccatctttagcaaaaaaaatcatttactactgtaatctctgaatagaaggaatatgagcaataaaataaatctgaatttacactccaatattgttgaattcaatcttgttcaatcttgttctataaaacatctttcacaaatgtgggctctgaattttattttatcctgtcattgcttaatttaccagattctgaaccagtcttttgggacatttgcagactgatttctaaggcaatctgacaaaaataacttgaaatttcaatgaggatgaagaattgctctttaaagaatgaggaagtcagtaggcataagggaatttctcacaaaaccgcaatgcagaccacttcacaaataactgggaaaattctaaatttttactgcactgaaagacaattgggagagaggacaaaccactacttacctgtaaaagcttcaccagtttattacagtaatttccctagaattcaccctaaagttttttgaatagagcagcacctttaaatctgtcttaattatcagcatatgcaaaatatagaatgattgctttacaaaagccattactccagatgtgcagactaggtgaatttcctctgtgggcacggcatttctaggcagacaatgttaatattcactatgactatataaagatgaatggaatgcttaggtttcacgcctacttgataagtaatcattttagataaattatagattgattacatttaattacagaactacaatgctcatacagtattctaagcctttgtcacttatccatctgactctctacacaaaggaatccctgaaaggataagtgagagaagcaaatgcttcaaaagctacagatttcatgcaattgccacaagagttgtgaacaacatcttttttgttctttcttttttaaaatacagatcatggggatacgagtgcagatttgttaaatggatatattgtataatggttgggcttctagcgtgcccatcacctgaatagttcccagtgtctgtcacttccctctgcatatccatgtgtacccattgcttagcttctattattattattattatcattattattattacttgaactcctgggttcacacaattttcccacctcagcttcttgagtagttggaacaacaggcatgcactactggctggctatttttaaaatacatttgtagagacagaatctcactatgttgcccaggctggtcttgaactcctggcttcaaatgattctcccacctcagactctgaaagtgctgggattacaggtattagccacgctgctcagccagctgccacttataagtgagaacatgcagtatgaattttctgtttctgagttacttagaatattggcctccacctccatctatgttgctgtaaaagacacagtttctttctttctttttttttttttttttttgagatggagtctcgctctttcatccaggctggagtgcagtggcacaaccctggctcactgcaacctccgtctcccgggttcaagcaattctactgcctcaggctcccaagtagctgggactacagatgagtgccaccacacccagctaattattttgtatttttattttttagtagagatgggtttcaccataatggtcaggctggtctcaaactcccgaccttgtgatgcacccgcctcagcctcccaaagtgctgggattacaggcgtgagccaccgcacccggctggtttgattctttttaatggctgtatagtattctgtggtgtacatgtaccatatatttttattcagtcacctattgatggacacttaggttgattatgtggttaacatcttcgatgatgaagaaccatggagttggcaatttggctatgaatacaaataagaagtagtgctcatcaggtaactatagcttgcttttttaattcacagaactacctttaaatatattttattgcctgtaccttacaagcatcagaactaaagctcataaagattataggtaacttgtacaaagctaacaggttgagaatccaagttcaaaaaaagctttactactttgtcataggaaattactatggacttcaccctaaagttaattcagctctgccctatttcaacgtttgcattctcttttcactctgccataatatttcacaacagaagtctcaagtgtaaagactcaagagaaacaccgggtggtaatttaatcaagacaaagttcctgggataactgtttatattaaaataattaaaactctaaaactctaaagtgtaatgaccatacaggtgatataaaatgtgcagctgagtagagaagagagatgtaacttttttcttagtgttgaggaagtctttccaaagagataattttaaaatgggttttaaaggatgcataggagttcaaccatgtataagggcaacatgggtgacctgagcaaaggattagataaaacaaaatccgggcacttgacatgctcagggatcaaatagtccaatgtggctcagggtttgtatcctccttaccttcctctttttgtgatcagcacatctcaatattttagctttccctaatcggcttaattttaatattaaaatattcaatattaatattaagattaataaaaagacaaaattttgaaatgacagcaaattcaatgatgaaattgccgtaagtgctaaagcaccaaagaactaaactaaaaacagttgcacctcttcttggctccctttcttcagggtcccaatatctttaccactgaaaattatttttttaaggcacagatttttcaggaaggaaaggaataaaattaacacaaattgaatagaaatatgaatagttcaaaattagacttttactctcttttagactttctaattccaagcaacactatccgacaggttatgatgcctcagtttgatgacagcttttttcttgaacacttgccaggatgaggaaacccagggaaattttcatgaaagacctcctaaaaattatgtgaaaattcaggcaagtatttgaggcccctgctagacttttttagtacatctgtaaatttacagattttttttttttatagaacaagcaaaatcaccaacttaaaacatccatgaacctgaacaagatattttatccaccacttctttccttcccaagagggagattctctctaatctcaggaaacaaatattttcctattgtgtggttcctcagacctggcttttgaaatttctgctaagtacacagttgtaatcatttattacataatctatttctaatgtcttattctacacataatgtttgtgaaatgcatgtagcttagttgtctgtggatatattccttgcctcttgcaagattcttaaaacagatttttatgattaataggtgtctctgttgctaacctcaagtcactcaaactctccttttgaaatgaacatttatttcagatagtacatgctctctgcggatagcctgtccacttttcaaatgtaatgtcctgtcttccatagatacgaaattttcaaaagatattggcataatgcaggagaaaatgccatccttttattatgttcaaaattgatctgacccctgaggtagcactttggggaattgggctacataatcatgtagaccctttcaggaaatggcttatttatggatttattttttatatacagaagatttcacacttctggctttatacaattgcatcctctcttcctttccaatatgtttccaaagtaggaaagctatatatggcaggagaactgaatttctatatcagctagaaatctgtcatctgctatatattggctctaatgataatgctttaagaatacatttatcccatatatgcatccagtcctctccagcagaacttttgcagttctcatttactgaataaagtaatgctaaagatagtgctatatcctggtcattgtccaatttttttttttttttaaaactgacttctaaatttattttttaaatgtctttttccccctgaagaattgatgtattttacactcttagataataaaagtttagtaagtctgcatgtgttttttctcactgcttagtttacatttagtaggtcatctttattgtattaaaatttaaggaaataaatcatattaagtacatattaaaaacatagtataaatatcaagcccttgttttgtctgaactttttattattcaaattgttctttatttttaaaagttaaaggaagaaatgtagttaatctgtatatccacataaagcaacacaagtagtccaactaaacccgctgatcttggttccagtcctttcgaaatggctatgttttaaataaaacctatttccttaggctaacaaacagtctataatccattaagtctttatgaacaaatccaaggcttttgaaattagtgcttggggaagaaagagtcaagtaatgaatttcaaagaattatgaaggtgattaaagaggaacaaaggatcaaactcccatcaccatgatttctagaacagagcctatcaaatgggcatttgggaattttatttatcatctaatcctgaatatgaaatagaaggtagagggaagaaggcaagaaacagtgttaatttagaaaggaggtgggatagagaaatagaaaaaagaatatgagagcaatttttctttaatggacatttgtaagctaaagagcaaccaggaaaaggtaataatactgacaaaaagagccgttgtttctgaagtttcaaaatgtcattttaactttttaagctggactgagtaaattgggtaagaccaccctgatcctagtgatgccagagatatcttagttacaaacaatggtttgagttatacttgttgtcacagaactgaaaattgcaaaactaattttctcttatgtactcaagtgtactatggaaaaacagagatactacaaagccaccaactccagtgggaaagtcatctctgtgctggctccaggagggtttatctgtggcagagacttaaaattgtcccattaataagctttctcattggcttccctgtctaggcagaattctgagctggccacaaggccatacaatataaagaaggaatttttcagtctcccttgcagctaagtgtgaccatgtgactaactctggccaataggatgtgagcagacgtgatgaggtccacttctaagccatgctcttaaaggggaatgtggtctttccctatgagaatggccatcttgtttttgtttttgttttgagacagagtcttgctctgtcacccaggctggagtgcaatggcactatcttggctcactgcaatctccgcctcccaggttctagcgattatcctgcctcagcctcctgagtagccgggattacaggcgcctggcaccacgcctggctaatttttgtctttgtattagagagggggtttcaccatgttggccaggctggtctcgaactcctgacctcaggtgatccacccttcttggcttcccaaagtgttgggattacaagcatgagccaccacgatcagctgagtagccatctttgaccaagcagataaggatgcctcatagggttagtgaacaaaaatacaaaaagagctggaactcctaaaaattctccagaaaagagccatctcacttgttcagatctggttattcagactctacatgagaagttagatgtaaacttctattttgcttaaatcatttaaatttcagcctcttttcctgcatcagaacttttacaataatagcaaacacactatagcccttaccatgtgccaggcagtgtcctgagtgcttttactatattaactcattacataagactataatttaaaacataacattattatttgtgtctacagacacagaattcaagcactgagaggttatatggttgatccagggtctgaatccagaaaatctgactccagagtccatatacttggtcataccatttagcacaacatcatacatttaacatatattaagggaacatttgtttaataagttaacaggtaatctgtctgtttaaaattgcataactgtgtttagaagtctcaacatcaacagattttttatgtgatctctgattttcttcttcaacaagggaaaagtcatcaatttagatggtaagcaatgtcctgtagggtactctgtaccctgcaaccttttatgtagccagtttctagcatctctgagaataccctggcatgtcagctactgctgagcaaagatgtgctctgacaatacaggaacacaagagaattgaaaaggagcacagatgaacagcatgaagaatcaagatgaggcccattgcctatttgttttccattctattagcatggtgcctactaagtgccagggaccaaatgtttggtgacagtggaagaggtatacaaatgaatgagacattctttccctcaaagaattaaaatccagcctcctttgagtacaaagtctttccaaagatctcttttgtgttcttcccttaactaataggcctctcgaggataagtcccagcaaatcatttttcagtggaatggaaaaaggggaatactgacaaacatgaagaaatatttttttaaaaaatttcttttaagaaccagaagttgttggggcaatgaagatatgtaggaaaaaaaatgagaaaaaaatataatgaagttagttttgaaactaagttttgtggcaattttatgacaaagattagggccatctctttgagatttttttcttctttccccaagtatcaaggaatgaatccttgaagtttcttttttgcagagatttaagttttcaacttttcaataatgaatagccactttgctttagataactttaattaaagtttcataaatgcaccaagagccatagggctttttgtattcttgaaataatgaataatttaatcaattaatacataatgggagcaaatgactaattgcagattcaagatacattttgtcaatcatctttattgacagttatagattacaaagtccaccataccaaaagtcaagaatgccttgattgacaattaattgctaagaccaattccattatcatgacttctgccctctattttccaatttggaaagcgtgttgcagtttcgatttatacactgggaagttgtattagtatcaactttagctcttatataaatgtggcattttaaaataaacattctcccaaattaatactttgtttctgcaaacatgagcaccaagcacatggctgaaaacatctttcattacgctagtttcaagaaaaaacactccttttcactgaaatttaatttgtaagacatttagggtatccctacactatatttttaattgaattttaaaggaaggatggagaaataacagttccgaatttgttggatatttattattttgaaaaataaatctgcattcatttatttgccatagtctaccaggccatccatccatccatccatccatccacccatccatctattcatttgttcatccatcaacgcatacatagatactttatcttttaagagtcaaaaaaaagtttttgaactaaagtccaaaaggaccttccgaactcagtctgcctagaacaccacgcttgagtcaaaaattctggaaatgtgttgctgtaaactcatcttctcatctggatctcattggagtaacataatccacattttcttcttttaagcatatacaaccccagaacacatccaatttgttcacagctatctgcataattaatcagtagtctttaggttcactccacacttaaattttcacatatctatgcatgcattggatacatacctcacaggatataatttctggacaaaagaatgttacttagaatgatgagcgtctgataaaactatggctatgctctcaatatcaagacagtttggctggtatggaacagacaaattaattgaaactcatgtaagttttattaatcacatttcagagtggccacatttctcttctttggctttatagtctttacagccaacttaagtcattatcatgcattactcatgacttgtgtatcatgtctatatacttccacacttggttatccctctgattgagagcactttgaaatcagtccctaaacactctgtgttataaatattctctgtaaacctttcatgtgtatttgcatgtaaataatgaaatatttgataagcagaatacaccacaaaaaattacatcaagacaaaatttattgaaaagcatcctgatttttgtcgttaaaactcataaaactagagcttaatcacctctagattctttttacaaaagttaggtaaaaacaatttccatttacattttttctacttactatcctatgacctacatagttcagcataattaataactggaaatttttgacctcctctgtgtatttgcaaaatgtaatattcccaagtataccttagcagagtcttctgtggcaaaaaaatattcactaagaattataatctagaaagcctttgtctatctatatagcttcagacaaaatagcattttatagatcataatggtaatgtaaacattcataacttaccccaattagctgaaagtcttgacatataagattacagccatagatcgatgaagatgcagcagaaaaggtatggcatatttagaaggctagttacactcatcataacaacagaaactaaaatatgtattcttttggttatctattctgggcacaccgaaataaattgtgaaccaaaccctataaagacaaacccaaaatgtacccagaactgtgcacattaggtaaatttttattagaatacaataggaattgaggacaatgcggtcttattaaataaactattaataaaaaggctgaaagggttgaagattttctgggctctctggagatttgaactatctttgattaaatgtgagctaaaaatactccagatatcaaaaacaaaaacttgtagtggtagcaacgaactataggtatatgtagtacttattcattccataccacaataattcaaaaattcctaggagccagctaatcccttttcagcatttgtgctcagggacttcttcactttttatagctgggtaatatataaacacaaatgtccctcctttttacttgaaccccagaggaaagcagttttacagagctatggaagcagatcttattaattaaagtctattttttgttcctctaaatttatcttttactatcagtgtgttgtgtgctaaggaatggattctaagacttatgaaatgggaagcatctatcacagtgttcaatgcatgctaaataaatgttcatcctccattaatataaaggtactcactgagaccgagtgtggtggctcacgctataatcccagcactttgagaggccaaggtgggcggatcagaaggtcaggagttcgagaccagcctggccaacatgttgaaaccccgtgtctactaaaaatacaaaaatcagccgggtgtggtggcgggtgcctgtaatcccagctactcgggaggctcaggcaggggaattgcttgaacgtgggaggcagagggtgtagtgagccaagattgctccactgcactccagcctgggtgacagagccagactgtcttgtagggggtgggatggggcggaaaaggtactcactagtttattaacttggtaaaattaaattgtatccacattaccagcaggcaaaacaagtgaagacttttaaaaaatgattttacagactcaagggctgattccttttcagaaacagaaacgagttacagagctttcaacttttatttatataatattatccccgtaaggtttaaccaagaagataaagtagatgtgattggcaaatcttttaaaacttgatgtacaaatgtttgttaaatatccagggtcctaaaaatcaaatagccatttaattttgtaaacatgtttttaatatagtcttgtaattccaatgatgatccaataactagatttaaaatttaaaaattcagtaaacacataccagaaacaagaaaaattttatttgttaaatttaagatttaagtcacaatttcaggccaatggattcaaaatactttaaatcttaacttgagtcattaacaattaatactaaatatccaatgccccaaatctcctttggtcctagattagctgatgacaaatgacaagttgattgctaataagcatagatcacaattttatgagaaagtctatttgtggcttgatattctcattaatattatcaaagtccacacttccaaaaattcaaattgcttttctgtaagaaacacaagacagagtctgctctaaattggtattcccaatgttcctgcccttgggagttataaagaaggtaaaaagctatcccttcttttccctgccaattctccgtccttccatgtgagaacagactttcagaaaataacattttccttctttcatgatcaatttagccctaccttattttttcttggctgaattggcccccacctgttgcctcctggttttgttaattaaaatgagacaagtgaaaagcactgacaacctagaccttgtgtgattattaaagaatgacaggtgctttggaaatcaaacctaacaccaaacataaagaagcctttagacctctatcttacaagataattacattaatcagtgaaaaactagattaatctattggggagttaagtaactgaaaatgggacaccctaaaaaattacttggtacaaaataagaaacaaatgtcagtgaattcattgagtagtctgggacttctttttaagtcactatggtattggtcttttactaataaaatagatgacttattaaagcaatatttacactgattaattcacaacggcagtacctgagacccctaagaaaacaactattcctttaaaatccagcctgaaagtagtgctcaggtgtacacactgagccttttgtctttaacttagcaaacactcagttcaaaaataattttgtcattcagaggagaagctattttatagataaaagattatgaatttcacagctgacttgagctctactcaggtcaacaacattggtttctactttgcaagtaggatttgttctgtcaatgcagatttctcagtaagtactttcccctttcaaagaaacatttacatttttttatataaatcaagtcactgattatattagctcagattcacatttgatgcacccttgtgcccctcctcctacacttcagctaaaatggaaacagactttgtttctaacttttaatactgacatttttgagtgtaatcaaaattccagagtgttggcttagatggagttctaaactgaagaaaggagtaagggctaaggtggctttttgtttttgttgtatgtattttcctattttataaatagttcttcagtttcctgtatgatactaacaatatgcatgtcatatattaaacaatatatgcattaaaaatgaggaactgtctgccctaatatgagcatttttttgtgagttttgttttgtttttttctgagatggagtcttgctctgttgcccaggctggagtgcagtggcgtgatcttggcttactgcaacctctgcctcccgggttcaagcaattctcctgcctcagcctcctgagcatctgggactacaggtgtgcaccaccacgcccagctaatttttgtatttttagtagagacggagttttacattttggccaggctggtctcgaactcctgacctcgtgattcacccacctcagcctcccaaagtgctgggatcacaggtgtgagccactgcacccggcctcttccttttatttagtttatgatttatccttattatatattttgaaagcttagagacatgtcaaattaggaaggatcaagaaggagcttaactttttgtagggggaggctctgattctgaatatctctaaagcctgaaaagcaatttaattagtcactaagtgggaaggctccatttgatgacaggctgtaaatggcattactcttggtcatctgagtagaatgcagaaaggttgcaaatgaaatggtaatggatttaattgcttattctgatattcataaaaatctgagatgtttctcaagccctgtttagactctaaacaattttatttttccttatattaataattagtgatcaggtcgaatacactgaagccttgtctatgtaaaaacaccatcaagtgactattttcatgactcctgacttactctcaactgcctccataatgactttatttaaaccatgatccattgaaatgactcatgaatttcagaggttccctttatcttttccgtggatttatacccaaagctctggaatagttgtatgaacactagaaaaaaagaaacagaaatgacaggttccaggtaatcaatgataaaactactttgaaaaccaagaagaaataatttcatttatggagttttatgagcactgtatttaagctgacattcaacttttaaaaattgtacgtatttaatgtgtacaacatgatgttttgacatatgtaatgaaatatttactgcagtcaagcaaattaacataaccatctagtcacagtcacagttaccagttacggttacctttttttgttgttgttgttggtagggagagaacttgtctcctgactactgtcttagcagttttcagtgtacaatataatatcattaactttaataatcaagctgtacattagatcactagacttatcctgaaaaacgtcaattgtgtatacttttactaatatctctccatctccccccacctccctgaccctgctaactacctttctactgtttctatatattcaattttttaaattattttttattttttacgtttttagagtcagagtgttactcttttgcccaggctggagtgcagtggtgctccttgcttactgctgccttgaatttctgggctcaggcagtcttcctgcctcagcctcccaagcaactaggactacaggcacatgccgcaacttccacgtaagtttttatttttttttaattttttatttttttccagttttttgagatgggagtcttgctatgttgcccaggcagctgtctaacgcctggcatcaagggatccttccacctcagcctcccaagtcttcaggagtacaggcttgagctactactacaatcagtgtattaaacatttttagattccacatgtaagtgagaccatgcaatatttttctttctgcgtccggcttatttcacttagtgttacgctttccagacattcattttcattgacaggcatcatacatgatgctaaagagcatggtagacagggagtcagacagatttgggttaatgatctgagcccaccactcatccaacgatgtgacctttaaatgggttaatttatcctagtcttgtgttcctcagctaaaaaatggggataggttgataatcgttaaggttttgtaagggttaaacgagacatgtttgtaaagcacttaatgaggtcagacacgcaggagctgcccagtaaatattagctacaaatttaggacctaacataaagggatctctcaagaaaatcactgaatgcaaagacaagtattttcttaatactttacagctgagtatttgatccaaggttctttcccatttatagatttgttatttgatgcatttcattttactttttatgcagatgggttggttagcccggcctcagttatcatttgaaactcaaaagggcagaatgtaaaacaagatattcttatgattccaaattgaaaaatacacaaacatcaatgtcttcaaaactatagagtttttactaggacacagtttttcctctaacttgatgaaaaatcaggagttctggcttccattggtatctctgacactaattaattgtgaaggccttggtctcctttatttgggatatgagagttttgacaaaatgacctcttaggtcccttcagtatgtctgaaaactaattcagaatgtaaccctaatgccgtttgtgaggaaaataaaagagacttttcccctgtatgtcataaatcccaacctgtgacaagttcttcacatgtgtaaaattctgtcctggttttctatggcagtccccatgatggaaactcttttagttatgcataaaatcaggccagtttatcacccagaaaaggaagagaggcgacatgcttccagcctatatcgtctagactaattttcttgttctctctgatgccactatgggacccttgccagctgcctcctaggaaataattattaattgcacttactcaaattagcctcctcctaagtccccttcaagatcacactacagagatgtcctgagagcctagcggaagcagagaaactaaaaaaaatgttcacaatctttcttcttccaaagaggttcctgcaaatagactcatgattaaaatggacctcataacatgtcagcttcttggaatggaccctccttccaaggctagaggcctgaggattgcttctaaataaaagaaagcttgctatgttttcagttccagatggtatatgtgcactaatagacagcaaattctaaaacgacatgcctctggcttcatcctggagtctcagaagcagagaagaaatgcattagaaaaggaaagagagagtatcttgctcttgtttgtgttgggatataccaaggcaacatttcaggcagcttacactgctcatagattattttgatcaaaattgttattgctcacttctttcatttcttggataagttaactgaccacttggaaccattccccttaaaatgggtaacaggaaatcctaggtcctctaactctcagcacatattcatagaaaaccaaagttgcaatactgtaaaaggagcagaaataactaactacaattcaatatatttcattcagaacgaggctttgaaaaaagcaatgatcctttgtgcccagggctgctcaatttgattactgcatcccctactttgtgaagtgatattttgtttctattttgattccaaactgctcaaatagagtcctcctcaggcaagtgtataagaatatagcatattttggcctcaaatgactcttattaaagaataataaatcaatttaaacattattattacttcaaaaatcaaatctgtaacaaatattaatcaatctgatacttctactgttattggagaacatttagtctataaactacattatggatgtcatggtcccatttcttaaaatatgtctaggtatatgcttatactgatgcataattagatatgtttatatcatatatatactgattcaacagaggagaaaatattcgtgaagacgagattaacacagcagacagaaagcatcacatcttaccttataagactgcatttataattaccatgtggtagaataatggatgatctttttcattattatgtttcttaataattttcaaattaaaatatttgaagaaaacaaatgcaatatcctataatttgtataacataaattccattttttccctagataatggcaaaggccgcatgactattaaaactttagataagtatgtacatatacacacaaagtagccttttttattttaatgtgggagaaataagctaagaagagtaatgctatctattcttctattagatagggttttatataatacatgcttacaaaaggatcatgttgtcaagggtacctcgtcttctctttaaaacaaaactaatttcaaaggttgcttaatcaaatcacaatgaagtttcatacttttcaatttaacaaaatatcacagaaaagcatgcatcatagaaaatcatatcttcctagataatgaatttccaacaggtaattttggagagtctctatttataagctaagaatgatgatttgaatatttaaagatatgcactgctgacaaataggagtgtatttatggagtacaagttttagttatctaaggtttctaaatccccaggagctcaagaatgaagaaaccatgcactgataatccgaacctggatagatgaattctagacagcaacttgtgtactcccctcacagccacagaggtaggtggaatgtataatacattgtcttgtggaaatcataagctcaaaaggaccctagaattatcttcattgctatctcatgatgaccttttcataatatgcagccactgatcttcacgtctcaaattataatagtcaataaagaatcactttatataaaaagtatttgacttatttcacttatttgaattccagggtagggagactgtttgcagggatatttagcttagctttcaaactatctgtggttcctaactgtcacaacattcaggagtatcctaaatatataatgaaatgtctgtaaacctaaataaatgttagtataaataataaatacctacacaattggaggaatagtgtcatattgaggaattaagtcaaaatggtttaatcatgaaaagctatggtagacactggggaatgaatggcaaaaataacagaatatagttagtgtccctcctggctttgagtaatatatgctgatgtaaaaatttttgattgttagtgttaaccactgtatttattcactaatctgtaaatttgacacaatggatttattaatgtaatttaatttacttggcatttcttctcctgagaaagactcctaatagatttaccctttaccagtccaaccaaattatgagatttctcccctatttctacctcacaggaggaacctggatatgcatagattcaggatcttagttttttacttttaatgaagaattatgctattggaagttgaacaaagatatgcagagttggaggacagtcatagtatgcaggggttaaaaaaagaaaacaattttgcaggcacttgatgtgggcatgacggtggtgtgtctatgagatggctgttctttgtgggtttttttttttcttttaatcttgggaaactttgcagtttttacacatgttcatagaaccatgatctaaatttcaatatagctagttttgacagtgcttttacattttcaacgcatttttattttcccctctgacaattcagcttattctattaagtgtacttccaacctctctctctccaggctctcatcctacacacatgttaaacctgaggtatgttttggaagtaggggatctcagacagtccatctgattttttgtcacatcctctcatctagtcactagaaaatgcttctatcagatttgtgtcataggtaagccaaatacatatgttgcaatttcagctacttcatttatcaccagctaaaaataaacaaaaacaaacaatggtaaaattaaaccaccctccatttcctgatcatataattttaagttttgatagaggcaggcagtgcttgagcactacataagcaacttgttagggcatgccacagaattctgatggagttcttggggctttcttgggagtcacttccttagaaagagagaatggaacatagatggctgtagacactaataatatatatcaagaaataagttaaagtatataacaacattatatatgggtaaatgctacaaaaaataaatcaagaagagagtgatatttctatgggaagatttaggtcaggaatttttttctgatgaagtcgactttgaatagagctccaaaactatagtacatattctaatatgtctagaattatctcatcagtatctattaatcaaggatggtgaataactacagtctcattctttttgccttatattctgctcactcttacttccctagttcccaccctaagctctcacgattatactattatgatttgattcttcactgacactaatattgctcctctgagtgcctaggatgagtgtttatttagtttatttatgcatttatgatgctcttgagtattttgacaatcaggaaccacagaaatgtgaggaaagccaagccaaatgcacttcaagcagtctccctgccatgaaagctgtgagccctgaagtcatttacctgataatctgttctatgggtgctagcaagcattagaccccgtagacatgtggtgctggggaggctgtaagccaaggaatctgggcaggtataacaggaaccgaagacttaagcagaaagctgacaagaacaccataccgctacttctctgaggtcaccaacagcatctcagtccaagagtagccagacccattaaacaaaagcataaatgatgggaatcagatccttttttggaagacatcaggattgctaggatatttagtgtctttagggaagaaaaagtatgaagaaaggcagctaaggacactggagacaaatgtctcgtgttttcatgattttacttgttaactttccactcggcagacagaatctgggcacagggactttgcctgcagctgtcatggggagctctgctgtaaatatattagcatataagcacagtatacaaggaatttgttagtctgacagcacataatgtagtttaatcaatataattattgaaaaaaataatttacacacaattgctcattcactcgagtatctgggaacctcaaagagaaaaagaaatggtttttctatgctgaagatgagagcttcagaataggtagattctggttgtaaggcagtcttaatcttaataatggaagatcttaatctttgatggtagacgctagtcctcctctcacataaatactgaggaatgctaagaaatgctagtttctgcagacatctttcctgcttcaaaaagacaagcttcactttgatctgtttcccatgtggactctgtatgatttctttcagagggggaaaaatgaagagagtcctgccactttaaaaaacaaaaacaacatgaaacaaacaaaacacctctctctaaaatctctagaaaacactccatccggcctttccctttcctcctcagctcaaatcagaagcaactcaccacaattaaaacaaagagtttccttctcatctttcatcactcaaaaggccagaagagctctaatccctcagagaaaaaaaaatcattccatataattatgggtgcattgacatcaatgattttctgagtttattttttaaatgccattgtttggtaaatgccatttctaaaatgtcattatttttttaatgccactaaaccacattaagagtggtttagtagcattgaagtgcaaatgaaaaaaaagaatatattttttgtaaatttaagagagtaagaataaaaggttcttaggactgtatactctccataagaatcatgaagagtaatgccgaagatcagagaaaactaaccagtatttataatgatgttcacttctattgtggcctgagccttggggtgtttggagcaatttttcaacccttctgagccttatttttctcacttttaaaatgagggtgttaaaggcaggtgatctcaacatcttttcccaacttacccagctttggatttttttttctggttataaaattattctgattattttttcttagaaaaaatatagataggaaaatgtatatttctgttaattctaccactcacagataaccagttcggtgtatattcttctaggtaatgcttgggttctttttttaaaagccataacgaccacaataaacacagtagaatctcttttctgctttatctctctgaagaatatgtgagcttttttttccccctgttttagtatttaagtgcttaacaattgaggttctggcaactaaaactgcacaggcagcagctccgtttttctcagaatcaagcgaaactgaacaggcaattaaaagttactgaactgcaaggtaaaattacttccctgctatgcttctgggtgactaaagaagggagacaatggaaaccatatttagaattaagatagaaggatggaacatagcagtctgctctactaaaatggaatctataagcattacacataatcagcagcacttcaatcatgctctttgctcacagttacatggaagattacacaaaacaaatgtgcaatattcaaatctgtggcattgctggttaacagaaggcacttctctcccagcccacacggtgatccaaattgtctcctgtacagtcagtgcccatctcacaaatgggctatgctccaagcatctacttgtaagctcattgttccattctctgtattaagtttctcatagaattaatgttataaattgtcctcagattcctaggctagcctatatgggccagcttattaaaaggcacattatcaaaaaataacatcaagaagactatgcaaattaaccaccatagtaatgcttcttttgaagttgtattcagaggtcaattgtggaagcacaagaatagctctcctcttctgaaaattactggtgacagtttccatccttagagacaaatggtaagacagaagaataaagtttaaagaatttcgggaattcaatcaggaggattcagggccagagatcaaggaaaaggattcacattgaactgggaaagcagtaaacggcatgagatgaaggagttggtagtatgcctgataatgcttaagaaaggagaaaatgattacagtatggagaaacagagccttcttctagggtatcttcccatgactttgagctcttatcttagttagaagcttggaggctataatatctggatgtcatctgttttccacactcagtagaaatgttgggggaagaggatttggtgaactggggtaaagataaaaatgagcagtggaagtctggggaagtattaagacatttccattccaactgaaaccttatgtctatcacctctccctccactgaggactctacctggtgacttgtattgggaatagttaagatgcctggaaaatgcagtggatcttgaaatgataatttcaaacatttaatagggtagctcaaacatcaaacaacaatgaaaataaataggaatgtggaagtcaagcaacggaagatcttgccacatgcaaccagtatagccatttgcacaataagaatcacattaaattggattaagcaatctgtgagaatctccttaggataatatttttacataacaagggaatcaacaaagcagattttataactgatgtcatgtaataaaatatgaaacccactcttaaaggttatgattctattggtacagttaagtataaatctgctggagatagtaaggtagtaagattaataagtaacaaacacatgttctgctataaaggtcacttttgatttaatgagaaatacaaatttgccgaaaatatgtcttccttctttaggaggggatggtggtactaaaatttaataaaatagggtaaaaaaatgtcaaaatatcaatcagaaaacctaaggtgaactgaaagcagttactgtggagtacagtatctactatgagatttcttttaggtaacttttttatgtcgtccaacctcaattatcaattttcctcaaaattacaattcgaaaataccaaaagaaaaaataataactgtttttgggatccacgaggacattattaaagagtattttggagttatatttgctgccaatatcatgtactgaatgttcagagaaatattttctgctctgcgtttaaaaatgacaaataactatgaaagacatgttactagacatggaggagataatcaaaagaccaaaatacatgtaatcactgttccagaaggagaggggaaagagaatggacaaaagactcacaattctacataattgattaattagacaaatcctaatatcaggaagcccagtgaatccaaagcaagaataataaaaagaaacccttaccaagacagacagacacatgagcaagaaataattgaaaatgcaaggaaagagatctttaaaacagtcaggaagaatgaaacagtagttagaaataaatgataactagatttacaactaacttttcaacacttacaatggaagctagagggcaatgggataatatctccaaaatataagagacaacagctgttctattacaattgctatacccagtggaaaaaaaaattcaaaatgaggttaaaataaagctatttcaaacaattaaaaaatgaaagaatgtactaacaaaagaccttcacgaatgaaacatctaaataatgtatataaaacaaaggaaaataatcacagaaaaaaacgtctaagatgaaagaagaaaagtaaaaccatggcaaacatctcagtaaatctaaagaaagccttactttgtaaaaatattaacagtgtttaatttatagagttcatacaacaaaagtcaaagccaccaacaacatgtcattccaaaaagatcatgaaaggaattgaaacattcaaaggtccttttattgtctgagaggaaaatattagttaacattagatgttgtaacctcagctattcatgttttatatttaatgatttcaaggtagaggtagaaaagtatatcttaaacaggatattaaaatacaaactataaagggaaatactgataatttaactatatcaaattttagaactccattcaccaaaatataccataaaaagactgaaaattccagtcacatactagaagaataaacataacaaaatataatgaattctaagcatcaataaagaaatgataaataatctaataggaaaaaaatggactaaaaatgtgaacagatatttcacagaaggggaaacacaaataacccagaaacatatgaagacatgtacaacatcattagtaatcaggagaattcaaattaaatcacaatgaaataccattgtacaatcaccgcactggcaaaaaatttaaaagtttagatgagaacacagagcaataggaagtcatcatcccccagtggacagcaggtgaatggtaagtaattttactaggaacgttacatgtgcatcctgtatgcattatatgtactgcaacaatactgctcctgagtctatgccctagagaaattcttgtgcatgatccagagtcacatgaaacagggttcaaggagcactgtttgtaagagcaaacactcaaaaccacccaaatatccatgagcatagagtgggttacaatattgtgattttttttcactcagtagaatgatacacagtggtaagaatgattaaattaaatgctataataaaccccaaacaagtttgacagacaaaaatgaaggaataaaactactattattccatttatataaaattcaaaaacaggcaaaagtaaacagtatatcatttactgatacatgcatatatgataaaactattttaaaaagtaagaagattataaacacaaaattcagaaggtagctagctatctcaggataaataagaggggcatacacagtgcttcagataggtactgctgtatttatgtcatgtgctggccacaaagtttttcaatttttaattacattttagtagacacacatgaattatataagttttaaaggtaaattattatcacaataaagaaatatttaatattgttaattgcagtttaataaacataataagtttaaattaagaagaaaagcttttcttttaaactaaatgtttaaaatttgggatttttattaaaaaatcacatttaaagaaacatggcaaaactggagtttaaatgggggttcttttctgagtcatatatttgcatagtgtcagtggaataataatgactctagttattctgactgaaagttgaaaatgtttgtttgtttaattattttagtttgtacttcatttttatagcattccctcacattaattatatattgtagttgcattatgcaaaatgaaaacaaataaagttagaaatactatgcttcataaaacgtagcataaagttacactggctgatactcacagtcatttgtatagccattgccttgaaatatactgatcacaagctcctttatctccaaaatgtctgaatgctgttaacatgagaaaaagacacctgactaacttgactgacctgcagcaaaattatttgttttcatcgaaaaggaaggtgccctcctctctgttactcacttttttcctttctgaactaatttctgagaaaattactcaattaatagcactaatttataaaattaattgtgtaatttgcctagattccaggcattcattagctctcatggaagcacctgtgtggagaaaactatcaggactctttggaaagaagacagtggcagacagtggcagacagtggcagacagtggcaccgtagcacctcaaataatgcaacaaagacccctacgcgagcttgcatcctgtcaaagaagctgttttctgctctattgaaatctttggcttcaagcactaacctcctctcatattcctttgtcccttaagctccaacttcactatgcaatcgtcctctctattcttgcctcctccagttctaactcaagtttcagtcttattagaaataggacatgctcactttggcaagacatggctccttttttacccagagggtaaagcactatagcaacaagaggtacacaggtaaaggacagtgttatcgaaacctaacatttccctaactatgcccaccctcactcctcatcagtgagcttctcctgtaacctggaccattccaaacactaacaatgactgagaagcaaaaagtttccacagccttctaacatcatcaattcaagtgcctaacaattctaatgagaagggtcttgaatgataatatttaaagctattttttcttattttatcagataaataatcaattttttaaaaaggtattcatttattcttatacctcaatcatatatatatatatatatatatatatatatatatatatatatatagtatatgattagcatcaggttagtctgggagtaggaatgggtttgtttgattaagaaataaaaaataagcatagtatcttactataaaaatgttatacttagaagagaatgtatacatttaaagagaattaaaatgaaaatgttttcatttctatatgttaatataatacagtgccaaacgatttggcaatggcattaagtgacacagaagttcaaagcacagacaaataccaatgtgagcaggagtcataaaggcttccaagaggaactagaaagagagctaggatttagggaattgatgaatggacaggagctaaaaacacagaggggaaggaggagggtatttctggcattggaaatcgaatatgaaattcagctcaagcatgtgaagataagtaggggctatgaccgtgaggtatggagggggctgatgccagtagctgctctgatgagaatatgaagagaagtaccacaaacactttgaagtctggctgtttcattcattgaactattggaatgtgcattgaatgccatctgattcaacagcaatggtttgtactcttctatcctctgataatttgctggcagcacacaccttctgtcatgccaaattactgcagcctgaaagttgtgtaggaaaatctgtggtggcaaattaagtccttgccatcctgaaagaatccaggcattcaggattgattattaacaactggaaagctgaggaagcaaagagaaaatcatcaccgtctacagccaaagtcccaaagccagtaaccatatagatattaacattaggtagcctcactggaacaaaagcattctttggtctctaaccacatataattcagagagatagcacagtatgcagaaaaaccagactaagtatcctggaatgcatgactctacaccaaagcgatatataaagtatccagagatacctagtatgacactgtcactggtccaacacattgtctgtattcctaaatctaagaaatcatagaactaacagggattatgttgttgaatgcagtatgtcccattagaacaaggagtgaagtgatattcactcactgggagaaataaactgcagttcgtgtctaagatatagaaagattcaccttttccatcctatggaccagtaacataatgtatacctttgaactttaaagagtttaaacagtgcatagctttataaatttgtagtgagaatcagggagacataaagttacaaaatgaacatttttttttcctaagtagcagtacttttcgagaaacggaaggtattgaatattcactaccttttaaaagatagcaaatgagagaggcaaggtgctttttgtttggttttgttttaaattggggaaaatgacaaaaattagcagttattaacttcacttttcattagatttaatactatcttccattctacaatattgtataatatcccattctacattgcactccattctaataataataaaataataaaacaattaaccagaagtagctaactagtatctatgaaaatacttacatgccagatatgacattaaatgatctagaaacattatctcatttaatttttatatttactgtaatatgtattatctgcccattttgtagatgagaattagctgagttatcattgatgcttagattagcaaagtggtctacctgtgatcacagacgtaaaaaattacaacatcaaaaaaaaaaaaaaaaaacagtctgtcatgtgcacttcaagcctgaaatggattaaatctagggactaaacacctactacctggtcagatgttacaatcaaagaaggttcctggagacaagggctaactagaaggttaacacaaggaccacgaaggccaattcctttttatcaccttagctatgtaaccgtaggagttgcctcaaaacaatcatttataaaggtgagaacaaacaacaacaacaaaaacccagaaacctccaaatacttcgtgattggaagagtgctgttgtggggtatgagcaagctggttgcatttaataatctgaccatcaagaaccattctgttcacttctgtattaattacagtaaaatgtgtgtaatatatctgatccctagaagatacctttttaaaagtatgcaaacacattttaaacaaggaattgacaacaatgatttcttagacaaggaatttttcaggtgataactgttttagaatgatgctactctgtaagtatgaaagttctctaatctatcactagattggctaactaatgaggatgagtagagacagaatatgaatttaaatacgcattcattccttgccttcaccaagatttatttgtaaatcaatgttattttattttcccattagttatatttgaagtaattcattccaaatatagaaaataattaattcttgaaaaattaaattcaaaagctacaatttaaaaattaagtttcatggagttaagtattaaaagacattagtcctaaacacagtctattccttgacaccagtgttttctctgtaagccattctgtataataagccgactaacattctaacacctactctaaaatgatgatctctctcctaactgtaaaataattctagtattatttttcattattaactatgattttgaaaagttgaaatgatttagttgtatgacagtatatattagaatttagtggaatgtaagcataaaaaactatttaacaacgttcttctaagagtcagctcataggtcatatccttcataaaacttatcggaagctttcttccacccaattaacaaatccctgaggggtcaactgtaccctatatggttgttcagagtctgtcattccttgagtaatacattataatagtagctctaaaactttaacatacagcagaatcttctggagtgctggttaaactacaaattgcagagcctcacagtcagagttcctgatttatgaggtctgggtggaacaaaataatttgcatttctgtacaatcctaaggtgaagctgatgctgtcagtctggggaccacattttgagaaccactgctttcagagtgtttcattttcaaaaagtctgcctcccactatgagactagaaccactaaagagcagatatggtgcctagcatgttctaggcactcaatacatatttctgaatgaaagaatgcagaggcccctgcaatgtttggaggagaaccaaatgaaaaatgagaagactgacaacgcaagtttcgggaaataaactatatatatatatatatatataacttagcagattcaaattttatttaaaccactgtgaagtcaatactctgaccttacaaatggttcagtgaaaatcttttgatgtaaagaaaaatgcgaagagtttgaaattaatacttggtctaggttcctctaagtccttttccaaaatatgcctatgtgtatctgttcattaagcaaacatttactgaatatataccataagcaatcaagctagaaaacataggaaacgacaagttgaccaaagtattacttcattttaacaaaagtggatcaaacaagtattcatcatacaattctaggaaaggggggtaccaaccgccagaaacaagagatgttctagaaactcaaagtagttcactagtgaggattttgaggtaggtagcagatagggaatcacagaaagagctggaaaactacgtaaacatataaagctggcccgaggacgggaaggctttgaatgtaagactaaggaatttgaacttacttttgtaggggtgagaagaaagcaatacttagcaaaactaaacttcaggcagggtatatgcttgagtagaaggagactagaggcagaaggactagtgagaaagctactgaaatgttctccacagaggtcagagcgacctaaaccaggtggtagcattaggagtgaaacacacagaaggcaaaatcagcagttaggcaaccgattaaatgcatggcaagagagagaaaaatgaattaaatggaaaggttttgagccttaatgacccaataaatgaagatgccacttaaaagctaaagaagccaagatgatagagtcaatatacttaaagacaattaatcataaacttcagaagcactcacttgcaggaacttctatcagagccctgggttgggggaatcctagcagtgtgttcactttgccatatacatgtgtaaagtgtgtaagtcttttattttattttattttatttgtttatttatttgagacggagtctcgctctgtcgccaggttgaagtgcagtggcgcaatctcggctcattgcaagctccgcctcccgggttcacgccattctcctgcctcagcctcccgagtagctgggactgcaggcgcccgccatcgcgcccggctaagtgtgtaagtcatttctatcttgcctgcttaagcttctccttccactcctccaacatttccttagtcacactcacctcccaccagatggccctggagaggctgtggtcatttttatttaacttttggcattctttccttaattggaactccttgaattatattagctttaagccctgaaaaatctgaatctgaccctgcaagaatagtttctggttgtgaggaagctgtgctcagttgtattcttggactttgatgcactacccagaatttcaggtggaaaaagcccaccatgggtttaaaaatctagcagaacatttgggactggggaaatacatgaggatagttgatgaaattactcaagaagagaaaacagacagaggggagaagacctaacattaaatttctgtaccctgacatcaagaacaggaagaagaaactgagaaagaagaagaggatggaacaatcagaatggatgaaaacaacaataaaacaatgtagtccagtgacataaatgccaagggaagaatgaatcttaactaagtaaagatgtagactgttccctgtgctgaaaagaccagaaaagatgagtgctgatataaagccattcctatggattggtggtcactggaagggaagatatgaatagagggagaagtttgtcatgccccccaccaggtcccatggcggagctacaggacagtttttctaacctcccttagggggatggggactaaaatttgctgctgctctagtgacaagcagtttacatatccactggaatatcgtaagatggtaagctagtatgattgacattttacaaatgagaaaacgtgtccaaagtgacaccaccaaccagagctggaactcaaattccagattttcctaactccaagtctactgtcttattctcatggccaattttaatagcaatgtacctatctatcttcactattattaacagtattattcaaataattacctggaatttagaaacagaatagccttgtctaattttaggactgttttctgaggttccacttcaattagaaatgcacacattagaaaatgcacgctattgcttcagtaatattttatatgtttgtaaccctttatttaaaaattaatctgataacatttgtgaacatgttaaaaagctaaaatgtcagcactttacttttccttcttcacagtttctaatctgtagagcctaacaaaaaaatgattaacatttcaaaagaaaacaaggaaaaacctggtagaaatatatttagcagagaaagtttctaagtatgatctgttgtttgaatatattttttaaaaagaagttcaaagtaagcattttacttcttgcattcataaagtgtttatcagttttcatcaaaacaaagaaaataagacacgattttgtttttttcatttcatgggctgatttttcatattttaaaaatattttacgtttgtagtccaatattaatatttaacacatggattaatgtacatgtgctgaaagatgaattgaataaatgccaggaattattaacaagcaatttcaactaaaactataaaacaatttcagcaacaattaccttaagtgataaattttccttcaatttaagaaataattttatccctcagctgtttattgaaattattattttgtacttgctgtatctgaagacagcaaaagacttagcccatgtaaaagtagaaagtactttttcataagtattttaatttcttacgataacacttagctattaaataaaattgcgggctggcagctgtaggctcaggcatataatggaagagaaagatggaaataccaaaggggcaggtagtcatgagcaaggacctgaaactttgatatatttgaagttttcacctgcaaccttatcttcagtttggtagtaacactactatttagtgttacttgcttatagttgtttctatccattaacttgctttgttaccttttgctatgtatataattatattctatgtacataattatatagagttgatgctatcctaaacaatgctttaaagggtatattttgtaattcctaggctgttctttgctaagggacttcagctagagcacacctatggtgcaatttactgtgttgaaactaggcagaacatcaacaataaaatttggaacacaccttaggtatggctaaaattttttaaactgacaatactaagtgtaaacaaaaaaacagaaacactgtaattctcatatattatcagtggaagtttaaaatcatgcacccaccttgagaaactgtgggacaaagtctaacaaagttaaacaaaatcctgtttcctagcctttccacttttaatatatgctcaatagaaatgactattgtgtcccaactcatttaaaaatgcttataggtataatagccccaaactggaaacaaaccaaatgttcttccacatgagaataaataatcaaatcgtggtatatgcatacaatggaatatgactcagaaataaaaaataaccaaccaatgatacatacaacatggataaatttcaaaaatatgatgatccaaagaaaccagacacaaaacagaacattctttacaatcccatttatatcaacttcaggacagggaaaatcacttatgatgatagttatcagaatagcagctgggcagaggagaactgtgactaagacgtagcttgagagtcacttcctagaattacagaaatgccctgtgtatggatgtgggtagtaaacacatgtgggtatatataggttaaaattattccactgacttatacacttaaaaacttgcacaattgtattgtatttaaattatatttcattgttaaatagaagtcaaaaccaaagaaaaccttcatcatgcttctttttcttttttcttctccctccctccctccttccctcccttccttcctttcctcctttctttctttttttttgttttgacagagtctcgctctttcacccgggctgaagtgcagtggaaaaatctcagctcactgcaacctctgcctcccacgttcaagggattctcctgcttcagcctcctgagtagctgggattacaggcatgagccaccttgcctggctaatttttgtatttttagtagagacagggtttcaccaggttggccaggctggtcgcgaactcctgacctcaagtaatctcccgccttggcctcccaaaatgctgggattacaggtgtgagccactgtgcccggccacttctttttcttacatggccacttatttttcttctttttcttatattttttatatgtgtattctgattttcctcgtaggattttttgcttgttgaaatgaagcagttaagatgtgactaatacaacagagagcatcttgaaaagaatgacatcatatagcaagcctgtccaatctgcagcctgcatatgacctagggtggctttgaatgtggcccaacacacattcgtaaacttccttaaaacatgagatatttttgtaattttttttgttttttttttagttcatcagttattgttagtgctagtgtattttatgtgtggcccaagacaattcttcttccaatgtggcccagggaagccaaaagcatggacacccctgtatagcatgagtaaacacctcagcaccaaggctagtaacagaagagatgaatgacttaataacatttaattccctcactctcccttctccaggctgcagcattctcaagaatgaattggaaacttcggttgggtgtggtggctcacacctataatcccagcactttgggaggccgaagtgggtgaatcacgaggtcaggagttcgagaccagcctggccaacagggtgaaacccatctttacgaaaaatacaaaaaaaaatagctggcatagtggtgggcacctgtaatcccagctactcaggaggccgaggcaggaaaatcgtttgaaaccaggaggcagaggttgcagtgagccgagatcgtgtcactgaactccagcccaggcaacagagtgagactccatctcaaaaacaaaaacaaaaaaagaattggaaacttttcatttcctactaattccgtcaccgctataaacttctgtcacctctcctaaattccaaaacctcactatgctagtaagagcctcatgcacttgactcctgacccagaactgcttggtcaaccttctaacacatcttgtctcttgttatttcaagcacagttatctgagtagatgctagctcaataccccctgcctgtggaaatatattaaatgcctccacatacagaatcatctccaaggggtagaagataagaaggctagaaaagaagttaacaatagagaaaaataccaatagattgattacaggaaaatattacattcctaaacattaatagcaccataaacaaaattaaaaggtatgtaattaactgagaaaaaaatgttagcaatatatataaaaatactaaaaagggctaacaacatcaataaagaattcttgcaaatcaatgtgaataaaaggaacacatcactaggtaatgcaaggtaatgaacagataatttggtgaaatacaattggcaaatccacatgtgaagatgttcaaacgcagtagaagttaaaacagtgtaaaacagttaaaacgatgagggtttttttttcttataaaatgataaggactgaaaataataattgcaatctgggaggcccattgtgctggatagtacaggaggtagtataaagaaacatacagaggaggagaactcagtttggcagtgagtattaaaaatctaaaaataactataccttctaactcatttccacacttcgtacacaatacaaatatttagattaaactatcatatataacagtagtgtgtgtgtgtgtgtgtgtgtgtgtgtgtgtgtgtgtgtatatatatatatatatatatatatatatatatatatatatatatatatatatatatttttttttttcccccccgagacggagtctcactctgtcacccaggctacagtgcggtggagcaacctcggctcactgcaacctccacctcccaggttcgaatgattctccagcctcagtctcccgagtagctaggaatataggcatgtgccaccatgcccggctaatttttttaattttaatagagacagggtttcactatgttggccaggctggtcttgaaatcctgacctcgtgacccacccgcctcggcctccaaaagtgctgggattacaggcgtgagccactgcacccggccagtgtttataaaatttttaatggaaaaaaatctatctgtccaatatcaaaaagattggtaaaataagtgcagtctagatgatatgccacgtatctctaaatatttatattatagaaggaaattaatatcaacaaaagatgtgtatgatgccatattagtttttttaaaaaggttgcaatacagtctgcacagtaggcttctatttttttttaaatgattaaatacataaaggcaaactactaaaaggaatataccaaaattttaatagtgattttctttagatacgattctggatattctattttcgttctcaaacttctgttttccaaatcttctatagcgataattataatcactaataaccaatgttatcgaaaatttccatgatctctaaatgccttaaagagttcgacagaaagaatttaaaaacataggctctcctttttcttctttcattagtgatgatgggctattaaaacaaggccacgtccttttgctttaacctcccatccccagggatttcacattagaatgtccttcctcccaatacctactcctaaccttccccaacccagaagttagtttctctccattaaaaaaatccccacagtagtataaattaagcaaggaaccattttaaactgtcagcttaatggtgcacacaggaaatatggctgctctcagtgcaagaaaattttaatgaataaagtagcttaagaaaaagatattttccaactataagtggaaaacttgttcagtttctcagaggttgtttactgccataggaattacctatttaaacttcttcacaacgttatcacttggatatggttaggttattctgcgtgtgggcgactcattaataaagctgaaggaaaagcaggacagtgctaggaaagaaatctagagctggacatttaatattcttgtgtgtcagagactacatttgtaatattaggggtgggaagtagttacttgctaaaatcccactttatactccgtttctgattctaggggtgtttttgtcatccatacaaagtcaaaaagaatgcaaaattataacccaataataatgtcattttttaaagaaaagtatagatgattcaagaccaagaaagaggcagttcataaaagatttaatgttgaaaaaccacaaacataaaaggaggctaaaattggaaaagacattataaaatctaaaactttaaaaatttgatatgataaaatatatgctggaaataatatgcaagaaagctgcatcaaagctttcttggtcaaaggaaaaagtgttaactattaagagattttttaccttaaaaaatacaaagaaacaacttagtttgcattatagactaaaataatcttttcaaaggatattgagaatagaggaccaaagagtgtttttatggaaggacaaaaggagaatgcagagtgagatttaaaagttgtgtgtgtgcatgcatataaccctcaaaagtataactccacaccaaaaacaaagaagtagctgtatctagggatgttctattccatcaaaactatgtctgtgaagctttaaagggaatcttcttgcagtctacttcctatatgaatactctctatgtataacagttcattctaagagaagagcaatagatttaaccacttgttagtatccttgttagcagtatatcaacagcaattgatcactaatgtgaaggtatcaggttttaggtaacttccaacaccattctccttgtgttcaagtgattttcctgcatcctctgaatagaaaccatcactgctaagaattgctccttagacagtacctgctggaggcttgcaaagatcttaggtaaaaagtcgtaagttgaagatattagttgataatggcataaggtcttgttcctcaagcaattgtgctaggaccgtctacattataatctcttaaagtggatatttagaaatgcaaattcttgagccctacccccagattactcaatagaatctttaaaggtacaacctaggcatgtgcagtttcagtaaactccttaggtgattctgatacagtttaaattttaagaattaaaatttaattatatctgtttgtattacatctcttcaacatacagcaaattttaataaaagctatcgaggtactaagaaatgaattgtaaatggtgaaatcacaggcaatggaaggaatatttaggtgttgcaggcaatttattatagcttgaaaatcataccatgctaactgtagctagctttaaagtaagttctgactaacagactgaacatattattgcttctgtgtgagtagaagaggttatttagaaatctttctacaaacatttgagtatctatgaaaatttacttttgcacactgagatataacaaaaaccacactttctgtcctcaggaaatttaatccaggaaaattagagctctgttttgaaagcagaggaagttaatttaaaaaacacagactggatgtatcttaacatcacctcctaagctcactaatgatacctgaaagcattcaccttcacctagttggagagatctctgctgcaaggaaaatgttaaccatcttgccagctaggcatcattcttcatactataataagcaaaaggcatttccaaagtgagactctctttgtaaatttgtttgtcattcttgtgaagaatcagatgctgtaattattaagctttttacagaacatttcaattttccaattgctctttaataattcccagcaagtaattggacattttaattatatgtagcttcttgtcactgttcatctaaaaaacatcacaacattaaactaagatgctcagcctgagtgttttcttgggttgtatgcatattttttgagttatttcaacaatgatcaaaagccagtgagttcatccttcaaactggaatcctcatttcttttccaaaagacaaaaactaataagcaacaaaaaaattaaaccatcacactaacaaaatgtattaaaagtcaatcgataatactggccatcacaccaacaacctctacctttattttattttcccataaagagccactaatccattttgtttttttctactagcttagcaagtccatatggactggaccctttcagtgtttctttcccagaatccctgcagaatcattgatctccttgatctactcatctctttgatcttttgaggatagtctacaaatagcctgtgctcccctacgtgggtggcaatagcagccctggagccttcaaaccagcttatggggttatagtcccagctctgccagttacaaacatgcgactaagtcaggccaattaaagtgaccgggctgcaacgttgccctacctgcaaaatggggcaaaaatcttccatatttaatttacaggcttgtgcagatttcatatgaaataaaaagagaagccactgtgtaaaccttgaaatctctacaaatgtgaaaatgaaaatgaaccaaacatctccccaatattagcatgacatctatcaggctcctatagaaatcagtaatgaaggaggatgtgtgcccacccagccatgccatggtacaaatggggcctctggtgtgtcagaaaagcaactggaaaatggaaaagagatggttcccatctttcctgtgtctgttctaggacactgcgagtcctcccgaaggtgtctgaaagaacacaaggcaggcatgttaagtgtgaaagacagcagaatggatttgacggcctctattaggcctgaggtcttttggcagagagtgagagaatgtcctattccaagcagaaggcacctgataagcacttgattgattggtctctgcattcttggcactcagtgaaacactgatttgccagcagagtgtgtaaacacccacattttggtaataacctaaatatctgcatattgtgaatgaggaggctgactgaatgaaattgtgtaaaaacagaaagtcaactccctgcaagtcttgccttcaccattctctttgcagatgcaggacttttaacagtgaggatattaggacatccacaagtgaaggatggagccctgccctgctctttgggagctttttgcctgtgtgtgtgtgtctggccctcattcaaggatatgctcctctctggcaactcccagccaatgtctagagagcacagcactgtgttttccaacttaactaagaattaggtctctttgctactgcctttccttaagaccaggaccaaatatatatatatatatatatgtatgtagatattgtttaacgggcctcacgtctaggcaaaatacacacacatacatacacacacgtacatacaaagtcattcattcaatagtaagctgcatttgtctggaattactaacaaaaattgaattagcaattattgcactgttgttttcttttaaaagcacaagttaaagtagtgttttctgctcatgcttaataagattgcctttctctctatttaccacatacccatctttcagagcttctctaaaagcctatgtctttcttgaagcttttactgattcccttgctggaaaatgtatctctgatttctaaatacctacactgccctagcacagattgctaagtcatgttctttggaggtcctatttcccaaatggcaggcactccatcacaagggtctccaaaattctccaaaacactagggaatgtatgaatatgtgaggtgggaccgatattcatattggctccagaggagccaggcaatgctttctccagggatacttttcactattatctgttatctagaaaatcgccttcattttaagatatttagaagaaaatccaagttatgtggtttcatagattaaacttattgctggcacttacataccactaaaagttaaccttggaggaggggcgatacagactataactttaatcatatcagcttcttgtcttaaccacatcttgctttgactgaactactctgatcctaaggactcctgactgttgatatcacagcttaaaggctttcttcagactccgggagagaaagtggtgggacactctgtaaagtgattcagttccaaagtatatatatcatcccaggtgatcatagagcttaaataaagttgcttcaaactagcatgaaattttgtctaatacacagtccccaaaagaacctctttagaaagaggatgaaaacatttaaacatggatgttaagttcctattaaaacactcatttattttaagaaattcgctagttatgttttaaaaattgataattaaattacagttgctgagcattttcctttgacttggtattttgaaatgcttgtgttctgtctaaatgctagattcttagcatttggctaaggtatacgcatcaaaatggccacagtaaaggaagtgacattagtaattctgggctaggaagcactgtttctcttaccgaaatctctcgcaactgtaatccagccaggtaaagatagctttgtgtttgctgacattttcagagttgattgggcaaaaaaggtgcaatcattttcctaagtttttcctcgtcatctttaccctctccccaccaccccctgccgttattttcaaaaggcttaatctaaattctaaaggaatgttctaagagagcgaggaaaaaaatattcaacactaaactgcagcaatagccttgacagttcagttctgctgcaggtgtcctggtttaactcccacatggacaaaggggatacaaattgttgggttactacacaatatcctcttgttaacatcgtgttgtcctcttttggaagaatcagacaccaggaaaggatctcaatttcaaccctttgtcttttacttaaagaatctaccaaatcagtctagaatgataagaatgaaatgtgttttaaaaagctcagaggagtctaccttatatctaacctcagtcctttctgttttttttttttttccagagcagaaaagacccactgttggagaggggttcatctgtcacttgaggggcagcagcaatttatcagttcctgtgccagatgtttacataatatcaagtcttcacaacagtcctacagaggccctatttcactccaggcaaaaccaaggctcagaggcttaggaactgcccaaggtcagatagttagtagacgcaatgagaattataagagtaatcctttatgtcacaagggaattccagaattcctgtaatgttattttaagtggaatgtgtgaaatgccagtaaataaacaacaacaattctggtgttaaattgaagaaacaaaagaatctttaagaacaatgtagttaagagactcaaactagaaagaatttaccatcctttctgaatgttgctccaacttatagtctaatataaaaactcataagaaatgagtagtagagatgcttaaattctctatctagtctacaataccatgcatctagaaacgacacaatttgatttttaaaatcttcaaggcttcataattaagagaccataattaaaattagaatactcaaataagtttattaattgtcagtcttttctctatatcctgccttcagaattatacgattttatttaaccatttgcaggattcctttcatctcaggagagtataatcatataatcagactcatcaccactgttcccttttaattgtaaatcatgactgcgcttgcaaattagtctattatcacagcagattatcaatttggtagggaaagtatttgccatctagaatgaaagtagttaataaacattaataaacatcttaaatcaatcactcctttactcttggtgtgccgacagatgtcatttgagattaataaatcagtcagaacaaataaagtgatgaggaagcgaagcacaaggaagcctctcgatgccctgtgtacttaagaatcacaatgcctaaaaactaattggaagataaagataaggcattaaaccttcagagaaatgacttgttggaaattagacaaagtaaatccagatagccattctctgtgggtctgttatgaaccactggcaataaaagctagaggagaaacaaaatgctcagtcagaataaattatgtttattgacagcataatgtagaggttaaaagcatggactttcttttttctttttctttttttttttttttttgagacggagtttagctcttgttgcccaggctggagtgtgcaatggcttgatctcggctcactgcaacctctgcctcccaggttcaagcgattcttctgcctgaccctcctgagtagctgggattacaggcaaaggccaccatgcccagctaattttgtatttttagtacggatggggtttctctatgttggtcaggctggtctcgaactcccgacctcaaatgatctgctcgcctcagcctcccaaagtgctgggactacaggcgtgagccaccgcacctggccaaaagcatggactttctaattggcctgcttgggtttgaatccagggcccacaacttccgtttcagtgacttaactatttcttaattttgctgtgcctcaatatccttatgggtaaaatgggagagtaaagtacctatctcataaagttgttgtaaggattaaatgaatcaatattttgttaagagtttaaaacagcacctggcatataacaagcactgagtgattgttcaataactaaatgatataattggccatttactaccattttatgtgctctagttctttctctgcacaggcttttatgagggagaattggggttgtgaagtaatcccacaatattttaatcacttcctcactataagccaagagttgaattaattcattttgtaaaaataattaaaatttaattaattctattaaaaagaaaaaaacacaaatttttcatttaaaaataagattactgaggcaaaatgttaacagtacaaatagactgttgttgtatagtccagtcattaattaaaggcatccagatatcaataccttgtgtattaacacaagacttttgtataaagatgtttaccagaagcccatcaggagtgttccacttttagttatggcacaaaacgttatccactagcatcatcaacaactcctctatatctcacctaggactagtcccaagaaaaagaatgagtagggaaaccaaatacattatttgcatatttaacagcatgtccaattagccactttgctgacagagactaatttattattcatcttattccagcatatgttactactttgacatccacgtgacaaatgactgatacagcacattgtgattttgaaaatgttaactgtggacttcaagaaaatgtagcttagactattgaggaaagtttctctgcttcaccttcagaaatatggaatctagaaaatgatcaatttttctactatgtaggcacaaatggtccaatatgacataattttcagaaatgagtatgaaataaaaggaaataagctatcaaatggtgccctgaaaaccaaatagaaggttcaatctctacgtacatcctctaggcaaaaattctcagaggtatttaaattagacatgttccagtattatttctctatactagattgtaatatattttataattgaaaaggataactatacataaaatgatatagatgcatagataggaactaaatcattcattcaattaacaaagacagaatcttgaaaaatttgaaagccaagttcctcagaaaaaccacatacttctttcaaatgtgcttggatagttttatattagaaagagaaaaaaaaaaaaaagataaaacaatgtgttgctgcatgccccttcaaaatgtgctcatcggttactgtgagagtactgtgtcacggggctaccacacttttcctgaatgtattttttagaacagcatcacagtcaactcctagtgaagtactttatgctctgtaactatccacactttagatttttcagtcttaacataaaattaaaaatttcagaatctaaaattatctgttttaagtagcattaaaaataccacttctctttaagcagctctgaaacctgaagtcatctagaaaaatatgccatgatgaccaaatggtaactaattgccaagacagactaaaccacataaataattacatgtaccatcgttagtccaatggcaacccagataatcaaaaaaaccatgattatcatggcatcatggcagaagtgttgtccaaataagtaaatttcactgccttgtattttaccacatattaaaaagcactcttttacaatctgttaattttttttctttctttatagttgctgattttcagagatatatcataatgcttttaccaattttaattatttgacaaacaagtcaccaaatatatacaggaacatttaaaagttcacaaccttggtttaaaaaatgtaggtcacattatgcaatacatttaaactggggatctcagagcccaaagggttctatattctgaatttcacaacaaaaatgactacaagattcaaagaaagttcatagaaaacaacatatacataaccacataccttgaaaatacactggagaaacacctttctatactgcctcagttaaaattcacaaatctcaccgatattaagttcccacaattaatgcagcaggttcttcttatctacttgtatatttagtgattaaaaggaagtctgtacaggaatcatcatcttctagtgttaaagctttttagtatagtggttactatttaataaataacattccttatcactacctgagcataacccttcaagtcaaatttgagaacagtcctcatttattaatccatctccatcttcctacttactgactaagtaccacaaggtaatattagataaaattccttccactgaaatgcagacataaatttcacatctatattgacttgaaattcttaataactatgagttagctactcttttgtggctaattttattgttaatgaagaacattttttgagacatgaattggaaagtaccaatgctgggacaaatttcaggtcttctaatttaaatccagtgggttttgtttgttagtcttttccaaaaccctgccttttatattgtcatggaaaagcaaatgtacagtggctatatattaattaggtgaacctgacataatcatcacctctttaaatttgtttccttgtcagcaaaatgatgatcataagccctgccgtggttgtgatgatgattaaatgagacactttatatgaaggcactgtggaaatatatacttaaaagatagctgttttcactcagttctgtcaaaagcttgagggaatgcattgttatgtgatcaacactgaacaatcttgtattttgtgagagaatggaatattttaaaaggccattacaagcttctatgtggagagatattctacaccctacatagaccagaaagggctgggcaaaaagaccaaatgaaagaagcgggtgcttttctaagaggaaatccttgagacctcagttgcgagacaagtactaggccaaatgcaccttgagcctgaccaccacgccatggctcctgtgcacctaagtaagccactcccagaataatcatgaggacaattagatggcttaagggacctgaatataatctttgcaaaaatatctccagttacaatatgtttagaatcaatacgtccctgggaaaagacaacaagaccatgaggattttaagaaatccttatgatcaaaggaaacttagaattggaaatgatcttagaggtctgctagtccaatttaaaaaaaagagagagagaaacagagaaaaacgaaacaagaatatgaatgacaaaacagtataaaaagtcatgctcattattattgagattgttaacatctcaaaacataaattgtgtttttttctttaaaagaggcacacactgtagcataaatgagtcatcgagggctgactgtggtgatggtcaacagtaaaggaaagctggttttctctgtatgaaccaagtttggttgctctattctcttctcaaagaccaagcctctaatcccagttaattgtctaaaaaggactgcttttggtcatacagtatacaggtgagagtgtagatgaattagtgcaggctttcccttctattggagtacaggctttatggaagagtattccataggaggaggaagatgagttagaagatatgggtcctgcctccatctctgctgctgatttgctgtgaccctatgagtgtagttcacttaaattatttagatctctgttgtcacatctgtaaaatgaaaggaatatactcctcaaactttagaactgaaagaaatgatgttcaaagtggtaactgaattccataagtcactgagttaataactggctgaactgggacaggaactcaggtcttctgattttaaggtctagatttcccctacatgtgctctaaagtctcttttaagtatttcttaaaaaaaaaaaaaaatcattgggaacctactatagtctgggcacttttcaaattcatggtctcatttattcttcacttattgtattttcattttataaatggagaaaacattcttagtaaagataagcagcttcgtacatttacacagtgctagtaaatggcaatggccaaatttttacacagatatgtttctgagaagtatttagtcagaccagtctgcattaattattcattattagtgtaaatttaaatcactgaattcctatcttaactacatttacaaaacaagacttatatctgttcgaaaagtagaaattgttatgttttgttagaaaaaatatatgcagcaacttggtggaaaacaactgtataaagagctctttctagaacattaataatgaagggcaatagaaagtggtgtagataaaatttactattttgatgtttttatcagatcatttcatggtgagtcccagatgattgctacatatacataaactttatgttttttgcatttatgcttggaaactatgtatttttaaggaaaaaattgaatttgcctctttaaggattaactctttccaacaatagcttggatttttagaactaagttgtaaacttcttgatggttctgcctccgatatcttgcctcctccaacctcaactctactctcatccttattattctctggtcctccatggtacctggtacacaaatacaaacacatgctcatagtaggaatttatgatatatttagtgaataaatgaatgcatgaatgaacaatctaagaaataaatctattaaagttttgggcaaccaaaaaattattctaaagtgccagggttacttggatcatcattgattcaaagattcttccaaaaatagtagctggccatcttgttgaaaacagcatttaagtgatataacattttgtccaagaatccaaagtaaggaaaaggtgtggaacaccagtgtctgtttcagcagaacagtcatagccaaaaacattctgggtcacacatatgaattcattaccagctaattaatattaaacattaaagctaaatatttccccaatgtagagaatattgtcaaaggttttgctagctctcttggttgccacacaaaagagtaaagggattactctatgaaacattaacctcctgcctcctggaaaaacagagaaacaaaaacctcctcagcagaatcaatgaagtaatctgcaggactccagtgaggtaccaacagctttctaacagtgtgcattattgttaaaacatgcttgaagcaaaacgctggaccatgtatcttgtaattatttcttaagagatcaaccattaaacggcatagaggaccctcttagtttaagtttaagtttaaaaacctctgagctcatagaattgctctgggctatgggccataggccttgattctaattcctctttgactctgatcagacatctggctccgtcttttggcccatttatggtatgcctcagtatccctacaggaaaatcacattcaaactcactctgaaacctacctatcctcttagaagtttggtatgtgtactgaaagtgtctcagaaacagaaacattataaattcaagatataattattatccttatataacaccattaagcaacttcaattacaaaccacacttttaaaatctgttaacacttccttctgggaaagcccttttgccctttaatagtgtaagctaatcatggcaatataatttccagagctcatatttgtgggaggagaaaggatggcactggtggctttctccttcctttatctcctgaaattattgagagactctaagctaattttctaaagtatgcagaggcacttaggaaagccgggagctgagatgggaacctaagcatttcactgacatcattccatgctccccacatatggcacatcacataagcagtactggctgagcacactggtctattctggactcttgttggcgttaagtagcattcttaattacaagcaggcttgctttttgtcatttacagtcacacagttctccctctatttaactagaaaaaaaaaacacaatttttctatggaggtagtttcaccatttatgtttttgagccaatgcaaaatataaaaggaccctgcagtgttctcaaaacctgcttctcacaggcccttaaaaaaaatcctcatcataatctctgcaactgggtcagcttgcacaaagatactcgggtagccatgagcgctctctgcgccctgcaaaccttgtaagtgacacctcataatagtgcaaatgaagcatggcaagatgagaaaatgaagaagaatgaacctggatagtcagcccagcagctttcaaaacataggggactcaattttattccttaaactataccataaatgaatttttattttacacattcaagcatatacatgcattctctattatgaaagaaaatgtcttacgattcacagaaattctaatacaaccaaacagcctagttcatttgttcatctagccaaataaatttgcaatagtctcagattttgaactaaacctcattttcacttgtcttgactttcagctatgaatttatcatattgtcattaacgtttgtgctttcctttcaccctcatctattaggctcaagggttctttacttgtgggtcctttgtcccaacaactagcgaaatattcagagagctattgacccaacaaattcaacatcacctctttcttattaggtttctctttaagccatcaccctgcctgccgtgttctcagtccctctgcactcacacctcaccccatttctccatcccccaccctgagaggcttattttttatcctaatgttccttgattgttctctataaagttaatattattttcaaaagagagaaaggatgaagtatgagaaattcacacctggcttttatttggcaggggttggttactgacatgtaagtttgcgcctctgattgaaaaaaacaaagaatcagaagaggagcagcctcttccaaaagagtaagcatgaaggagagtgggcagaaatccaaaaatacacaaacacgaccatacaacagaaccttcgaaggaaacagaaagttctttgacccaaaagaataataccaaccactatacacacaacaattttctctactatcctattctttctctttttcgatgacagacacctctgatttttcattcacatgcagagacaatcactgtattctggagggaaagaaatgtttgtaaaggccagcagacggcgcctgactggggcagaagcttgcagcggagaggaaaaaggagtgccccactctgcggcagggccccttggtcttctcctctcccacgtccccagcagccttatccctctggagagaggccgagacacagaaaaggagaagttgcatatgagattattagccaagtgcttcccactggcacaattaggtgttccacctgctccatacacccatctgcctcaccacacccacctacccacactctgcccttcctgcaccctggcttgcctccgtccctcaggactcacacaattctgcacaaaggcagggcagtggttgagaactgcacccaggtaaagggaacaacaagctcctagaatactgtgggcttgtggtgagatcaccagaaactccttattctttcagagagatctaatctctgttacttataaaaataatccctagcttgggacatcactctcgtctccatactagacactcttaactggagagaatttctgggagagaactaggagaaggagaaaggaacaaattcctagaacccacagggatgtgttttttctagtatgctcccaaagagggcttgctaggggacttggtctctcttcagttagattatgctatagtttttcatatctaaccagaattgtccccaggtgggaaacccccaccccaccctgcatccatggaataaagggccatcctggtagcaccagcagctgctcagggcagagcaaactcataaggagtggggcaaaggattctgagctgaaacaagtctgaaaggtgacgggtcctgcaagaaagaggtggaaaatggatataaaaaaagtgcccacaactttcactctgctttctaaacaagtgcattttacaccggggtagaataaaaattgggagtggggaacgactcacaaaaacagattgatgttttaatttttggcaattcggggaatctggaatagatatttatctgaaaattagaggaatctggcctcacagtgctggtcactctggaggagaaagctgccaaccaaggcttttctctacactctgctgttttcaaagggacagggcattaggagaatagtttcccttagctctaacttcttctccaggcagacctccgggcttagcccagccagcattgactgacttgcccttcctggaaagcattaatcactgaaggaggaagtaagacctccctggttccaatagccttcacacgtgatcctccgggagatgggtatgtgtagtcaagcctctctctgttccatttagaaaagaactcagcctaattaccaagaaaaagacatatatttatgtgcagagtggatggaaggggaatggtgtccagaggtcccctccatgcctgcgaagggctggcccgcattaaaggggatgactcggttgccctcctagcttttctaattaagggaaggcgtgggggcaaaagtaattggcctcctgttgagtgagtcccaggactgcttcgctgtcactgcagtctgggcgcactttggaggaatgtgcgggctggaatctctccctccccgccccccggggccagggaagatgggcaggaggtggggcagcatatacagcacagacaaaaggttctgcagagccctcttctctctggtgctcaggtcccttagctgagcgcggcgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacccgcgacgccttcccccatcccctttctattgtcttcaaagagataagtggctcgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgcaaggatgccggtgacctgtagattgcaataggcactgaatgatgcttgctgctgccatggaaatggtggatgtggtgcgctcccaaactggatgccccccacgccactcctaggaggccgctgagggtgagcgggactatccaaagcagggccaggcgcccccctgcgccgccgccgccgccgccgccgccgccgcccccgggcgagcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaagcgcggagcgggtggctgctcccagatttccagggctccaggttctcgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcagcgcgcggagcagcggcgcgcatcgcctgctcccgaggcaatctccgcgtccgccgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaag

SEQ ID NO: 1418 - DNA, 7486 bp, Homo sapiens
ggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttctagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttcttctgcttggaggatttggttttttggtcgtcctgtatttcatttcaaaatgaaatattttttaaaagatacttaaaagatggcaatacctctgcaaaccattctgtacttgggctttacgatgcagtgccagcgttgtctgtggttaaggctgaagtgtttgtgggctgtgcttgcacattcacagtggttgtctgttggcctttccattgtgaaggaggcactctagttttggttgtcagggtccttgaagtatgttctttatgcctttcctagtaattgaaagactgggacagcaccatatatatatgcgcgtatatatacgcatatgtattatatatgcatacacacacacagagcaccatatatatatgcgcgtatatatacgcatatattttatatatgcatacacacacacacgcatacatatttgagatggagtttcgctcttgaccaggctggagtgcaaggtgtgatcttggctcactgcaacctccacctcctgggttcaagtgattctcctgcctcagcctcctgagtagctgggattacagacatgcaccaccatgcccggctaattttttttatatttttagtagagacggggtttctccatgttggtcaggctggtctgaaactcccaacctcaggtgatccgcctgcctcggcctcccaaagtgctggaattacaggcgtgagccgcgcaccacatatttttctaaccttatatattttagaacctacaactttgtagcattgtatatggtatcatagattacttcactttagggagaagtcatagtggtaggagggagatgcttctcaggaatgtgggatttcaactttaactcaaattttttgtggtttctcatgtaatgtatgtaattcttccaaggtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggtaaggtggggctggaagcctggactggtgaacaggcagtggttctgctatcagtaggttgcagggcatgtggcagctttgctgggctgagtacttagcatagcgctcaagggcccatccccctgcaaggtagctacgggtgctggtgttcatgcttttttttgacaggtctttgttttggggacaacttcaggcttgaaaaattttccttactctttaaggaaaaaaaaatgttaacagaggatttgatagtcctactaatgtgacttgaaggacacttgaacacccactaacttttaaattcgaatggctaagaaccaaattcatatatggaaacacttcagatatatatgatagcagcactgtcttacttgatttcaattcctgtcctcttacctgagatgaggactgcatgtttctactttgtgttaaaacagccgcatactcatttgaaatgtgtccctgttcctctaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaa

SEQ ID NO: 1419 - DNA, 92819 bp, Homo sapiens
agagaggaggcggttgtcaaggcgacgtgggtaggaggagaggacagagggaggaggaaggatgggcggtgttggcgtagccgcagggaggtgactgaagcgagcctggcctcttgcatcctccgcctgtgtacctccctcccctttttttccgccttctgccagcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagaggtactgccgcccccctacccgatcccgctttggtcacaaaagtcttggatccaggcggagaccttggggacccaggcgcagagagtttcagacgccacggagtttagatttctttggggatgaggcgtggggggagggaagaggagccagtctggcgtcatgaggaggccagcacattggaggactcacggatagatcatcctcacagattgggatgctgagctcagcgagaaaggtcccagccccaagaaggggagctacctgggtacctgaactcagaatgagggaggcagacgagttattttccagttaggatgaactcaccttaaaagtggttgacaagaaaagattatgcacagagaagcaaaataggaagaggaaagaagagtagtgggagaggaaaggagttaggaaggccagaaaaaagtatcagagcgaagtggttttatcatggctacacaaaacggagtgtgaaggtgggagatgtgcgagagggatgataggattccagctctctagttccttgtttattaaacatcggttagtgcagactgtaaaatgtgtctcctccttatagcttggcctccccgcagcgtactatgtttagtgtacctgacagtacacgactcacctttttgcagattttgagttcttcaatatcttgtgttctgccaacctctagtctccttctctgacttaacatatgtcaaagtctttttcaaggtatttccaatatgttggaagcagaattcagacaataggtagtcaatctcttataaccaaaaatagcttttgaaaagtcatcttggaggaacataaaagggcactagcagcaacaaaactaagtcatttctatgttattgaaataacaatatttggttgtgctctgagcaacttttttagaaaccatatggcagaggcaacaataagatatttacaagaactacgttggggaaggcaaaataaaagttctgttatttctgtgaaatgtgaaggacttcataaaaagtcaagcatctagctctgtaaatttaatcccaaatatcaagcttgactaaggttttgagaggttagaatatatatatagatgtattttctttactttaaaaaatatatgttttaaaatagaaatgaggtttcgatatactgccccggccagtctctaactcctgggctcaagcgacttcccacctcggcctcccaaagtgctgggattataagaatgagccactgcgcccagcccagaatattttttataaattgttagtgtgaactgattggcaacaactccatcccatatggagataaattcttataaagatgttctgtgtctacagcacagcaggtcataaagaagtcaggtgtgggggggaggatttttgtgtgaataaagatacttgattttgaagattcatgaatatgacataagtgaccccagtgagtgggacttttgataacctttattagctccaatgacaacctgccctgggccatctacatttccacctagccgcattatgacctgttttagagatcgcagggaacagtatgatcttatcagtgactggctcactggccttgatggcctgtggtctaaccaaccaaaataatgagaccaagaaagcccacttgcctaagaatcaaacaagggagtttcctgagtggaaggtaagaatcatacagtttaactaccaattcttgttgagatctttgtcaacaatggaaaatatgagacatttcagaaattaagcacttctattatcttggtttggaggaagggaagaatattgatacttgagaactcgaacttgtgtacgaattttgcctttggtcctgtttgaataaccaatatttgcctaagcaaaaggtcttgccacaaagtgtaagcttaaggtagtggaaagctatggagctcaacctaccagggtttcagtcctgttacttaccacgtggtttttggatttgtagaatgggtatcaaaataacacctacctcagaaaggattgctttgagtattgaaatagaaaatacattggaaacacaaaagagagttacccaccctccttctctgttcagcttctttcccattagatccacaccccatgccagattggaaatggcttaggaggcatgcccatttgccacaggcgtcagcaagtcctgtttacattctccttgagcaaacagtggccattgaacaccctcaactccaaaacaatcagggagagaataaacccattattatagtattcatttggcaatatgaactgatcaaacaagtttgggggcttccaaccccaaatggtgaaaaaccaattcaaggtagaccagctcttctctgttctttttttttttttttttttttggtgagacagagtctggctttgttgccaggccaggctggagtgcagtggcatgatctcggctcactgcagcttccacctcccaggctcaagcaattctcctgcctcagcctcccaagtagctgggattacaggcatgtgcaaccacacccggctaatttttgtatttttagtagagatggggtttcatcatgttggccagggtggtcttgaactcctgacctcaggtgatccacccgccttggcctcccagagtgctgggactgcaggcgtgagtcactgtgcccagccactcttctctgttcttaatcttcatacgaatttcttgtgagctgatgttgggtgttgatggcaggactcttatcaggccaaggctgaccctaatgacaataatattgttccagccttgttcgtgaaagctgaggcatccctctggatgtaatcaggaaacggagaggtttagcttgaggcctaaactgaagtggcaaagtgggagttctagactgctggacatgtgctggggcttggcattcctctcacagttttataataatcagggtcacaaatggaactaaacatcctgtatgatattcgttttcatgaatcgtttctttagccaaggctaagtgctgactgcgagccaaaggagcatttcccaaggtgcagtgaagcaaatcaaaccaaagaggagcagaaagctgcctttaacacgctctaccttatcctgaggctccagggctaattggcctcaaaggggttccccagtctatattgaaaagcccatgggttaggaatctagcagacatggattggaataaaatttgttgaatgagtgatgccatttagtaaggatgctactttgagaagttaattaacttctgtcagcatcaaattcctgatctgtgaaatggggatggtaatacctatctcacagggctgttgtaggaattaaattaaataaaataacatgtgaagtgcctagtacatacccttgatatatcataggtacttaataaacgttggtaggaagaacagttaagtacacagataatgacgtataaatgacgtcataagattaacatgtggtaaacaatgcaggagtggcaatatagaggatgataggaaaagaaagaagaaaactaattcagggcggggcacagtggctcacacctgtaatcccagcactttgggaggccgaggcaggtggatcacctgaggttgggagttcaaaaccagcctggccaacattgaaaccctgtctctactaaaaatacaaaattagccaggtgtggtggtgcatgcctgtaatcccagctacttgggagactgaggcaggagaatcacttgaacctgggaggcggaggttgcagtgaactgagattacgccattgtactccagcctgggcgacaagaatgaaactccgtctcaaaaaaaaaaagaaagaaagaaagaaagaaaattaattcaaacagttggcacttgacctgcttctgtgattgataatcagcagcatttcagtaggcagagatggaggaagggtgttttctagatagagggaggagcttgacgaaaggtccacatgtggaaaatgcaaatgatcctgggacttgcaagcagaccagctggctgaaatgtgcaatagtgtgagatacaaagttgataaggttgaaaaattctaaactaagtggagaatccctgaaggatttctggcagagatagcagcctaagcagaatggattagcatgaatataaagtaagcatggttgaggtgggccaacagatgagagcagagagatgaggcaaggagaccaatactgaagatattactgaagtcaaggaggaggttaataaagggactgcactgggatgggggcagtggaatacatggaaaggcgtctgtgtgaaaaacatgctgacggtggaggttagaggatttggcaactgattgatggtgtagggtgatggtgacgggcgggtcaaggatttttgtaaggattttggagtgggagaatggtaggagttactatccaaaatgcagaaagaacagctttagggagcagagtgttccctgttcttagttctgatgtccctgggatcagcccctgtagtcaggggagaaagtcctgagcctttggcacgctacttcactttgtgagcacagtgtctaggcttttctgtttcctcctgtatttggttcttctttttttttttttttgagacggagtctcgctctgatgcccaggctgaagcacaatggtgtgatctctgctcactgcaacctccgccttctgggctcaagcaattctcctgcctcagcctcccaagtagctgggattacaggtgcccgccaccatgcccagctaattttgtatttttattagagatgggatttcatcatgttggccaggctggtcttgaactcctgacctcaggcgatctgcccgcctcggcctcccaaagtgctggcattacaggagtgagccaccacacctggcctaatttttttttttttttgagacaagatctggctctactctgaaggctggaatgtggtggtgccatctcagctcactgcaacctccccctcccaggctcaagccatcctcccatctcagttgggattacaggtgtgcaccaccatgccctgataatttttgtagttttggagagacagggtttctccatgttgcccaggctggtctcaaactcgtgagctctagtgatctgcctgcctcggcctcccaaattgctggaattacaggtgtgagccaccgcactcagcctgctttttttttttttttcacatgtatgtctctctaaacaatcttatttagatctgtttatttttgacctttgtaaaaatatattgcattgtatatagagttataacatttgcttttctaactcaacactaagcttctaaactcatctacgttattgtatgttactatattttgtgcattttcggtgttgtaaaatactcctttggtgaatattccacgatttaaaaattagttttcctgttaatagacatttgggtttccattgttttgctatttcaaacaatgctgctatggacatttttgaacctgtcttctggtgtgcaggtacacgtttcttgaaggtataagcctaggagtggggtgctgggttgtgggttgtgtatagattcatctttacaggagaatgccaaattgttttctgaagtgagtgaattaatcataatttattcttcagtgactccagagattgggattctattaaggaccttagtcaccactatggtctgatgtttgtgtcccccctaaattcatacattgatacctaatcctcaatgcaatggtattaagaggtggggcctttgggaggtgattatatcctatgggattagtgcacttataaaagaggcctgaggggctgggcaccatggctcatgcctgtaatcccagcattttgggaggccgaggcaggctgatcgcttgaggccaggagttcaagaccagcctggccaacatgttgaaaccctgtctctacaaaaaatgcaaaacctagctggtgtggtggtgcatgcctgtaattccagctacttgggaggctgagacacgagaattgcttgaacccaggaggcagaggttgcagcaagccaagatcacgccactgtactccagcctgcgtgacagagcaagactctgtcttaaaataaaataaaataaaataaaataaaataaatacaagaggcctgtatttttgccccctccactatatgaggacacgtagacagcaccatctctgaggaatgggccctcaccggacgcctaatctgctggtgccttgatcttggacttcccagcctccagagctgtgagcaatcaatatccattgtttataaattacctagtctatggtattttgttatagcagaccaaacagactaggcagtcactttagccccagacataccaagttagggcttaactgtggggacactctctcttcacaagtaatgctgtttcttcagagctcttgggggtcgtgtttacctagacttttacagctttcttcagttttcagttttgtaatctgatgtgtcgcaggtgggatgagttttcttctattttggaaactggacagatgaattctcattcagatcactcactaaatagagtccaggtgaaagcaacttctagggccaggcttctggaaattagtagcatcttaaggtgtcaaggtaggtaacatcttagggtaaaacagaaatgtcactcaataagagctatctactgctctctattctatctgagaggagtcttagctattgtaacgtctttcagggaagtgccctgtgggcaaaaataacgcttcgtatccagatttggtacagtttacaaaattttgaaatttttggtacttttttggtccctttttgcattctgtatttcttgaattttttttcaattttttttgagatggagtttccttcttgttgtccaggctggagtccagtggcgtgatctcggctcactgcaacctccgcctcccaggttcaagggattctcctgcctcagcctcccaagtagctgggattacaggcatctgccatcactcccggctaatttttgtatttttagtagagatggtgtttcaccatgttggctacactggtctcgaactcttgacctcgggtgatccacccccctcagcctcccaaagtgcgtgagccactgtgcctagcttttgaattattacattaagaaagtatcattgttataaaagcaataaggttattttaaaatagtattcaataggccaaaagggaatatggaagtaacagccttgaactcgtggcctcaaaggattctcctgcctcagtcacactttagagtttccctttacattcaggatgaatcctgaaaagaggggtaatgctgccttagacactggagggactaaactctgacaaaagaacattaccaagaactatctagccttgtgaaatttagacaatttctgcaaatatggatctttcatactccagtggcccaataatggaggtcttctttgcctgtgtattacttttttttttttttttttgagacagagtctctctctgtcacccaggctggagtgcagtggcatgatctcagctcactgcaacctctgcttcccgggttcaagcaattctcctgcctcagcctcctgagtagctgggattacaggcacccgtcaccacgcccggctcatttttgtattttgggtagagacagggttacatcatattggctaggctgatctcaaactcctgaccttgtgatccgcccaccttggcctcccaaagtgctgggattacaggcatgagccaccacagctggctctttttttttttttttgagacagagtcttgctctgtcactcaggccagagtacagcggtgcaatctcagctcactgcagcctgtgcctgtcgggttcaagcgattcccatgcctcatcctcccgaatagctgggattacaagcgtgcaccaccacactctgccatgttggccaggctggttggtgttgaactcccaacctcaagtgatctacctgcctccgcctctcaaagtgctgggattacaggcgtgagccactgtgcccagcttcagataacctttccattaaaaaaaaaaaaaaaaaaaaggcaggatgtagtggctcgtcccggtaatcccagtactttgggaggccatggccagcagattgcttgagcccaggagttcaggaccagcctgggcaacatagcaagaccccaactttacaaaacagttttaaaaattagctatgtgtggtggcccacgcctgtagacccagacactagggagactgaggtgggaggttcacttgaacccatgagttaaagattacagtgagccgtgatcaagccactactctccagcatgggcaacacagtgggactctctctttaaaaaaaaaaagagactgggtgcagtggctgacacctgtaatcccagcactttgggaggccaaggtgggcagatcacttgagctcaggggtttgagaccagcctgggcaacatggtgaaaccccatctctactaaaaatacaaaaattagctgggcatgatggtgtgcccctgtggtcccagctacttgggaggctaaggtaggaggaccatttgaacccaggaggttgaggttgcagtgagccatgatggcaccagagtaagaccctgtctcacaaaaaaggtagggggatctgtattagttagcttttgctgtataacaatccaccctgaggcttattgtcttaaacaggaccccttgtttagcccacaatcctgtagtttgactgggctagggcagcgtggctgatctatgctgggctcccttgtgtgactggtcagctggtagattgactgcaagccagattacctaaaatgcttcacccagaggtctgacattgacaggctgttgggagcccctgcaaagtcattatgtaggggcatacatatgggggatgggaagaatatgttgccatttttgaagcataccactaggaaaagcagagttgatacaaataaccaaccactccaatggacctatagttataaatgtggctaattactaggaaagaaaagtaaaggatatgagagattattacaaagatacctactttacagtatgccacaagatcttttatatactttcagcatctttctataaagacgacatatgaatatttttaatcaccgtatctgttggtatagatcactgctttgggaatgcagcaagaaaactacagcaccatagtcaaattgcatagtcaaggaaaagcatacaaagtgttgatttgaatgagatgaactttaaatttctctattcccttttggcttattgaatactattttaaaataatcttattgtttttgcaacaattatactctcttattctaataattcaagaaatacagaatgcaaaaaggaccaagaaacttacccagaatttcataattggttaagctcattgtaaacatttcattatatctttccagctttctctccatacttatagactttctagacctctgtatgtatggatataaatatatacttttttttgagatagagtttttctctatctcattcccaggctggagtgcaatggcacgatcttggcccactgcaacctccatctcctgggttcaagcgattctcctgcctcagcctcccaagtagctggtactacaggcgtgggccaccacgcccagctaatttttgtatttttagtagagacagggtttcaccatgttgcccaggctagtctccaattcctgacctcaggtgatctaccccctcagccttccaaagcgctgggattacaggtgtgagccaccatgtctggccataaatatgtaattatccataagtgtgtttattccacacatgctctttcataacctacttttttcatgcaataatattgcagggggcattgctacatgttaataaatataggtctacatcatcatttttctctttaagagaaggagtctcactatgttgcccaggctggagagcagtgactattacaggtgtcatcatggtgcagtataaccttgaactcttgggctcaaggtatcctcctgcctcggcctcccaagtagctggggctgcaggcttgtgccaccacatctagctactttattatttttaaggctgcatagagttccgtaggctgtatataatataatttatataactaaccaattcagataaccaaccaatttctattagaatgaagaatactgaagtgaacacttgcatatatagttgtaaacatttgctcaactgtcattcagttaactccttaaattatgttcttagaaatgaggattctttgaccaagggcatatatatttcatattgttccctatttctccatttatcttttggagaaattgcatcaatttttacttctcattaaccttgcacaccgtcaccttttctcacatccttggcaatgctatcaatcctttaaaactttcataaattaataggcaatgcacatgcatactgcattcttggtccataactgaggaatcccacctgttttcaaaaggaccctactggagctcccaagtgacctcagagcatttctaggggttattacttcagttgagggagattttctggctcctcactctaccactttcgattccttgtgtgtggtctctcttttttttttgagagagacagaatcttgctctgtcacccaggctggactgcagtggtgtaatctcggctcactgcaacctccacctcccaggttcaaatgattttcctgcctcagcctcctgagtaactgagattacaggtgcccaccaacatgcctggctaatttttgtatttttagtagagatggcactataccatgttggccaggctggtcttgaactcctgatctcaagtgatcaacccacctcggcctcccaaagtgctgggagtacaggcgtgagccaccatgcccagctggtaatttttgtatttttttagtagagatggaatttccctatatgttggccaggctggtctcgaactcctgacctcaagtgatccagcgctccttggcctctcaaagtgctgggattacaggtgtgaaccaacatgcctggccaagcagtctgttttttttgttttgttttgttttgttttgttttaagacagagtcttgctccgtcgccaggctgtagtgcagcacaatctcagctcactacaacctccgcctcccgggttcaagtgattctcctgcctcagcctcccgagtaactgggactacaggcgtgcaccaccaggcccggttgtatttttagtagagacagcatttcaccatgttggccaggatggtctcgatctcttgaccttgtgatctgcccgccttggcctcccaaagtgctgggattacaggcgggagccaccacgcccggccaagcagtctgtttttaatcctgcacaatctggatacacagtttagcacttcctagggtgataagaatgcatcttcatacataaaaacacacacaccaagcaaaaaacaccaccactacagcaagatgacactaatgagcaatggactttttttccaggaggaaaagttttaatttattcacagaaatagcataaaaatccccgtacatcattcttaatcttccaaatcccttctcagctgcttcccctccacccaaccaggagtgaagtgttccatccttctcccacactacgccagcctcctctcttctctttcacatttccccacttaggtggtcccagggagaagctcatttggcttgaaaagccaagttgttactcacaaataaccattccaatcgacttgcagttatacatttcattaagtgctatgcaggaaaagtgaaggctatgatgagagattatttcaaggagacttagatggggaaagtgagagcaggcctttctgaggagtgagtttaagcatggatctgaagggtgtggaagagttgggcaggcaaagataagggacaaactcagcctggtgctcagaggatggacagaaggccagtgtggctgaaccacataaacttacacttgtaaaataaaaaagtgcaaggccaggtacagtggctcacccctgtaatcccaggtatgatccttaaaaaacaaagcaagcaatacaggaaagtacaagtaaagaaaataaaaatttatcccaattttaatcactgagaaataattctaaaaaagcactttttttttttgagatggagtctcgctctgttgcccaggctggagtgcagtgatgcaatctcagctggctgcaacattcgcctcctgggttccagcaattctcctgcctcagcctcccgggtaactgggattacaggcacgcgccaccatgcccagctaatttttgtatttttagtagagatggagttttttcatgtcacccaggctgttctcaaactcctgacctcaagtgatccgcctgcattggcctcccaaaatgctgggattacaggtgtcagcctccgtgcttggcctgtagcatggatctttaatgagatcattagccctctccatctgtggtcagctgacaggcttggacagctttggctgtgaggaaggcgaagagtgctgatttcaccacggaatcactgagacatggagggccaggctcaagagcttgtctgctttatcaagctgccagcttgtccggatcagggcagatgggccgggtggagaattctgccaaattttttgaaaacaagtcaaactcttcctttcctcagtctgtattgtccctctggtgagtgataaaaattgggctgtttgtcacatttctttcttaagctctccttctatgtcataccagataaaagaacacaacagataattatagttagtgcttgacagctgctgaaaatacaaaaatatattctcatatttcctgggccctccactgttctaattcttttttttcttttcttttttttttttttttttaagatggagtcttgttctgtcaccaggctggagtgcagtggtacaatctcggctcactgcaacctccacctcccaggttcaagtgattcccctgcctcagcctcccaagtagctgggactacaggtgcacgccaccatgcctgactaatttttttgtattttagtagagatggggtttcaccatgttgaccaggatggtcttgatcgcctgaccttgtagtccacctgccttggcctcccgaagtgctgggattacaggtgtgagccaccgcacccagccttcaaattctttcaagtctgagaaggctgatatgatgttacctttttattttatttatttatttatttttttgagacagcgtcctactcttcacccaggctggagtgccgtggcgtgatcactgttcacggcagccttgagcttctgggctcaagtgatccctcccacattagcctgagtagctggaattacaggcacatgtcaccacacttggctaatttttaaattttttcagagactaggtctcaccatgttgtccaggctggtctcgaactcctgggctcaggtcatcctcccaccttggccttccaaagtggtgggattgcagacatgagccactgcacccggcctgctttttttttttttaagtcttttctttgagacagagtctcgctctgtcaccaggctaacgtgcagtagcttgatctcagctcactgcaacctccacctcctgggttcaagagatcctccagccttagcctcctgtgcagctgggattacaggcacatgccaccacacccagctaagttttatatttttatagagacagagtttcaccatgttggccaggctggtcttcaactcctgaccttaagttatccacctgccttggcttcccaaagtgctgggattccacgcatcagccactgcacctggccttattaaaggcacttttaaaagatccacaaaactatgcagcatgaaaaataaaataaattgagtttcataggcctagaatgtggttttctaagtatgaaccttactgctaatacaaaatgaaaagcaaacagaaaaattggactctaattgtaataaacctgcatgctaattggggcatccttttcctgacctgatgcaaaacaataaaggaaaactgaaattggctaattttgtgcttgaaatcaattactttgacctcccatcccaatcacatgaaaatagagtggctagtaacccactctggggagtgtcacctagatataaaactgtaacttcataacattgctggtgttgaggtgaatcttagtggtcatccagtcccaaggcatccttgccagccccctacaatacctggatgggcgcttatcttcaggtaggcctgagcctttctggtaaagaggagctcactatttctaaaggaaacctgtgccattgggttaaaaaagtattaatttttaaacattggtagttgttaagcagttgttgaatattttgagccaaaatttgttacctccctttctagattttacatgcttcagaattttctcctttaggtttgagaccagagcccaagtggatctaaacaggctctttgtaccactctgcaaattctctcattttctgttgcccaagaccaaggatattatctccatagagtgccatttcccagcttattaaataagagaaatcatcagtttcttaaaggttagactgagaacctgagccctgaacatttaacatctacctgtagctcattctgggatacatttaagaaagtaatcatcagagtattttacagtttgaagatgtcagtgacagattgcctctggggctcatgggtcatttgtcatgtttttaccaaatagttatttttcctcttatagttttaatttttaatcctctgaaatttaaaataaacccctcattaagtatttattaaacataatggactgaaagagacatagaagaattatatgatataaaaccaactttggcctgggagcggtggctcacacctgtaatcccagcactttgggaggcctaggcgggtggataacctgaggtcaggagttcgagaccagcctggccaacatggtgaaaccccgtctctactaaaaatacaaaaattagctgggcgtggtggcacacgcctgtaatcctagctacccgggaggctgaggcaggattcactagcttgaatccaggaagtggaggttgcagtgagccgagatggtgccattgccctccagcctgggcgacagagtgagactccgtctcaaaaaaaccaacgaaacaaaacaaaacaaaaacacacgcaaaaaacccaactttgatggaacacacagcctttaagggaacaagtggttgccagcagttacagagatcaagtgcatgatagaatgaggccagttgggaaggagcagtggacagagcgcagcctctggagacgggcttcataccccagttggagcttccctcactgtaagactcaggcaaactgctgaatctcagcatctcacttaccaaaggagctaatcctatttaatttgaaggaccactgtgaaaattagaaaggagaaataagacgtgcactagttatattagttaccttgggctgcctcaacaaagtatcacaaactgggtggtttaaagcaacagaaatttatttccttgtgttctgcaagccaggagtctaaaaccaaagtgccagcagggccatgcaccctctgaaggttctagggaagaaccttccttgcctcttccagcctctggtggttgccagcaatccttggcctttcttggcttacagctccatcactccaacctctgacttcactgttacatggccttcctcttgtgtgtgtctctgggtcttctcatggcataaggccttgaaatttgggcccatcctaatccattaggacttcatcttgactaactatatctgcaaagacactgttccaaagaagattacattctgagctccagggtgggcaggaattttggagggacactatacaacccagtgcaccggcacgtagtatagactcaataagtagaagctgttatggttatcaagtgccaaagtgccaatgagcagagaaaaattatttgtatgggttggagtggttaaggagagcttcacagaaggagtaagagtcacggagggcttcaaagaagtactaaaatttagataagaactaaaaatatatagagtctctcaggtggaaagaatagcatatcaatattttattttatttttaaaattatatatatatttatttttattgaaaatagagacaagggctcactctgttgcccaggctggtctccaactcttgagctcaagtgatcctggcacctcggcctcccaaagtgctaggattacaagtgcaagcactgcacccggccagcatatcaatattttaaaaatagagttattaaccttgtaaaatcagctactcatgagacagaaatctcctttggcccaataatgggaattaaaaactataatctttttcaaaatggtttaactattaatgcatattttagttacctattgcttcctaacaaattaccctaaaacttagcagcttaaaataacaaacatttattaatattagctggacatggtgacgtaaatctgtagtctcagctactcgggaggctgaggcaggaggatcacttgtgcccaggagtttgagaccaacctgggccgcatagcaagactctctctctaaaaataaataccaaatacttactatctcacaatttctgtggacaggaattcaggagcagtttagctgggtgattctggctcagagtctcttaggaggttacagtcaagatgtcctccagggctgcagtcatccaaaagcttgtttggaacttgaagatccagttccaagatggttcactcacacagctatggcaggggccttggttcctcaagcatggcctcctccattgggctgcttaagtgtttttatgacatagcagccagcttcctccagagcaggtaatcagagagagagcaaggaagatgccaccatgccttttatgactcaatctcagaggtcacacactgtcacttttaccacattctgttcatcaaaagcaagtcacgaaattcagtgcaccttccaggggaggaggatgaagctctaattcctgttgaaaggagaaccacaccatggcgtataatgaaagcatccattcctttagctgttggtctagtttccggcagtggacgttcttaaatctccatgttattattattatttgttaataaaataatcattttgagcactcgcagtgtgccaggtgctgtacttgaagctgggaatttggaatgaattggtccagtgcttgccctcgaggggtttacaggttagtgagggaaagggaatagtctgtaaatataatgcacgtatataagagataaaagtgaatataaacagagggctttgcgtttgcaactctaagagggaaactgaagaaatcagagaaagcttcaggggccggaggcatctgagggcctagggcagtacccaaatcttagcccaacccctggtatagagtagttcctgggcaggtcattgaagagggacatttgtgcctggagatgggaatgtgtaggacttgtaggtgggaatgtcaggttgtccagggtcactttaatggaagggggagaaaaggaagagtttgaggccagacttggaggcccttggagaatgtggtaaggagaaagattagacttgattatgaacacactggagaatgacttgtgttttttgagcaggggagtgatatgcttagatacttgttttggacaacagaaaaaaatggagccagaggaactaatatctttgtgtatatgaacttattcatttattcaaaatttattgcagaccaaccaggcttttttttttgagactgaatcttgctctgtcacccaggctagagtgcaatggcatgatctcagctcactgcaacctccgcctcctgggctcaagcaattctcctgcctcatcttcttgaacagcttggattacaggcatccgccaccacatcccgctaatttttgtatttttagcagagatggggtttcaccatgttggccaggctggtctcgaaatcctgacctcatgatctgcccacctcggcctcccaaagtgctgggactacagctgtgggctaccgcacccagcctgccaggcattatttatagagagcttgtagtctaatgggagaggtacatattaatcaaatcatataaggataaaatgacaactttgacagtgctacaaagaaaggtacatggtgcaatgagagcacatattaggggatttgacttaagccaaaagttcagggaactcttctgagacaatgataactgagcgaggcctgaagaatgtccagaagtaataagccatgcaagggtagggatcagcacaggcaaaggccctgagatgagtacaaaggacccaaggaaggccagtgtaatgggaggagcagagacagaaggaaggagaccacagttagaaataaggtgggagaggaaggcaaggatcaaaccatgaatggtcttaattaactaatgaattaattgtgcccctatctacaaggacttcggtttttaggaaatacctccgtcaaaatagtaaaatctaaatataaaataaaaattatggcagaaaaaaatacaacttaggatcaggtatggtggttcatgcctgtaatcccagcattttgtgaggccgaggcaggaggaccacttgagtccaggagctgaagaccagcccgggcaacatggcaaaaccctgtctctacaaaaaatataaaaattaaccaggcatggtggcttatgtctgtggtcccagtaacttgggaggctgaggtgggaggctcccttgagcctgggaggttgagggtgcggtgagctctgattgcaccactgcactccagcctgagtgacagagcaagaccttgtctcaaagaaaaaaaagtacaacttagaatgacaaatgcagaaagaatcattacatgaatatatgaatgctatataagcaaatggactggaaacttgaccctgagctttctagtggccaaagtagaagccaaaaaaaaaaaaattagaatatgtagtgctcacagcccatgaaaaaaaacatgggaaaatcatttagcaggcaggtgcaacagaaagatgtactgatggtctgtctgtggcatgagaatggaaaagacaagcaacattagaggaagacattgcagagagattcaccaattagttactatggttactgagactgtagtatctccggatattatctcccagtatctaccgagattattatgggatcaatgattattatttctccatcatatatgtgtgaagtagaagtggaatctatcttattttttaggccagggtaattttcttttgtctcaaattggaatagcaggggatatgtttaattactgtctatgaaccattatagaagttggcactacttagagtgggaggaaatagatagcttgtttatcagtgggcataaaaataaagaaatggcaagatttgtcctgtttcctcctgtgcctgctaaaaagcagaaggatcatctgaggccttcctgaaaattagggagaatggcatcctgtcttaatttcttccaccaaatttcacttttggatccaggccatttctactttggcaaagtgtgaggtgctaatgtggactcctgttcccagtgatgttgcgccagcctggcccaggggaactgtcagtgcctggtcatgggtgggcggaagtgggagggggcagaggagtgctgttaacactttcagtactgtataaaggagcacttccttttattccttgtagcagaagccacctgagaaagtgaacttaggcaaatggcttgtgcttgagtgttctcctttagattctgttcttttctccaaatccactcctgccagcctcacctctccttttcacagtggtcaatatcacagtttcccggaggaaacattgaaggcgactcaatggcactgcttcctcctattgccatagctttgggtgttttcagattttactctgcaaagcctcataggttctccaggtggagcccaatggtgaagccctggtgtgggcttcttgacctcacagggctgtgggcctctcccctctggctggcatctggctgctctcttccgccaccaagacccccaagaagaaaagtagcttcctctaaaaccaggttattcctgcaaagcttagtcctggccctctgtgtaacataaaaaagaacatctgtccagtgaacagccagcttttatggcagtgccccgttggcctactgataagaaaccgtggctgctcaggcggctgctgcacctgctgcttttgccgtttctttcctgcttgtgtagataaagccctgcggagctgagctggtttcaccttcgtcattacaactttgaagccctctggaggctttaacaacatcttgccagtcttatcctagagaggacagctagttctccttgctaggtgggaaggctgaagctgaacttgggaattctcatcagggctgcccataggaggtctcatcatttccagcagaggaaagaaacttgaagaaagaatggatttaagtaattgcctccaggcagtcttctctctctcctccctctctttaaaaaaaatcatgggatcatgtaatttttcagcataaataatggcaataatggttggaggacaaggtaagatttctggaaatctggcaactacgcaggtgactcaaaagaaaaaataatgaccaagctaatctttaactccacacctactcttgccttttcccaggcagcttcctggtttagagcagggttcccaaactgcagtaggtatcagcatcccctggagggctttctaaaacccagattggtaggcctactccagagattctgattcaatgggtcagtgagagaggcctaagaattcaaatttcttttttttttcttttgagatggagtctcgctctgtccccgaggctagagtgaagttgcgggatctcggctcactgcaacttccacctcctgggttcaagcgattctcctgcctcagcctccccagtagctaggattacaggcacgtgccaccacacctggctaatttttgtatttttagtagaaacggtttcaccacatgaccaggctggctggtctccaactcctggccttgcgatccgcccaccctggcctcccaaagtgctgggattacaggtgtgagccaccgtgcccagctccaagaattcaaatttctaacaagtctccaggggctactgctgctgctgctgcccccacaggtcctgaaaccacactttgggaaccattggtttaagctttatggaaagtacaagagctttgaagaaaggcaggcttgggtttcaatcctaaatccgtagcttatataccagctgtgtgactgggggcatatgactgaatatctcttaactggtttcttcacttttaaaatgggggaaatcatatctactccatagagttcattgattctacaaatcctgcagtgccaggccctgagctgggtggtgggacgagacagtctttgatgtcaaggatctctgggtggatatgaaaattaaagagataaaatgttcaaagtccaaggaccatgagggatgcccaataaacattaattttatttccttcaaggaggtaacatgattctgcttttcttttctttttttcttttttttggtctaagaagtaattctcaaatttcacagcatggaacaaagagctatgcttctccccttatctagatggaaaatttgaggtacaggtactgttttgagttcaattgtgtccttcaaaagttcatatgtaccttagagtacccgctgtgtgccccagcacctcagaatgagaccttatttggaaatggggtctttgcggatgtagtcaagttacaatgagatcattaggttaggccctcatccagtatgaccagggtccttataaaaagggggaagtttggacagagacgaatgcacagggaaaatgctgtgtgagagttggagttatgctgccacaagccaaggaaatcaaggatggctggctgtcccccgaagccagggcagaagcaggggccagattctcccttgtggcttccgaaggaaccagccctgccaacaccttgattttgggcttctggcatccagaactgtgcgacaacaaatttctattgttcaaagccacccagtctgtggcactttgttacagcagccctgaaagacgaatgcaggcaccgtgaggtagaacatccctcgcgaacagggcacattgaggagaggtgaaggaggacttccagtttttaatcccacacatctctttattgtgcttgtgatttaaaaaaattaattgtaggtataattactgctaaataccctgaaaataacgaactcctgtgtctctagatatttaaacctctcagttagcaacagcctctgaccgtgtgtccatctatcagggaattcttcaaaatagtcatggagtgtctgtttgcaggcaaagcacatttagacgtttaagtcacagacacacgtgagtcaaataatttaccatctaactgggaccaggagaactgaacagtaacaacatagcaaggcagtttgtgatctttgccccatatccgttgtggaggaggggagctcccaccggccagaaggattaggggccatatcacaaaggacggggaaaagggcacttcagccaggactggtgagtttgaggggtgaaggggaccaggcagggcattctgtggggtaagggagcaggtataatgccctcttctgatgcttttacttagagtttcagttgcaaacccatgtcactctggaggggtaagtgataaaggcaaggtgataattttttaaaatatttgattatttatttatttattttgagatggtgtctcactctgttgcccaggctggagtgtagtggtgtgatctcggctcactgcaacctccgcctcctgggctcaagggattttcctgcctcagcctcccaagtagctgggactacaggcatgcaccatgacgcccagctaatttttgtatttttagtagaaatggggtttctctatgttggctagactggtctcgaactcctgacctcaagtgatctgcccgcctcggccgcccaaagtgctgggattacaaatgtaagccaccacacccgacctaaatttatttatttatttattttattttattttattttttgaggcggagtttcgctcttgttgcccaggctggagtgcaatggtgcaatctcggctcactgcaacctctgcctcctgggttcaagcgattctcctgcctcagccttcctaagtagctgggattacaggcatgcgccaccacccccggctaattttgtatttttagtagagacggggtttctccatgttggtcatgctgatctcaaactcccgacctcaggtgatctgcccgcctcggccccccaaagtgctgggattacaggcgtgagccaccgcgcccggcctaaatttatttattttttaacaagtaacccacatagtaatcaatccaaaaagtataaagggacacaagaaagatcttcattcttttcttcacaaagtatacaaacttttctaattccttagctgtttctagaatgaaggtcaagttagctgaggcctagaaagactacattccagctgtatgggacagtgaaaggactttgctggtgcagaaactttatcaactagtgggaatctcttctgaaagcacctactcaggtacacctccacccaaccctgcccccagagcgtggccccaggttacagctgaacctgcttaagcaagagcctggcttctgtttgcccttaagatcaggttgaccagaggaagcctgacattttagagatgattctccactcacacatctccagttcacctggtgatggcagaggctgggtgagaatctcaattggtgacacttggtgatggctgagggtgcgtttttgtcccagagaatggcctgtgtttttattcggtgtttccttcacaaacgtgatacagataaccatagccacaccagtcactggcacagttttcattttacaggacacagaggcacctgcccaggtgtctatttggcctctatggctcggagcgctcatatatcacaggtgtgtccacagctgataagatccctttgtgaggcctagataaaatgtcaaacacagtatgaaaaactgtttctatcacctcctccctccccaccagcagcagcagcagcagcagcaggctaaaacttcctgatttcctaatgttctcatgaaggaacactttctcccctgggtcagagtcaaatgagaaacccaatgacggtgtcaggtcctgcccagggtggtgaaatgctgcttcagccttctccccatagtcccagctctgagtgtcctgctaaaggatcttctccttggttgcggtgagccgagatcacgccattgcactctagcctgggcaacaagagtgaaactccatctcaaaaaaaaaaaaaaaaagaatcttctccctaaaagagacgttaaaatttttttcaaaacttaatttaaaacaaatttttaaataggtaattcatccacatggtaatcaattttaaaagtataaggggtacagaatgaagcgtaagtatccctcctacccctgtcctggccccctagttctcctcctaggaagtagcccctgttgccttggaacttactactaaagttacctcgtggctgggcgcggtggctcatgactgtaatcccagcactttgggaggctgagacaggtggatcacttgagcccaggaattagagaccagcctgggtaacatggcaataccccgtctctactaaaaatacaaaaattagctaagtgtggtggcaacgcctgtagtcccagccatttggggagctgagttgggaggattgcttgggctgtggctaccatgagccatgatcacaccactgcactccagcctgggtgacacagcgagacctcatctcaaaaaataaaaataaataaaaataaaataaataaataaagttagtttgtattgaacaagcactcctgaggcacactgtagatactggggatacacagaagacattataacagtcttgaccacacgcttctctctctgggacaacaaaaccagagacaggagagtgctcactggccagtgtggtagtcacaacatcaaagtataatacataaagaatgaggggttcctttaaattagctttaattatttggattgggattggaggagttggattttgagccagatattgacatgaattggaggttaaaagaaaaaaagaagctagggagcattcaataaatcactttttaaaattcttgaagaatattatttctcatctgtcatggctgccaatttctatctgatgttatgtttatgtgtatatttatagcattttttttccttttttttgagacagggtctcactctgttacccaggctggagtgcagtggcatgatcttggctcactgcaacctctgactcccgggctcaagccatactcccaccttaccctcccaagtagctgggaccacaggtgtgtgccaccactcctggctaatttttgtagagttggggtttcgccatgttgcccaggctggtctcgaactcctgagctcaaaagatccacctgcctcagccactcaaagtattgggattacaggcgtgagccaccccacccagctatgtattcataacattcttattttgtagtatatatcatttatttatttatttattttaacaactgtattaaccaatgtggtatataacttataggatagtgtcttgtagactactatgtgaaaagcactccctggggttataggatgcacaacctgtacatctgtacatattggctctctatatgccaggattgtcctgactgtatttgtatcccctcactatatatttttagttgaattactttgaggtaaagtgggcagcatcacaaaccattatggctagggtgcagggttggaataaagagaggaaagactgaagaggtaagcagaggccaaagagtgaaggccctcgtaaaccttacaggagtctggccttgctcagaaggcagctgtggggcagccatacaacctgacttgcattttgtatagatcactctggctatagcctagagaatggattggaggggagaggggagcaaagcacgggaaaccagtaaggaggctcctctagataagaaataactgtgttttgacttcatcagtagcaatgcacatggagagaggtggactgactcaagaagtgttttggagatagaaaatagatagatctcaggattgtatacaagggcaccgctcctggcttgaggaggtgctgaatatagcagtttcattatcagagcaaaaggacaatgctgagactggtattttattaagtgtccagaatttatgaaatattttaaagaaataagtgaaactaaatacttaaaagcttcaaatgcattttattttatttatttatttttttctgagacagagtctgtctctgtcacccaggctggagtgcagtgccacgatctcggctcactgcaacctccccctcccgggttcaagtgatccttgtgcctcagcctcccaagtagcagggattacaggcatgcaccaccacatccagctaatttttgtgtttttagtagagacggggtttcaccgggttggccaggctggcctcgaactcctgatctcaggcaatccgcctaccttggcctcccaaagtgctgggattacaggcatgagccatcatgcccggccaaatgcattttatatattatgaaacatcaagtaaagtatacaataataaaaatataaacattacttattctaatataaattgttagcagataaaattaatgaaagtattattaattaatttttttttgagactgtgtctcactctgttgcccaggctggaatgcagtggcacaatcttggctcactgcaagctctgcctctcgaggttcacaccattctcctgcctcagcctcccgagtagctgggactacaggcgcctgccaccacgcccggctaattttttgtatttttagtagagacagggtttcaccgtgttagccaggatgatctcgaattcctgacatcgtgatctgcccgcctcagcctcccaaagtgctgggattacaggagtgagccaccgcccagcccaaagtattattttaaaaaccctgaagagccagtattgccactacaaagtggctgatgttaccactcaattagatatggaatgctgctggggagagtagctgagcactatattttatttcattttttagacagagacttgctctgtgcccaggctggagtgcaatgacgcaatcatggctcactgcagccctgacatcccaggctcacatgatcctcctacctcagcctcccaagtagctgggaccacaggagtgcaccaccacacctggctaatttttttttttttctagagatggggttttgccatgttgcccagaatggtcttgaactcctgggctcaagtgatccttccgccttggcctctcgaagtgctaggattataggcatgagccactgtgcccggcctattttgttttctttgacatccagaatacatgctggagagaactatatttttaaagttgggtctgaggtgcctgtggaatgcccccataagcagttaagggtaagaatttggagctcaagagtaagctcaaaatataatctgggaatcataaggacataaaagacaattgaaactgtgaaaatggctttgtgtaagagagttgattgaattctggcactctgaagaaagaaaaaaagaaaaattaaaatattaaaaagaacaaacaaaaaagagttgaactgagctttagaaaagactaggactttaattgaactagaagacgtataggtagaagctgaagaaaagagcaagtcaaagaaagctatgaagttaggagtaaatggatactgtcagtggtgtgctggtaaatgcttaacaactggctctctagggaggtgaaaggaagccctgatttatagtgtttgctgaattccatggtgtaaatactcccatcacagtcaatctcaagctatcagtgtcactgagcgtggagctgggaagaggtgagcacagtcagatcttgtgatctcatacaagtgtacgctggtccacagccgggcactgtcctgatggaaagaggattctgtcaggggcatgtaaaggacatacttcaaaggtaacgtggaccacataaagacagataataacaagtgtggttgaggatgtggagaaattggagccttcatacattgctggtgggaatataaaatggtatcgctgttatggaacagtttggcagttcctcaaaaagttaaacatagagttaccatatgacctggcaattatactctaggtatattcacaagagaattgagaacatatattcacacaaaaacttgtacatgattattctagcagcattattcataatagccgaaaaagtagaaacaacccaaatgtccatcaactgatgaatggataaaataaaatgtggtatgtccatacaatggattttttttttttttgaagcagtctcgctctgtcgcccaggctggagtgcagtagtgcgatctcagctcactgcaacctccggcttccgggttcaagttattctcctgcctcagcctcctgagtaactgggattacaggcatgcttcaccataccctgctaacttttgtatttttagtagagataggcttttgccatattggccaggctggtctcgaagtcctggcctcaagagatccacccgccttggcctcccaaaatgctagaattataggcatgagtcatcatgcctggcccatacaatggaatatgattcagccacaaaaaggaattaagtactgatcatgctatagtatgtacaacacttgaaagcattatgccaagtaaaagaagccagacataaaagaccacatattgtatgattgtgtttgtatgaagtgtccacaataggtaaatacatagagtcagagaatagattcgtggttgccaggagctgtgggaaggataaaatgggaagtgactgctgatgaatatgaaatatgaaaataatttcagaatatgaaaatattctgggattagatagtggtgatgcttgcacaatcttgtgaatatattaaaacttcctaaattgtataatttaaatttgaattttagagcatacgatttttatctcaatttttaaataaatggtaaaatgagtttcagctgcctgtaaaagtttgaactttttttttgagacagggtctcactttgtcacccaggctggagtgcagtgggacaaacactgctcaatgcagccttgacctcccaggctcaaacagtcctcctgcctcagctgcccaagtagctgggagtacagacataagccaccatgcccagctaatttttgtagagacagggtttcgccatgttgcccaggctgatctggaactcctgggctccagcaatccacccgcctcagcttcccaaagtgctgggattataggtgtgagccactgctcttggcctaaagtttgaacttaatcttaaggattattgggtgccaatatttttggaaagggaaggtgaattttctaaaattatatatatatatatatatatttatatatttttttttttttttgagatggagtttcgctgttgttgcccaggctggagtgcaatagcacgatcttggctcaccgcaacctccacttcccgggttcaagtgattctcctgcctcagcctctcgagtagctgggattacaggcatgtgccaccatgcccggctaattttttgtagagacggggcttctccatgtttgccaggctggtctcgaactcccaacctcaggtgatctgcccaacttggcctcccaaagtgctgagattacaggcgtgagccatcgcacccagactaaaattatatttgaagaagtgacgagagtagattgaagagttctgaagcccgaactttgactttttgatctcattcttgaataattttcttagaaatagaattctaggtagggtgcagtggctcatgcctgtaatcccagcactttgggaggcagatgtgggaagattacctgaggtcaggagttcaagaccagcttgcccaacatggcgaaaccctgtctctactaaaaatacaaaaaattagccgggtgtggcggcatatgccagtaatcccagctactcgggaggctgaggcaggagaatctcttgaacctgggagacggaggttgcagtgagcccagatcgtgccactacactccagcctgggcaacaagagccaaactccatctcaataaaaaaaaagaaatggaattctaggattggccttttctctcagtactttgtttatatttcccattttctcctagatattattgtattgtgcagaagtttgctgtaagtataatttagtatttttataggtattttgtcttttatctctgcttgctttaagaatcaaacaacttctataaacaaaaccaaacatatattatatatcatgcatatacataatatatacatttgttatggcttaaataggtctcctcaaaattcaagtgttaccaatgtgatatattaaaagatgaggtctttttttgtgatctgcttgctggggaaagggtggggcctttaagaggtgattaggccgagtggatctctcccttgtaaatgggattaggtacccttataaaggagcatgacaggggcagtagatcccttttcttgcccttctaccttctgccatgtgaggatgcagcaagaaggctctcactagacaccaaatgcttgtgccttgatcttggacttcttagtctctagaacggtgaaaaaaaatacatttctgttctttaaaaatcacccagtgttaggtaattaattgtagtagcacagacagactaagacaatattcattgaaatttaaggctgggcacagtggctcatgcctataatcccagcactttgggaggccgagatgggcctatcacctgagatcaggtgtttgagaccagcatggtcaacatggcgaaaccctgtctctactaaaaatacaaaaattagctgggcatggtggtgcgcacttgtggtctcagctactcgggaggctgaggcaggagaatcacttgatcccaggaggcggaggttgcagtgaaccgagatcgtgccactgcattccaacctgggcaacagagcaagagactctgtctcaaaaaaaagaaaaaagaaatttaaaactcggtggctaggttcccttgcagatttgaaagagatgactagataatgaagtggatgactatgaagaaaacattactccatgcagcatagagagagatggaactgggactgcagttgctgggactacagacatgtgccaccatgcctggctaatttttgtactttttgtacagacaaaagacagaatagaatgagaaatagaatagaaatagaatagaatgagatggtccaacttacatctagtgggatttctgaagagagaaagaatagcaaaagcaggaacaaaggcaatattcaaagagaatatgtctaagaatttcagaattaataaatgataagaatctcaggccagcacagtggctcacatctataatcccagcactgtgggaagccgaggcaggtgaaacacttgagctcaggaattcgagaccagcctgggcaacatggcaaatccccatttctactaaaaatacacacacaaaaaaattagccgggcatgggggcgcatgcctatagtcccagctactgaggaggctgagatgaagaatcacctgagcccagggaagtcgaggctgcagtgagccgaaattgagtcgctgcactccagactgggtaatcagagtgagactctgtctcaattaaaaaaaaaaatacaaatctcgattcaaaaattaagaattccaggccaggaagaaaaagataaatccatatctagatatatatcagtgtggaagctgtgtggctctttatgacctagccttgggagtcacttagtgttacttctgctgtactttgcctattggtctaagtagtcacaagcctgcccagattcaaggaggctggagggtgtaggaatggaatctacttttgttttttctcttgctttttctcttttgagaacccacttttctaagagagaaatgtaaaaggatttgcagccacactaggtgagacagcaattgtcaacacaaatgcaaaagcaggcactgtaaccttgtgattgttctcgagggaaggtagtcatcaagatgaacttagatatgtctaaactaatattattactattattttagagatgggggtctcactctgtcctccaggctggagtgcagtggtgcaatcatagtttactgtaacctcaaactcctgggctcaagtgatcttcctgcctcagcctctcaggtagctgggactgcaggtgtaagccaacatgcctggctatttaattttttttttttcaagacagagactcactttgtcacccaggatggagtgtagtggcacaaacttggctcactgcaacctctgccacccggattcaagtgattctcctgcctcagcctccggaatagctgggattacaggttcctgccactacgcctggctaatttttttttttttttgtatttttagtagagatggggtttcaccatgttggccaggctggtcttgaactcctgacctcaggtgatctgcccacctcagcctcccaaagtgctgggattataggcatgagccaccacgcctggcctatttaatttttttaagtaacatcaaatgataacacaattaaacagttagtctaaaatgatttatccagccatgaaaagatatggaggaagcttgaatgcctattactaagtgaaggaagctgatctgaaaaggctacatactgtctgactccaactatatgacattctagaaaaggcaaaactttggagacagcagaaggatcattgattgtcaaggattatgtgtgtttgtgtgtgggggtgtggaaaaagcagagcacagacaacttttagggcaatgaaattactgtattataactatatactataatggttaacacgtgtcattaaacatttgtccaaacttatagaatgtgcaacaccgagagtgaactctaatgtaagccacgaactctgagtgataatgatgtgttaatgtaggtttatgaattgtaacgaatgtaccactctggtgggggatgttggtgatggggaggctatgaatttgtggggagatatgggagatctccataccttttgttctgttttgctgtgaacataaaactgctctaaaaaaaaagtctattattttattttatttttatttactttattttattattattattattatttgttttttatttttttcgaggcggagtcttgctctgttgcccaggctggagttcagtggcaccatctcgtctcactgcaagctctgcctcctgggttcacgccattctcctacctcaggctcccaagtagctgggactacaggtgcccgccaccacgcccggctaattttttttttttttgtatttttagtagagatggggtttcactgtgttagccaggatggtctcgatctcctgacctcgtgatccacccgcctcggcctcccaaagtgctgggattacaggcgtgagccaccgcacctggcctattttattattatttttttgacatggagtctcattctgtcacacaggctggagtgcagtggcgcaatcttggctcactgcaacctccgcctcccaggttcaagcgattctcctgcctcagtcccccgagtagctgggattacaggcacccaccaccacgcctggttaatttttgtactttcagtagagacggggtttcaccatgttggccaggctggtcttgaactcctgacctcaggtgatccgcccacctcagcctcccaaagtgctaggattacaggcgtgagccactgtgcccagccaagtctattattttaaaaaattatcttggagaatattattttgaggactcttgagaacacatatgggaactctcagggttctaaggactccatttggagaaacagtgctataggagattgagtattgcagctgctcatatctatttgctccagtagagttacagaagccctgtctgttgaactggttctccaggctagaattctgtccgccaggttctctccatcacagacagctaacatatccaaacaagcaatgtccttggagagttttgcataggccacaacctagattgcctggttctgacatgtatgattaaaagctcaggtgaaaaacatttaatagaacattttggtctcattaaaaagtgatagaagcacatcttcagaatataacttcataaagccctgccttgtagacagatgtgtgtgctatattctttcctactagaaagagattggaatttataaagggacattttgtttcttggtgacaaagccatttcaatcctagggatatttacaaccagtactgaaaaaccctctgcacctgagggactggccgcagttacagactgtcataaatgtcagcgaccagggtttctcttggagagattagctctggggagttgctaggggagaaaaagtggaaaaaggacaggtgttgctccatatgtatgagaagactgggattagagaagagggcgcgtcgggcaggcagtaaacatgacaggggaaactgaggaggggctaactgctgaggattatcacatctaggccagaaatgtcagcggggctcctttctctcagctgggagaacacgtgggtgctccctcataaaccctcttcaggcagggttagagcagtagcttttttttttttaaccagtttacaaagagcttgcctaaacataatgccctaatcatccagagaaatcagtgttactcagttttgtgggggagagctactgaactatttaatcatcttagcagggtgttaccctccctgtttatagacaagggagattgaatgactgtccccggtcatgcagcatggggtggcaggataaaagcagggtctagaccttttggctgtaatcccagcacccgcacagctcccgagctgttctagggccacaccctggcccaccattcagtcattcaacaaatacttattgaaagctactatgtcaggtgctgttctgggtgtctgggccacatccatggataaaaacaaagatctgtgttctgaagacacttacatttgatctggaatggggacggggcagaaatagacaataaacacagcaaatagtaaaggtataaagtgtgtgtttgaaggtggtaagtgctatggaaaaaaattcaaagtcatcccagatttgaaggatcaatggatcgttgagaggggggagccaattgctattgtcaacagggagctcgaggtggaagggataatattggcaacacttcaggaggcttttgtgagggctaaaggggaagaagatgcaggtacagtgccgggccccgagcctggcacatggatgcttagaggtgctcactagggtggctgttattactgccgcagtcctgtctccctcacgggactggtcagtgttttccaagaaccctcatgccaaggttcagcctaaaatagacaggcagcttaaattactcacagactggacaacgtggtcaaggtcctgcctggcccagagcgtggtgatacaaactaccccaggtccgtgtggaggccactgtctgctttgtgtgatatgtccatagctaagccagtggggtaggccctgccagggggaccagttgctgtctctgcggtttatgatcaaaatagaagctggaaagccagagtagaatagagcaatgctgaaagaaagggcagtgtaaggccagggttcccccagactcctgtagactgggagcccctgcaccccagcactgtgttgctaggcgacggtccagggattgaggacggccagcaaaggccggcaggactggggtccatttgcttcttcgactgctgctgggtctggtgcttgctctgggggagaggaggtcttaattgtaggcagaggaagcaactaattacgtgggatgactaaagtcacccttgaccctatgcgtctgcctcggtgtctgcagttttacctttagcaactcgttcaagtcaagactctggcatcctaacatttttggtgtgtgaaatttttggttcaaacaaaattttaacttagaagcatgaacaagaaaaagatattttaaaatattgctccattaatgggggactctctacttcccccttcgaaggggctggctttcttctaaaaccctagactctggagcataatttgaaaatcagtgggttaaagtattgcagccaccctgttaaaaagtaaacagccttggtttgataaaatattaagctattttaaaattactgatacatgatggcaggtggcaatgttttcctgtgtagggaggaggagggggataatagactccttagaggatctgaagtcatacaatggacccactgcccagaaaaatgcacatatctgaaattctgcatctggccgtatatgggcaatgatccatgggccataggttaaggacccctgtcttgtgggatatttgtttatgtgatttactttcaaatggggtaaatatttaaggcttggagcacagaagaatgagttttgaaaaggggaggaaggagaagaagagctagagaatcaggatcttggtggtagaggccaggaatgtgtgtttttaacatgatctccaggcagttttgatcagacaaacataggcctcagaggtctagagctggtgcacccaggccctattgagtcagcagtcctaagggagtgggaggagggagggagggaggagcccagctgcctttcccaggcttcagtgtgaccagctggagaacaatgggaaacgtcctcttccctcagccctcctcttcacaatgggacacagtgaggtcgcagtgcccctgagcctcaaccagtccatccacccaaagcctgagcagaggaactctgaagcaaaaagtacagaaaccaggagttcacaaaacacccgcaagggctgggcctgagagaaagtctcatctggggaactcatgttccaaattctgacatttctccatggttttccatgttcctatgctaagtggaattcattggtacttcccagcaaagggctagtctctccctaacagtcagggaacttttagagtttgtcagaagtaacacagagcttccattaatttggggttgattaatggaatctgttctggtctgggtcaggtactttccaggcaaagaagcatttgtaactaagtcaacaactacctattgactctgctatacccagctccagggcatttgcctggcgaccccagcctcatcctttttttttttttttttttgaggcagtgtctcactctgccacccaggctggagtacagtggcatgatcacggctcactgcagcctccacttcccaggctcaatcaatccttccacctcagcctctcaggtagctgggactacaggcacgtgccaccacacctagctaatttttatatttttttgtagagcagggttttgccatattgcccaggctggtcttgaactcctggcctcaagcaatccttctgccctggcctcccaaagtgttgggattacaggcgtgagccactgcgccccgctgctaattttgacattctccccgaagaatctgctttttagggactatgagaggagaagagaaacttctcttctgaaagcagatcctttgggaacaagggaagaagtggcctcctccagaccccaaggcatccagtctaaagttggctccagacaaaacccaggtttacttaagaacctgtttcttgacacagatcctgtcccagccaagacaaacccaagtcatgttgatcttctgcttcctttcctacttgtgactttatgcagcagtggtttttagactcagaatgtgagacacctgcttggctctgtcttttctctctgggaggtaggggaggtagggaagttgttccctttttcccaatagtctttgggtagttattcttagccctgttaatgttttactcaaatatagccatttatcaaaattgtggagttaatatttgttcatttcaatgtatataaattttaccttttaaaaaaggaccatgaggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgaggtgagaggatggcctgagttcgggagttcaaggctgcagttgcagtgagccgagatcacaccactgcactccagcctgggtggtggagttagaccctgtctccaaaaaaaaaaaaaaaaagaaagaaaaaaaggaccacgaaaaatgaaaaatgacagtctcatgtggggaggagcaggtggaggcagatgtagtggggtagagatagataaagaacggcagaaattggtgagtattgaagttgggcaatgagatggggctcattgcactgttttgtttttttaatatatatttgaaataatgtatttcaaatttgccataataggttttataaatttaccacatcaaaaagtaaaagtggaagaaaagacttagggatgtctgttttctcttagaaatctcttgatcaacaatctcaaagaaactcatactctttaacctagtaattccacttctgggaatttatctaaaggaaataattagagatacaaagaaagtgtcattgcaatattatttaaaataaggaaaaatggaacacaactccaggtccaacaataggggaatggtgaaagaaactgtgatgcggccattaaggacatgggaaagtgcttttgacctaaaattaaatggaaaaaagtcagaaaacaaaactatataccatatgatcttcatttgcatgtgtacatgcatgtatagaatcagaatctggaaagaaatacagcaaaatgttaaaagtagttatctctgtttggtggacttgtggcaggtgttttgttttgttttgttttgttttgttttgttttgttttgagacagagtctcgctctgttgcccaggctggagtgcaatggtgcggtctcggttcactgcaacctctgcctcctgggttcaagcgattctcctgtttgggattacaggtgcctgccaccatgccaggctaatttttgtattttttagtagagacggggtttcaccatgttggccaggctggtctggaactcctcacctcgattacaggcgtgaaccactgtgcccggcccagatttttattttcttttttattctagtctgtattttcatctttcctgcatttaacaggtattactttgataattatttttaactaagatgtgctattttgaaagaaaaggggccgggtgctgtggctcatgcctgtaatcccagcagtttgggaggccgaggcgggcggatcacctgaggtcgggagtttgagatcagcctgaccaacatggagaaaccccgtctctactaaaaatacaaaattagctgggcatggtggtgcatgcctgtaatcccagctactcgggaggttgaggcaggagaattgcttgaacctgggaggcggaggttgcagtgagccaagattgcaccactgcactccagcctgggcaacaagagcgaaactccgtctcaaaaaaaaaaaaaaaaaaaaaagaaaaggggaaaaagatggaagtaaggacagatttccatatcagtacccgtacaaaataataagttcttggaactggaaggaatcttagaagttgtctaatcttagaagttcaactgtctcattttacagatgaggagactgagggtagaatgaatcgaatgaccaccaaggtcttttgttcctcgtctcagagactgtttgttttacttcaccactagccctcgtatcccctgaggaccttcgcagcctggggagtgcccattgttaatccctggaggccccatttgaggggctttccagacagtctgggccatccgttgcagtcatcattggccagctgggctggagaagtgccctggcaggaagaagaaggctggtagaacagtagacctcactgccacctggtcaccttgtgcttctcccttggagtgttctgaccagtcatccgtgtcttcttagctctgctgttgcaggggttatttcgaagcaactagggtaaatgtctgggggagctggcttgtcctggctttcaaaccaccatcacttggaagagaaatgatgtggtttaatggttagtcagatcggagttagagatgtgttactgtctttgccacagtccttagacaccaagaccctgctccggagaaatgggggcaagcaacagcttgcaatggcaactaaacctctttgggatgtgtgtttatgtgtgtttatatctcctccccgtcccatccttgctagcacactccccaccacatacacataaaagctctagaaatcaacaggttttaaacaccactgcttcaccagaacctagcacataacaggccctcagtacgtgcttgttgaatgtgggatgagtgaacatcattatatatatatatttttttgagacggaggctcactctgtggcccaggctagagtgcagtggcgcatctctgctcactgcaagctccgcctcccgggttcacgccattctcctgcctcagcctcctgagtagctgggactacaggcacccaccatcacgcccggctaatttttttctgtttttttaatagagacggggtttcaccgtgttagccaggatggtctcgatctcctgacctcgtgatccactcgccttggcctcccaaagtgctgggattacaggcgtgagccaccaagcccggccgtgaacatcattttcttagaatgtagaagaacagacatattccaagttaacaatgtcttctgagatattgttcctgagctatataaacattttatattttataataaaataaaaaataaaatatattctgagacatttaaacattttaattctaaaagaacagaatgtttgaacaaaaattagcacttaatatttatttgcacaactgcaatgcaatgtttttgaaagctgtcaatagtgaacaaataagcgtgagggaacaccacagcccgggtatgtccagtgacactgctacaatgtgcactctgcctgctgccttccactcctccctctttgtatttctgagtttggccaatcatttggatggtgattaaaatatttttggacgggtgtggtgactcacacttgtaattccagcactttgtgaggccaaagtggaaggattgcttgagtccaggagttcaagaccagtcttagccacatagcaagaccccatctctgcaaaaaaatttttttaattagccagatacagtggtgcacacctgtagtcccagctactcaagaggctgaggagggagaatcacttgagcctgggaggttgaggctgcagtgagctgtgattgcaccactgcactcaagcctgggcaacagagtaagacaccatctctaaatatatatagatttatattttataaaaatattttttattttggagatatttctcaaatttagactatcagatcatcagacttttaccttctagagtactcaatagaataactcagaggttaggcatgttctctaggatctgtggtatcacctatttaaaaaaaaaataaaattgtggtaaaatacacataatgaaatttaccagcttaaccatttttaagtctacggttcagtggcatgaagtacattcacactgttgtgctaccatcggcaccaccatcgtcattatccacagaactgtcttacaaaattgaaatgctgtactcatcaaacagtaagtccccatcctgctcctctagcccctgacagacaccattctttctgtctctatgaatttgactactatgtaccttgtataagtagaatcatacagcatttgtctttatgactggcttatttcacttggcatgatttttatgtttttattctgtggagtttggttggggggcaccaaggccagccctaggtagaactgggaagtaaggaggggccttatcccccgctgccccactttcctgccccatccctccctcagttcccacccacttgaggtccctgctcagtggctaaatgtcttcatccccctcatcccatcttccacttatcagcaaagagcatctgattggcctcgtgtgggtcatgtgtccatccatggcagaggaaggtgggccacctcacttgacaatcccatcaagactctgtatgtaataaggaggcaatagttcctcccagagaggtgcttctctcagaagaaggggggtggacactgggcaggcacaaacaatagatgtctttgttgaacctccaacaaggtacaaaatgcctttccgccttcccattgcacacagctttggacttgggtcccttccccttgggccttgtttgcaaaattttttatctacttggctttccttgcagtttttagcagcttgaaagccagtgctgtgccccagacacagtatgtaagtgtgacaggagcctacacaggctgctctcaaacaccggcagccttgaaaacagattctggactcagatagcctgggtccaatcctggtttggcagttcctggctgtgtggctttgagcaagtgactttgcctctcaatgactcaattttcccatctgtaaaatggtaaaataatttaccattgaattgttttggagattggaaaacctactgtgtgatgtgcttgacctacatcatcttaatcatgctcacagagggccctatcgcacatggggaaaaggcactccctctctgggcagatgcaacacctgaatagggcataccacctagcatgcaagacttgagctagatttcaccctccactcatgccctgagctaggtaaccttatgaatagcctgcataactatacagcagcccagcccctctatgatgcaggagtttgtatatccccatttttcaatgaggcagctatggcttagggaagtcaagcaccatgtgggaaggggcggtgggatcacttctaatttgcctatttacttagggcacatgaaagaggctaacccagtccctaggactctcctccacctgaattgtggaccacatctctgtcatcagctaaccagcttaaaccttattcatcttccacagtggatggtaatgaagtacagctctagcatctaacccatagattacctccaatctctagtctataaacagttcctttttttatttgagacagggtctcactctgtcatctgggctggaatgtagtggtacaatcacggctcactgcagcctcaacctcccaggctcaggtcatcctcccaccttggcctgctgagtggctggaactacaggcacatgccaccacgaccgattaatttttgtatgtttagtagagacggggtttcaccatgatggccaggctggtctcaaactccagacctcaagtaattcgcccaccttgacctcccaaagtgccagaattacaggtgtgagccactgcgtctggcctctaaactgttactttgataatcatttttaaaagtaacagatactattttgaaagcaagtggtgggaaggtagaaggaaggacagatttccatccagataccatcctgacttgacagttttctttttttttttttttttggtcatttcagcagtccattcaatacctagacagtaaggactaaaaatattgtgagtctgagtgaattcttctagaactgaaagatcagtgttaccgacagatcagtcaatacaggcaaagcatattccagtttcagggtttttttcctcttccttctcatgtgcccaggagtattacatggctgggtgacgctacggaaggatgcgctaactacagttccccaccctctcatttctaaacccttcctttgtttttctgatgaacaggcagcacccactgcctgctgtgtcccatttagcagtgtaatttgggtgtgcgtcatagaattgtgcacagggagggggaaggagttacgtgctggatgtatatactgaacgtgtttatgtgctcctttgtagacctgcactttatgcaaattatatactttcagacagatcactgagtaaactgagtaacagatcactgagtaaactgtcagggaattgatgtgtttgcagaacgctgaatataattgaggagtcctgccagttctatccctggtttaactctctctaagcttatgtctttttttttttttttttttagacggagtcttgctttttttgcccaggctggagtaaagtggcgtgatcttggctcacagcaacctctgcccccactcccaggttcaagcgattctcttgcctcagcctcctgagtagctgggattacaggcgcgtgccaccacacctaatttttgtatttttagtagagacagagtttcaccatgttggtcaggctggtctcaaactcctgacctcaggtgatccacccaccttggcctcccaaagtgctgggattacagcgtgagccaccgtgccccgccctaagcttatgtcttgaatggtgtgatctcaaagtgtagttcagatttgaaacaggtgtattagaaccagccaccttgaattaatatccccaagtggcatgaagtaaatgagcatatattgaaagggaaattttcttaggcttggaaccaccatttcctcagcaaacctcccacctgagtgagacccaggggacatcaaatgaaagacgatgaaaagtaatggatttggcccatgtgcctctaagaggccaatgcagtcagaatgaactgagatgatcttcgaacagattagatattttaacaccaattcttgggcctcagaagtgagcctggctgctggcacacaaccaacactgtcatgtttaatttttagatttggctgttaaatttggccctgtgtgagtctgtgtttggtcagagtctataagggtggaggaggattcctggtgggaaggcctggtttctagctcagtgacttatcggctgcatgactttggacaagctatcacaccactgagagtcattttctcatctgtacaatgaaggaaacaacccctggtctacttgccttatagggagtcgtgaagatgaaacgagatggtatttgggaactgtgaacacactacacaaaagaccagcatgaatatgttcagaagcaccacacagtcctttctgccttgctcactcaattctccatttaatttatacacagtggattttacccctcattcttgcagcaaaacccttttgagagtatcattttaagaagtggattgacatcatatatgtatagttgccctatttgtcctcagagtctgagatgaggaaaagacaagaattattgggaaaaatagacccagagagggcacaaagaattcccatcctgatgttctttctttcctagatgacattgacatctacatccaaagccaaagattctggtcaagagttaatctattggctgggcatggtgttgcatgtagtggctcctgtagtctcagctacttgggaagctgaggtgggaggatcacttgagcccaggaagtcaagattacagtgagccatcatcacgccaccgcactccagcctgggtgacagagcaagagactgtctaaaaaaaaaaaaaagaaaagaaactacatctttaccatattgcaacaagtctgaaatgccactgcttctaagacaccatttttttaatgtgtcatcaagaaagaaaaagctctctatcccttaaaacataacacaattcttccttactgtgtcaattttaagacacgtcttgatttcatagatgttagatgtggaaaaagcgtgcatcttggaatagatgaaatgcagtgtgtttacctatccccaaaaataaagcttattccttttgatcctgacgcattattagattagcaaacttcaaaacttgtattttttgtcttagctccttgacgttatacatgttatgcaatcaggctatcacgtgggttaaagggggacattaattctatttttcttatgcatacagtaatacaaaatacctctgggcttgaatatagttttaggtaagtgtagattgtaaaatacttgtcagagccaaaatcatcactaattccatggtctgttgtttattaccagatttaaaggaggaagaaacgcttaagggcatttggcacatcaattgtgttttctttgttctgagtggaactgtttgttgttgttgttttacttaatgcttgatttggttgttttgttgttattccatttatttttagctcaggtaaaacaattaaactatgagtttcccattgcacagacaaattagggatgaacaggctcaagtgagagcacatcacctgcctcggccaaatatattttcataaaatgcaattgggaattcatagtctttctgagtggaaaggagcataagaaacacagggaaatagggccaggcgtggtggctcatgcctgtaatcccagcattttgggaggccaaggcaggtggatcacaaagtcaggagtttgagaccagcatggctaacatggtgaaaccccgtctctactaaaaatacaaaaattagcctggcgtggtggcactcgcctgtagtcccagctactcgggaggctgaggcaggagaatcgcttgaacccaggaggcggaggttacggtgagccaagatcatcccactgcactccagcctgggcgacagagcgagactccgtctcaaaaaaaaaaaaaaaaaaaaaaaagaaacacagggaaatagaaatacataccacttctgtgaggagcctttgtaaattttttgtggactaaggcttccatttagaacatccttccatttagaatgtcctcgttcataaattctacactttggaataagaaaaattccacctatttctagcctgttccttagttacctttcccacgttcctctgctccataaggacactacttaaacataacaacaaagagagtcacacacaaaaatgatttctagggactagaccatggctgggtggaagggaatgatccaaatcattgtagttcttgtactcggttcataatcatcagctccctgcccggggtcccagggcccatttctgagaggatgagcatcagtagccatggtgctgggaagtgggtgggaagctgttaatgtttgatcactgctaatgcacatttcgcccactgttctctcccctgcagtctgagtaccactatgagtacacggcgtgtgacagcacgggttccaggtggagggtcgccgtgccgcataccccgggcctgtgcaccagcctgcctgaccccatcaagggcaccgagtgctgtaagcagctatcctgctcagggcctccctgtcactcagctttggtctctcccccaagtctcctgccatccaatctgggcccttcctggcagagcagctgcattaaggaatcagatcttttccccaattagtccccacatcccagacccttatgagatttggtgcagaagtatttcatgaatgcaaactggatatctgaatttgctttcattttttaaaggaatttaaatcccatcagtggatacagcataagcaatgccagctgtgtgcactcagatattcttttctgtttgcatacattttcatttttgccttgtatgtctctccaatctacactcactcaccagccacaatcagtcattaggcaagattgagatttgctttcattcttaaaaaggaagtcagagaggctaagtttctgcagagacgtcctttaaaatgctccaggcatcacttcaggagacaagaatcttcttgactgtgggtctgattgtgcaataggaaaggcagtggcttgccgcagccccagcacccgcctctgtgactctgcagtcacaacttttctacaattggcagctgtttcccctgcattattcttttaggaatgcaaagggaataacaagaaaaaccaggcactagatttaaggaattatctgaagagttggaaaggagtttgaagatatttaaattctaaaatcagcttagtacagtgcctggttgagtaagtgagcaaataaatacttgttaaattaatgactggatattgctgagacctgagcagaactgaggtgtgactagtggaaacaaatgagccatcttcattgaactctgctgacttcagtgagtcccactatgtgttagcaccatgatgtgcacatgcagtgtgaactgcaaagacaaataaggcacactctctgctttcagaagcttagggtggtggaaagtgcagacattcattcattcactcattgtttcagaaacattcatgaagctcccagtctgtgccagtcactgagccagccatccccagaggagcgcagagcctagtgggtggcagacatatatgatatgagaaagaatgagagttacgaatatttagggatcaggcatagctgggagggccacttgagcaaaagtttagacgtggatgaagagtgacacatttgaggaagagcttgtggtccagggtagaggcaacacagagaaggtgatggatggagttgaggtgaaaaaagatttgtagtgggaggtcaagctgggaagttaggctgcagggaaatcgtggaaaactttgaatgccaggccaagagcataattctagaaccaaaagggagtgcctgtttatttttaaaataaggagaataatagtacatacgtgttttactttttatttttttaaagacaaggtctcactctgtttcctaggctgaagtacagaggtgcaatcatagctctgtagcctcgacctcctgggctcaagtaattttcccacctcagccttttgagtagctaggattacaggcacacgcgaccactcccagctaatttaaacatttttttttttggtagtgacagggtctcactgtgttgcccaggttggcctcaaactcctgggctcaagtgatcctcctgccttggtctctcaaagtgttgggtttacaggtatgagccactgtgcctgatcacatctgttttagaaaggtacctctgaccacagaatgagcaaaaataagaatagggaactagttaggaggatattgcaatgattgagttaacaggtcatgagaattccacctagcatggtggcagtacaaccagaaaggcagaggccagaggctcaagggagaaattcaaggctgaagggccatgtgtcattcagaggggtcagcacaagagaccttggcatcttcttcaccagagagctctcagaatggtcagggcacctctccaaaggaaacgagtgccaggaacaagcccaaagtcccacagcaaggcagagcatccgtggccctagatctattttttttataacagctttattggtatataatttatatgccatgaaattcattcctttaaggataaaattcagtggtttttagaatattcacagcaaccatcatcactctcatttcacattttaatcatcctaaaaagaaacctcatattattagcaatctctccccaggcccctccccacagcccctggcaaccacaaatctactttctgtctctatggcttcacctcttttggccgttccatacaaatagaatgacacatagcaaggaatatcactgctgaaaaaaaaatttttttaagaaaaataaaatcaaatcacacagtaaatgccatggccctaaatcttagtgggccaaactcctagaccccaacccagcgctcctcccttcagctgctcgcagcccattcacttctggggctgcagtgacctcactgccccaccttgtctctgccctgttttccagccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtgagtctgcacacacccccaccccacccccagcccactgggtaaggggctacagggcacactggacagcctcctccgctgcccctcaggctgggcagggaggatggagggaagaggaagccaggctgccagggtgaggcctgcagctgtgcccgcaagaccagtggatgtgactctgcctggcccactcttactggcctaaacttaccagtgatggacaggcatttgtgggaggtaaaaaacatgaggaaataagagagtggacaaggggggcaagggttaaatggcccagtctatttaaaacaaaacccaattggagctgggcacagtgactcacccctgtaatcccagcactttgagaggctaatgtgggaggattgcctgaggccaagagtttgagaccagcctgggaaacatagcgagacccctgtctctacaaaaagttaaaaaatttgccaggtgtggtggtgcatgtccgtagtcccagctactcgagaggctgaggcaagaggataacttgagcctaggagttcaaggttagactgagctatgaccgcaccactgtacccctggataacagagcaagaccctgtctcattgaaaaacaaaaaccggcagggcgcggtggctcacgcctgtaatcccagcactctgggaggccgaggcgggtggatcacttgaggtcaggagttcaagaccaacctggccatggtgaaaccccgtctctactaaaaatacaaaaaattagccaggcctggtggtgcatacctgtgatctcagcgactcgggaggctgaggcaggagaatcgcttgaactgggaagcggaagttgcagtgagctgagatcgcaccattgcactccagcctgggcaacaagagtgaaactccgtcttaaaaaaaaaaaaaaaagaaaaacaaaaacaaaaaccaaaaaaaccaaccggatttccaccacggaatttcagatcagccaatatactttctcagcttgactggaacacaatatgcaaagcttgggtatcttcccggcttgggtgctaacttcttcttcttcttcttttttttttttttgagacagagtctcactctgtcgcccaggctggagtgcagtggtgccatcttggctcgccacaagccccagctcccaggttcaagtgtttctcctccctcagcctcctgagtagctgggttacaggtgtgtgtgccacaatgcccggctaattttttttttttcttttttttgagatggagtctcgctctgtcacccaggctggaatgcagtggtgccctctccgctcactgcaagctctgcctcccgggttgacgccattctcctgcctcagcctcccgagtagctgggactgcaggcacccgccaccacgcccagctaattttttgtatttttagtagagatggggtttcaccgtgttagccaggatggtctcgatctcctgacctcgtgatccacctgcctcggcctcccaaagtgctgggattacagcgtgagccaccgcacccagctaatttttttgtatttttttagtagagatggggtttcaccatgttggccaggctggtctcaaactcctgacctcaggtgatccacctgcctcagcctcccaaagtgctgggattacaggcatgggccaccttggctgctaacttctgaaactgattctgcctagcctttgcccagtgctggctgaaatcttccaaatgctgtgagaccccaatgactagcaaattttcttggaaagctcagtccagggtgcttggagaactggatatctatttcagatatgtcttttgtaggccaggcactattctggatgctttacatatattattttctctaattctcacaagaaccttgtgaaataggcattactatttctattacagagacgaggaactggaagctcagcaaggttatgacctgctctttgttatccggtttacagccggcgagattgaaattcgaacccaagcttccactgctccataatgccacattcaaataacatttattatgggcaaggcaacactgggtcctagggagcgaaagtggggggatatgaggatgtgaaaggcagccatattgttccttattaaatatggacagtgaatacaggaggaaagcaagtgaaagtttcacttatacccaaacaatcaaatggataagaaggactcaagaattgtattacacttggatttctaaaaaccgggagcaatgtttcccattcctatacttaaatcttgtctaagccaagcagtggctatttaatctgtagtccaattttaatgttatgttattttagagttcaacttggtgtgtcagattcattagcatgacaatactggaggcagagataaagctagagagctttaaagctggaaggagcgggaatgtgtgggttaagacaaccaactcccatttgagtcctaactgagaatgtcattaggccctggacaaggtgcagacatggctcagtcaattcctacccatgtaaaggaaggatttcttctctctctggggactgcaccgagagtccagaaatcattatctctcagagaggcaggatgtgggtgggttaataacaacttgtgtttccaccgcacggactatttcagggcctgcatcttaaggcatcccacgacatcccggggagggagggagaggatatttctctgtcaatggagaggaaatggccatctggagagcttttgtggtttccccatcatccctcagaaaggcaataattgagctaatacctagagcgcaagtatttggctttcctattcagctgtgcagctacccaaatcctgcctgctctgcctcaagagactccaagctcatctcctgcttccattcccagcctcctccaggcctgtccactcagcagccagattcatctttcttttttcttttttttaagaaacaaggtctcactctgtcacccaggctggagtgcaatggcgcaatcacagctcactgcagcctcaacctccccgggctgaagccatcttcccacctcaacctcccgcgtagctgggactgcaggctcatgccaccacacctggctaacttcttatttttctagagacacggtttcacttatgttgcccaggttggactcaaactcctgggctcaaatgatccttccgcctcaacctcccaaagtactgggattacggatgtgagccactgcacccagcctcatctccttaaatccagtcacagtactttcccgctcaaaaccctagattcaatggctaccaattgctcttgggataaagtccactaccttcccacagcctgcagggccctgctgccctgccccctgccctctgcttgtttccccagcctctcccaagttccttctgtcttcacttgctgtgttccagccacactgaccatcacactccttcccctcctcagggcatttgaacatgtgactctctgtcccctcttctatgtctcctacttaaccctcaggtctctacctaaaaatcccttcctcaaagaaaccatccccgaccccacagactcctgttacactctctttatcatcctgcatttctccaatggcacttatcacagtcattgctatgtgattgtgtgattagttaagcttctgtctcctcaactagaaagagaatgcaagccccaagagggaaaggatcatacttgtcttgttcatcactgtgtctccagcatctaacatagtgtctggctcaaaatagacaaaataaataattggggacaaaacagaccagctgaacggagtctccatggcaggattctgagccttcagggatcctcccatgggtcctgggttgatgtcccagggctaaggtactggcctgagatcagaaactaggataagctaagggaacaggagtgacgtgggtgtaatagaaagaatgtcatatattagtggaaaagatcaagcagacgcccaaagactgtgacagtgaaacaagaatgagagagaaatgtaaacattaaaaatgaaaaacattatatgcagatcacaactggatgacctagggtaagtttcctaagcacttctgggcttcagtttcttcattctaaaaatgatgataaaaatagtactcttatagttgaggtaaggattgatgagatgatacttgtaaagaatttagagcgatgcctgacactagaaatcaatcaaaacatgttgttattattgaatatgaaatgtcttcaccgggggcaattctgacaaaaatcagaattatgatgcattttgcaaatgtaacccacttatggcatcttttaaattatttattaaacttcaagagttatttatagctgatgtcgtggagcatatcagcattaaaggttatccctttcaacaaggagaaatcaatgctgttaggttagctgggatattttggatgagctcatgttatatgttttcgttttgagaataacactgactgtcaaagagctgaaaataaccatgttattctgacaaacacagggggaaatctgtggactaatctgagattcctttaactggctattattattattattttgatatggagtctcgctttatcacccaggctggagtgcaatggcacaatctcggctcactgcaacctccgcctcccaagttcaagtgattctcctgcctcagcctcctgaggagctgggattacagccacgtgccacaacacccagctaatttttgcatttttagtagagatggggtttcaccatgttggtcaggctggtctcgatggtctcgaactcctcacctcaggtgatccacccgcctcagcctcccaaagtgctgcgattacaggcatgagccaccacgcccacccaactggccattattaagcaactggaaacctgggctggtctcaggcaaaacagtgcaatagcgtgagtgttttcgattacctgtttccacattcaactctttaaccctgtgactccccactatgtgccaggtccaggctggtgctgggaatactttagtgagtaaggtaaatttggtctcttccctcacataatattggcaacaattttgaggtctgacagtttcaaatttggagaggatgtggagcaacaggaacagtgtagcagtagctggtaaatgggaggctcacatacagttctcctcccaggctttctactcagacatgtgcctaaggagacaggaacacagcagaatgtgcacatgaaactgcaaacaatccaaatgtccatcaacgagtaatgcacaaatatatatggcagagccgtacaaaggaatgttatgcagtagtaaagacgaagccaaaaaagctggatgtgtgaatatggatgaatctcacagttagtatattgaagtcccttccttcccaaagtgagtttcagagcccataaatataataccatttatgtgaagcttgaaaacatgcgaagcactaccatacagtatgttgtttagagatacatacatgtagagaaccgcatgcgcatgttaaacaccagattcaggaaattagtcacttggcagtggggaaggcagtgtgttccaggaaaagggatgaggttagtggagggtacgcagaggcttctgctgtgttgaacttcttaagcagggtgatgggtcggggagtgttcattacaccattgtataggtcttacatatttcataatatactaaaaatatataaaatatcatgggattatggctatgagaaggagagcaaagagagctaagggcacccatagcagaagcagatagaatcaaggaagactttttagattaagtgacatttaagacacagtaggagttaaactgagagagagaggaggaagttcattccaggaagagggaagaggatgtcaggaggcccagaggtaagagaaagcttggcagaggaattgaaagaaatgtcatagagttgaagtatatagagtgcatcaggaatttgtaccctatcctaagggccacagggagtcagtcccaggggttttaatttgaagcaagggagtgccatggtcagacgtctattctggaggatctgtccgctgggctgcagcatgcagagggcttggaggatgtgggactggcttcagggagacaagtttgggggctggttcatagatggtgtggtggtgagtgtagggagagcccgtggacagggtggatagagtgaacacgtatttaggagataaaacagacatgaccaggttggctgtctccagggttctccggccctccttgtttccataaaaaccatttacatgcagcatcttatagtagacatttctggaaaaacaggtagactagactgggtggatgtctgagttctgaagaatatctgtgtctactgagttatttgacagctttagagtttggcagacctgatttcagccctgccactcgctgcttcgtaatactgggcttggcactctccaagccccagtttcatcatctcttaaacagaaaaaacatttcctcttattgatgaaaataaatcatgaatataaagcacgtagttcaattcctggaaggtagtaagcaaccaataaatgttacccctccctgactaggcgcagtggctcatgcctgtaatcccagccctttttgaggccgaggtgggtggatcacttgaggtcaggagttcgagaccaggctggccaacatggtgaaaacctgtctctactaaaaaaaaatacagaaattagctgggtgtggtggtgcatgcctgtaatcctagctactcgggaggctgagacaggagaattgcttgaacccgggaggcagaggttgtggtgagccgaggccacgccactgcactccagcctgggagacagagcgagactctgcctcaaaaaaaaaaagatgttagccctccccaacttcacctgccacccgtatcccaggtagctctgcacaatgtggaggcatgcctgcttgttttcctcacctgtctgccttcctcttcttagctgtactccaggtccttgacctacctgagagcttcttttgtctttcttcactgagcattttcaggtccaagtttcagtttgtgaatcacaagcctgaaaattcccaaagacccagcagaacatgagacctgcacatggcacaaagcctggtgggctgtgctcctgcctgtgaacctggttcctgttccttcacaggtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgtaagcccctggccaaggtggagggtgggagctaaaaagcctctctggggttcagatccgtttgaggaatccatcatgagtgtagccctgcttgggggaatcactgttgttttctctctggagagagctgtgggcaaaatgagctgaggcccaggaggcaagaagaaaaggcaaaagtgaaaggactattgggggaagaattgtctggcagatttctaagtgttttatccagctcagacatgaaaacagcacatctgagttacaagttatttctttggtgtcaacgctcattttgtgtgtgtgactaactcctgccctactttgaggctcatgtgttttgagctcaatccctaaaggaaattggcaactcttcccatataaagaagggccctctggagggctggtgcaatgtggggaaaggtatccatttccttagaaagctgagactctggtcccaaactctttttatgtcaggttcagaatgaccagtgccagcccaatgcagatgactccaggtggatgaagaccacagagaaaggatgggaattccacagtgtgagtatcacaccagccttctcccagagatcccagaaaagggacccagggcctttcctcagagagtgcttcctcccagtctgagcctccaccccaatgtccctggagggcaggaatgtgatatgatgaagatgctgtagttactgtcctctagcattgacagaatatgggtgtgagctgacttgtagcttctatggcttgactccaaagaccagcagctttccagctttaagactgggtcttctgccgggcatggtggctcatgcctgtaatcccagcactttgggaggtcgaggcaggtggatcacctgaggtcaggagttcgagaccagcctgaccaacatggagaaaccccatctctactaaaaatacaaaaaaattagccaggtatggtggcccatgcttgtaatcccagctactcgggaggctgaggcaggagactcgcttgaacccaggaggcggaggttgtggtgagctgagatcgagccattgcactccagcctgggcaacaaaagcgaaactctgtctcaaaaaaaaaaaaaaaaaaaaaaagactgggtattctggggaggggggctgtccccctgcaaaaccacagaagaatgagggagtgccagtcaccctgttgtcaggaccctcaggtctctttactggtctcaccataagagatgctcatggtatatatgatccagggagtggtgggagggttgtaagaggaggcttagaaagagagaggagctgtgctaagttgggaagaaggacagagctgaggaagaggaggaagagggtcagaagaagcattaccatgcagttagtaagagaagtcatcccaacaagaggctataccaacagattagcgagatttttctctgtgatgaatgaatgctcctgtttgtggtttttaggtggagctaaatcgaggcaataatgtcctctattggagaaccacagccttctcagtatggaccaaagtacccaagcctgtgctggtgagaaacattgccataacaggtactgagagcagggttactgacttcctgggctgttgactttgcagtctcctggggactcagtctccaggctgaatccttgcttttctgtgctcttcctcctccctaggggtggcctacacttcagaatgcttcccctgcaaacctggcacgtatgcagacaagcagggctcctctttctgcaaactttgcccagccaactcttattcaaataaaggagaaacttcttgccaccagtgtgaccctgacaaatactcaggtgatgtttctgagggtgggaagagtttggggatagagagtaccaccaaaacacacaaggagataccagggaatagagccatccttctggccaagctgaggatggtaattcttaaacccttcctttctggatcctggaatacccttgccaatccatatatccattaatcactttgtcatttttttttttttttgagatagggtctcactttatcacccaggctgaagtgccgtggtgcgatcatagctcactgcagcctcaaactccctgtcccaagcaatcctcccgcctcagcctcctgagtagctaagactaccagcgtgccccaccacacccagctaattttttatttttatttttatagagacaggggtcttgctagttgcccaggctggtcttgaactcctgggctcaagtgatcctcctgcctcagcctctcaagctgtgagcctataatctcagcactttgggaggtcaaaccgggaagatcaattgggcctaggaggttgaagcttcagtgagccatgatcacaccactgcactacagcctgggtgacagagtaagaccctgtctctaaaaaaaaaaaaaaaaaaaaaaaaaaaaaaaaaaatcattcaataaatattgagcctctcctatctaccaggccctattctatgtgcttggaatacgtcagtgaacaaaacagacaaaggtccctgtttttatggggtttacattcgggggtggggggaagagagacaataaacaaaaagaaatagatgatacatatataataaattatatagtatgtgagatggtaaaaagtgccatggtgtcatggcaaaaagaaaaagcagctcagagctagagggattagggaagctaaggaaagggttgcaatccttttttttttgagacggagtctttctctgtcgcccaggctggagtgcagtggcgcgatctcagctcactgcaaactctgcctcccaggttcatgccattcttctgcctcaggctcctgagtagttgggactacaggcgcccgccactgcgcccggctaattttttgtatttttagtagagacagggtttcactgtattagccagggtggtctcgatctcctgacctcgtgatccgcccgcctcagcctcccaaagtgctgggattataggcatgagccaccgcgcccggcctgggttgcaatctttttgttgctgttgtagaaacacggtctcactgtgttgcccaggctggtctcgaactcctgacctcaaagtgatcctcctgcctcagccttccaaagtgctgggattacagacatgagacactgtgcccagtccagtcattttttttaagtggtgaatttttatttttatttttatttttttttgagacggagtttcactcttgttgcccaagctggagtgctcgaatgcagtggcgtgatctcggctcaccacaacctctgcctcccgggttcaagcaattttcctgcctcggcctcccaagtagctgggattacaggcgtgcaccaccatgcccagctaattttgtatttttagtagcgacagggtttcattatgttggccaggctggtctcgaactcccaacctcaggtgatctgcccacctcggcctcccaaagtgctgggttacaggtgtgagccaccacacccagtcagtggtgaaattttaaatgaaacattatataagattataatataggccaggggtggtggctcgcgcctgtaatcccagcactttgggaggccgaggcaggcagatcacttgaggtcaggagttcaagaccaggctggccaacatggcaaaaccacgtctctactaaaaatacaaaaattagcccggcgtgggggcgtgtgcctgtaatcccagctactcaggaggctgaggctggagaatcacttgaacccggaaggtggaggttgcagtgagcagagatcgtgccactgcactccagcctgggtgatagagcgagactcagtctcaaaaaaaaaaaaaaaaaaaaaaaaagattataacataaacagtagatactgtagatttaaaatgtataaatttatacattttaacgtataacaattattatcaaagttaatttcatgagcctatattgatgaacaagaagattttgataacaaggtctaaagatgcaaatgacaatcttttatcaacctgagagcattcattgaagtcaaatcaggcattctgggaaatctaggtttccttgtaacacaatttgcaaaccactgctctgagggaaagtaaggggacagcaggaagcagcctgtttttattgtttgaggatagcttcctaaagcattccaatttgagaaataggacgtggttatttgagggagttccagggggtatcgaggctctgatgtgggatgggcagtgccagcagatggctttctgctcagacagtccagacattggtatgagggccaacctccaagacaggttctgaaacaaacaagaagggagagagaagcagtcccatcttttccccagaaacactcacaactattctacttttccttttttacacagtttatatgtaaacccagcacaaggccctctctcaaacagacctacatatccctacaaagacatgccaaacttcacacaggtgtgaaagtatgtgtttgctcagccaagaccagccactgaccttgtgaattgcttgtttctacactattcctaaaacaaaagtcatatttacctacacagatcttgccaaatgagtgcagttttctttttttttctttttttttttttttttaattgatcattcttgggtgtttctcgcagagggggatttggcagggtcacaggacaatagtggagggaaggtcagcagataaacaaatgaacaaaggtctctggttttcctaggcagaggaccctgcggccttccgcagtgtttgtgtccctggctacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtacagaacaaaatgaaaagtctcccatgtctacctctttctacacagacatggcaaccatccgatttctcaatcttttccccacctttcccccctttctattccacaaaaccgccattgtcatcatggcccgttctcaatgagctgttgggtacacctcccagacagggtggtggccgggcagaggggctcctcacttcccagtaggggcggccgggcagaggcgcccctcacctcctggacggggcggctggccgggcggggggctgacccccccacctccctcccggacggggcggctgccgggcagagacgctcctcacttcccagacggggtggctgctgggcggaggggctcctcacttctcagaccgggcggctgccgggcggaggggctcctcacttctcagacggggcggccgggcagagacgctcctcacatcctggacggggcggcagggcagaggtgctccccacatctcagacgatgggtggccgggcagagacgctcctcacttcccagatgggatggcggccgggaagaggcgctcctcacttcccagacggggtggcggccgggcagaggctgcaatctcggcactttgggaggccaaggcaggctgctgggaggtggaggttgtagcgagccgagatcacgccactatgagtgcagttttcaactaaaacagaaatctttagatcttgggggaagtttttatctgtaagtctagattcctgtttttccacttgcattttttattcctcttccccactctgcttctatcaacagcaacctttgttagcctaaatctctggctccctttatggtccagcagttgggcagggtttgaatggcaaggtggttctagaaaaacttctcatagaagtgttttgatcaactctgtgtaagctgatttttatccagagtgctgttataaaagcattaggttgggagtctgaattcttggaatctattttccttctgccactgatttctcaatgtgccccattgactgagaagtgagttttttcttttttctttctttttttttttttttgagatggagtttccctcttgttgcccaggctggagtgcaatggcgcaatcttggctcactgcaatctctgcctccccagttcaagtgattctcctgcctcagcctcccgagtaactaggattacaggtgcctgccactatgcttgcctaaatttttgtatttttagtagagacggggtttcaccatctcggccagcctggtcttgaactcctgacctcagttgatccacccgccttggcctcccaaagtgttgggattacaggcgtgagccactgcacctggccagtgagtttttactatgaggaacatggtcaacttgttgacaacctcaccggcttggggtacaaagagagtcatatttctttgagacttgactcttccagaatacagggtcagtgagagactgggaaattgcagggagactctgatgatagcctatgatagactgtatgcagggagtgacagaaggtccatgcatttacaaatatattctgagtacctgccagttgccaaggactagcttggtgctagggttagagctggtgcctgacctccagcttatgttgaaaaggaaatgtggttatataaacacctaagtgcagtaactctccatggtgttgggataggagagctgggtgtagaatgcagtggaggtgggccgggtgtggcggctcacgcctgtaatcccagcactttgggaggccgaggtgggtggatcacctgaggtcaggagttcaagaccagcctggccaatatggtaaaaccccaactctactagaaatacaaaaattagctgggtgtggtggcgcacgcctgtaatcccagctacttgggaggctgaggcagaagaatcacttgaacctgggaggtggaggctgcagtgaaccaagatcatgccactgcattccaatctgggtgacagaataatactgtctcaaaaaaaaaaaaagaatgtagtggaggcaaaaaaggaaaatggttagtcccctctagaaaagaaggaaaagtttcactcgctaagatctggaaagatgaaaggttaattagtgatttggtgggggcaggatgtttgggatagaagtgtgagcaaagggccaggcgcagtggctcacacctgtaatcctaccactttgggaggccagggcaggtggattgactgagctcaggagtttgagaccagcctgggcaacatggtgaaaccccatctctactaaaaattcaaaaaattggccgggcatggtggcgggcgcctttagtcccagctactcgggaggctgaggcaggagaattgcttgaacccgggaggcggaggttgcaggttgcagtgagccgagatcatgccactgcactccagcctgggtgacagagtgagactctgtctccaaaaaaaaaaaaaaaaaaaagaagtgtgagcaaaggccagaaagctcaggaaactgcaaataattcagcttggctggagattaggtggcgagaagttgcatctaaggctgagaagcaggccggaaacagattatggagcagtccttctgtgctattgtaggggcaaaaaattgggatttgatcctatcagcagtggaggtcattaaagaattttaagaggccaggcacggccatgcctgtaatcccagcactttgggaggctgaggcaggtggatcacctgaggtcaggagttggagaccagcctgaccaacctggtgaaaccccgtctctactagaaatacaaaaattagctgggtgtggtggcacacgcctgtaatcccagcaacttgggaggctgaggcaagagaattgcttgaacctaggaggcagaggttgcagtgagccgagatcacaccattgcactctagcctgggtgacaagagggaaactccatctcaaaaaaaaagaattttaaatgaaggatttcagccagtgcttttgaaagaccactctggctgccatgcagaggagggagggaatgctggaggcagaggctgtggtagggagatgttgcagctggcatcattgctgatgtccaggacctaaactaaggtggaattaatgtgggtggagattggagaactcacaggagcattgtgaaggacaaaagcctgactaaaagcatctttctcactggtccctaaaatttgatcattaggtttaatttctttgtgttatgtttcatattagtgatccatttcctaaacagaatagcatgaagttaaagagcatggactccagaactaaattactagggctcaaatccctgctccaccaattagtagcagtgccaccttgggcaaattacttatctgtgcctccgtttctttgtctataaaatgggaaggacagctgggcacagtggctattgcttgtagtctcagctactggggaggctgacgcaggaggatcgttcaagcccaggagttagaagctgagtgagccatgattgctccattgcactccggcctgggcatcagaacaggaccccatctctttaaaaaaaaaaatgggaatgacaataattatatctgcctcatagtgttattgtgaggattggttaatacaggtaaaggatttagaaaggggcctggcatatagtaagcagtaattttattaattcatttaccttaagccctgtcccaacactccttttttaatatgaaaatactcaggccagcactatggctcacacctgtaatcctaatactttgggaggccgaggcaggaggagtgcttgaggccgggagtttgagaccagtctgggtaatagaacaagactcctgtctctacaaaaataaaaaaattagccaggtgtggtggcatgcacctgtagtcccagctactcagaaggctgaggtgggaggatcacctgagcctgggaggtagaggctgtactgagctgattgtgccactgaactccagcctgggtgacagagtgaggccctgtctctaaaaaaaagaaaagaaaagaaaatactcctggtacaggtaacactcataagtcacgtgtatagtactctccaattgacaaaacatgatctcatttattacctatagcatagtgagggagttatttctgcatttaccgaggaagaaagagaagctcagcgacactgaggagcttcacaaaagcatgagctgctgtctgacccgggcctgtgtccattcagtactgaaaccctcaggagaaatgttttactttgataaaacagatcccagtgagaacattgtactcctggaggtggggggatattgaaaggaggaggcaggtgcagaaagaggagttggagcccctgagataaactttatcttcttacagttttgcccagggccaatcctacttaagtcacttttcactccctcaaccaaacacagaggcccatcttccaaacttgactagcatccaacttaaacactttgatgaaacccaagctgggaaaggaggttggtctcagcattttggttaatcatttattaaaaccaccttaacagggatcagtgtgtaaacagctgagccatttttgctaaaacccagagctaggatgtcagattgagcaaatatttgacaagcagagaaaggtcttggtgtagaatgcattttctaacacataacttgtactttgctagacctaagaattggcaccttcccacgttttcagcctctctccccacatttttcctggccaagtcagtcaaaagcaggagtccatgggtccctctgtgctgaattgggcctcctgcttggtaaccaagtaaatgagctgagaagaccccaactgtttctcagccagtagttcccacctgtccagcctaataagacagagacagaagaggtatggagatgtgcagttgagagaactttccagctcaggccaacaagactgcaattaggagattatctgatctacgaacccatgtggtgcctggagaaaaagaaggaatcagttgagaaataagcccttaactgaaagggaggtaaagagacctttaatccttattcactctcctgtgactactcccaaataaaaataattcccggctgggcatggtggctcacacccataatcctagcactttgggacgctaaggcaggcagatcacgaggtcaggagtttgaaaccaggctgaccaacatggtgaaatcccatctctactaaaaatacaaaaattagctggatgtggtggtgcacacctgtaatcccagctactcaggaggctgaggcaggagaatcacttgaacccgagaggcggaggttgcagtgagctgaggtggcaccactgcactccaacctgggcaacagagcgagactctgtctcaaaaaataataataataataataataataataattcccaaacatgcaggtaataatagttactgctatctagtgagtatctacttacaatgtgccaggtaggtactggctccagcaaggtatatattattattcctgttctacagatgagaaggctgaggctcagagaggttaagtaacttgcctaaagtgacacagctgctaaatgatgaagcaggatccaaacccatatccgtctagcttaaaatctcattccaggccgggagcggtggctcacacctgtaatcccagcactttgggaggccaaggcaggcggatcacgaggtcagcagatcgagaccatcctggctaacacggtgaaaccctgtctctactaaaaatacaaaaaattagccaggcatggtggcgggcgcctgtagtcccagctacttggaaggctgaggcaggagaatggcgtgaacccgggaggcggagcttgcagtgagccgagatcgtgccactgcactccagcctgggcaacagagcaagactccatctcaaaaaaaaaaaaaaaaaaaatctcattccactacaccatactgcttgccaggtaatataaagagagagaagttcttaccattattcagtgcttatctgcaggtgacacagcagtcatattcgaagtagtggtggcagtagtaacagtattgtaatgtgcacctcataaagcagttgtttttattctggaggaagtaaattccctagaaaactttcaaaaagtttttatttgtatgaattacgcatatttttctaggtagagagaaacatctctttttttcaaattttcaaaagagtttttaaaatcaaaaaaagttaaacccactgctttaaagagagagtcaagcacaatggctcatgcctgtaatcccagcactttgggtgggtggctgaggtgggaggattgcctgaagccaggagctcaagaccagcttgggcaacatagcgagactctgtctctaccaaaaaaaaaaaaaaaaaaaacaaaaaaaagagagagagagagaaaagaaaacaaaccctatgatgaaataatgaaaaaaataaaattaaaaaatgaattcatagaagtagttctcactatccagaggttcacagggttaaagcagagctaacattgaaaggaggagaacatgcagagagcagaagaaaactgatagttcacgtttttcttctttctttcttttccttccttccttccttccttccttccttccttccttccttccttccttccttccttccatccttccctccttccttccttccttcctaacagagtctctctccattgcccaggctagaatgcaatggcatgatcatggctctctgcagcctcaacctcctggactcaagtgattctcctgcctcaacatcaagtagctgggactataggcctgcaccaccacgcccggctaatttttgtattttttgtagagacagggtttgctatgttgcccaggctggtcttgaactcctgggctcaagagatcctaaagtgctgggattacaggcatgaaccaccatgcccagcagttaacatttttcattaggtataaatcaagagttaaagatagtgttgggctggtgcgggaggcgggaggatcgcttgagcccaggagttccaggctgcagtgagttaagattgtaccactgcagtccagcctcagcaacagaacaagactctgtctctaaaaaataacaataataaaataataataaagaggccgggcacggtggctcacccctgtaattccagcgctttgggaggccgaggagggcagatcacctgaagtcaggagttcgagaccagcctgaccaacatggagaaactccgtctctactaaaaatacaaaattagccaggcatggtgactcatgcctgtaattccagctactcaagaagctgaggcaggagaatcacttgaacctgggaggcggaggttgcagtgagccaagatcgtgccactgcactccagcctgggcaacaagagtgaaactccatctcaataataataataataaagatagtgttgggatgcttgggttgaggcaagtgggaagaaccttatgtgttaggtggagtccaaggaaattacaaacctggtttgtgtagaatgattgcatgaagaaaaggaaatttccaaggtggaaggccttcattctaggcatatattagaacattcatagaaaggcttggaatgagtatgaaagcaaaatcatgttttacttcaacacttcaggagtagaaaaaccacacccagagtcaagacactaaggcacctggaagatggtgaactctctgaacctccccaggtttcagggaacttaggttggcagtggttaacctgcaagaagctgtttccgtctaccctccttgctggtcctttggccaggccacttctccctcccttgccccatggggcgggggacgggaagcggcaaacagtggtttctcatcagcacctggaacaggtgcaaagggaagcttgagcagggttggggaactggaaatgacactattgagacaaggggaagggtgagtgtgcaggattttctacttccggcaatatttgtgtggcaatgcacccagggacttgggagtcacagggccatgaagaggccaggagctcagctttcttatgtaactccaaatatttcttcttgctttggcaatttagagaaaggatcttcttcctgtaacgtgcgcccagcttgcacagacaaagattatttctacacacacacggcctgcgatgccaacggagaggtgggtagtacagtcttggagccccttagccccagatggactgtctcccactccctgaggtttgccaccatttggaacttcagcagtcaatgacattggcactagttaaaaccccacagacctttgaggtgaccctagggctaggtggggtggggggcaaaacgagacctcttcattcattttccggtcagaaactgtttttgcagcgtttgtttcactgtttatgcacatatgttctgtttcaaaaacccacttcattctctcttgcttggtttcttctatttgccgagccactccggcagagcctgcctgtccgtacacaatgtcctcccggggctcttcaggctcaccccctcggcactgttttgtgggctggcacggggaatggattcctgcctatggtctgacttgttccgtttctgctgcttctctttcctccaggctttctgcttcagaaaagaactttccctcctagtctacactgtcactgagtcaacaagcattttttgaggctgactgatatgtcaggcctggcactataggctggggagtcagagacgactgaaacaagctcctgcccccagggagctcacagtcctgtatgagaggctggagagaggagaaaaacgggcccagtcaaggcaaccagagggatgtgcagggaactgggggagcccagaagagaagcgaccaggacttggggtgggggcagcagagaaagcctctcagaggaggccatttgttcaacagtcaacaaatatttatcgaggagcgactctgtgccaggcacggtgctaggtgctaggcatgcatcacttaacaaaactgagggaacatctagcccttatggagcttaactcttgttggggagggagtggagagagagataatagacaacaaatgggtatataatatagcaaatggtagtaagtggtaggaaggaaaaaaaaaaaccaggattaggagagagagaatgaaggagggtggtgccactattttagaagggtagggatgtcctctcaggaggtgacatttgagcagagacctgaaggagatgagggaggagccgtggagctttccaggcagcagacacagcaggagaggaggcggcagctgggccaggtgggtggagaaacagtgtaagtgagcagggaagggcttgaggtgcacggagaaggatctggctgagctgtctgtatccctaagctagagattctcaagaggatagaactaggagttgggcattctgcactcagcactaagcatgatgcttggctcttagggagcataaacatttgctggctgggcggctgactgaattctccctttcctaactaagcatgggttaaagtctggtccttaacaatgaatattttgcacagtcatctcttaccaacaccacctcccccacgtatttggggcatcatccccttctccagcagccaagagagaatggctgtgtcttgtcagttgcaccttagactcagttctgtggtgtctggtattctgtatgaccttgtgaacatttattttcattttcttggtctcagccaactcactaataaaaggcagacaattaatcctgctgctcttctccctcctgttcataacatgtgactgaatgtggctgtctttcctcccttctgccccattctcttccctccctgggctcacgccaaggccttctgggtcagtaccgtgcttgctgcctgaaagcccgggtgtctgccttggcctgaccactgccggggcctttagatgctgggtcagaccaaagcctgtgttcccgccttgcagcacagccaaggcccagctcagaggaggagcactgaagcgtgtgctttcaggagtgcgcatgaacatgcattccccagctgttccttgcagacttctgctttgtgcctcattcccgcactggttctgctcagtctggtgattgagtttgtcttctgaacagtattttaaaatcaagggacacacctcgagctggctcctatgattacatttctgaccttggctgtgcctcagttgtttctcagggaccaggatggcccatccattggggtcagtgaatgtgctgctccaagagctggcccgagacagtttgccagctcctaggactctcctctccctgagactcacaggaggcaggtgaggttcaagcctggggctctggctgtcgcagccctccgcagggaagagggccgagctgagcaggggaaggaggagcccagggctccccatcagttaaggcagtctgtgtccctccttaaggacttgtttcttatcttgaaaaatatggacagaggccttattcatccttcttttcatatgtatggtatctgcacagatcatgttcatcaacccctcagttcaacctataagggcacgtttttgtctgtgactcgatctgagggccacatgggaagaatggagctgcccaccttcacccctgactcagccggggtctcctgcgggtcatctccacttctgtacccaatgcaggggccatgtttcattcatctctgagacaccaggtctggcacatagatgcattaggatttacccaataaataaaagagcaaagaatgtaccactcaaaaaataagtggggacatctcagccaccccctcagtccccgggggacatctgagccacctccacccttgtgcctttctgtgttctgggattttcaccagctgcttttcctgtgaccttggtagcaataagattctacagtggaatcggagctttctctaagacaactggtcccacattctctgtcataaagtcttcattagagctattccttgtcacccaggcaacattcatttggcagatagtgattgaacacaaccatgactcaggcactgggctaggtgcttgggatacatccgtgagccacacaaagttccccaccccagaggagctcttacctggcccagaatctggatctctgcccccagcccctatcctcaaggtagagtcccaaagatgtcctaaatctcacacaggctgagttgtgcttaatccatttctgcagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcaggtaacctcctcaccaccccactctctgcagcacatcgactgtgtgggtgggctgtgtgggcactaacagtggccagctgaatgcagactctgcccttccaagggaggcagtaaggaataaggaccaggccacctttgaggactaaattcaggagaagagaggtcagggctggcctcgtctgcaggtcagagtcatacttgaggctgccttccttcctccttgctccaactgcaaatgtgactcaggactgaaggtgcccaatcctcaaagcagggcttccagcatatggcagagatgctgactaggcttacagggctgggatgaccaaccccacacaaccaaaacctataagccatgctgccttggggggatttgagtacctgttaaaatgaaagcatttaatgataatatgacaataatatgaactatatgtatcagactagaaggtacatttaagttttgaaatggaaattggggtgggcaaataggatggttggcatattggaatgaaggctcagtgtttacatcttgagttaaatacattgtcagaatgtttttgagtcaacttgatacaacttcctgcagcagtactcagcagccaggcttctgggctgcccgctactgttgcaacttgtctgtgtggcagcagctccagtcagagtgactgcagccttcccactgaatgcatggatcttgtttgtggttccccagactgtacccgctgccctgcagggactgaacctgctgtgggatttgaatacaaatggtggaacacgctgcccacaaacatggaaacgaccgttctcagtgggatcaacttcgagtacaagggcatgacaggtaattgcctctccctgtgccatgagctgtcagctccctgcacaccctcagttcttccaacttcacatttcttcataatagtgatgtctgagaaaaataagctaaccatgtcatgcattcccttgaaagttccactcctcatggacatatgttctgccaagacagctttagaggaaggaacagagctagaaacatgagcgtgcacttcaaaggtcttgctctgagagcttcagggtttttgaccaaagtggcaggataagtaacacggttcatgttcagtggtggttctgggcgcctcaaaagatggtgtcaaacctcccttccagagtgtcatctgggtgcacatttgccttgcacccaagagcacaaggcattaactctcctctttccttttcaggctgggaggtggctggtgatcacatttacacagctgctggagcctcagacaatgacttcatgattctcactctggttgtgccaggatttaggtgaggaatccaaagcccaggggagtccaggccagcttggccatatccgaatcccacgtattttggaatattgtagaggagagggcttccggggttgtgtttcatttcatttcaaatgtcagttgagaacagagggtacagtttgaccgaggtaacccaatgctatcacgtttttcaagttgctgcccatgttgatttaccgactgctctctctcccgtatagcttctcccagccattagtcacgtgctattcaaattcttcctcctcacagcatcacttaagattagaaaaaaaataaaaataaaaaataatggggtcagaaatgcccatagacagttcatctttatttggggcaagaagattgggaaggattattcttactgtatttgtccccatatcccaggaagacctagggcaacacgaaatttgtttcccactaaacaaacaaacaaacacgcacacacacacacacacctcctggcagtgtggtgtggtggaaggaacaccagactggaagacagggcacttgtgctttgccgcttactggccgtgcgaccttaggaaaagtcacttcacctgttcaggcttcgggcccctcatccataaaaacagtgtgtgatttaagactaactgaggttcagatggcttttccagcccgctggttaacacagctgcatagagataagctgagaactggaggtcctcagaattcaggcaaatggctaaagccaaaaggaaagccgtgaatgaatttccaaggccaaagtgaactcttctgcccatatgtgctctaaagataagaagcaggcactgaatatgcttccctagtgccagtctgacaccttcatttccttcttcgaggtccctgcttcccatccctgggatgttgctcagtttgccttcccttaacacacattactcagagctagccagatgaatgaagcctgtgtttgcaaggtgagcaaactttttaggctttttttggaataacattcaaaaagtactttccaatttgcaaatctgatcgtcatagtaaagtgttgcctcatcccccatccccactactaccccagcccgcttgggcatggctctctctttcccaaaagtaggaccaaacggaggactttgctggatcacaaattctgctcctttaaccccggcaaagctccccagtgctggagagacagctgctgagtaaatgtcaacaatttacagtcttatgatagacgtgcttctcaaacataaatgtgcacacgaatcgcctgggaatcgtattaacatgcagattctgattcactgggcctgggaggagcctgaggttctgcagttctaataaactctgggagatggccatgttgctggtctgtggaccatattctgctagtgaggtgatacagcattttataaaggaccgccacatctgtcatgccttcaggtctccccgcgatgatggggggtaggtaagaaagagatttcatcacctccattttacagataaggaaaccgtggtttggctaggtcaaggtcacatagctaggagggcagaattggatttagtccacacgctttccatcatactcagaacttaaccctgtcccccagcagacgctctgctgttgtctgggctcttcaataagcactgcctggcctttagaactgacttttaatttctgcccctacagacctccgcagtcggtgatggcagacacagagaataaagaggtggccagaatcacatttgtctttgagaccctctgttctgtgaactgtgagctctacttcatggtggtacgttttcctttctttgcccgctagagggcctccaggggagggttagccccatctgccccattggtgtgtccacgtgactgacacccccccttgtagtgattccacagaggaaaggcccagactgaccagcagggacttcacagtttaacaagggtctcaccaaccgtgatggcacctgggatggcagccacatgggcacccacttcccctctggccatcgcacccgcttcacttgtctgtcctgggttcagggtgtgaattctaggaccaacactcctgtggagacgtggaaaggttccaaaggcaaacagtcctatacctacatcattgaggagaacactaccacgagcttcacctgggccttccagaggaccacttttcatgaggcagtaagttcctccccttcctcagacccccaggagagaccctctgaacccaggaggactcctagcattagcttaagtatgagtgtgaagttcagaatctgagggttagaaggatctcagggggtcaagcagaaaactgcctaacccagccctctgaggaccacctagtcttgtccagctgacttcctggaaagatgacaccataagaaataagttggccctccttgtagtccctgccctgatacatgtgttaccagacttgttgttgtttttaataataacaactctggttttagtttcttaactcaaaggaatacaggctcattgcagaagacacagaaaataaaaataaacaaaaataagaaataaaatcagccataatcctactactcagagataaaccagttaacatctggacaatctcctatacactgtttgtttctgcacaagtacatttttttctcttttataaggaaaagacttgcttttttcataaaactgtatatattatattttccccatggtacttaacatttttatatgtcctataaatggttcagtctcattttaaaatgacatcaaatgcacacgaagagctactggtaagtgagtaaaaagagtcagatgcttctcagattcttcttaagtatcacaggatagaagattaagtaccttgctctttctagaggcctcaattgttgctgctgtctcaggcctctcccctctcccctcttgtttccttgtctccagagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaaggtacctgtagtctggcatgcatcctaaacctgaccctctgcttggatgacctcagaagatgctgggtcctgggtagggttcttgagaggctgatacccgagtgctccccctagcatactcctaggttggagtcctggaggacacccatccaggctgtgactgtggagggttagcagggcttaatttccagggtccaggactcagtcactgacaagtctcctctttagttggcaggtaagagaggttggtgactgtctggtccagagggttatttggcatctgtgcagagacctaaagggaaggaacagtggggtgaggcctgtggcttatattcaaaaatgttcaatccagcctgttattatggaaatctgccccttctttggaaagatagaaacccaaccattgctgggacatatgataactggcattgctgtcttctatcccagtggcttctcagctttacaagtataaggattcctttcctaagtggaaaaaagctgggtgcagtggctcacatctgtaatcccaacactttagggggctgaggtgggaagatcacttgagccccggggttcaaggttgtaatgagccgtgattgtgccactgcactccagcctgggtgacagagcaagaccctgtctctaattaaaaaaataaataaaaataaaggcacattaaaaaactaataaataaataaagtggataagcagtgttgttgcccccatgtactttctgcatctgagaagtacttatgactaaaagcttttagatattaatcgatgcttttaaatgaatttgcattttactgatcacaactacatgcacatacatctgtaaagcactatcaatatgtactctgcaaacgttgcctagttcatctgtgcaataagtgcagcgattctacagactcctggcaacctctttcgggtaccctggacttttgccacaaccttccttccctggagctccctctgctgctgtgggagggaatgacagttgtgtgcggctaccgctgaatggtgaccctaaaacagagcaatgaatgggtttatgggaagaaaagcccctttcggagttcagtttcctacagagaacctgagaaacaggaagcagagttcagtgagttttgcactgtgagggggtgaggagggagcaagaaaagtttctcttctcccatctcagatacccttttctggttagtgcctcattgtcttctgctggaaagtaaaaaggatcctcttgtgtcttgagaggcttctataatctaggcacagggttataaggctatagaatttgtccaaactcccttctgaacaataacagatttaggtttgtccatcatatatgtgctaataattgaatggcaaatgtacataaatcccactagtgcctgtttcacttcttttactagccactcctaatcctttcttcctcctcttgaccccatttgggcgggaccagacgggggagaaaactgctactcttggctgcaggccctcaaggcccttcctgaccagctggcccgacccgtccctctccccctcagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccaggtaaggtataccagttgacagggtgaaaattgaatgggggaggcccatggatcagaagccagagacagacacaggagaaaaccagaaatccttcaggtagcagggggttgaggagcttcaaaggtttttacatattattctccctgaggactttttcccctaaaattaaataatcaggattataaacacttaagaaaataaagatatttaaaataatgtgttcttgccgggtgcctggtgcggtggctcacgcctgtaatcccagcactttgggaggccgagacgggcggatcacctgaggtggggagttcgagaccagcctgaccaatatggagaaaccccgtctctactaaaaatacaaaaaaattagctgggcgtggtggtgcatgcctgtaatcccagctactcgagaggctgaggcaggagaatcgcttgaacctgagaggtggaggttgcagtgagctgagattgcgccattgcactccagcctgggcaaaaaggtgaaacttcatctcagaaaaataataaaaaatcaataaaataaaataaaataaggtgttcttttacctgacctttatttcctcaaaatgagtctatttaaaaatatgcaggaggaaggctaggcgcggtggctcacgcctgtaaacccagcactttgggaggcctaggtgggtggatcatgaggtcaggagatcgagaccattctggctaacacggtgaaaccctgtctctactaaaaatacaaaaaaattagccgggcgtggtggcgggcacctgtagtcccagctactcaggaggctgaggcaggacaatggcataaacctggcaggcggagcttgcagtgagcggagatcacgccactacactccagcctgggcgacagagtgagactccgtctcaaaaaaaaaaaaaaacaaaaaagcaaaaaacaaaacaaacaaaaaaaaccccagaaatatgcagaaggaaaggtttttttcccttgcttgaaaaagcagtcttcagcaatcactgcatttgtcgcttgttttctagaggctggataaaatcaactgtttctagttcatccacacgtctctttgctgacagtatgaaagaaagtaacatgaaatgctttataaggaaagattgtcaccatcagccatttcatgctgctgcaaatatttcagatccaaaattcaaaggcagaaatgcaaaggttaatcccaccactgcacttgattaaattgcaacaagccacaattagcagttggaaagttcatttcaaatgttacaaaagaggctgggcatggtggctcacgcctgtaatcccagcaatttggaggccaaggcaggcagatcacctgaggtctggagttcgagaccagcctggtcaacatggtgaaaccctgtttctactaaaaatacaaaaattagcccggcatggtggcacacatctgtaatcccagctactcgggaggctgaggcaggagaattacttgaacccagggggcggagattgcagtgagccaagatcatgccactgcactccagcctggacaacacagcaagactccatctaaaaaaaaaagtgacaatataaagagcatcttgagcatctagtctttgactctgttggtggtaaggcctttacatcatagagctctgacccatcttctgcagcatgcaaagaagtcgatgggtgtttataaagagaacatgtcaagaaataaactaatctatgaaagattagagataggtgtctctatcttgttttcagaagtcttcgaagaagttaaaatgaagcctcagaagtaacaggtcatgatcacttaggaaataagactgattaaagcaggcttcatgtagcaaaagtgtcattcagtgaattatggagagcaatgaaggtggggaatttggggaaatggtgtatttttttatctactcctttcctgtttagaaatgcttatgatgtactgccacacgatagatccttagttcaaagacaaaagaactctattttattgtaatgtaaaggttttcttcagttttcaagctcatctacttcctacaatctagaaaaaaaaaaaaaggctgagacaccagatttagcactttttttttttttgaggtggagtctcactcttttgccaggctagagtgcagtggcacgatctctgctcactgcaacctccgcctcccaggttgaagcgattctcctgcctcagcctcccgagtagctgggactacaggcatgcgccagcacgtccagctaatttttgtgtttttagtaaagacggggtttcaccacgttggccaggatggtctcaatctcttgacctcatgatccacctgcctcggccttccgaagtgctgggattacaggtgtgagtcactgcacccagccagcaccatttataataaaatttataacattgaaaatgttgactgggcacagtggctcacccctgtaatcccaacactctgggagactgaggcaggaagattgcttgagcccaggagttcaagaccagcctgaacaacacagagaggccctatctttacgaaaaaaaaaaaaaaaaattaacctgcggttccagctacttaggaggctgaggcaggaggatcacttgagcccaggagttcaaggctttagtgagctatgattgcaccattgcactccagcccgggcaatagatcaagactctgtctcaaaaagacaaaacaaaacaaaaaaatcaaatctgtctcgtcattagacctgggatgaatcattcccctacaacataccattgaaacgctgaaaatttagatgtaaaaaagccttccctattcccttctgggaattcctctgtgaccactcacttcttcctacttcttcctccccactccccaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggtgagtaactccgctgcctcagccttgtttgagagtgtgtgtgtgtgtgtgtgtgtgtgtatgtgtaagagagtgtgaggttaccagtctgggaggtaaaaggccccacatgaggggcccaacctcttgacctgtgttttctattccactctgtgtgcaaagtgctcccagggactctgacaaacccttgtttcaccctttcataagccactcagggatgtgatgagatgaagtgaggttggatgttgacaggtattggaagaattgaagtggttgccagctaatgctactagtgagaactaattaggagctctaatttggcaggggtgacaacagatatgactctggatggaatcacctccccagctgaacttttccacctggagtccttgggaataccggacgtgatcttcttttataggtgaagatgagaggctaggctaatgcaagtgaaacctaggactcctccataatttctgctgcatccctccctctctagccacctactgcttatcaagccagaacatgtctgaggtctagcagatctgcccagtcatgatagctaagggctgggagttcctgatcccagcttcctggatattactggagcagatctgccctagaggcaaggagaaatattggatgatctgcagtggacttcccttccagcctaagcaggctccagtgtatgctagccatgactttcctaaaccagggcatttcccccttgactacatattgttgatccccaccctttccacgtataaaccaaggcctgtgcactccctgtgtgccaggctaaagcccaagtcctgacttccccagcaagggaattgctccatgcggatttctcttggtggctgtccaataacacagctgagtgactcattccctcatgggggctggctttctctgcaggtccaatgatgtgacccagtcctgcagttctgggagatcaaccaccatccgcgtcaggtgcagtccacagaaaactgtccctggaagtttgctgctgccagggtaagccctgcaaagggatgtaacaaaggccaaaatctcccttgaagtcattccatcctgagatccagagattactgaaaaagagcaaaaaagaaaagagtttgagatccattaatgggtgcttaggggcacagtcatggccccagaccctcagtcttcatatggcaagaatggggtagaaggaagagtgaaagctattctcatattcctggtccattaaggcagcagctgcgtagcatggtaaccaacagctcggctgagagccaggttgaatcatctcctccactaaccagctatgttatcatggatgcatttcttaccttctttaggcctcttttttccatatctgtaaaaatgggcataatgctaaattccctcagcgggttgttttgaggattaaatgagacaaggagactttaggacgtttcatgatctctggctattatgaggattagtaaaggtttagggatcctaggaatctctctgcaacgaaaatacccagttctgaggttaatagctgagtgaactaaatcaaaaatttctaaatgaatatgaccacaggacaccccctcccctccccgcataacagcagctaacatcttgacgggcactagcgtcttgaggaagacgttttggatatgctgcgcctaaactgactggggagatggggagcaaagcagggcgtcttgacccagtagtggtgtctgagtgtcaaatccctgttcttgccattgtaaacatcacagtaaagtacataacaggtatccataccggaagttcattcctgaaccccacctcaactccaatcccaccccgaggaagctgcatcaaagtggctattgcaaaatgtcacaagtctgtggggaggacaggaacctcaaaggggttgatgagacagccatgctggagctcagacaccttacaatagctctcataagatgtcagcaaaaacataaacgggcagagggtggggagcccactggaggccaggaaggcctcttatcagtgaaatcagagatcaaaacctgtgttaaggactagttggaaggatcctggtagggctaatggtttgggcagggagagggtaaatcaggcaagctatgagacaacaggcttccaaccagatcttccccacccctccagcgagtgagagctcaggtctcttttctgctttgctagaacgtgctcggatgggacctgtgatggctgcaacttccacttcctgtgggagagcgcggctgcttgcccgctctgctcagtggctgactaccatgctatcgtcagcagctgtgtggctgggatccaggtgggtttccctctgatcgggcacttccatgagagaagggaatgggagatctgagttccttgtttttctccccaacagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaagtacatgttgcggtattggagtgtggggatggacagggttggattattgatcagggagaatatctgaaagtataaattaatggggtttttctctggagttggctacagactctgtgacttatccagtgcatggtttggttatcctgactcctgaacagggatggtaccacgtggcagtctataaatggatgttaaattctcaaaagcaaagagtatcctcagtttgctattattaacagtacagagaatgacattatgattttgatatttccattaaattttgagatcatagaaacagacagccttaaggaacaaagatcactgaactgggaactaagattccttctattaccccagccctgacaccattttaccatgcttcagtctccttacccatggcatgggaataggacctgttcatagcctaacctctctacctctttcccccttattcccacattttgggatcttgtctttcccatcctcctgttttatagactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaaggtaggggtcctggccagtgcactgaggtcagcctggagggctggaggagacactgctcctcagacactgaatggtcctgtaccgttcagggatgggcaccctgctccccacgcccgatacaattccatttccccactctgaaaatcctgccttctccttctgtgtttctacaccaatactctttcccccggggcccaaggctgctcttgatcaggctccttctctctcaacatgcactccagttagtgaactgtttgggccttttcacttccagaaggagtactgaaccatctatgttgtaagaatcatcccctactcctttttttattttcactgaaaagggaaaaggtgatctctgggatcaacttctgatagaagtcaggctctcctttgaccagtggggggtgctgtcttccaggtgtctgggtccagtcctttgggagctgaatcatagttcagtctcagctgttccccactgagcaattctgagctgggagggctggctttgtgtgggtgggtgagtatgaagcttataaatgcaatacagacaatactgtcactgggtgtggggccagcagacagcatacaagcaggtcctccagggctatagtcctctgcagcacaactctgccagtgcccatacctgactactgctctgaaccagttcatcccaataggagtgggtggggagggcggaaagagggaggagggtattgggaggtggtgaagaaaggaccgtgcttgggtgtttagattgctaagtcttgtttcctttgtgctgacctgctagggagactcccttggcctccttagactgcgatttctttttttttaaatgaatgggagaacagttcaccctgggactcttgagtctatctgggactgctagaattcagcaaaggtgcaaagcaggggatttttaagatttttggctcatgcctgtaatcccagcactttgggaggcccaggctggaggatctcttgaggctgggagttcaagatcagcctagacaacataggaagaccccatctctacaaaataaaaaacaatcagctgggtgttgtggagcatgccagtagtctcagctacttgggaggctgaggtgggaggatcacttgagcccaggagttggaggctgcactgaactatgattgtgccattgcactccagcctgggcaacagagcgagaccctgtctctaaaaaacatgtatttatttatttatttattgagacggagtgttgctctgtctcccaggctggagtgcagtggcatgatctcagctcactgcaacctccacctcccaggttcaagtggttctcctgccttagcctccctagatgctgggattacaggtgcttgccatcacacctggctaattttttttttttgtatttttagtagagacagggtttcaccatgttggccaggctggtcttgaactcctgacctcaggtgatctgcctgctttggcctcccaaagtgctgggatcacaggtgtgagccactgtgcctggccaaaaacatttttttaaaagaaaaaaatttttttttttttgagacagagtttcgctcttgttgcccaggctggagtgcagtggcatgatcttggcttactgcaacctctgttcccgggttcaagcgattctccttcctcagcctcccaggtagttgcgattataggcgcctgccaccatgcctggctaatttttgtattttcggtagagacagggtctcaccatgttggtcaggctggtctcgaactcctaacctcaggtgatccacctgccttggcctcccaagtgctgggattacaggcatgagccaccacaccccgcctaaaagaaaaagatttttattgttctccaactgaccctgaagggagcaagcagaatagagggtatctcatttctgtgtttccacaaagccactgaaacaggaatttcataagggttccttctgtcacctattttccatttctctcctttgtccccaaacttgcccctgtgcagcagccagctcctgtcaccatctctctttcagaggactcctgatggatttgactcagtgccgctgaagacatcctcaggaggcctagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattatgcccttgcttgtatcttgtttcccaaaatggcccatccgccagagccatagcttcgtctgctcataattcttatagctttggaatgaaaatatttctatcttcttaagtatagaaactatttcctctgtcctctaacttaagggcagaaacagctgggagttttcctcgcatgccctcagctcatgatctcttcaggagagaggctgggtgaggagggtgtcggggttccctggtggataatcttcatagcagcctggatccatttcccctggataaccagctcaaagggagtgaaaatggtagtctgagggcaaggggagcaaggcctgggtaagaaaagccttgaaaagcataaaaagaggccgggcgcggtggctcacgcctgtaatcccagcactttgggaggccgaggcgggcagatcatgaggtcgggagattgagaccatcctggctaacacggtgaaaccccgtctctactaaaaatacaaaaaattagccgggcgtggtggcgggtgcctgtagtcccagctactcgggaggctgaggcgggagaatagcgtgaacctggaaggcggagcttgcagtgagccgagatcgcgccactgcactccatccagcctgggtgacagagtgagactctgcctcaaaaaaaaaaaaaaaaaaaaagaaaagcacaaagagaggcaacaaggaatgtttttgtttttgagacaggctctcactctgtcacctaggctggagtgcagtggcataatcactgttcagtgcagcctcaagctcttgggctcaagctatcctcccatctcaacctctcaagtagctaggactacaagtgtgcaccaccaggctcactaatttttatattttttgtagacacagggtttcaccatgttgcccaggctggtctccaactcctgggctcaagtgatctgtccgcctcagcctcccaaactgctgggattacaggcataagccactgcactcagccttttatttgttttttaaaccacgtagctcattgccttctcttaagtaaatgatagatattctcactgaagccaaaggaataagttcatcaagaaaatgcccaaagccctggtggatacatcctccctatcttttttttaaaccttccactatcactctatgacactgaaaagaaccaggtaagccccaaacccagatgttccagccttatcctctgttgggtttacccacagacatagcaaaccctgtcagtgaggaaaattccccatccttgagtgcccccgtcctagaagtttgggccatattatggaacaggggtctcttatttgaaaagagcacaaggaggccaagattttaatggggcactttaggggatacagcccacaatggcatgggcctgaggtggccgtgatgtctgcttctaagcttaacgcatctgctcaggcacagaataaacgtctaggctggccaaaaaaggaactgaatcccaggcccatacgccagcaccagaatcaaaccagtcttcaaggaaggaaggctaggagagtttaacaagattttcactgggcccagcatggtggctcacacctgtaatcccaaggcagaatggtggcttgagctcaggagttcaagaccagcctgggcaacacagtgagaccctgtctctaaaaaatttaaaaataaacaaggtgttcaccaagctgggatacttctcactattaagcccctatctttctctttttttcattctcaattgctttgtgtgataaaaaactaaagagacttctggtccaatttctggcaacatcccttctgaaaggtgagtagagtgggtgtcttctatgcccattttccccaattttacacaaactattatcaatgaacttttaagtacctagaatgggtaaaaccagagcaagactttaaattaccttcttctttcttctactggcagttctgcctccatcactatcaggctagggtgaccttcccttggtcaagccccaattgcccatgatttgtgcctgtgccctttctccagtgaccatttggtgaccagatggtagatatagaaaggggatggcatttgcaagtgactagtctgccacaaaatgctcatctgattagccactgctgccctggcaatggctttgtaagagtcaatgagaactagagccaggctgtggtccctggccatcaacagtgttggtgacggcagggagtccctttggtttaataaatccagtttttctttgggtatccaaattctcccctccttttgtaggagtcaggctctcagaacctgtgtccatgttggaacttcccccagtgtggatgcagatacgcagctcctgagctccagcctaaagtcttctgtagcctcagcaatacttgggcacctgctgtctcactgaatagctttcttttgtgacaaaggccacagacagcccttagactattccggaaacagtaggaaaaattacatatgtctttgacttctttattctgactccactgattttagccataatactttaaggagctactttttactaccccttaccgtgctgacttctgcaggtctgccctgtgacctgtcaggaactcctgagttacgctactggggtcacctgttgctcccctagcaagttaggcatgtcatatatttttaacagctttattgagatataattcacatattacacaattcacctttaaaacatacgattcaatggttttcagcaaactcacagagttgtccgcccacttgagagcaaacacatgttcaattttcttttcctttttttttttgagacagagtcagctttgttgcccaggctggagtgcagtgccatgatcttggctcactgcagcctccccatcctgggttcaagtgatccttctgcttcagcctccccagtagctgggattacaagcatgcgccaccacgcctagctaatttttgtgtttttagtagagatggggtttcaccatgttggccaggctggtctcaaactcctggactcaagtgatccacccacctcggcctcccaaagtgctgggattacaggtgtaagccaccgtgcctggcctacatgttcaattttctatgaacaaaggctttagtccttgacccagggctaaagtggtctgtccaagctgttgttggtagagggagtatgataaaatgtttaaatctcatttggttaccttgagtcctggaacatgcagtaactgtcatgctatagacatcatctgtatttggctgggaatacaaatgaagattgtggtgtattcaagcagtagggtttttgcttttgtttttgttttagtgccaacaaaacttttttttgtctgactacattaaagataagactgactatatttatacaacagaaactttgtaatagattttttcagctttgtgaaatcgaattttttttcatcagggctggttggatttcctttttaccctgtaatccaagcgttaatagtttgttagaagatgggttattgcatgtcactttttttttttgtaaaataaaaacataccttacaa

SEQ ID NO: 1420 - DNA, 417243 bp, Homo sapiens
tggtttttgcaaatagtatactagaattcatcctgtaagtattaaattttataaatatccaaaatgcctgtattttgccaaaaagtaaagccaccctatttcaaattttttaatctcagtacctacttttaggtaagcccattgtaaccacaaagaaaatacatacagagcagtgttccccagcctttttagcaccaagggacagttttatggaagacaatttttctatggaccagggttggtgggggatggtttggggacaaaactgttccacctcagatcatcaggcattagttagagtctcataaggagcacacaacctagatcccttgcacacgcagttcacaatggggctcaagcttccatgagaatctaatgccgtcactgatctgacaagaggcggagctcaggcgggaatgctcactcgcccgcctcacctcctgctgcatggcctggttcctaacaggccacagactggtaccggtccatagcctgggagttgggaacccctgtatagagcacatacaaaagaaaaacagaaagaaaaaaaaacaggaaaggagaaatgggacaaaataaatacaagacaaacaaacaaacaaaaaaggttaacaaaatggcaatagtaagtcaataattaccttaaatgaaaatagactagactccccaatcaaaagacagagtgactgaatggatttgaaaacaacaacgacaaaagatccaattaaatactgtctacaggagactcactttaagtttaaagacacacataggctgaatgtgataggatgaacaaatgataatctatgcaaatggcaaccaaaagagagcaggagtggctatacttagaatagattttaagtcaaaaactgtcataagagacaaaaaaggacactatataataataatatcagcagaaggaaggctaattcaccaagatgtaacaattttatatgcacccagcatcagtacctctaaatatatgaagcaaacactgatggaactgaagaaagaaatacaatattagaagacttgcatatcccactaaatagcagatagacattcagacagacaaatcaataagaaactatagaccaagtggacctaacggacatacacagaacatcccacccaacagtgacagaattcacatccttctcaaacacacacagaacattctccaggatagatctcatgttacgtcacaaaacaagtttcaataaacctaagattaaaatcataccaggtatcttttctgatcacaatggaatgaaatcaaaaataaataacagaaagaaaactgaaacatttacaaatgtatgaaaattaaatgaaatactcttgaacaatgaataggtcaaataaataaatcaaaagggaaattagaaaatgtctcacgacaaataaaaatgaaaacacaacataccaaaatgaatgcaatacagcaaaagcaattttgaaagagaaatgtatagtaataaacagctgcataagaaaagaagaacgcaaatcaacaacctaacatacctcaagaaactagaaaaaggaaaacaaacttagcccaaagttagcagaaggaagaaataatgtagattagagcagaaataaacagagtaaaaaaaaaatagaaaaacttgaagaaatattttctaaaaagataaacaaaattgacaaactaaaaaaaaaagagaaaaaaactcaaataaataaaataaaaaatggaaaaggagacattacaacctgatggcttcaatgctgaattccaccaaaaatttaaagaacttatgctaatccttgtcaagatcttccaaaaaattaaagaaaaggggatactttcaaactcattttataaggccagcatttccctgacaccaaagccagacaagaatattacaagaaaagaatactacaggccaatatccctgctgaacatagatgcaaaattccttaataaaatactagcaaaccaaattcaacagcatatcaaaaagatcatacaccacaaccaggtaggaagaaggatgtttcaacataaataaatcaattaatgtgctgcactacattgccagaatgcctaggaataaacttaagaaggtgaaagacttgtatgctgaaaactatgaaacattgatgaaaaaaattaaagatgaaaataagtggaaagacgtcccacgtttatgacaggaaaacttaatatcattaaaatgtccatactacccaaaggaatttagagtttcaatgcaatccctatcaaaattccaataacattcttttttctttattttattttatttatttatttatttattttgagacagggtctcattatatcacccaggctggagtgcagtggtgcgatctcagctcactgcaacctccgcctcccgtgctcaggcgatcctcctgcctcagcctcacaagtaactggaactacaggtgcatgctaccaggcccagctaatttttttattgtttgtagagatgaggtctcactatattgcccaggctgatctcaaactcctgggctcaagtgatccacccaccttggccttccaaactgcgaaacttacaggcatgagccactgtgcccgccccagcattttttacagaaatagaaaaaacaattccaaaactcatatggaaacacaaaggatcccaaatagctaaaacaatcttgagaaaaagaacaaagctggaggcatcacacttcttgatttcaaaatatattctgaagcttcagtaattaaaacactaaggtactgtcataaagacagctttatagaccagtggaaagagggcccagaaataaacctgtgcatatatgaccaactgatcttcaatagagatgccaagaacagacaatggggagaggatgatttcttcaataaatagtgttggggcattgtatatccacatacaaaaagaacaaaattaaacccttactgtacaccatacataaaaatcaactcaaaattaattaaagacttaaacgtaagacctgaaactgtaaatccttagaagaaaacgtaggggaaaatcttcatgacattggtctttgcaatgatttcttggatatgacaccaaaagcacaaacaacaaaagcaaaaacagagcaagaggtatactatgtcaaactaaaaaacttctgtacagcaaaggaacaatcaatacagtgaaaaggcaacctgtagaatgagacaaaatatttgcaaaccacatatctgataaggcattaatttccaaaatatataaggaactcctccaacttaagagtaaaaaagcaaacaaactgatttttaaatgagtaaaaaatttgaatagacatttatccaaagaagatatacaactgggcaatagatacataaaaagattgttcaacatcactaatcatagggaaatgagaatgaaaaccataatgagatatctcacacctcttagggtggctattggtttttatttgagggggtttgtttgtttgtttgtttgtttgtttgtttgtttgttttgagacagaatcttgctctgtctcccaggctggatggctattgttttaaaaaaaaaagttacttggtgttattaaggctgtggagaaattggaacccttgtacattgttggtgaaaataaaaaatggtgcagctgtgtatatatatgtatggaaaactgtatagaatgttctcaaaaaaattaaaagtagagttgccatatgatttaataagtccacttctggccatttactcccccaaaattaaaattagaatcttaaagagatatatggaccccatgttcactgcagcaatattcacagtagccaagatgtggaaataacctaaatgtctatcaaaagatgaatggatacagaaaatatggtatatatgtatatatgaatggatacagaaaatgtgagatagatagatagatagatagatagatagatagatagatagatagatataacagaatatcattcagccttaagaaaaaggaagtcctggctgggcgtggtggctcacacctgtaatcccagcactttgggaggccaaggcaggcagatcacttgaggtcaggtgttcgggaccagcctgaccaacatggtaaaaccctgtctctactaaaatacaaaattaaccaggcatggtggtgggtgcctgtaatcccagctactggagaggctgaggtgggagaatcgattgaatccaggaggcagaggttgcagtgagccaagatcgcaccattgcactccagcctgggcaacagagtgagactctatctcaaaaaacaaaaagaaagaaaaagaaaaaggagtcctgccataagtgacaatatagatgaatcttgagaacattatgctaagtgaaataagtcaaccacagaaggcaaatactgcatgattccatttatgtgaggtatcaacaataatcaaactcatagaagcaaagagtagaatgctggttgccaggggctggcaagaggggaatacggggacttgctattcaatgggtataaagttttagtcatgcaagatgggtatacaacgtagtgcttacggttaacaatactgtacacttaaaaatttgagagagtagatctcatgttacctgttcatactacagttagagtattagtcctttttcacactgctgataaagatatacccaagactgggtaatttaaaaaagaaagaggtttaattgggcttacagttccaagtggcttgggaagcctcacagtcatggcagaaggcaaggaagagcaagtcaagtcttacttggatggcagcaggcaaagagagagaacttgtgcaggggaactcctccttttaataccatcaaatctcattagacttattcactatcatgagaacagcatgggaaagacctgcccccatgattgaattactgcccaccaagtccctcccacaacatatgggaattcaagatgagatgtgggtggggacacagcaaaaccagatcaaatagaaatagaaatcaaaatagacaaacaaaaaactagaaagaatctgagagcctatacttcaaggtgttttacctaagagatctgaggaaattacaaacatgatcaccagcactgaaatcttgaacttggatcaaagtaaccctacataaccacaaaatgacagggatataagtctcagagactttaaatgaatataacaggttcttgtagataactcatatacagagatccaaaaatgaaaaacttgttttacatcctattcacaatatgtgtagtacccttttcccaaatacttgactgataaaaatacatacagatttttaacttatccagtctattacagtttatttgccaactcttagttccctcttgtgctacgtttaaatttataagatgagtacagagactttttgaataactaatttaattaatgaattttaaagttaacttttgtagagttttagatacgtcctttggtcatacagtttagaaattacattgaaaagtaatctaatgcaaagttttttgtttttttttttaatttaaaaggtttgagtaaatctttctttctttttttttgaggtggagtctcattctgtcgccaggctgcagtgcagtggtgcgatctcggctcactgcaatctgtgcctcccggggtcaagcgactctcctgcctcagcctccagagtagctgggattacaggcacacgtcaccacacctggctaatttttgcatttttagtagagacggggtttcaccatgttggccagaatggtcttgatctcttgacctcatgatctgcccgcctcagcctcccgaagtgctgggattacaggcgtgagccactgcgcccagccgagtaaatctttctttaaaaattactgaagctgagtttaatatactgtatttatttgcatcaactcaaaattgaattttatgccacctttttggtcagttgtgaattgaaattttataactgaaattgtttacaagattatgttaaagtagggctgagagaatgaattttaaagtatgattcaaggttatagattaaattatgttcttatatattttagtcactttttgaactattacaaatatctagtaaattttttaatgctctgcccctttaattctggtcatgtaatttaggactgaaaggtgagctttatcttggaacaatattatctttcatttatatgatagcaaaaaaattaactatactgcctttattcaaaagtgcttaaaaacaactatatgtttactctctccacttcattattttcttcctcagtgcaaatatgtttatctggaaataatgtatgcattgtagcatgcagaatgtcaagctattttaagagatgcaacataatgcttgctataaactcttatattcagtcctcatttcataaaactctcatgtttaacttgaacatgctttcatgtaaaagctcaacttaaaagtgtgcctgtttggatgataagaaaaaaaagcaaacaaataaaataactacacctatcttgtactctttaaaatatatatgttggtttttaaaaataattgcactaagctaaacatgagaacctctatattagcaacttacattaaaagcaagtcttttttgggaaagcaaaataaaattaaaagacacatgattttagatcactgatctgagtacacagatctaatctctttgccagggttgtgtatactgtacacgacatttattttatttttttttttttgcactcacttattttgatccagtggatcttgacctattatcaagagtgagtgaatattgctagaagtggtcacttcagtatgacttaatctgaagacagagaaaaactggttataaaagaggaaatatattagaaaggagagtatttttgtatctagcaacctggaatatgaatgtaaaagagaataaacagttcaacacagaatgataaagggtgccattgagagggtcttctggagttggttttgcttcattcaactatgaaatgactacatgtattcatttatccctcccctccctcattttgagggtataataaatgtgtttctcctttttctcctctttcttcaactctatctccttgaaagagaataaacaactaaaaacaatgctgcacccccactcaccttgataagcagcatgagtctattaaattaagcatgcttgacactcaaacaccaattttagggacagagtgctcaaaatagaaagcacaatggtgacatcctgttaccgtctctttgtgcccttggactcataaataaagttctgcaggtttctgtgctcccttgatacaaaataaagaaaagtgaatgagttagaacaagctctggcagccatcagtaatgttgcaccccattgctgcaggacaggagacatccaattatggagcaaggtcagcctcagtctctaccagtattttctctggtggtcaagagaccctcaccccctcaccaccaccaccaccaccaccacgattcccttctacctgatggtgctccgggactttatttttggatccttcactgcttgacttaagaggaggaagacatgataggccagtcagtcttggctgggttgtgggaaaagtgagaggacagaaccagattggtcagtttgtgaatcttgtgatcagctacttttagaatttatttgttgttaagtttgaccaacaaatttccatatccttcatgttttctcacaaagatctttaaattgcctttcccagcttcccacctaaatacattcaaccatcataacacattccaaaatacagtggttgcccatggtttgcccaatactgggcaataggcactcagatcccagttagtgaccaatatacctatgggacacaaatcatatcaatgaggcacagctgcagggtgcatgtctactaaggatactgctcatctgaaccctcagactatacattctggtaccttagttctgtctcttggtgccctttcctgcgggtaacccacattcttattctctctccatgcggcatgggcactctctctcctgcctgagtcatagttcctggagcagactccacccccatgtttcagatcctgcctgagtccactgaatgaaagcaacaactcctgcgtgtcactcacaattccctggatgatactaaaaagcaatctttctctcattttcgaaacccctttgagatattaatgacttcctagatttttttcaggacttagagattatttcagaaataatcatataataagaagcattttgaattggagactcaaattgctctttagatcatactatataatcttaatgatgatgacgatgataatagtagctaccattgaacaaatgcctactatgctaggtgccttctatcttaaccatggttaattctcaggggcagtcctcaaaagttaggatattgttcctatttctcaggtgggggaaatgactttcagcaggagtaactatttttattcatcttatagctttaaattggcagctagattttgaccccatgtctgactcgaatttcattttatttccacaacaccattcactgcgtagagataagaactgtgagctggtctaataattttttcttcctgcaatagaagtccttttctaaaatttgggtcaactctcagcactcgtaaaaatatgcatataaaaagggaaagaaatggaggaaaatattttcccattaaatactaagacctactatacactaagctacagtatttaaagcacacaatactaggaccaattggatggattatgataaagagactagacactgacccatacataaaagaacttggaatattatagaggaaacacgaagaattaatgaaaaaaggaaaataaatgatgttgcattaattgaatttcaatatttgaaaaagtaaaatagctttccctcctgaaacaaacaaaaaattcagggagatattggatctcaatgaaaagaacatttaaatatattaaaaaacaaaactttaaatatattacaggaatatgaagataatacctttatgatatctgggtaacaaaaggcaaaccacgtaaattaagtaaagcaggattttttttaagtaactaaactggtacaatttataaagtacacatactcctttgaaaaagtaggtctcatgtgaatctgctcaaattccagggctgtattcactttcaccaaacactaatgacctgaggctattgtatttttctagttttcctgttaaaaagagacatgagagtgttgactctcaggtgtgagatcttgactgatcccacacctagcccaactggaggcttaaggctactcatcacagagtccttctggagccaagataaatgcctatgaatctcaacttttattcacagctttcaatattagattttttaatattagattttaatatttttcaatattagatttcatcatttcctgtgcccatttccctagctcaagggttcacttatctttgataagtttattggctagatgtatgtacgatgactcactctccatcacataaaacatacaattttgacagttgataaaaagatgttcgcataaactataatcatataattaaatatgtaccagaaacctaaaaaatagggaagagggaagctgatagtattttactcacatttaactaaaaagccatacattttaaatctatgaggtaagaagaaaaatcaggaaatctgcctgaacccattagtgactattcatgtaggatttttttttttaattttattttttttgagacaggctgtggcccaggctggagtgcagtggcacgatctcagctcactgcaacctctgcctcccgggttcaagcgattcttctgcctcagcctcctgagtagctgggattagaggcacctgccaccacacctggctaatttttgtatttttagtagagatggggtttcaccatgttggccaagctggtctcgaattcctgaccttgtgacccacccatctctgcctcccaaagtgctgggattacaggcgtgagccaccacgcctggcctcatgtagaattttatggtcacaagcctgtagttctagcagggaaactcaacacataaaaaggaggcctttaaatgcattgtcaagaatgacgaaaggagctaagtatcattatattctgatcaaaagaaaaggcaagtgtccatttccaatctctctttctctctctctctctctcacacacacaccccccagcagatttgtaaagaaaggtaaataaatcccccatacaaaaagtttccttttttccccacttgggtctgagagttgttcagtttaacctgagttgccattagtgtccttcgaagctataaattttgcttttccatgcaattgtttcaaaacaaagaaaatctgtgactttaaaattactttagagccaagcatggtggcgggtgcctggggtcacagctactttggacactgaggcaggagcattgttttgagcccaggagttctgcgtggtagtgcactgtgctgatagggtagtcgcactaagtttggcgtcaatatggttaattcctgggagcgggaatcatcagtttgcctaaggaggggtgaaccaagccaagtgagaaacggagcaggtcaaaatttccattctgatcggcagtgggttccacctgtgaatagccactgcactccagtctggataccatagcaagaccctgtctctttaaaaaaaaaaaaaaaaaaaaatggctttagaagcaattttacaccctaacttaccaatataggtagcggtccgactttatcgccacaggaggaaaaaataaaaagcagagtaaaacttacagagcaatggtagatacaatacgatcaatacaatcttcaaacccaacttcactgagcatgagtttctacacataaaagagattctttcattatttcttttttaattatttatttatttatttatttttgagacacagtctaactctgatgccctggctttgagtgcagtggcgtgaacacaactctctgcagccttaaccttctgggctcaagggattctcccacctcagcctcctgagtagctgggaccacagacaagcgccatcacacctggctaattttttaaattttatgtagagacaagatctccctgttgcccaggatggttggtctagaattcctgggctcaagcgatcctcccacctcgggcaccaaaagtgctggaattacaaggcataagccatcataaccggtccaagaaaatcttttagaaaaccccatcaaacaaatcaccatactatttaactgtaagtccaaacaatagtttcaatcgtaatatttgaagcaactagtataaaaagagaaactcataagctagcttacatttctgttgtcaaagagtaatttatccttgctggagttggtttggaggtattaatagccggaattatcccaacaatattctggcaagaaactatacacgtactttctgatgtgctctgatgtggccacagtctggcgctgagagtagctccaacatgagggactgaagcaaaagggtttcccaaagaagcactgtgccccggagactggaaggagaatttgaggaagacattaggatgaggcatctcaggggtgtaagagagagaccctggaaggcatttggggccatgacttaattataagctaggaattgcgtgtgtagaatttacaaagtaaacaaaatggcagccgagggtggggatagttcacacccttagtaaaggctcgacattatagaatctgcctcatactaggattcccagtagcttttctggaaataggtctccttcctctcctgccagccctaaaataatattggtaacacacacaccaacttctagagagcactcacaaaaaaagttgtcaccgccaagtgacctcactgcttctccctggagagctttgcagacagaaaatagctctgtgtctttataaacaaatcactctgtgaatggcagtgggtacacaaacatgtcgattctcttccagagttcttactcgctcaattgccaggtttgcttctattttggttacagaattaaaatgtaattagttgtgtttttaatgagtccaaatgtgacacattaagattcagtaattactctaaaatgataagctgtgattgaatgtccccataaacaagggacatttaaaggcagtaccatttcttgctcagttgttactgcttttaaaaccgtcactctttcctgggtgaatacagttttaggatttaaatgattacgctggattattgcacatatttacagtcagagccagctataccgacatatttaaagtgtgtacgttctttgatcatgtggccatgtctacctaagaacctaataactgactttactgaatgttggctgtccaggttagtacctcattatgacttactggcttttaagacacgtttattttatgtggcatcagtttttctcttcaacctgatgcaagacctcactgctatttctgaggttctttatgtccttagtgtttggcagggctcacatcaggtctagaaaagtggtgctagaggttcaagatccaatacaacaatggcagcagtaattgatgcacttgccccatacggaaatctgatctcttaacccacctgtttcctaggctaactgaatcagcagcatgtcagtagctgccaatgctgatcaatttcctagtgacattggtaacttaaaaaacattgaaatagttaagttcgttgtagaagtaagcctttcatcctacagcaaatcaaaaacaaacaaaatggataaatgttttctgataacttttaaaacagtttacctaagaggaggaattgtaaaaacttaaacataaattgagatcatcccacctgattttttaatattcgtaggaagcctgttcatgatattccagtcaactactctagaatcctattttggtatctcagtatctcgtgcagcagtgaatagcactgctcaatattttagaggcttcatatttccttagagtcacaattgtcaccctaaaatttagatctaataatcctactactgtcctgtgtaggaaaaaatacagaaagcatatacttcttatttcccagccttcaagtatgtgaagactgctatcaagaccactgtgtcttactggccaggcgcagtggctcacgcccgtaatcccagcactttgggaggccgaggtgggcggatcacgaggtcaggagatcgagaccatcctggctaacacggtgaaaccccatttctactaaaaataaaaaaacttatctgggtgtggtggcgggtgcctgtagtcccagctactcgggaggctgaggcaggagaatggcatgaacccgggaggcggagcttgcagtgagctgagatcaggccactgcacaccagcctgggcgacaaagcgagactccatctcaaaaaaaaaaaaatccccgcttccaacagcagttctcctggaaccctaccttcccctgaattttgtcatatttatcaatgcctttcttatggcaaccagaagtatatagagcagttcagttcacaaagggctgtaaatacagtaggacaatacctatctcactttactttggacaaccagatgcttcaaaacttgctgatggtagattaacttttcatgtaactttatttattttactgttggcacacacggcatttttgtgtaaagttttctaatgatttttacatgaaatgatgtccagttataaatctctattctataccttgaatttaaaccaacaatttttttcacttaatcctattgtattatgtggtgttgtttttattattctaatctatttaaagcatattaatctcactctgaaagctgtataaaaacctctaaatctgggccgggcgaagtcgctcacgcttgtaaatcccagtactttgggaagctgaggtgggcagatcactagaggccaggagttcaagaccagcctggccaacatggtgaagccccgtctctactaaaaatagaaacattatctgggcgtggtggcacaggcttgtaatcccaactacttgggaggctgagccaggagaatcgcccaggagacagaggttgcagtgagctgagataatgtcactcactgcactccagcctgagcaacaaagtgagaccccgtctcaaaaaaaaaaaaaaaaaaaaaaaaaaaaaaaagcctctaagtttggttcatctgaaaatttcatgagtctgcttactcttacaagtccttgctcataatattgaacaaaaatcaccaagaatagacatgtgacacatacaccaacagaagtctctccccagcagttcaataagtggaaggtactctagctagcatctccatcgttcaactgtaccccagtatatcaacaaacacattatgagtggttcaaatgaatgcttttctgaaatgatgccatcctcaatggggaagtttcccagtctatcaatctccatgcagcataatttgtagaagtcctacctttcatttctagatgctaatcgatcttctattcaatggaagatctagcctactggtgtctcattttttattcttcctacaatttagaaaatcagatcagcataagaactttatttttaacaaatattaatataaaagtattacgtgtttttctactgcccatatctgttctgtccaagccatgtacattcatgttaaataaataccgtcttttaaaacataaatagcatggttactccacattgactcctgatgtcccaagatgttcaagatgcagtaaggagaaatattattttaaaacaattcaaagggagtgaaaatggtagcacacaaaggaggcagcatttcctgcttctcacaagaccatctgcctgtattgtgggcaagattttttaaaaatcctaactgaaaagaaaataatgttaagagacatatgcccatgtttacaagctgagggaaattgacaagtgtgtctgtttcgccagtatttttacagtcaactgttatacataatggggaaaattaaaatcggtaattacttttctagtctgccattgttttaaatgtgcttggaattttccttaagcatccattccaagtaattatttgtaataggccagaacacttaaagggttgtagggatggatacacagctattttacaaagtgaaatactttgacaataacaaattatttttcctcctttctctccccaatgttggctgagttatgtttatacctcactttgtagataatccttctagctacactttttttaggcacagccattataaaaatcttctgtttgggcttggcactgcttagaactagaaattgctatttgctgcctgccaattacagaataatttaaggtttgatgctcccaggcacagtttcttgaaatacacagaaaaaaatatattaaggtggatgcataatattttttctgcattgcatagcttcaattgcctgtatagaattatatccaaattgctaaacaaatcaattggagaaaaattatgtcttctaggaaagtgttttgtaatggttttactactctttcttttgataagatcatagcaaatattttacaaaaattttatattatttgcaactgaatgatttcaatctatgaaatgtgatgggtataaatattgatataattttaacataaaatttaaacttctaggaaataatagaggaagatgtgatttttttaaaatcaatttggaataattaagaagaaaagaaaaaagagagttaattaagtttcccggatcttttcaagtctaaaatgcaataatttttcatctttgtatattcgtatctgaattatccatcatttgcagtacgaagcaggaaagcggtaaagcaaagtaaatttgtgatttaaaaggatcaagtatatggttgaagactcaaaaagctttttatttgggacagtagaaggaaatgtgctgattatcatgagaacaacaaaaaagagaaatgagttatttatgtaaccctgtcatcatgcctacaacacctcgaagggcagtcaggcatagtctgttatcaggaaaagcaagcaaacaaaagcctttatatatatatatatataactaatcacaaacatgctcagactccagaagatggtaaaataaaataaaataaaataattttattgacttctttcacctaggtgccttggttgcactccctggaaaccattcttcgcattccccacttacttctcttttcttttctttttttttctttttcttttttttttttttttgagacagagtcttactctgtcgccccaggctggagtgcggtggtgccatctcggctcatggcaacctccgcctcccaggttcaagctattctcctgcctcagcctcctaagtagctgggattacagatgcgcgccaccatgctcggctgatttttgtatttttagtagagatggggtttcaccatgttggtcaggctggtctccccacttttcttaattcacccctgaaatacactacccaaacacgtagcaactgaggtctggaaacttcattcttgacttcttctaaggaaggccactttcttcaaaatacagcaagacaaacacatctagctcctagcatgacttcagtgtgaaaaggctgggcttgggagagcagcaggtagacatgcctattaacattgtgctgccatgtttactttttttttgtttacttaaatcatggacagaaagccaagtgtataagtgaaaacccaagggacaatgacatggggtagactgcagaccaagaataagcaggaagttaaataccaagatattcccccaaaataaaccagatagcttggtttatatggaagaaaataaaccagagtaccactaacataagcatgacagaaggttttacacaaaactttagcagaagtgggtccaaatttcagctagtttcaggaatagttggtcgaggatggttctccaaagagggtggaattgtgctgttgatcagctgccctcacatgagcgatttgcattttcttggcgagaaatagtcgctgaagtcaagcagaagagtacgtgagaaggaatagctgtgagaccaggacaagccaaggccacagtgggatattctcagtccgtctgggtctctagatttacaaagaagcatgttgaatctgtagaggcaaatgggaagctcccccttcaccctctaaaggttagctgaaaatgagtaaatgacaagagggggattaataggaggaaaggacatagagaaggtaattaacatgcttagggacaggggaatcacaggaggagaatgacccaataatccagtgaggtcctgacacttatttgtatacccttcttcacagggacagggttgatgaggagtgtagggataaatgacttacaggggaaatgaataagcccaaagcacggtggtctgggacaaagttcctctgagctctaggacaggtggagggaaggtgagtggttgagcttcactgtaatcaaaggttatcttattatgcagataaagcctcccaggtaatctcttggagctgtcttgagaagaatagatgaaaagtctttctgggtgcagtggagactcccagtgtctcctcttctccagtggttaatctttcctggttgtttgatgagattcctagggaggaggtcttaagacaattgcatttccttttaaagggttttcctagtcagataaggaaattccggttctggtacagtggctcacacctgtaatcccagcactttgggaggctgaggcgggaggattgcttgagcccaggagttcaagaccaccctggccaacatagggagaccctgtctctacaaaaaaaaaaaaaaaaaaaaaaaattagttgggcattgtagtgcatgcctgtggtcccaggttctcaggaggctgaggtgggaagaattgcttaagccagggaggtagagaggctgcagtgagctatgatcgctcaactgcactccagcctgggtgacagagaaagaccctgtctctaaaaaaacaaaaaataaaattccagcaagagtagctcccaatgcttcaggaaagaaaagagatcagagtggggcttgggagggaacactggagagaccttggttctgaggcttatttctgatgcctttaatttcctttaattcaaagcatgccaaagagccatatttttggaggagtattttctgagccccaagaactcctcacaatgcaaaatggatgcctggctttcatttttttaaaatgatttatttaccttaaaaataaacttggattcatttgatcttcataatccctgtagataatttaggcttccaaaggaaacatggtctctattggcctaattaccaataaccaagttaaattccatttctgtacagaatttttttaaaatttacctcacaatctagaaagaggagaaaaaaataccttaaaaattaattattttcaaagccatgtatatgcagatttggtcatggcttattcagaacacattagaattattttaaattctaagtatcctcaatggtgaacttaaaatttcattctagggggaggggggcatggttaatgagtagaaaaaaatagaaagaatgaataagacctactatttgatagcacaacagagtgactatagtcaataatgactgaattgtacattttaagataactgaaagagtgtgattggattgtttgtaacacaaaggataaatacttgaggggatggattccccattctccatgatgtgcttatttcacattgcatgcctgcatcaaaacatctcatgtacccccataagtatatatacctattgtatacccagaaaattattttaataaaataaaaataaaataaatgaaataaaattttattctagccattccaggaaaaaaaaaaagccccattttgcaaagatgattataaccatatatatcatatgattatcaccttgttttcatacacacaagcatatatgtatgtatatatacatatatatttacacacacacacacatatacacacacacacatatatatatgtgtgtgtgtgtatatatatacagttgacccttggacaatgcaggggttagggctatgtcctgcacagtcaaaaatctgcatataacattggactccccaaaattttaaccactaatagcctaccgttgactggaaaccttacccataacataaacaatcgactaccacatattttgtatgttatgtatattatatattgtaatcttacagtaagctacacaaaagaaaatgttattaagaaaatcataatggccaagcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaagaggcggaggttgcagtgagccgagaagaaccattgcactccagcctgggcaataagagcgaaactccgtctaaaaaaaaagaaaagaaaaaagaaagaaaatcataatgaaaagaaaaatatatttactagtcattaagtagaaatggatcatcatgaaagtcttcatccttcctgtcttcacaatgagtaggctgaggaagaagagacgaggttggtcttgctgtcccaggggtgaaagaggcagaagaaaatccatgtataagtggactcacacagttcaaacctgtgttgttcaaggatcaactgtgtgtatatatatatatatatattttttttttttaggtttattgcaggaacaaaatcctctctccaaagctataatcctgactggctcaagatgtcttaagaaacttagaaacacagctaggaataaattacagcccaggctagttggttgttctcccggaatgagcgaattcaaaaggaacctggttatttagcaagaaatagactcagtgacctcagcagcattctaatgcatggaaaggtcagagaggtttcgtaccactctgctgggtcagatggaagccagagaagctgttggggtctccttgaaggttgaccctgggctgcaggtcaggaaacccaagtaggattccaggaatggattgctaagaagcttcgaggagaatggcttccacccatgactgagaattgaattgaggtccaggtagaatgggtagtacctggtcacagcccataagaaataagaagaggctatgatttgaattggtattaataacaaagaagaaaagcagcatttacttcgggcacaaggccagccagcctgctctcagaagctaaatgcaagtgacattttcttgtcaaatcccaacttttacccatcaaaggcttggggagaaagggaatccattgcaatgagttggttctgtagatagccctgcagaatcctggggggtgtttcacacgccagagaccaggatgggttgcggaaagcagttaactaccaagtatagtaagggaggcacagtaactcacctggaattgactttgcaagctgaagactgttttcaactgtgactgtgccattaggattaatgcaattcatacagttggctagcacatcagataaatatgatgaattgtccttatatccttagtccagtgagaactggcttttccatcacagcttaagctatacacatagagaggcaaaaaaaaaaaaaaaaaaaaaaaaaaaaagaccttacagttttgtttattgtgcttatcacaagtgctggaaactcacattttcattgctaatagccctctttgaaagtttgttgacatttcagctgatctttaatgtgctctactgttataatacccttgggcaaagtcagtttccaataggaaaatagacagcttctgggtacccctgtggaagctgcacaaacacaaacagactggcaccccagcctgcaatacctggtgagctctgctctgtccgaatcacagaagggtggcagaatatataacctcaaagcatgccactttggcataaggattatgttgaagtaaaggctcttgaaaaatagcagatacaagaagagcactttgaccttcctttttcttcctaaaagcaggagataaatctccaggggaaagttgttgtccctgtattgggaggaagaaacattcttatcaccagagatagggagtgaaggtcaagagaaatccgtaccaaaaaactttgttaaattaaccttatctgtctcttcacttttctacaattaactgctctggcccaagcctctttgtcttgccatgttttcacaaggtgctcctcttcatccaacttaggatataagcatctgactctaactgcttctttgggtcttcattttcctatgtgaattcccatgtccatttaaaatctgtatactcctatcttggtaattatctgatagcgatttaattctcaggcccagccgaggactctcagagggcagagagaaagttgtgccttccaggatcactgtatttgggagcctggaagacgaagaatggagcccagtaaatagagagggaaggaaagacatttaaacaggttcctaaagagaatgtgaggacacgtaagaacaacagtaagaaaaagtacagaaagaaaaatttacaatctattctacagagcaaattgaggtatttcttctgtaatagggaaagaggaaagagaagattcatgactgaccatcagtaggctttatagtggagagagaattgtccaaacctccgtataatcaagcacatatcctgattcttagaatatatgttccaaactaaattaagaaagggtgatgctggacagaagcagttattaattctggggtcaacaggataaaaatagtcagaaatgaacgttgtggtttgggaatataagcagctgaattcaaaataagaattctaatagaaagtgttaaatcaaagagcagttcataaagtcagagctagaccttgggtggggggaagagcaattcaaaaatttagagcagcatgtatcttaaaaataaattttattgaaaaatgagaacacatggacacagggaggggaacaacatacaaggggggcctgtccgggggtagagggcaaagagaggaagagcattaggacaaatacctaatgcatgcggggcttaaaacctagatgatgggttgataggtgcagcaaaccaccatggcacatgtatagctatataacaaacctgcacattctgcacatgtatcccggaacttaaagtaaaattaattaaataaaaaaaaatgaaaatgaaaataaatgttgttatgagaactcatagtggcatggccccaattttagaaactgagcttaatacagttaataggtaaatgttagatgaatacctcaaactgaatgttaatgccaaaattaagatcattctttggttcaaaatatagagcatgtttatatcttaattaaaagcagtcatacttaaatctctccttttcggccaggcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaggaggcagaggttgtagtgagccaaggccacgccattgcactccaggcagggcgagaagagtgaaactctgtctcaaataataataacaataataaaataaatctctccttttcattatttatagaaaatcatagtattttggcacattaaattgaacatatttctttaagtaattaaatgtacgcctatcataatgtattcctcctggtacttaactatcatagattattagcagtttagtgtttaaagggaactcaggactgagagttttaaaaacttagactcacagtaagaaagtcatctcatgttgatgaagtataaatatgcacatacacacacagacacgtcacatgcaggtacataactaaaatgaaagcttcctgaaataatacttatttacactttgtacagaatcgaatgcactttatttcctagtctttgcattttaaaaatatacttattttttttaatgctgctcctggttccccaaattgaaattactatctaccaatgtatctcaatttacagtttggaaaacactgccttagggaatagctagtctaattttgcacctgagaaacgtagagatttagggaatattcccaaggtcacgtagtatgtggcaaagcaagcctgtgctgtcttctaagttctggcgtaatgagttttccccaatcttacattgttacattgttttcaagatgaatggtcatgtatagtgtactctttgcctctcaaatttgatgaagtaagcattattccgttgctacgtgtcttgctcactttgcgttttcttagtttcataggaagcatcagttgtgctaagttttatttgtgtgttccattgtctcttccccctaaactgaaagcttcctgagaatagtgtgtattcttatcaatatcccctaaaccaagctgagtagtgtgaatgattgaatccttagaaagacaagctcatgtagtcaaatagtctaaattacatgagtgggacaaaaatatcagcatccaggtagccacagatgctcttctttccttctaagaaatacgattctcattccatacctagatgatgggttgataaggtgcagcagaccaccatggcacacgttcacctatgtcacaaacctgcatgtcctgcacatgtatcctgaaactttaaattttaaaaaaggaaatatcaattctattggttatgctgattagagtaataagtggagagggaattgagaagttctaagacaagctgtgttagtatcctagggctgcagcaacaaagtaccataaacagagtagcctaaagcaacaaaaatttactctctcaaggttctagaggccagaagcctgaaatcaaggtatcagcagggccatgatctctctcgtagcttctggtggttgccggaaacccttggtgttcttggcttgtagacacatcgctccaacctcagcctctcttgtcacgtggcattctctctgtgttttctgtgtccaaatttcccccttcctattaggacactagccattggattagggcccatcttaatcaagtatgacttgattacatctgcaaaggtcatatcgagaagtaccaggggttagaacttgaaaatatctttttggaagacacagttctacccaccacagaagctacaccaatttacatgaaaaagaacctaagtagatctagaagagttggagagagaaatgggatagaagggagatgagcaggaagacatgaaagcaaacaaatgagttatcttcaggggagaaaagtgcttgtccagtgtactatggagagacgcataaatgaagatgactttaatacattctgctttgcatcatgcaacataactttttttcttttggtgcctctcacagagacctctgtaaatcctaaattatcttttaagactttgttcaagtcagattttttagagttatttcagatgttatgttattgcaggaagcagctcacaagtgacctagcattaaagataataaaagctaatgtttttatgtgagtagaagatatagcattgcatttaaactatagtttcaccattatacagaaggaaaagaagacagcaagcagaagagacaataatgatatattgaccttactgaaagatgatgacataaagcagtaggatttatcattttttgtaagttactgaacattgattcagtgttatgcatcttgttcttctatatattaagcaattatgtttatttctagcactgaaaagcatagttattttcagccaataattgctatttgaatgctatagttaatgtttttataatttttagatgacaattttattttaattaactctcttagaaacaatcatttatttatttgctcagcaatatgtgttcagtatccaaagtgtgttagacacaattcagtatatccgtcccctatatcgagagtctagttagagtgagttaacaaaagcttttattcatgggaatttatagtataaaagtgtacaatagtataaaaaggctgaaagatttctatagtgatttcactatgaagagatctctctgatatttttcttccctttcaccttatccagtctccaacgtttctgtaaaaaacagctacacccacttttttcttcctgtcaggtgaatccagatagtgcagcaaagttgagccaccgacactgaatttcccaccacaagtgaaacagcagaaaaggctttccaagttcactgtagggaaaataaaagccatgtgatatttattgcacatccaagtatatggattaagattaattcctctggagcaataatgatcacactttttaaatcttacaactcgttgatagtcatcaaaattgaagatccaaaaagcttttatttttatgagttttacatatcagaatttcatgtattagaaattaaaactgacaaactttaaatatttattttaagacaaatgatatactttaaatattaatttaagacaacattaaaaaccctctacttattagcataacatgcttttattttttaaaaaaactacattattccaaaacaaaaaaagattaatgagaagagtagtgttgttccattacacacccatgagtgaatgagagtgaaaaaggaaattgatgtcttaatattattatgaaaattatttggtccaatagttaatggatcccctgaaaggtattcagaacccccagttgtctcctggccacatttagagaatttcagccctagaatgttctgatatgtagtggaggaaattgattctatagtacagaatcagagggcaactcactggcctgctccccacctcagctatcatatgatgcacagtccctgaccaagtggatcggaaatgtctcctgttgtaggtcaaggtatccctgagaaccacaaactgagatatggacaaaagagcaaaagcgccgtgcacatatcttgagatgcaggttaaagaacaaaacaagaatgcatgtattttatctcaggacactaagtctccaaagaatggcttgtgatgggggtacagacttgacccaagaattactgactataatcaaaccacagtttaacagaggtgctatttatagtgaaaaattttcccccaagcaagaattccatagtaaagtaagatcacagttgcacactgcaaatctttaaaagaaaattccagaatttatagcttacttagcctacttagctacttgctttgctcatatataccagttctttcaactaccacaaaaataataactatttgaatatactcaataaacaggcattgtgaaatttgaattttacaacatagaatttggttactgttcctgttaaaacacaaaatacatgagtgaatatttatgtgtatatttttcaataatgttttccaaatgacctttggagaatatctcaagatgattatttctttggcagggggcaaaaaaaaaaaaaagctatcagtgagataagcacatcaatcgaactgttttcatttgagccatgtttaaatgagctaggatgcaaaatagaaattctggaaatatccaaaagaaagatgtacatgtcctctgatttctcctaagtctggacagaattggcagcagaggctctaatgaaatcttgcaattagtctgagaagcccattcagagagcttcactgtgttcagccttctgccgctgacacccttgcctgaagacacatgcccatatcgaagcacatgcagatgcctttcctcatacctagaccctgaaatgaccatggaccgcaggattctcatgtgagatttcagtttactgcttaatttttcatcttgattggacttttcatccatcatatcaggaaaagctgaatatacagacccagacatagataggtttggggacaggaagaagatttaattctacttagattgatcccattttttcttttcttttctagaaatgagtgagatcatttgctgatcctgaggtgtggagggaaaaagtcttggctagaggtgtaagagaatgtgtggaagatggaattgactaaagaaagtgatagggttgtcctgcaggtctgaggacccaggtgatattcatggtctccatgtaacgcataactggtcagcaccttttgtttgcttgtttttctccaagttttactgcttagatgcggtaaaataacatctggcattcccagagttggttttccaagtaatgtcacttactgaggcaggaaggagaaaaggtgtttgaggtttgaagagacaggggaaaaagtctgttaagagaaaaggagtgaaagtgaccagaaataagttagtaggattgacaggaactaaatgggttagcatgggttagcagagaatgagatgtaaactctgttggggttttgctgacaaatacgatggagagagctgaagttgtttgtttgtttgtttgtttctcaaagatgtgataattacagtgaaccttggaatctaaactaatgaagaaaaggagtgaggacaagagagtgaaaaagtgatagtcaatgaattgaaggtcccaggagaagaaatactgtatttgagaaccagagtaaatgaaatggaaaattaaaggcagtggtcagaagtcagcataactagaataaaagtttgaaaagataatgactaagtcaagggtatcaccaggggagtaggtggctgaagtgcaatcggatgaaaaaacagtgggaaacgagatgctcaaagaaatgggaggttcgtaggtcactgtggtccagaattgcaatgattatgtattcagttccggttaaccaagaaattaagcattttgcaattctaaaatcatcagttgatatactaaaattaaagtctaaaatgccatgaacattatgttagatacatatatattaaatggaaatcaaattgtatacgtaaaaaaagatataaagaagaaatatagggctagacatagtgtcttatgcctataatctcagcactttgggaagccgaggtgggaggattgcttgaactcaggagttggagaccagtctggacaacatgaggagactctgtctctaaaagaaaattaaaaattagccaggtgtggtgtcatgcacctgtggtcccagctgcttggaaggctgagatggaaggattgcttgagccttggaggttgaggctgcagtgacagatgtttgcaccactgtactttagcctaagtgatagagtgagactgtctcaaataaataaaccaataggacatattaataaatactgtgatcttaagcaaagacgctttaactttctagagcttagttttctcatctgtatcacgagtaatttgaattaaattatctagaagttaattctttgcctgaaatggtttgtttcctttatccaatattactcattgattataatgatcaccaaaaaatgaatacttacgtgaatactagagaaaaaatattgcttaattttgaaaatacaaattgcttatttgtagaagctattttggttttatttgtatgtttatttaaagtttgcgagggaaccagggttatcaggatcactctgatctgaaatctgagatttgggtaatctcacttctatccaaaaatctctaggacatcaagctcatcaaggtcttcagatgctcatgatgcattaattgccctttgagaataactgcctaagagatggatgtttatattgattttatggtagatattttcttcttcatgggagtggaattccttttacaggttgattcacaaacctagagccaaaaatataactgaactattacagatttaaagtatagattgcataattttgtaaaaatattatcatacaaattctaacatatcgtgagctgaattatactaccacaactaaaactcaattacttataggagtcagacgtatattctaataagacagacactgaaattgctatttttgtctgctggccaaattaactcccaactcatcagtttgcctcccattccctaaagccttgtgcatatgaattacctggcactattgctaaatacagatttttttgcagtaagtgtagggtggaatctgtaattccacatttctaacaaggtcccaggtgtgtcagtgcaacacatctaaggaccacactgaacataactctatacaaaaaggctccactttttattaaactgtgattctgaaaacccaagtagaaatcaggtttttaaaaacttatcattcctttctttggctgttgagacttgtatttctccatgccatatcagacaaattgcatttacctggttccctctgaattagcaatcttaggaacttcagctactctcagattctattccgttatttcagagttcccagtggttggctcaagtgtgagtgcacattcaggttttccagttgcctcatagcgtctttccatgaccttctcccttattccagctcctgcttgggtgtctctggcaccttcttaggacagatgtgggttgtccaatgctcaggacactgaatccagctcaagtacccaccatgagtttgatgcaaggcaagcgagccccaaagtggggcttagcccatgagggttcttggcttctcccaggaaagaatttaagggcaagccaatggtagggtagaagaaaacagctcttatggaagtggccgtgttacagttctgtgattgctcccacagagcagggctaccccacaggcagtgtgctgagagtagcaactcggggcagttctgcagtcatgtttataccgaccttgaattacatgtagattaaggagcagcttatgcagacatttctagaaaaggggtagtaactttggggtcatcaggtcattgccatgggaaggggtggtaacccccaggtgttgccatggcgatggtaaactgacagggcatgctggtgggtgtgtcttatggaaagctactcctgccccagtcctgttttagctagtcctcaacttggttcaggatctgagccccacctctggagtcgagtcccagttggtacctcaacttcaagtgaagaaagtcacttaattcagttttttgttgcccccttaccaataacttgaaaccatttgagtggcctctcatcctattcaaaactactcctttcccttaagcctaaaacattatccttggaataagcctcagcacctcgactctctccttcctttaggctcagagaactgatgactacttcatgccaatacatccttggcaagccacctagtaggctgccattcccacagcaagcccagcagaaccatcagagtcatggagtggttatagtttaggctcttaagttggaattcccaaggacactataacatagtgttcctgcatgggtgagggaaaaataataactggtttttatggagggctaggagaggtagatgaattacctggtgcaaagccggagtcagcatctgtaactgatgagtgagcaggacaagttagagttctatgaggaagctttatgccgtcactggcaaaatttgaggcagcaaaatgcaaaggaactcaataaatggtgagatgattaaccaatgaggtggtactgactccagcagtggtgttattgaaagttcaggtatattcaattataacacattttaaatcttggattgcctgaaatcagcctgccaaatatgagaataatccaggcagacaaggacaaagaacattacacaataatgatactaataggcagtgtcctgtacattgtaattgtacaatagtgacagtaataggcagtgttttccagcatcaactggagtatcatttcctatcccaagtaagttaaacacaggatgagctcaacatcctaaggtccagaggagagtggacggtagtgagttatgctgtctccctgtggtgcccagggactctctctctgtcaaagatgctgtatctaattacctaggctctttctttctcctttcctcctcctttcctccctctctccctccttctctctctctgtctctctctttctttctttatgccctagaaataagtctttttcttctttcccagaaatcatggtgataagtagaagcctgcatgcaggaaattattgaatataacaaaaaaacatagttggtgaagttaactcaagacaaaaattatatacaaagaggtaattgcatatagattagagaagtccagtgtattccctttttgtaaaacgccttctgaatcgagtatcttttgattccatacaattctgtctcccctcacatctgacctattcatgtcagagatctcctacctggctcctttttcatctagtaattaatttatatccctgtcctaacttctatctcctgctcccctcaacattatatctctttttataactaggatatactcaaatgaaaaaatccatgtatcttactatcttctgccttcttctaaatagttgtgcttccttttgatctatttatttgctacaccaggaatatttgacatttcctggagaagtaggaatctcttgtatgctcatttgaaatgagctagtgtggttatttaacaaatatgcagagcaacaatgcacaagatgatcaaaagatatacgtggagaaggaagttctctatttcacaccactgagttacattttaagcatggggcttgtgaactaataccactgttcaccttctcaaaagggcatggtatttaggaatggcattattacagttttctacagttttccaatagaagacattaaataaatgagagaacatttctattgggcaatattaaaacctttacttccacatccactgctttcgccagcttgaacagattagttattcccagtagattattctcattggtaattctgtaataaaagattctagatattgtgcattttcatcactggcattacaatttttatttcagaatcttggtcatcgaatattcattatctaattataataaaaatgcatgattcccttaggaatgcctataactaaatgaatatgaactttattaaaggaattaaattaggagattaaaattattcaaagggggtaacaactttattcttaaagaactgtaggattgcaatactaggaaagaaagagaataggaaaggcaacagaaaagtagtaaaaagaaacagaaacaaaacagatagatccctgatgtgctatgatggggaatagagtattaatttaattattcagttataaataaactaaagcctaagcctagtaaattatgtgctccttgaagattagagttaggactgattaatctttgcattccccaccagaccaggcagtgcctggaatgtagtggacactcaataaatttttgttgaattaataaggaagcaaattctatatgaaaatgataacaagtttatgagtactttttcaagtcagtttgcagatacaagtttaaggaaattcatactcggatatagttagaatgtgtatactgaattagaatgttagtctatgtgctttgggaattaattttgaagctcaggaagctatgcaagaggcagccaagctcagaggaagggtgagagacttgatcagctgcccctccctgtcttgaactatttcctgttatagatggaaatcatccttcattacctgggaaaaagtatgagcccaaagcagaattagccttctttatacatgtgttgaatttgtgttcccatcatattaagtattaaaggaaatgattatgagctgtttgttggacagtaaagggaagtgataatgataattttaatatagttaacattagcttgaaacacatgaaactgatatttttgtgtgtaaacacctaagtgaatattgacaatttcacatggtttaatttaatattgatcaaatgctacgtggtaggcactgtgctaagtaatgtatagtccattaatttgtttaaatttcatccaaaaagctttgtaatagatgaggaaattaacaataagttagggaacttgcccaacatacaaagaggacatagaaggtaaacagtttaacatcagagtcccttttcttaaacagaatactatcctgccagggaaaatatggatgtcataaattatgttatcaaaatcttgccttccaatcacttatttatgtcaacaaaaatgtgacaataagatataccatggttaattcacagtgcgaagtgtctgcttctagaaaggtgaaatttgcttataatacagttattattataccactgcaatatcgaggtcaagttctatggctacaaaatgacataatctttactcaagaaggtcacattgcagtaaagaggacataattataaagagtattacatcactagagttagatttttttttgttggtcaaatgactcaatccaaaaagtaggatacatagtaagaatgtgctatagagacaaagagataaatatctgaaaccaaggccccagaaaattaacaatctatgtcaaccataactgtattatccatgtgagtcaatttctatgggaaatacagttctgttatctatggataatacagttcttcctagaggaagaagcaattaattgatcttggaggggtcagggagagtttcatagaagatataacaactttacaaggcttgagggatgagtgggattgcattaggcagagaaaagaagaaagacatcctagaaaagggcgcaacatgtacaaacagaggaatgtgtgacagtaaacagtcacgttgaggaacagtaaatggtttatgtggctaggaggcaagtttgataccacattatattctgtattcctaaaacacccagacacgcgaaatgctgaaacagtaacttggactcttttgtgaagatcccaggactggaaatttctactgtgtcctagaaagcaatgataagccaacgatgctgtttccttctcgagctataactttcatagagggaagtgcacacatcttaaatggacagcttaggcattgttacatattagtatacccatgaaattatcacccagatcccttgcttggaagaccaaatgtcttttttcccccctcagaaatttattaccatttttcagaattaatattttctaaaacccaatataaaacattatatataaccattatggactgaactgtgtcctctgaaaaactcatctattaagccctaactcccaacatgattgtatttggagacagggtcattaaggaaattatttaggtaaaatgaggccacaagaatggggccttaatgcgatgggggtggtgcccttataagtagaggaagaaacacaggagaggttcctttctccactttagttcatggaaaggccatatgaggacacggtgggaaggtggccctccacaagccaaggagagaggcatcaccagaaaccaactctaccaacatgttgatcttggacttcaagctttcaaaactaccagaatataaatgtcgtctaagccacccgatccatggtgtctcaatacggcagcctgagcagactaatccaacagtctcgaagaattaaatttagaattggtcatcaagattttgttcacctcaaggaaataaaatgactcaatcctccacggatttgtttccatcattttcctttcctattttcagattatttgcaacctggagactgccctgcaaaagcacgtggcaatttccccttctggatcctcacaggagaaaaataaattcacattaacaaatattcagatgctttatttattctgaaaaaaataaaaaagtgaaattgctaaattgctaaattgagtttttcactggtcaaaatttacatagcccaataggtgtaggctccttactccttttgaggcattttctctctcttgattaacagtgatggatttttattgccccacttctgagaggaggatttatatgtcttttaatctgtgtaagttggactgaatcataaatggttcaccctctaaattacagagtaagtttgccaatagagatgaccttgtttattaaaatctaattaactgaagttttagaatgtccctgagtgggttgctgaatttctgattttctccaaaccaatatagatcaaatatccagctggctggagttaaccacaaagctctgaacctcactgtgaaattatctagttaattcctctttcagacattttttccaaaggtacaagcccaagaatcctttaatatgttggccatcctatttcagaaaagccatgtgcccaattatgagttggagaaagaagcccaggtgctccttgttcactgcaactgaaatgagaggaccctggagtgtaactttcattccccagcaatggtcagtcagaatgtctctgatcatgtgccacttttcatcttctggacaaagttctatgctgcctatacacataaggcagtaatattcatgactttttactgccaaccttggaaagcaatgttggcaaattgattacagacatatgggataaaacataattaattgattcagttcctagtctatatacaaaattgcttaatgctaaaactcctctagtttctgccctattgcttcttccatttctcattccaactttaagagtttaaggtttgtctcttctctctcatctcccatttaattatcagctattgaactttttcttcatgacattactagatccctttgtgtcccgtccaccgatgatctccatattgatatagctgatgtacatgctttaattttttgataacggacatttttgcaatatttaacataatataccacctcactcccaccccaccctccagaagctctctgttcccttggcttatagtacatataattcttttggttccttcagaattttagatcctgtattttcaacttctttggttcattcttcttctttcatgctgacactgacagtgctctcaaggctctttccatggctgcattctgacttgcatttagtcccagtcactgagagatattttgaagttctgtttttatttgggccacctcaccctgaagagtaagtacttttcattgttgtagctgaggtggtgtgcctttttcaaacgtctacgtcccacagcatcttcgagatattgataacataaaaacaaatatcgatcatcctaagggccttacagacttcagagatgggtaaaagaaaccacttccaccttcaaatcagtcttttgtatccactaggggagcaaaatgacctgctgagttgaagtgggaataacaaagtatctcaaagatgatgtgatgtttgtagagaaaagtttgtggcagtaatcgatacaggaatcacttatatggatctgtgttacttggagggggctttagaaatggcatcaagaagaaaaaaagcaatgcttcttggtttaaaaaataatgcttttatcattgaaaaatagtaccttttaagatggccaaatccccaaaataaaaattcaaagcatattgtacttccttctgaggccaaatgcatcagaactaatgctcttttgagaaaaccatgctatttaagcaaaaatttagggagtggagagtccgattattgtttttcatgagtgttgaagtctatggaaacaatgaaggaatgtacagaaagtaaattagataaagatttgatttataaaaattgtccaggtttagaaatttttatatatccaaacagaagtcatgaattaggtttccccaggctgtgaactagactaaggtggcatgtaccctcacattccaaagctgagtgccctctctgtccgtgtcacccagttaccctccttgggtgacataagagaagcccaacaattcctgggggtgtctcagagtccagcaggaaagatttatttgcagagttgagatgtcagcatattccgtctgcccacaaccatcatcaccatcatgggagtggactatcgctgtttagtttcaagggaaagaaacatggatgtgtggaatgaagccagccatgagcaacctttaaaggcacccacccaggggccatcaaggcaagagtgaggaggagtgtgaactgtgcagaaacagaggggagttgtcagtggctgggtgcacatggcattccagtttctgcacttatttattggttataaataacgcttcagaaacaccgagaagtcctagactattcactctaattttaaaagaatactgggccattataagggaagattttccccttgactacttttgagatgccaggagttggccattaattgctagatatgaaaacacatggaaatggcaaagaggctacacatcaagcattccctctactaatcatgcaaatgagtcatgatgtacaaaatgtaaggaactcctgtttagggaaaatatgaatgtagatgcacaaagtaaaatgtatgtagtccaaattagtcttctagccagtaaggcaattttcctatatgataaaaagaatggatttttatatcatttaaaggaaatacattgaaattattttagaatttaaaaaatgtaaacatgcatctttccttcttaaactctagagtatcggagatttgatctgtttttttctagctcagctattaactggttgaataccttagtctaggcattgttttattcctagtctattacctctgaaaaatgagggtagtaattagattatctcccaaaatattactgttctaattgcatgtggggaaattgcgtagaactacaaagtcttgtcatacaacctacattaactggttgagtaccttagtctagacactgttttattcctagtctattacctctgaaaaatgagggtaataattagattatctcccagaaatttactgttctaattgcatgtggggagactgtgtaggactacaaagtcttgtcctcaaagggctcacactgcatatctacgtgaagaaatattggcccagataaactaaccaacttacttttacatagagacagagccaaggtagggtttgcctttgcaaatctaagtcttgtacccctttcaccacgttaatgagatatggatcttctaattaaatattaatttctaaagaaataataagccccaattacagaaaaaaaaagatactaaaaatatttcaagagcattcaaggagcttcaatacaagaaaggcttgttgttgggtttttttcatctctctccattgatagttaagtacatacgggtagctattttagagctgcgcctagttaacgtctatgtttattcatgtatttattcaatcatgaaacacgtggagccggccacttttatttgaatccactttaaataaacacttttgtgttgattgtacaaagttccatgaaacaatatatctgccctcagggaacttgctttccagaaaggcaaatcaaagaaaaacgttttgcaaagaatcccgaaatggttacaagggctttctaagagaagtctaaattgaacagataattgtctcacattttgtaaaaggcctagactattctcactgaaaagcagtaattgaatctgtaattactttcatttcactggggacataggcatggattctaaagatctcattgtcatggttgttttcttaatcactctcattgcttcctagcaacactagcttccttccttccatgcaggaaagctcaacagtcaatggtgggcaaggacactatgagaaacatttaatggcacccacccaaggcccatcaaggcaagagtgaggaggggtgtgaacagagggacctgccgcttatttgcctttctgatgatccagcccctgtttgttttatgaacaaaggctttaacttctgacatagaagcgatttttgaaaatgaacgtaaaggaactggcaaactcagcccatgggtttcccttttaagaacatgaaatcacctcctcataatcatttcagtgatgccaggaacgttcctctctctctcccattcaccctccaccattcacagagatttgatttctagaattttgtcaaaagacaaaattgcacaaaaaattaaagatctaattggcttttattagcaattctcaaattgggcaacaccccactctataaactggaatagctgtcccagtgccctgagtagaggagattggctttataggcagaaaaggtctgaagaaagcagaaacaaggaataaaaagtggattggtcatttcaaagttactttccttgtagggttaaaacagggggatctcttatcatgccagctcaggcaaactggtctccttctctctttttggttttgacaaaatgtcttgctctatatggtggtatgatctcagctcactgaagcctcgacttcctaggctcaagcaatcctcccacctcagcctcttgagtagctgggacgacaggcatgtgccaccatgcccagctaatttttagtatttttggtagagacagggtttcgccatattgcccaggctggtcttgaactcctgagctcaagtgatcctcccatcttgatctcccaaagtgctgggattaagggatgagcccccacgcccagccaaactgggccccttctgattgatgactatgactctcctgttatttggaaaactggtggctttcaaagttcacgttagttatgtggcacctagcacaagtgattgcatgttggtttggtctgagttgttgggacctactgcagggcctactccaaaacaatggcctcccataaaccctgtatgacagtctcattaaggcattgcttctacttaactggtttgttaagtgggaggtttaaggtttgtcacctttttctctgagagcaggttttagtagagacttggacagagggcatgtagcagagaggatacagaaagatggagctgagaacaaaataaatacaataaactaaaaattcgccatacttttaaaaatatttaacaaaaactaactttggcttgagttataggtttcctctcctgttttatgtgcattagatacacacttttaacaattagatagtttttggtattaaccatgaagtagcatcttatttctgggtaaagtctgtctatttttttaagttgttttaaacttttaaaacattttttagttatgaatttattttattttattttattttatttattttattttatttttgagacagggttctgtcacccaggctggagtgcggtggtgtaaccttggcttgctgcagcctcaacctcctgggctcaagcaatcctcccacctcagcctcccaagtagctgggagtattgatgtacaccaccatgcctggctaattttaaaattttttatagagacagggtctcaccattttgcccaagatagtcttgaattcccacctcagcctcccaaagtgctgggattacaagcatgagacaccatgcctggatgtgaatttttatttaagagatagaaagaataagaacaacccaaagattatttaatagaaataactagacattaatcaaaaatctttagtgtaagccattagtaaaataactttccaggaaaattcttataggtttttaccttttgacctactttttctaaacacttgctatggaaaaagtacagtgtatttgaggatgattgttaggaggcagaaaaggtggagaaaagagaggctgggctcagtggctcatgcctataatcccagcactttgggaggtcaaggtgcgcagatcacttaagtcaggagttcaagatcaacctggccaacatggtgaaaccccatttaaaaacaaaaaaagatggagaaaagagatacaaagatttagaggtaaagtgaacttaattgtctgaacaagaaatcaaacaaaagactccaaaaagtttagaagccatccttgagatgcagatttaatgctaaaaatgttggcattttcagaatattacaatgatgaatgttgacagtcaaacagaattttattgttaagcttgtcctggaaaaaccaagaatgtttgattgtctgtgattgagacacagtccctaaatctagtttggaaaagtgacagatgtttcaggttgggatacaaaagacaaattctaaataaggaatgaaggagagaaggaaacatggaggaaattggtgggacattctgtgccatttaaatatcttgactcttgttaatgaatgtctatatagaggtcaaaggtgaggaaaacagacaaatcatgggtatctaagaaaggtgtgttttctatccaggaagaaaggtcaatggaatacataaatatagtgatataaactttaaaggtaggaaaagcccttaaaaacagagtcagtaaagattttgtagtccctggttcatagtcacaaagtagaagacaccaaagccaggaaatacaccactttgtagttcattaccctgctacttctagtgagatgtgtgcaaaacacttgtcagaccttattgccaattggcatttgagactatctacagttcttttttttaataacctcattgaagtataatttaaataccataatattcatcgattttaactgtacattaactgtacaagtgtacaggtttttttagtaaatttttagaaaattcattgagttgtgcaacaaatcaacacaatcccaacttaggacatcaacattatccctatacgattcccggttaccatgaatttctgtttctactcccagcccgacaaccactaatctcctttctgtcctggtagatttcctttttcatatcagtaaaattagaatatgtgatttttttgtgtgtctggcttctttcacttagcataaggtttttgaggtttgttcatgttgcaacatgtattcagatttcattcctctttattgtctaataatatttcattgtatgtattaccatacttttatccattcactagttgatgggcacttgcgtgatttccactttgggcctcttatgactaaatctgctataaacatctacctaaaaggctttgtgtgaacatatgctttcatgtctcttgtatagatatccagaagtagaattcttgagtcatatggtgtgtctatgtttaactttttaagaaactgccaaactgttttcaaaaatgactgggcacagtgtcactttagtgtaatccaagctacttgggagctgagacaggagaatcatgactttacagcccaccccccgagcaatgtgtgatgattccagtttctccaaatccttgtcaacacatgttattgcctctccttttgattatagctatcttggtagtgtgaagtagcatctcaatgtagttttagttacatttgcctaaggaatgatagtattaggcttcttctcatgtgtttatgttgtatttgtacttatatctatgagatatcttctgtagctataactttgacttcctgaattctgtccagaaatttctagtttgggtgatgctgtgatggaaatgcatgaaagtatgcagagtaaacattttttaagggttactaaataatcctgaaacttcacaaaagagaagtccatctactctgctagaattactgtataggaaaactcagtgtaatcattttcataatatttggtagaagagcaggcttattgtaaaaactggggatgtttatttttctttagggcttcatttttctactttttcattaagctaaggataagattaaactgcctggaggcttctttgctttctcagcacaataaaaaagtcaaggaaagacagcaaagcaagacagaattcttcagaaaaacaatactgaagggaaataacagtaacaccaggttagagaaacaaaatccatagaatcaagctttacttgagtaacaatgctgatggaaatagcatgtaagagtcttagttcagggcctattggaaatggatgatagaatttttccaatgtacaagcccactaacagatataattagcttattatgctaacatgataaatagttactgaatatctccctaaattagattgacctcaatctgtaaggatcgtaactttcaacaaaggctcgttttgcttgcaaaaagattcacacaagatgctcagatggacaacataaaggtatttcagaggacccctctccagaaaccaaattggttgtggaggctaggcacagtggttcacaccgtgaagccaggagtttgggaccactctgggcacaaaagcaaaagcaagacctgtctctacaaaaaaaacatttaaaacagtgggcgtggtggcatgcacctgtactcccaactactcaggaggctgaggcaggaggatcacttgaatccaggttgagcctacagtgagctatgattgcaccactgcactctggcctgggcaacagagcaagaccctgtctctaaaattaaaaaaaaaaaaaaaaaaaaagtaggttgtgctgtaggatcacaaaaactttgtgctggttaaaccactttactgcctttcatgaattagtttccacaactaatgtagagtccgcttctttgagagtttcacatgccattgcttgtggctttccattctctggatccctgtttagatctttggtcaaaagtgaccaaggaggcatctttatactattttctccttttattattttctcagctgacaattctttccctcttttgttgattgggtaaggaatatctgagtgttattactactagctatacggcaaccttttataaacttcaatatagcattacaaacattggttgatttgggcatgaggtagttctagaattcttttttgcttagtatggtatattgatagattaggggtaaatgtgaataaaacattgcagatatctttgaatttatgacttacaagtaacctcaatatttcagcctagctaaagacatctttaaaaggtaattttcacctcatctataaatgagagttaaaaggaaaattcttttaatttacatagtggtgttttggcttatattctgttttggtttttcccctttttaagacgaaaagtccaaggaggggatccagatagtgtgaatctgaatccagactgccactggtaaactttgtctagctaaattctctgattctcattcttctcatcagtaaaatgagaataatgtacattatctcacttaatgattattattctcacttaatgaatcatgatattaaattttcagtatcattgaccaataatgcaaacattttcataaaacgtggcttataaatttctatcatccctgatgttaatcagtttttcttgcaaaataattaagtaatgcctgcttttagtattaaaaatttttttaagttcaaaacctactaaaagtctacatttataaaattattacaaacacttaaaaattatatttccaaattatgagagtgtgtagatatgtgaattcctataaggttatacacatatcaatttgggcaatacaattacataataattggaatatttccaaacacttgttttaaaaatgctttctcctagcactagtttcataagaaggtagtacactgtcactcatcatatataaaccaacattactggctgggtgtagtggctcacacctgtaatcccagcactttgggaggctgaggtgggcagatcccctgaggtcaggagggcagatcatctgaggccagcaccagcctggccaacatggtaaaaccctgtctctactaaaaatacaaaaattagtcaggtgtggtggtgggcacctgtaatcccagctactagggaagctgaggcaggagaattgcttgaacccaggaggtggaggttgcagtgagtcgagatcgtgccattgcactccagcctgggcaacaagagcaaaactccatctcaaaaagaaaataataataataataaaataaaccaacattaccaagtgctgacaatgatcttgagcaacctgaattttcatacatccctggtagaaatgtaaattggtacatgcttttgggaaaactgcttgaaattatccactaaaattaaacatgtgtactttatgacccagcatttctacttttaggtaaatgcttgacataaatgaaggctaataagtaacacatctataagaacattcatagcagctttattcataatagccaaacactggaaacatccaaatgacaatagaatattcattcttattgttgtattatattttatttatataatacaatcttttgtattatataatacaaatacatgcaacatgtattatacaattttttgtattacatataatacaattttttgtattacgtataatacaattttttgtattatgtataatacaattttttgtattacgtataatacaatttttttgtattatgtataatattttttgtattatatatactattttttgtatcatctaaataaatatttaaagttgggtagaaggagctaggcacaaaggaatgcatagtgattccatgcacataaaggtcaagaacaggcaaagctcatctatgatgacagtagacaaatttatggttacttctgatggagtgtactgattgggaagggcatggggggtgcttctagggtgctggagctgttctaaatcattatgtgggtcatggttgtacaggggtgtgtgtgtgtgtgtaaaattcattgaactgtacctttcagattttcatgatcattattcatttcattacagaatgtcatagagattccaccatttaaagaccttgtttttataaaattacccatactatcttatagatgctggaagggttaaacaatgagagtagccacaagtagcagagcaccttctcttcctacaggatagatctcacttgtaccaaagctgacatatgactgcctgctatgtaatgcacagtaaatttaaaaatttattattaattaaatttatttctcactgttacaataaataaattgaagtgtagatggtttctgtcctcttgcatgtttctttgcatttattctcagtacatatttttgccccctctttggtcccttcccaaaccccttgctcaactttggaaacttgattgagttacacaacagttgcctaccatgatagtcagtgggatatttgctcaataaatttctaaagcaaaaatggacaattatgccccattatgagttagaattggcaaactctataaaggaccacataatatacattttagactttgggggggtcttatgtctctgccatagcttcttacctctgtagttgcatcatacatagacaatacatttttttaaatggctgtatttcaataaaacttttttatgaacactgaattttatagcatcacaaaatattttttcatcttttttaaaaccatttaaattgtgaaaattattcttagctagcttttgagccatacaaaaagaagtgatgggcagaatttgggtctcaggacttagtttgcagagctctgatttagagtcatgtaattttaagtaataacttgaatctcaaccttcagttccatcatttctagtaggttatcaaattaccatatgctgttagagagtgcttttatttattgttcctttaagaagcactaaatattaagtttaatatcaaaggctttgtttcctctttggcatgattgtaattcataagacttctaataaaagagggtgggtttgtaaaaaattccacagatatttgaggcctagtcattagtagctacagtgtcaataagaatcacagtacttttctgcattatcttaattctgatttgataaataattattttttaaaaacccttcattttgaaaacaatgaaataactaaggcagtatataatgcatttatttgaggccaactggccaagttctgtgactccttcctgggtttctatgggtcctgacacatgaggaaacaaatattcactgacattcaagaaggtcagaggtacaagtaactgctccacactgcatagcattttcaagacaggcctccaagttggttcctctccattccctgcactatttgctaagagacatgaatgataaatctttacatcattgaactgtctgtctcattctcctgtcatccaaaaatcagggtgggatttttctgatgagttctatgtgcaatttcaaaattgttatttctattcagactgaatagtaaaaaatcatctgaaagggtaaatttgaggaatgacatcacactgctttgtgcctcccacccattcactcccaaatgagggatccctcagccacagcagcagaaaaagaggacaaaaggccactgattttccatgaaggtgaaatctgtgctgcacgggctccaaaactcactgcacataactcatcttaagcccatctccaggaacccctcctgggtttctatgctccattctagagtcagtactttgcaactagccttgtctttcctcctttaggatggatacagggtagacttgggagacctgaaacaagataaatatagagtcaacagaagaacaaactcaggaggaaagccaactgggctcaaatctcggctccactcttcattgtagatggaaatagacacttattgaatacctgttctgtgctggaaacttcacataaactgttccagttgttaaactaaacaagaagagaggaaggaacaaaaggtgtcccttatttaactcatgtacaatagggaagaaaacttctgaaggaactgcttcaaatagggttttgtttcacatattattcaagcgaccaggttgactttgttgaacttctgattccatgacaacagcaaactctgcatgtgtgctcagggtttgacatgctgtggtgtactctctacctaaaagagtacgcagcataatggttgtgaatctctggaaatcagggtgtcgcttctgttttccagaagatgaagatgccagaagggcttctgagcaatgtgctatgagaccacctatggaagagagagaacaactctttaactgtggctttacttagtaaacttccaaacgattactgaaatgtcatcattagacaacgtaagcaactagcagaaaattcatatgtctaatgcagcctcctcattctttttctgtctttccctgtgatccaggaggaaggatgctggtttcttatcatacaaagatcacctgccagtgagccaagtggtggttggagatactgaccgtcaaggctcagaagccaaattgagcgtaggtcctctgcgctgccaaggagacagtaagtttgcatagcagctatggcttgcactttcttatcccatttaaatattgtttccaggctcctcagaagatgcctgcaatcagacttgctctcctgtagctcctacagaaacatcacacaacccaagcagagataacttagaggaggggaacagccataaagcctccagtacaggagccgagatttgggcataaagtggggatatccatctttcctctatattcatatgtaacaagtttgactacctaagtttatgatgatattaatagcaatgctaatagcataaatgcagtactcaacagctgtgattccacggagtgctgctgttaatgccattaggatgactatttatatcaccataaaccgagtttatggtgatataaatagtagcattatggcttaatgtatcattgtaaacttggattatggccatataaagtttgacattattgctatcaaacttcatcatcatcagagcttgatggtcccttgtaagccaaagattgtttctgttaactatgtcttgctttcaagattagtcaccccagagaggaatttggggctgctagcttggacagtgggaggtaagggagttggagtgatggtccctcctaattaagggcaccattaggattttatgttgtttgatacccttcggtgtgctttatgtgcagtcagagggaaacagtgacatggttgcactgtggggattctgcagcgagcatcctgggcatcgttttctctcttctttctgggacacgtggtttaggcaactctcctgagagttctatgcttttgtgattgtgtgctaggcatccggagacctagattctgctccccaaatagctgacttgccaggagacctcaggcaaacccctccattgtcttagctgtggtaatgagaataccacacacatcccaattcctcctggggaggctgtgaatattttagtgcctggatttggattcctcctagcaaagcattatgtgagatggaatattattaccactttgtaaatcaagggagaattagacctacttgataataaattatagcgtccactcaaagagatgtcctaaggaacgtaatgatgcatgcttaacagtttcctacttagtaaattgaggttgtcagcaattaagcaatgccatgttcctaatacaaaagggagatggactttgtactgatttttctctacttacattgaaaatgctacctgtaaaattgagactggtcaagatctttatcacgcacttattgaacaataatacttcatttgtttagtcaggcttagtaaaactgtgcagaagaaatttaatttcaactgcctaagaaaaggatattcacctaaagcaatagtatatatgcattttaaacaaatattataagaaatgaaatacagtgttgctctaaaattaggaagactgtcatgtgttgtctaatgaaaatcatttttgttatggaataattactcattagcatataaaggtaaaatatttctggcttaccgattctaattctgaagttagctttgaatttgagaaagtgttcccattaaataattgattaacttaatatatttataaaaattccacttctgcaaactttttttcttgtctgttttgttttgctttattttctttttttgagacggagtcttgctctgtcgcccaggctggagtacagcggtacgatctcagctcactgcaacctccgcctcccaggttcaagtgattctccagcctcagcctcccaagtagctgggattacaagcacacgccaccatgcccgactgatttttgcacttttagtagagacggggtttcaccatgttggacagactggtctcgaactcctgaccccgggtgatccacacgcctcggcctcccaaagtgctgggattacaggtgtgagccactgtgcccagccttctgcaaacttttattaccattcttaaaaaaaagattctaggaacattaaatagtagatgctgcagtatatgagcactttataattaatattagcttatttgttcttaataaatcagcctcaggaagaatttattgtgaggctgtcattcatctagaactttcctaggtgctctggaaagtaagaaaaagaagttcaaaccatgttatgtgaaatgaacatgaaaaaatattggaaaacacaaattggcttataatttaattttaggctttgtaatataaaattattgcaactgataatcaagaaaggagccatagaaggtgtatttcaggcagactttctttttaaaaaagagaaaatgagaaaagtatagtggtcattgttcatttgcatttctattctagggctgttgttcttagaaacatttttagaacctattatcaaaataaacttatttattcacattacatgatctcagtatacttataattactgtaacttcagagaaactcttttaaataatattttacctgatatttcatgaaagcaaaagcagtcaacagttaatggcaattatgtagaatacttttgtgtctgtgtgagagagagaaatctcattgttttccaggcaaccgagaataagtatcctacctggtactcgaattgcctggtagcagtcagcagttgtgaagcccatgttccctttaagaatgttctcacggccgggcgcggtggctcacacctgtaatcccagcactttgggaggccgaggcgggcggatcacgaggtcaggagatcgagaccatcctggctaacgcggtgaaaccccgtctctactaaaaatacaaaaaaaaaaaaattagccgggcgtggtggcgggcacctgtagtcccagctactcgggaggctgaggcaggagaatggtgtgaacctgggaggcggagcttgcagtgagcagagattgtgccactgcactccggcctgggtgacagagcaagactccatcttaacaaaaaaaaaaaaaaaaaaaaaaagaatgttctcacatggacacagtagtgatagagtgttccgtatcaactgcattttccagtttttatacatatgtgatctccctggttacacacagcctcctgtgaattgggcagggcaaatattagtctttctgccttacaaatgaagaaaatacttctttgaaaatggcatttacacagcaaatttctgagcatactttcagcctctgagaggcttcaggacaaaagatggaacagagaatagaaatagctgtgtctgtacaaggtcagagttgttttcccaactgtactctcatccctgagccaattgttgattaaattaaaatgccttaaaatgtttcatttgggttttatcccaccactagcctcagccacacatgtcagttaccaacatagtacaaacattatagggattacatttatgtaatttaaaaagtggcatagtgcatttttcctgctgtttatagagatgaacttactttgtgtcatttactgaagtctgttcaaacctacagcttataaagactaaacctattgttgaaaaatatctttcagtttgaggagttgagtgatgacagccctcagaacctgcctcttgaattaggccccagttccatcctctagtctcagagaatgaaaccatttttgtgggctctgcccaaccatttcagcagttttggttgatttcatcatgcctgctgagtttcatttttgctttgattcgtctgaactcagacccatataatcaaaatgctaaagaaaatcagtgcatgccactcagatctgctgcatttcccatatagttctgtgaaatgcttatgtccttacaggtgtgtgtgtgtgtgtgtgtgtgtgtgtgtggttttttttttctttcattctttcttttttgcaaagcctatccaaatggaaacttcaaatcaaatgacactgaaagtatgagtggtgacggatggttcgctgaaataaaaagtgctgtgaaaatacaaatccccctcttaaactacacgtacgcacctagaaagaaacaaaagaaccatttggaagattaaaaatcaatgatcaggtagacattgtttcaaattgaaatatgtaatcatctttgcagatggctgccaaactttcatactttcatgaaattagttaaaaaaataaaagacttccactttttggaggtagaaatctcatactatatatgacgaatataattaattgtaggaatatagtatttgctagacaattgctttattttcagccatatgatgtaaaactttactgtactcctctagggatacggggactgtaaataaatactttggagcaagtttgtcagaaccataggaaaggtttaaaaaaaaatcaaatgttttcagtaaacctgggtagaaacaattccagaaaatgtcttattcaagggcttcttccaaggccatgccagaaacactggctgtgaagctggcagacagagcactggagtcacactgcaggattaagatgcaaattcagtttctcagagctacggaggtgacccagagagacaaggaaggaaaggcaaggcagtagtgacacatctagttctggaacactcagaggacagacaaagctgtgtgtaaacaaataaagatactgatggagattcatcaagatgatggtgaatatttgttctttgggaaagttattttatgtgccagactaataggaaggccattatcttttttttgcaagaattttacaaaccaggatcataacctgccattcccttgacaggagagataagatggccaggcatggtggctcacacctgtaatcccagcactttgggaagccgaggcaggcagatcacttgaggtcaggagttcgaggacagcctggccaacatggtgaagccctgtctctaataaaaacacaaaaattagcagggtgtgctggtggccgcctgtaatcccagctactcaggaggctgaggcaggagaatcatttgaatccgggaggtggaagttgcagtgagccaacatcgtgctgttgcacttcagcttgggtgacagtgtgagactccacctcaaaaaaaaaaaaaaaaaaagcaaaaacagacaaggcaataaggcaatgcctcggtctccacgttgtttctgtaccaatgaaacatttccaacaggggcgcacatggcagtaactctctttcagaagataatacccacgagcatacataggccacatactctgtgcagtgaatagggactgaaggagaaaccacttctcatctgggttcaggaagcaattctccttattgagaggaagcagctctccaggctccagagaagagttcaaaatttatttatctcctttttctttgctgcttcaggcttggaaaaggcaagaaaggaaaagggactagcatgcaggttctaaaccaatcactttcgattcattttctctcttgattctctcaacatcccttaataggtgatactgttgacaaaaaaaaaataaaaataaaaataaataaataaaaaagtaccctgtaaaatatttaaagaggtttatttaagccaaagatgagtggccatggcccaaggtacaggctcaagaggtcctcagaacatgtgtccaagggctacaatttggtttttatatgttttagaaagacataagacatcaatcaatatatgtgaggtatacattggtttagtctagaagcaatgtgagagtgtggcttacaagtcataggtggatttaaaaatgttctggttggagattggttaaaagagttaagttattatctgaaggtctggaattgatagaaaggagcatctgggttaagataaggggttgtggaggtcaaggtacttattatgtagatgaagtctcctaggtggctgcccttagagacaatagatggcaaatgtttccatttagacctttaaaaggtgcttagactctcagtaaatttcttctggattttgagggcctggaaggggaaagatctagttatgttgatagagattattcatagatgtgaattttcccccacaaaaaaactgcttagcagggtcatttcaaaatatggcaaagaaacatgtttgggtgtgaaatctttttatttcttcctttttctgtcatgtgatgttatgctagagtcaggttaaaatttggtatcttattgctacagtctgtaaactgtcatggccctggtggaagtatggcagtgaggacaaccagaggtcactcttgtcgccatcttggttgtggtgggttttagccggcttctttactgcaacctgttttatcagcaaggtctttgtaacctgtatcttgtgccaacttcctatctaatcctgtgacttagaacttctaaccacctgggaatgaagtccagcaggtcttagccttatttcgagatggagttggtgcttagatttttagttttggttcacagtacctttgactccagtgtactgatgaggaaacagaaacaatgttattaggtgctttgccaataagtttcagagttcagactggaatctacctagttccaaagtcctcctttctactctattcaatcagagctgatgttaggataaaaatgggaagaaaaaaaaatctcttatgctctcggggagtggctgggtctagctgtttgctaatgagggggtctagggaaacatccctattgccctgtgaagggtcactgaaaaaccaactcacaaggcaggttaatagaagaaaaggcatgcaaattttactacagggagaatcacagaatgatttctcaccccccaaaggagttcagaagcttatatatcatcctggaaaaacaggttttgggagcaggggaggagaggaacttcactttcactgtcaaaaggactatttactggctgggcgcagtggttcatgcctgtaatcccaacactttgggaggctgaggcggatggatcacttgaggtcaggagtttgagaccagcctggccaacatggtgaaaccccatctctactaaaaacacaaaaatcagctgcgcatgttggtgcgcacctgtaatcccagctgctcaggagactgaggcatgagaatcgcttgaacccaggaggcagaggttgcagtgagccgaaatcacgccattgtactccagcctgggtgacagagcaagactctgtcaaaaaataaataaataaataaataaataaataaataactatttacaagttcatctctgttcctagatccatttattctctctggtaatcccctcaacagaattcctcttctctccactcccataatctatttttccaggatggtaaataagcttctgaacccccactgggggtggggggtggggagtggtaatccctctggggctctccttggttctccacatgtacatgttaaatcaatatgtatgccttttctccatttaatctgactcttgggagttgatttatgtttttactttttttttttttttttttgcgaatcttcagagggcaaaggggaagattccattggctcttacactggcaagctgtgtcttctaacttactcttacatgaagggctggttctgaaagcagagataaaaaaaggataggtgacaaaaactgctcccagtcccatgcttagtggagaaaagatcccccttgattttgcacccctctttttgacaagtcatcaaacaactgatctttttccacttactgcatctattttggctcccctaacagtgtacttcttaaaagtaaaaacaaaatctaattcacttgtatattctcagtagtatcacatgcctaacacctagaaaggattcaacaaatgtttgttgaatgaggaagaaaaataatacatcagagcagagggagagtgataatgccaggtttggcctgaaactcagcttctgcccttagggcactcatcaccccaagcagagaaatctcagggcgctggggctttggagttctctaatggagccacaggtgctgggccaactgacttcctacatgaaatctggattttagaccctgttttcctagacccctcatttcctgcttgggtacagctcttgcctctgccttttcttttttaaagttttcattacactgtgtactgatttctggctcactttgcttccctactattgttctgaaagcttatctctgattcagccccacccagaaaagagaggttgcctcaggcaatctatgtaggatgataataggtgtattaccagcatagaggaccactttctctctgtctctccattcctgccctggccattaattataatacattcgatttacttgggtttggtcttcagccctcatgcttttgcaacatcatgatgggctcatacatgatttttaaaaagagcattaacatcacaaatctcagaatgggtaacgtttgatcattcccagtaactatttcctgagaagatgctctaaattgtttttctttccccattttttcccacaaaatgtggctgtatatttttgcctcacgtatagctcaaaacaagaccaagaatcacagtgtcctaacagtggaagcgtcttagagatcaaccagtgcagaacctctcattttacagatcaggggtctgggtctagagaggttaagtgactggcccaaggtctcagagctggtatacagcagagcacatcgagaaacagtttaatacagccttcatccttagtaattccccagggccaagatgaatgttgacacccaaagaggaaactttgacctggaacaatgaccttgggtctctgcctatcaacagctgagtgggtatcagaactcttaatcttactccatcatgagatcaatcatctggaaatcttgatagaaaacctacagccacagaagtgagggtcagtggcagaaagttgatgacttctgtttttttgttatgttttttgtttgtgtgtgtgtgtgtgtgtgtgtgtgtggttggttttttttaactttttagggttgataatagaaggcatgaaaaaaaaaacaaaagcaaaaacgccctggagtgatgtgtagaaatcattaagctctattttttcttaatgtcccagccttcactgctattgccatgggctactaacaactgagaagcagtagtgggtctaagaacaagcagaaatagtgaaattttcaggatcacaacctaggctgactcccattaatggattgagcccaccgggcatttctgaggtcaggtccaattacaaatgctgtagcttttacaagtagatggaagccttcccttttatcttccagattccagagtgactttaaacaattagaagaaatggacaattcctgcgaaggaaatcagctctttaagattactcagttactcaacttcagctgcaaactcactgttgaaatgggacgtaaaattggttacagtttggaaaaaagtctttctgttttacaattgacatgatatttgtgtgcgtgtgactgattttcttacctgtcctttcaaataccatttgtatttggaggaatcgtcacatgccacagaggaattaacgtgaatgagctgatgccagacttggttctgcaggtctgtgttgtcaacaaagagtcaaattctgtaaaatatttgaagacatttattctgagccaaatatgagtgaccatggcccatgacacagccctcaagaagtcctgagaatgtgtgcccaaggtggttgggacacagcttggttttatacattttatctattttatgttattttattttatattttattttttgagacagagtcttgctctgttgcccaggctagagtgcagtggcatgaccttggctcactgcaacctctgcctcccaggttcaagtgattctcctgcctcagcctcccaagtagctgggactacaggtacatgccaccacaccccgctaatttttttatttttagtagagacagggtttcaccatgttggccaggctggcctcgaactcttgaccttagatgatccacccctctcggcctcccaaagtgctgggattacatgcatgagccaccacgcctggcaggttttatacattttagagaggtatgagacatcaatcaaatacatttaagaaatacgttggtttggtccagaaaggcgggacaactcaaagcggagggtggtgggggtaggggttccaggctataggtgaatttaaatattttgtgattgacaatttgttgagtttgtctaaagacctgagactgatagaaatggaatgttcatgttaagataaaagattgtggataccaaagttcttttgaagtcttatagtggatgcccttagagacaatagatgacaaagtttcctattcagatcttaatctctttaggattgggagggtctagaagaaagagatctagctatgttaatagagattctttacagatgcaaaatttcccccacaaagaacagctttggaggcccatttcaaaatatggctaagaaacatgctttggggtaaaatattttgattttcttccttgtctcataatgttatatgagtcaggttggaaaataagtcacaatatataggttaaataaaacccatctgatgaaaatttattatttgtagggcatgactccccacacctcttagataggaatttgggcaagacttaaaaaaaaacaatcagagtttagtcctcagtgtggctggatgggttctgcctcctccatgtcctctctctgggtgcctctcccttcctgaacttgttactctctgcagaagaaacagcatccccagatgcaggcgggagatttctctgcaaattgaatccccgtaatttggtttctctgctgaactctctgaccaatctctcaccatttgaagagaattagtcttggcctattggatctaaacatccacagtgtggagcatactttggaagtgacagaaacacggagtgaaatagagtctaacctattccaggatcagctcctgaaaacaaattcaacctaagagactttattgagaaaaacgagacatggctctgatcctggatcagtttatgtttcagtgagggtgaaaattttaacaaagtggaggagattaggatggaagtttggattcctagtgggactttgagtggaaagctgagaggcctcatgtagttgtgctttacaaacattaatgtacttagaaaccacctgagatcttgttaaaatgcagattctgattcaggaagtctggagcaggacctgagatgctacaaggtgtggctgctgctagccaacaggccacgcttaggccagcaaccttacatagcagcatggtgaacagcacagactttggaatcacacccacctgggtccaaatcccaactttctccctcactaaccatgtgcctttggacaagttccttaacctctctgggcttctacttctcacccagatccttacctcagctgcaaatgagaataattgtaacatcactgagtttgctccagtaaagcctgattgtccccagtccttgcacatagtcagagctctctaagtgttagccaacatcatcattcttatatccatttgctgtggaaaaagtggcaggcttgatatcagaaaagctctgcccatcttcctgctccatgttcctgtccctgtacccttgacttcatgccttttcttggagaagacaggcctagtctcaggtgacagtgtagcatccagccatttagcttctcctaatttggaggtgctggccacaatacctgattagagctcaactgcattttctgagtccccagggacaatgtccttccacataagcaatctctcatttccttctcatcatgtggatctcagcttcgatgttaattcttctaagaggacttctttgtccactcagctgacatagccactcacacctccctacagcccttcttaattttcttcatagaatgtgccactccctggaattatctctgcaatgcacaactcaattctgacaccaactgccctgagttagcacagccttcacaagttaaaagcacagtccccaacaaaacagccttctcttcacacaccagctgcaaacttgggtggctctcaagccactcacatttctgaccaactgactacaaatttggggttgctactattctttcagggtcaataattcactagaatgactcacagaactcaggtaagtgctatacttataatcagagttttgttataaaggatacaaatcaagtctagccaaatgaagagatgcacagggtgaggtcgggggaagcttcagagacaagagcttgcatgtcctctccctgtgaagtgagaattgtaggagttaaagaaagaggaaagaaacacaaaaggcagctcaacagtcaaagacaggtttattttggagaacaaacctaagaggggcttctggctgatttcagtcaagagcactctctcttacagactaagagtatttaagggttttagggtgagagagcttatcacaggcttggactgtttctgtgtggaagagaagtttattgcagggttgaaatgtctctggttggaggggggttatcttggggctgacatctctccggcctctctggccagaggggagattatcttggggctggcatgtctctggctggggaggggtttatcttggggttggaatgtttctgattggagatatcatttgtggtttatggtcatgctgaccttagcctgatgccctttggacttaggcgatttttttatcaaggggaactttaaaatggcggtgcttgtccaagatggtgatgctcctgctctgtcaagaattccctactcttctggtacaccagtgtgcatcaccaaccagtgacgctcacccaggctttgggtgttcaatgatttattgggatctcattctgtaatcatgattgattaaatcattggccacatgattaaatataatgtttagcccccttttcccctcctccctggagatcaggctgatatcaggaagctcaaagcctcaaccctctatcaggtggctggtcttcctggcacacccagcccccatcctgaaaccacctaggggcccaccatgagtcaccttattggcatggacccaggcatggtccctggcgctcactatgaataacaaacactcctatcacttgagaaagtcctagggtttagaaacttggtcccaggaacctgggacaaagaccaaattaatgacctgttatgagtcaatctcttttctctatttatttgctttattgtcaccattgtccctaacagtagacgggaatctcaggcagaagtctgtatcatggtgccaaggacaatgcctgccacattgaggcactcagacatgtgttcattaaattaatatgaatggttaaataaccacaaaagatgatttaaattagcatttccaagtaacaatggaggcagtgcatgaggcacttcatgataaattgcagaaaacttgcacagacaataattgttataaaggtccaagagaagcactatcacttgatttatatgcacaactatttttaacctcaacagggttttgcacatttattcatcttaactaaatgaaaacttttattcctttgtaccttgaaaatcccttgaatctgatgattatctttaaattaaggattaaaaaaaaactcttttgctaagtttttatacattctttggcaattctaaattaagatgcacatgaagtattaaatttatataactcattgtttaatctaaattagattaacccccttggcccttcagagatccaagtagaggcttccatacttttgtttatccatgtctcaaggttattactgacaaaattacaattagtcagtacttcatgtccattgttagggtgctaagctgtgagctataaactacctcactctggcataattaaaaccgtgttccagttcacctattttatgatacctacttggctttccataaagcttcttttcacactcctaactatgtgcaggtctgggaaacttgggaactttactgaagaaaactttaaacataagcttcttcttgaagtttgctgatagttctgttatagcagtcttactatcatcaggataaaaaaattgtactaaactattgtaaaaacataagatttgtattactacctctttttttttttttttttttttttttgagacagagtctcgctctgtcacctaggctggagtgcagtggcgtgatctcggctcactgcaacctccgcctcctgggctcaagcaattctcctgcctcagcctcccaagtagatgggataacaggagcatgccaccacacccagttaatttccacgcccagttaatttttgtatttttagtataggtgaagtttcaccacattggccaggctgatctcaaactcctgaccttaagtgatctgcccacctcggcctctcaaagtgctgggattacaggtgtgagccaccatgcccagcctctattactacctgtaaaataaatcctaattcaaaagtcgccatgtgtatgtacataggaaatagtgcatttgaactggcatttacctactggcataacaaattgctctttggaatagatgcctagtcccaagttaagaagaaaaggggactcctgtgtcccatccatagtttctcattaagtccaagagccaattgtgctaaagtaaatgaatatcttcaagctaacctataaggggtggtgggaatattagttgctagaccaacacttaatcaagaatctctcacactgtctaagggtgaatagaacaactagacttgtagaggattgcttaatctttttatgaaaaagtcatgtgccaattaagattctagccatacctccttcagggttttcttgacttactcaagctttagacaatgaagtggctcaataatcttttctgtaatccctatgtctaatgtattaagtattccttaattcaatttggtagattaccctaatcgattttgttttctggtatttaaacctttagaatttaattatattatactgaataggatacaaagtaggacttgagcttaaaagatggcctttcatttcacagaaaagaaatttatatgtcaagtattttgctgtggtattctcattgacatagctgagatgataatgtaaccagttcacgacgtcaggattgctatgagagaaccccgttactgggtgcttgatttgctcttttggtttatccaaagatactgagtttgctctgactgcctcggttttctccattttaacaaaggcaaaaaccaacactttgtattaaataacctaaaccttggcattgaacttgtcaaaagagaaaatgacctgaacattagagccaagaagatactctgttgtattttactttgttacttaggtatctttatttattctttacttatatatttcaaaaagacatagccttcctttatggaaaaattcatttgttattatttaagtacaacagatagatagatgctccaaaattaagtctgagtgttttctttgcctgcagaactgacagtttgcttggcttatgctgataatccccaaaaaagtcgcttgtgtcttgaacatccataggaaataaaactgtagttccgggcagtgtcgataagaaagcaaactttacaccttcacttaggggttgagaaagagaatgagctattgattccactctgaactttagatggccatatcacatctgaaaccagtcatttcgtggtgggcagtattaaacccgactttgtcttatgactttacaaattagcgaattatgttgttatgataagagaacccaacaaaagtatctgagtttggaacatcaattttcaggatgttatatatttgagaacacttctccactgctcctctaactcctctagcctacctaactttaatagccaggcctccttcctacctgtttccttcccccttcacaagaagcacctattaaggaatcaagaaaaaaaaaaggatgacacttactttcggaataaagtaatatagtctctactatttctgctttcacacagatttgccctcctttctggcacaattacacatacacacacacacacatgcagatatacttacgtatgcacacatgcaggtatgcttagaatttagcattaggctgggtgcattggctcacacctgtaaccccagcactttgggaggccgaggtgggaggattgcttgagccccaggagtttgagaccagcctgggcaacatagcaagaccctgtatttacaaaaaaataaaataattaaccaggtttggtggcacatgcccgtggcccaactacttgggaggctgaggcaggaggatcactggagcccaggaattcaagactgcagtgagctatgattgtgccactgcactacagcttgagtgacaaagtaagacctgtctcaaaaaaaaaaaaaaaggaacttggcatttgcaatcctgaacctactttaacccaaggtaatatggtttggctctgtgtttccacccatatttcatcttttagcttccataattcccatgtgttataggagggacccagtgggagatgattgaatcatggggacaggtctttccagcactgttctcatgatagtgaatggctgtcagaagatctgatggttttaaaaatgggagtttctctccagaagctctctttttgcctgctgctatccatataagatgtgactttctccccttgccttccaccatgattgtgaagcctccccagccatatggaactctaagtccaataaacctctttcttttgtaaattgcccagtcttgggtatgtctttatcagccatatgaaaatggactaacacacaaggtaaccacaactcagggcttaaaacttctggacaccagtgtagttggaagatatagagaggaagctgaagagaaatgagaggcagccttggaactcgttcctctcagataagggggaactgctatagttgtactcatgggtatgactacagcaaaaggatacaaagcaaagtcagcaaaaggaaacgtgcatgagatgaagtccagaggaaaccaaacacaagcttccaagagactcccactggagtccacagaacacacttaattcccccagctattagttgtggcatcatgtgtgaaatgctgtctacaacagaggctcactagagactcagcacccaaggttttattgggtactggtcacaaaggcagcccctaccaggcatgcacccaaaacccagactcccagaagaaaggcagttgtttagcacaaaccacattgtttgtaccaacagttcagcatagtggggcattcttattaatcagttaaccctcctgaaatctaacttggtgggccagccatgggaagcacttctccagcacaaggatgctgcctctctccttcccctgctccccaaacccttctccacactcttttccctctcccttccatagaagtattaagaagatgtgggaacatccagatcttcaacctcacaccaccctgcatcacactcctgacaccatcatactccacttccacctggctttgtcctgcctcttctaattcttttgttgtttttttttttttgagatggaatcttgctctgtcacccaggctgcagtgcagtggtgcaacctcagctcactgcaagctcctgccattctcctgcctcagcatcccaggtagctgggactacaggcgcccgccaccatgcccagctaattttttgtatttttagtagagatagggtttcaccatgttagccaggatggtcacaatctcctgacctcgtgatctgcccacctcggcctcccaaagtgctgggattacaggcatgagccactgtgcccggcctccctgtccgaattcttagagaaggaaaagaaaaaagactgtgctcttttcccttgagctgatcctttgtatctcatggcctgcagtttctgctgcatccattccccgggcagcaccagctacataatttgcaaagtccagtgaaaatgcaaatgcaggaccatttgtattgtgaattttaaaagagagacaataaaccaggtgccaggcccttctgaggctgtgagggtcacacacctatgtttctacgtgctagcgaaagcacaaggtcaaccctagattctgaatatcactggggcatggcagaccttgcagatgtggatctgcaagcttggtttctctaatagctttgaaccacaagaaacatttatgtgatgaaaaccaaactatatatggcaaaaatatttaacacaggggcttcttatatgtactggcaaaccatatcatattattgagttttccctaaacttgattacagaaattacctggggttcttatcaacatgcagattcccacacagctcccctagagattttgatttggattctccagagtggagcccagtaacctgtttttaagaagttttctagaatatttttctgacagggaaagtgtagaaacttaggctcagaatatttgggggcagacaggcctatgctgaaattctccatttatcagcagtgtgacattgggaaagttatttaatttcactaagcttcaatttcctcatctgtaaaatagaaataattgtgctagtacaaaaggttgctatgggaataaaatgagacaaatgtctgtaaagaacttagaacagtgactgctacagtaagctgtcagtaatcgtagttataaatattacagaaaaagagtagaactcatttaaaaccctcagttttgtaatactagatgaattaagcttaaatgcaaattgctaaaggcaacagttatttctgtcaaattaaactcattcagaaataataaattacaatctgaagtgaacaaaaggctcaatcagtcatcaatggtaaacattttgagcactgctatggtctgtttttgtctttccaaaatttatatgttgaaacctaatcacccacatgacaatatcaggaggtggggctctgggaggcaattaggtcatgaggccactcccattaatgggattagtacccttgtaaaagagaccccagagagcttattggccctttctgccatgagagacttcagctggaaggcacgatccataagccaaaaagtagaccttcatcagatatcaaatctgccttaatcttggacttcccagcctccaggactgtaagaaataaatttctgtttttcataagctacccagtttacgatattttgttataggtagcccagacacactaagacaagcaccttgtgttggcagtgtcacgatgcctccgttcttgtcttcttagtttaaaagaatttaaacagctgggtgtggtggctcaggcctgtaatcccagcactttgggaggccgaggcgggtggatgacctgaggttgggagttcaagaccagcctgaccaacatggagaaaccccgtctctatttaaaaaaaatactgaattagctgggcgtggtggcacatgcctgtaatcccagctgcttgggaggctgaggcaggagaatcgcttgaaccgggaggcggaggttgtggtgagccgagatcacgccattgcactccagcctgggcaacaagagcaaaactctgtctcaaaaaaaaaaaaaaaaatttaaacaagagacgcacagtgaagcgggtgcagcataatttattgcaaaagaaaaagaatactttgaaagttaagtgcagaatagacaggatgctctgagagagagaggagtcagggtgggctgccggggaggatgagacagaaaagattggcgggagggagactccccttatgggagtcttacctgattattcctaaggaggtgaaaagaggtgttaccagtaagcatgttctgggtggttctctgggtgcacatgcgcagtagccgcacatgcgtgttcatacgtctcatgtctcattaacatcttaaatctccacctaggggtgtattttataccattataatgaacaaagggtcagtctgaggacggatgaaatcaaagtgcgcatactctctacagggggagtccctaatgaagatagctttgcttgaacgagctcaattaccaagcgaatgctggggcttattgtattgactgtgtggtcaccacggttgctgcgtcctaagaacatggtcatttcttttttcttttttttttttttttttttttttttgagacggagtctcaccctgctgcccaggctggagtgcagtggcacaaactccgctccctgcaacctctgcctcccgggttcaagtgattctcctgcctcagcctctcgagtagctgggattacaggcgcccgccaccacgtctggctaattttttgtatttttagtagagacggggtttcaccgtgttggccaggctggtctcgatctcctgacctggtgatccgcccaccttggcctcccaaagtgctgggattacaggcgagagccacggcgcccggcccatggtcacttttttgactacctatcctgcctcattgatagcaggctgcagatacagaggcgtgaccgatgatttttgcaatcaaggaattgatcatctatttcaggataagttagagaggtgagaagatgcatctctttaaaaggaaacacataaaggttaaagggcaaagcaaagagaatgagtaaagaccattttccgtggggattggtggagtgggtagaaggcttgagctggagaatattagacaatgattagccaaacgtaaagaagcaaaagtttcctgtagaaaaatatgcaaacatacacagtaagcattcagtaaatacttgaatgagaaaatgagacctgagttggaaccagaaaaaccgacaaatgccaataatcccagagctgaagatagtctgtagacagtggggagtttgttagccagaaataggaggggtgagtgggaaatctttaattaaaataaaacctttaatctttaattaaaatattaaactcttcacttgtgcttagttgcagagatctatgcctatgtagttttttaaacaaataaaacaaacattgccaataaaatgatgtaattcaataaagggcttacagtaggttccacatccaacaacgctatactgaaaatacacaattaaaacttattgttatattctcattatagaagtctttttttttgagacagagtgttactctgtcacccaggttggagtgcagtggtgcagtctttgctcactgcagcctctgcctcccgggttccagtgattctcctgcctcagcctcctgagtagctggaattacaggcacgcaccaccacacacagctaattgttgtatttttagtagagacggggtttcaccatgttggccagatggtctcctgacctcaggtgatccgcccacctcggcctcccaaagtgctaggattacaggcatgagccaccatgcccggccagtagaaatcttttttaagaagacttttaaaagctactcattttagacaagcctttcttaattgtgtaagaatgcttggaaaaaagtagtattttactatttttaataaatctgtaaaattattgatgactgctagcttttctgttttgcttcatttataagtgaatgaacagtgattgttgtgggttgaataacattccccaaaagagatgttgaagtcgtatcccctcatgcctgtgaatatgatcttgtaggaaatagggtctttatagatataatcaagtcaagatgaggccatactgaattggggtgggccctaaccctatatgaccggtgccttataagaagagaaagcgcacacacacacactctcacacacggggagaacactatgaaaaaatggaggtagaagttgcaattttgcagttgccctgccttaagccaaggaacatgaaggattgccggctactgccagagcctgggagagaggcacgggtgaacattctccctcagaatctgcagaagaaatgagccctgccaacttggactgtggatttctacccccagtactgtgggagaataaatttctgttgatttgagccacccagtttttggtactttgttaaagtagcctgaggagcctaatacagtgacttcctaatcaaagaatgtggaggcgcaattcaagtggtcttttcaactccaagaggattgggctgtgtttgttatggttaaaggaccattagcagttgttgaaaggataaagggaaggtacttcagtctgatgcggagtcagtgaggacacccaccgctcccctgcagagcagtgtcttgagagagaaagggttctcctctctgtaggagaagcaagctccattcctggtgctcctctgtatgatgggcatggctacctatgcctgccctccagaggggaagaagcctttgtgtttaggaccccgggatgatgttgacagctatgatcacataataataattgtatgataatgattgcagataacatctgttgcgtatctaccatgtgtcagatctagttaagcacttcacaaatcaactcatttaatcctcgcaagtatatagtccatgaaggtcatattattacccttattttacagacgtgaaaaccatgatagagattcagtaatttgctccaagtgacacagtgaatgacagagctggaatctaacccaggcaaattggctccaaagcccatactttcagcctttacagtttagcaaggctgcaccagaccccaacaaaaactagttcttttgtataacaagagaaagattccctggctgaattctagcagactagattcctcagtgccattacgggctgaggacttacaaacatgaggaaaagataatggctagtttggttttctaggtctgccttagcaaattaccacaaacttggtggcttaaactagagcgacttctctcaacagttctggagccagaagttcaaagtcaagcatcagcagggccacatccctctgaaggatctgggggaggatccccttcttgacttttccagattctgggggctcacggcagcccttggcttatggcagcaaaactcccaactctgcctgtctccacaaggatttcattgtgtgttcaagtgtcctttctgtctcatgtcaggaaagtctcattggatttaggacccacgctaatttagtgtgatctcaagtgatccttagcttaattacatctgcaaatacccagtttccaaattaggtcacactctgaggttctgggtggacatgaatttgggaatggggaatgatattcaacctgctacaatggccaagaaacatctacctagttcaaaagagaacaggatctactggaaagcttctcagctcttggagccccacaactgtgtctcctgggtcctagccttcagcctggctctcagcacagctctttgcggataacatggctctacactgcgtcgaacagatttggtggcagtgactcacctagcagagttctcagcagcccacctggaaggtcccatcacattgttgttattgcagatagcactttcactgttactcaattttttttctagtatcttgtgaacaatgtgtttcaaagtataggacgacttggtggttaatgtcacaaaagcaatcattggagttgtcaatcacagaatgacattacataaaagaattaggactcttcttgctcaagatgctttatacatgagcataaattgagagttatgtatatttggatagtagaaaagctatacattaatgtgcatcttaatgaggatgattttcttcttttgataaccaatgtgtctatgaagccatctagctaggtactggtgagaaaaatgtttcaaataaagtatttttattggagcatataaaagagttacaaaaatatttctgtaaaattttctggtctatttttttcaggttggtactttttaatggtttagctgttaaataagcttcatctattaacttgtattcagaaataagcttaattattcatcaattcatgctcaccttatattttatggttttccaaatggatgatatcttctatgtctgtacattttttattaaacataagtcattttatgcccataaagcttattcctgaaaaaattattttgctactaaaaaagatcattaagttcacaaattttctctccatggcttgatgctgctatctttctgcaccataattagttgcatgtatagttaattattatgagaaaagcagaacatctcccaatttctacaagatacttagagtttgatggtttaactatgttttctccttcatttctcccatccaccctccagccacgtgtattttcatggtaggaagatgataagcatacgctttttcaaaatgacagcaaaatgttcatcaggaacttcataaagctttgatagactgaatatatatttagaaccagcatttcaatggctctttaccttttcttaagaatttccttatctatgaccctcattgctagaaaaaaaatgcgcacttttatataaacacaacatttttcatataattttaaagagatttgaaaccctctgaaggctatatgtagtccccatgccaagaatgccagatttgggaaccaacatttcttatccatttataatgctaattaattatttctcttaaaaaatactctagttagcctgtaaaattcatttagatgacacatttaattttgcccaaaaccttgatttttttggaggaaaaaataatgtaagaaaatacattattttaggttaggatctttaaattctcacagtcaaccaccatggtttctttgtacgacctaagctcattcactggtgggcaagtgttttggggaccaggagtggatctgattcatctctgtatctgccacagagcctagcatgatggtttagacatggagggagctcaagtaatactgttaccggtacacttgttatttaattttaaaaattaggaatggctactgtgtaagtacataaacatttaagttcataaatttgtttacagttgaacacaaaaaggccatttgtgttcagatatgtgacctggggaagaaagatgaaatgggtattttgatcagcacggggagcagtcagtgggcctacagagaaggcgattagaaaagccttgtgctgacagtgcaggttctatgatatggaaagaactagtgaggaagatgcacatgcttagtagctcctaggaagagttctcaaggagcatcaacctctatgtgtccttcccaaggaagcagtgggccctagattggaggaattcaggataaaacacacagtcctgctaaccatttcttatcccagtcacctgaagggatgagatcagaattactagggaaagactttgcagtgggatagatatgcttccaaggtacttctcccagcccctaatacttcctgtttgctaatgcttaaaatctctctaacctaaaatctccctaacctaacctttcattttaacattagaggaaaaaaaatttgctaaatattgactgaaatttattcaccctaaatttaatcacaaaagtacaagagcaagcatacttcctctctgattccgtgaatgagaagtattgaggagccaaggttggagaaggggttaccattgagaatcggagagggcaccagaggtcaagactggggaaaaagacaaattgaaaagacattctatctttccctaggattgttccaattatcaatcctattagataagcatatgtagaaacctggtataaaagaaattattttgtatggctaaccactctccttcaaaaaacttcacaatttgttaagtttagataaagatttatcctcttgtttgattagtttccttagaaataaatttcattcttaggggtttcactaattaagataaatagacaattagcctcttggcagcagaagctacttcttatttatctctgtattcccaatgcctaggccagtgcctagcataaatattgtgcttaatcaggattataatatgtatatttcttgaatgaagataacaaaaatatctattacaactctaagtgatttattaattgatttgagaaaggatttatgttaacttacaaaagttcattcaataagaggttacatcaaatatttaaatcattgcaagaggaaattagaagtaaagccaatgaaatgaagttatatagctaataaatcaatttttcttagttgtaataagtatacaaaatctttctgcatgtaatgtgtatgctatcagcttaatataggcatgttttaaaccatgataaagaaaatattccaatatctcaaattctttcagaattatgccaaccctagaacacagtttctagtatgtgattaagccttctattttttaaaaaagtatttctcaattgactgctttacataaatcatataggtgtaaatttgaattattactacataaatttttcttagatttatgacagaattaaaatagccttttaagtcttaaaaatattaataagaaaagctcaattatgtgaacacagctaataatacattcattctggcaggcattgtgcaaagttttcaatgaatatgaatatctttatgaaatatgagaagctttgttcatttacatacaagttccttagtctcctacattaattattttttctcattttttcatgtggaaccttttccagtaagttctcataagacaacaaatgacccagtggagtacctatttaaaacattataaacaaagaaagcttctttcttcagccctgttctttaatatgtaatgaaaatgcttcatctttcattacagaaatgttttatgttctaacctcttaacctcattattatagtttggttagatttttaaatagaactcgagtttttctcagtgtttcagacaggaagaaaggtggagtacctgacaacctgttccaggaaagaatgttcaataatcaagcatctatctcctcttcctgagttaatccagttagcttatgaggcaagcatgggggagttgcaaagtaaatcaaggtgctgaattctactctcatcctgatcctaaatggattgagttttgttctttcttatgtactatccccatattcacagttacagactttgcaggtcacttgctgtctttgtcatattgggatgctctaacataccatagactgggtggcttataaacaactgaaatttgtatctcccaggtctggagaccagaagcctgagcccaggctggcaacaaggtcaggctctggtgagggcactcgtctcggtagcagtctgccaacttctccttatatcctcccaagtgggaagaaccagagagctcgttagggcccctttttataagggcattaatcccactcatgagggctccatcctaaagacctaataatccccaaaggccccccttctcatgccattacattggtgattagggttttagcataggaatttgtgggggacacagacattcagttcatagcagtggaagataaggggtgctgtgcagacatcatgggctctatgtgtcacataatgtagcatctcatacagggtaaacaatcgccactgttatctcttcccaaagccctgctgtggggtctgctcaccggccctgcatccagtcaaggaaggggaggtggagaagggcacttgaatgctgagtggcaccaagaggaatgtgcagatgtcataaactggaaaattggggctaaaggtgaaacagcatcatacaaatgtcttccctccaaaagctcaatcttattttagaaatatatgatccatgaggactttatcataaattggcccaaaacagccagtcagctactgagggtcctcattttccaatgagtgcatgttttgctgcttcagtggtccagcacgatttggaagtattattgctttgttactgaagagacctttgttttgattcagttgccaatattctctaagatggtttaatgtgagccatggtacttaggtgtaatcctgtaaggtttcttttcctgggattcacagtccctgctttcaatagagtctcacgagggtctatgacccttccagacagcactgatttcaagtctgtatcactttataaaatcctacacatagtcgtgatcttagaaaaaaaatggacacaatatagaacacaaaaagatgaacccattactaacaaatctccatatatccattgtatctaagtcatactctatgagcccaaaggctaataaaaaaacaggatcagacccaggtacaggggcaacagtgccaacttctgaaagcagggatattggtgtagcgaaatagagaatatgaaagaaaaaacaatactctgtgagaaatagcctagtagcctatactttatgccaataagctttataggaagttctttttttttttttttttttttgaaacagagtcttgctctgttgccctggatggagtacagtggtacaatctctgctcactgcaacctctgcctcccaggttcaagtgattctcctgcctcagcctcctgagtagttgggattacaagcatgcgccaccacgcctggctatttttgtatttttagtggagacaggatttcaccatgttggccaggctggtctcaaactcctgacctcaagtgatctgcctgcctcggccttccaaagtgctgggattacaggcataagccaccgtgcccggccataatagtaacttttatatcccagacaaaaaaaaaaaaaaaactgagttaggcttacagacttgactctgaggggctcatgataataattttcttttttttttctttagttcgtttgttttagcatgtgctcagaggaaaaagaaaaagaatttatggaagaaatctctaaatcatattccgttctttcatgaaagtgggcaattcaaataatttcactcaattttcaagtgagatattcacagtaatttgtatcttcaggttgaggctaagcttcattgcacttcatgggaatatatagaacattctagcaaatctttcttagactattacatctttgacttacatgtttatgaagaatcatctgtgcctctgattggccttatataaatacaagggtcatttcagagagcagttcttaactgacttggaaaagcctaagagccaaacaattcagcagctcttccacattgatggcaccagccacatgcagtacatgtgctttacgcatttcattattgcatctctttgtcttatgagtttattgatggaaaattgtgccttgtcttttatcaagtaaacatatttcagaagacatctacatgctatcaacaaaacagagcaaattcagaaaatgtaggacttcgttgtacttgggggattacttcaattgccttaatagtctaccagagtagaaatattacattctttaaagttcagataaataatttgtgctgcttatgtaggaagtaagctattctccactgtaagcagtcttttatgttgacaatatagaaataatctgtcttataagctacactgcatctaaagccctgacactacagatttatgcatacttctggctgaaaataatattgaaatgtgaaaatgaaatctttcaccaaatctctgggaacataggtttgaggctggctttggaatcactaaaaattcattgattcccaaacgtagactaagtaccataagaactgactagggtacttgattgagcttgtgctgtatggtttattacactggtggtaggaatgtgtcaatagtgattatactgctctaagtattttgttttagggtatgattctagcttcccttgtatcattactcaaaactccaaatgaagtgtgtaagagtatttttcaaccctggatttacttgcattccatactcattaaatatatgacacaataaaatgtctaggtcttatgcaaggaacttcaactcttctatggctcctggcctaaaaaggtatctgtgagaggcagaataatgtccgccaccaaagatgtccacatcctaatcttcagaacctgtgaatatgcgaccttacatggcaaaggggatttagcacttatgactaaattaaggatctataaatgcggagattttcctgcaattcgctgggtaggtagaatctaatcacatggatccttaaaaatagtaggaggaggccgggcacagtggctcatgcctgtagtctcagcactttgggaggccgaggtgggtagatcacgaggtcaggagttcaagaccagcctggccaaaatgatgaaaccctatgtctactaaaaatacaaaaaaaaaaaaaaattagctgggcatggtggcggttgcctgtaatcccagctactcgggaagctgaggcaggagaattgcttgaacctgggaggcagaggttgcagtgagtggagatcacgccactacactccagcctgggtgacagagcaagactccatctcaaacaaacaaacaaacaagcaaaaaacatttgaagcattgagattaaagtgttttctttgattaaaaatctgtcaagagtaattagaacctgcttcctttcctcttctcattgtacagcttacaatatggatcaagaaattgtttctattgacatacttctttccatgtttagatcggcttccaagatcttatcctttccactttcaatgtcatgaaaaatcattgagagttcctttaatgcgaaatgttatgccagtgtcacttcctgtgagacagcttcatcctttttggggtcacaaccaccttccttatttgtgtagttcaattcatttaacctgagttcctctggctacaaatctggagtctctgaaacaatgacacattcagctattgcttctataactccatttacattcatttcacatttcactttcagcatcatcactctctgtttcttgatgcacttttatcttagttagccaattctcccttctcgtgtccagttttgtaaagtgttatatgggcttatcactgggaaacaaggaggcaacataaccacatgctttgctgtgtgtggaaagaataacattatgtggagtaacaaacccttaatagattttgaaagaagtgacatggttggtcactgatcatgatgcacatctgttatttctgtatagatacttctgaatgcacaatgaggttatgtcccaataaatccatagaaaacacatagttgaaaatatatcaaaagttgaaaattcgtttaatacacctaacctaccaaacatgatagcttaacctagcctaccttaaacatgctaagaacacttacagtagcctagagttggaccaaatcacctaacacaaagcctattttgtaataaaatattgaatatctcatgtgatttatagaatactgcactgaaagtgaaaaacaaaatggttgtacaggtactcaaagtacagcgtctactgaatgcatatggcttttgcaccttcctaaagtacaacaattttaaggcaaactgtcataagtcagggttcatctgtagtgtttttggacaggagagctagtaacaaaacttgaacactatacatatgcataattaaatttgtatattatgcaattactcaaacttagtatagcacagtaactaaaatttgaaccatgttgggagactggtatatttacctatactatagtaactgaaatttatgcatattaaagtgtgtgcaaagcaaggactgcctctttgtgtgtgtatgtgtatgtgtgtgctctgtatgttttgcatattttcaaactttaaataaatgccatcatataatatttatccttttatgaacttgctatttacattcaaacaatgtttctgattattcttattaatgtatgcagtcaccgtttatttctttttctgttttatgatattccattcacatgactatactacacttcaagttatttatgtattctttattgaaaatatatattgctttcagttttttatttttgcaaatatgactcctctgagaattaatttattgcttccatgtagtcatgtgcaagaatttctctaaggtaactatatctaggtgtggagttattcagttttaaaccttattagatatttccaaattgttttcccaatttacactttcaagtaagttttaattttattttgactcaacttgctccataacagttagtattggcaaattccattttaccaatctgatcacataaatgaatgaggctaaactaatttaatttgggttttcttgattaagggtgagactgagcatattttcaagtttcctcaaatatgagttatctgtatcttttgataattatattaatatatattatttacataaaccaaatattaatgtttataatttgtatatactgcagctgtcatctcctaatctttgtcttgtctttttatttgaattatgatatattttgatgtgcagaagttttaatttgaatatagtagaattcatccattttcctttttggtttatgttttgtgtcttatgtcataaaaatattatcttttgtgcttcatgccttttttcttttatgatgtcttttttcttttaaaagttttaaccgttttctatgtttgggtcattaaaatacatggaactcaatttttttaatggtataatctaagggttcagtttcttatttttgacacatatacaaccaaattttccatcatcaaacatgggaaaaattctttctccactgaactgtaaagccacctctgtcatacatcaaggtttttttttttttattagactttattttttagagtcaatttaggttcacagcaaaactgaatagaaagtacagagatttcacattcaccctctgcccccacatatgcacagtctcccctactgtcaacatccatcaagtttttatacatgcaagggtctcttttgggctctatatttttttcctttgttcacattgtcaatgctgcacaaatttcatactgtgctagtgatacatcttcataatagaacttggtttctgatagagtttagtctacagtgttgatttttaataaagttcttaaaatttctaactaaaattcatgcaaattttgctactgcaaatagtatcttttaataaattactttttctaatgattgctgatagatagaaatgtaattttttgataatgtgagacagaattcacattacatataattcatccatttacaatgtaaaagtcaatagcttctgttttttgaaattatatgtatatatataatcatatagtgtgaattctttgtgtctgacctctttcagtcaacgttatgtttctgatattcaagtttttgtgtgtagttatgtccatttatttttatcactgtagagtatcccatcatataaatatatcagtatttgtgtatcctgttttcagtttgggctattgctgattatacatcattattctagaatttccttttggtacattttaaacctgcccactctctagagagtattttattattttctcacggttttcatttcttttggtctgtcttacaagtgtcttaagtatatttgttttgtatcttttttataattattacattaccttgagggtttagagggtttttctggcactttttcacagtggcttatttcctcatctgttttggtatttttgttatctttctgcttatcccttgcaccttgcaatgtgtgagactcattttgtcttaggttgatgttgctctgtctcaacaggatttggatttgcttatacacgtgctttgatacataatctaggttgggtttatgttcatttattggcttggcttttcttggactctcaagtagtgtatactcaaactgtagacctctgtgagggcaggcctgtggttatgaactctcaggagaatagctcttccttattcagtattctggccaagacagatgacagacatttcctatggccagtagtcagctgtgtttcctagaacatcctatcattgaagatgtagccttcaggggcctcagccctgtgcatcctctagattcccaccacaggggagcccagggcactttcctgtccctggaatgctgtgcaattcaatcctctcgctttccaagataaaggaatgtccccagttaagggccagctcaccactctgatgttcttccccatttttttggtttttgcctttttgtttatttctttgtttaagaggggatgttgctttgttgcccaggctggcctcaaactcctggcctcaagtgatcttcccccctcagtctcccaaagtgtcgggattacactggcatgagccatcatacccaacccttccccttctttttctaccattgggatttatcttgctctttcgagtccccagctataccttaaaaaagacacttgttaatttttatgcagcatttgtgggaattattttagagattttcagaacccctagtctgtcataataccaggatagaaagtagaatggtgctggccagggcctggggagatggagaaatggaacattgctgtccaaccactgtgaaatttcagttatgcaacaggcataagttctagggatctgctgatccaccttgtgcctgtaggtaacaatactgtatggtgctcttcaaaatttgttaagagggtagatctcatgttaagtgtttttaccacaataaaaaaattgttttttaagagttgaagactattttctgaataaaaacaaaatgaaacctcataagtaaattcagagttgcctagtaaaatgtgtcacacgcataataaaagtgtaaaacattcacactcctcactctcatttaattatcaagaattaattaagcttttatttttcttccataaattccaagttcccgatagctaacttccaaagctaaaagtaatgttacttttgactcttttgctacaacaaataatactacactaataccctggcatgtattgtgtggctatgtagagtatatctgtaggaaatgttggtggaggtggagctgctggttaagggtgagagaaattttaattttctagctttcaaattataccattcagcctcccttttgtaaactgttagtttaaatttgcttttctgtaattgtacgtgagtgacaattattaaccccagttaaatgaacaaggagttgatcatctgggggtgttcacagtgctgaaattatgaggaaaagatgtggttcaggagaagcttattaaatgtactttcctttttctccacccccacaccaacatgctgacaatagaaactcattctcaaactgaccttattcaaggtaagaaggtattgttccagtgtgttggtttcaaggactttcttccatgcagaataaatagtagaactaaaatatcactaaacctctaagtaagcagattatgtgctgtcaacggtgaatgcccaatatatccacagcgcaagaacttaagtagacagaggtattaactgtcattttatttgaaggaagccaaaaaatcttgtgctcacatcatattccttaaaacctcattcttccagaatggctaccacagtcccaggcatcacctggagacagagacataatacccagcagaagaaaagagtttattattttatgatctctctgtttgaagaagaaaaaatacaacactttcttaaaaatttctaagtggacttcctcttgtgtattattggccaaaattgaattactgaatcatatgccaaccccaggaaaatcaattattggtgtgaggaatagaattcccctgatcaccttagcctaatcaatttgtatccatgacttacacaccctgcaacaaaggaaaatgtaggacttgctattgattacgtacacaagtgtgcctgatgtggacagcaaataagtttgatggtattgtttgtcataaagttaagtaacagcatgagtaatatggccctctgtggaatttcttggtggcagttgagcaaaatttaaattgctctgaaatggaggactgtgatcacggaaacaaggtagagttagctgatataatttggtacaaggaaattaaccatggttgggtttttgagccatagatatgataatactcagaaatatatgtaataatgcagcattcccaaatgattccaatgttgagttctccacacaaatcatttcattttctttcagttggtgttaaagatattggagtcctcatttggaagtcactcactatagcatttatgggaaaccgagctctgaattacaaacatcgagttgacaaacgaaaatctggaacagaacccactcaccagctggcgaccacccagtattatttgactttaaacttgatacttgaacatgattttttaaaagaaacttaagcaagtaaacataaaaaaaaaaaaaaaaaccacctctctttgacttggtcttgcaatgggctttttaccgctttgaaatggaatacagttttatttccaataaacagcagccgtaacaaaacttcacacagacacctggagaaggggcatttgatgaatgcaatactatcattgtttattatagaattatttactagaatctggcagagatcctaaacaccatttaccataactttggccaattttcctaaatccatacttcaaactctactgatataatgggctgctttagccaagaatgatagctctgttactccccaaatattaccaaaacaaaggcgtggtcacttcccacaaatccacctggagtatgagtcaccagctgccccttgttgatataaagagctcgaagaatgaacagttttgaaatccattagtgaatcactgagaatccactcagtacagcttggagatctcaacagaagccaataataattaaagaaagaaaagctctgggttaaaggaaagcaagcaatccagcggaaccaactagaaaacatcagccaactgcagcgccttgctggaattagggcagaccacagtctagtgcctgctagagcaattgaaggaagcccagctgagagagaaggcttcagtaaagaaaattagggaaggttttatttttatgtgaagttcttgtgagaaggatgttaagagaaagcattatctgttattatttatgattgttgagccccacaagcaagcctttgagtttttataagcccacatagcatgtttttttgtttttgtttttcctgagggtaaacacttttatttgtaacagcattgtccatggctgtcaatgtatctgatggaaaatacctgtccataagcatgaaggaaatccatgatcttcccctttaatttgcagaacattacatagtatttttttaaaaaagatgcaaatagcagcctacttctttgctgctaaagagctttaatggaatttttagtgaatcagatgtgtaagggctgatgtcctccaagctgagctggatctccccagttcttcctaaggttccttttgtgtcacattcaactcaacagacaggaagcaactctcctgcagtgaaggccgcacagtgggctctgctcctaaatccaaggacacagaggagcgcctgtgtccccaaatcaggaaggcgggcatcggcgagacccagtgtcacagagaacgagcatttttgctgctactgttctgtgcaagtgatcacagcccagatgtacagtatgatttggaacctccacactatttagcatcccttaatttgtatccagtgtgctaactgacctggaaacattagaaccccatttccaagtttctcttaaaaatccccaggtcccaacacacaccaaccactttcatcctcaacagggcatgttacgccagagacagatccttctgcatgcattttgccttaatgccagtaagaaaattgattttttgtttcaggatttttcaatccagaagacaaagagattagtcagcagcttttaaaatgaaagtttccaggtgagagatttcaacactattttgtagatctggtgaattaagatacatattttcagtattttaggaattcaaattctaatcctttccaattcaccaactccctttatccaaatccatggaatcagagtctaatgaaaggggtacttagcatttgattccaagctttcccttacaactacatttacaagaaagtattttgaagctgagaaaactgacaggtcctgtggttgatctgcacagttctatttcctttgggctccaaatgttaaagcacatgccctggcaattcgggcaccagttttgaatgaagacacccagcatcttgcacctgcctgccaatctccacgtcctttgtagaggaccggggtggacatgcccatcccctcctggggaagtctgtttacactgcaaactcctgacttctgcatggcggtagagctgattgtgatacctctgtccacctatgccagcccaggtgcctgacttgtgttgggttaactattctgatagctttgatatggccttcccacatgtgccttctcctactgtggccgctgtcactctgtctccactcccatgacacttggatgctccagtgacaccagctcctgcacagtaccactcttcagcagcgttcatatcaaactgtgcatgtctagcttatctgggggaagacactgaagagaggcagaggtggagacgtgaaagaagacagcaaaatcacagagcttcgcaagagaaactgcttgcttaaagataatttcttcttctgattacaaaagttacacatgctcattgtcaaaatgctggaaaatacagagaagtttaaagaaggaagaagttaccataatcatactacccagctaacatttcggtgtattggtagtagggaaatttctggttgtcaaggaggaaggtatatatccctaatcacagaggttttttcatgctcttaggtcctaagttatagcattttaatgggagatttctaagacggaaggtatttctggaatagcattccttccctttcttctgcagatctgtcaaattgttcagctttcttgactaatagatgctatggatagagcatccctctctctctaaaaatctcaaaaaaagcaagtcttatttattcaggatttgaagagaaatattcaggaaggatatttcatcaaacctgattcatatattatgcactgtaatgatgctagacacaaaacacaagatttcttgatagatggtcagaataaattacaccaactgcattagctcagcagcagtcctgcccggatctcagcacctgagcttctcatctgcgtatggttgctcagcttggtcactgagacatgcaaaagggaaatgggcattttccctgaacacctaaatcctttccaaaatctgtcaaaatgtttactaaaatgtagcttctttgtttatcagacgaactgtggtaacagcagttatgaaacttatcacagttcatctgataaactacattttagtaaacatttcaaagtgaagcagatatgagagagaacaaaattatttgtgtttacatgagacttggaattgttaaaatttttatatctagcatacaaaaaggctgcttatgttaaaaattgatagtaactaaatatataagaccaaaagaatactaataatgtgaattaaaatgaaatcttagcttggtttataaactatgaaatttgactaaaatctattctgtatatatgttctagttttagaatataaactagaactagaatctaagtagtagccaattggtaagtagtgtctgactgggatctaaaccagttcagattaaaccattgcaacactactcagaaaagcgtatggtcaagatcttccgctatggagattaacaagaaatgcccatctatgtaacagtaatttaaaaactgatagtggtatattacattccagtgaatgacgtaaataatagcctttttaaccctcttgcgaatatacatggtatttgagaaaaacgttgcttcagaacaggtgaaagaatatgcctggccaaaataagttcggctacccaaaatggtaatggcttaagccttttggtttttatctttgttaaaggcagcgagtgacattttaatcttcttgtgcaggtttttctaaaacacaaaacgctttctgttaaaactcgccacaaaggcagaaagggaaaagcattcacagatgcacacagattccaagaactctctcacactatctcaggaactcttactgctccctagaaactgtttttcatcagaatggggaaaataacacgactggtacctgcaatttctgacaccaatttcacatctaacctctgtaggtatttaacggactcagggcctaactgaaactgctgctaactattgatttgttgaggtgttcatcccaggtggtttatggggactctgtaaatatgggctgataatagtaatggtcaagctcccataatttcttaatttcagtttatttatttataatatttatggttgtaagatcgaatctggtgattatctgtgctgggggcagaaatttcatttctaaaggatggcggtaaatataagcatgttgttggttgaatgttcaaaaacatatttcaaaaaccaagtactaacagctaaggggaaaaactcacacaatgaaccagaagtgtatgaaacaaggaataaaatggaaaaggagaaggcatgaatgttggagggatttaagttatggatgaaactacagtgaacattcagggtatgttgggagatgaaaactgaagcatccttttactcggtagcaaaagtgaccgggatcaagggtcactcccggatacaggtatcccggagcacctccacaatggcttccagcccagacctttgtcgtgggaaggagtcccatgctctcatttttggcacaaacagagtttgactctcaccacaaaacagcatcaaacaatgtcacaggctgtgcttctcacaaggttttttgtttgttaagttcattttcctgaactcaaacattgtgggaagaagtaggtcataatatccatttccctctaaattgatccagagcttccagaaatctgaagaccagtgaagccaaggtttcttccaaacatagagttgtgtgaaatcactatgtaaaactgtcagcattattttggtggcaagttctgtccccatcttggctctcctccctgcctctcccacagcctggtacagtcagctatagagttcagccctgaatacctgctggatttacacctagcaatgcatctgttgatctcactgatgtgaaaatcattttacaaagaattcccactgcattttctttagcatggcattcacattcccccatagtgtggtcccaaatcactcctggtcttcatcttctaggttcctcagaggggacctcctagcatcagtctgggaattctctgtctcctatgggatccaggacctggaccacccagtgtccttccaacaggcctgaaaccttcctatgtgcaggtgtggaatgctgctttcgcttcttgcctcccaatatcttattgattcttcagttccttgttgtaatctccctcattcagagttgttttgtgtttgtgttttgttttgttttgttttttgagacagagtctagctctgtcacccaggctgtagtgcagttgtgatatcttggctcaatgcaaccaccccccaggtccaagagattcttgtgcctcgggctcctgagtagctggacttacaggtgcatgccaccatacctggctattttttatatttttagtagagacagtgtttcactatgttgcccatgctggtctcgaactcctggcctcaagtgatccgcctgccttgccctcccaaagtgctggggttacaggtgtgagccatcgtgcccattctcagggtattctttttttggggggaggggtgtgaggggagggtgaggagaatggagtttcactcttgtcactcaggctggagtgtaatggcgtgatctcagctcactgcaacctccacctcctggatgaacgattctcctccctcagcctcccaagtagctgggattacaggtgcctgccaccacgcccagctaatttctgtatttttagtagagacagggtttcaccatgttggtcagtctgtttttgaactcctgacctcaggagtggtccatcagccttggccttccaaagtgctgggattacagacatgagccaccacacctggccagagtattatttaattctctgagtaaccagaagccaaaggatattgcttcacctttagttgccatgtaattgaggcatacctcatcatcagcagtacacttggttttctatactggattacacaccttttggaggcaggggctacttttattcttctttaaatcttcacctgcactagcatgctaaaacaaggaaaagaaagttttatcttctatactggaaacaaagaaaaacaagggtaattcatcttacttttatcactagtctccgattaactacatgttcaagtttactgtatagtatatctatgtgatctaggcaggcatatttcccctcaaatatataatatggcaaaataaagtgcaagttgtgattggtgaagataaatgactgaacttttactatcatattctcactctgctgataaatcatctttgagaattcgtattaattttggtcaagaaatacacaagttaaatccattttattcttttttttaacattgggaggactaagtgaataaagaaggagtgaattatatgattgtctaccccacagtttcagtaaaacgatattttttcctgcaatatatttatgatctgccttaaaaccatagaatctggcttaagccaaagcaactgtatcttcctttattttttaacaataaacacctttaattatcttccttccgactactttgttgtaacacacaatgtgtttgtctcctgaggtgagcataaaaaaggagcccagcatgacttgaatgctaccgtaattaaagaaaagctaaaaaggtcaaaaacaagaatgtggtaaatcttaagcaactccccagaacaggcgccacctgccactttgtgctgacaccgtcaatcattgaatcggttactgaatactttcttgcatttcttcttctccaccttgtgcccacgttaagcaggaagacatcatattttcattagcacctgttttgttttttcaccttctgtagactgttgagtgaatttctaataataaagccaaaaggaaaaataatggcaatatgattggacaagcagtttcagaatcaaggtaggatgcctttttgttggtggaggttttttgtttttgttttgtttttggacttattctccctcatatcaaataaatttattaaacacacctgaacacttgttatgtgccactgtcggccacgtattagggacacggaagaacaataagacatactccctaccaaaagaggcttatggtttagaaggaagacacagtcttgtaaacaggtaagtaaaataaaatgtgagctgcactatgctggaagtcagcccagggtggcccaagtagaccatagccagtctacataaatagggagacacgggggacagctttctagatgtccctaacgctgaatcctaaaagatgagaagcatttctagggtgccagagtggagaaaacacctgacttgtgggagaacggaaggcctcgtgttcattcaatggatcaactatcattgggcatctccacctgcgagagacggcgctagcccctggggatccagtccccggtgagctggaaagctactctgtgctctcagaggacttggaacagagaatgcagacagggtggcaggaatgcaggaatgtgctcacagtgcaggaacccggtggctcgcagagaagggcaccaaacttagacctgggagatcaggaccctctcccccaaaacctggaggattgctccaaagctgtaccgagtcagtggcggaggccgggtgagcgtggggaagggcatcagacacggtatacctgctccacctttcccttttgttttgttgtcacaagaggcactacttcgctgcctccgtctcctctgtgggtggaaaggatggacccaaaggaacagaaggctgtggccactcgacgatggttttgatagggacttatcttgctctctctccctggacactctctttctaggcctgcagcctctctcctcccttcccatttccaaagcctctgccccaacctgatccaagtattatatgtaaacctgtcattagggttctttaaatcaaggctttttgatgacaaaaagagggtttaaaaaaaaaaatgtggctcacgcctgtaatcctagcactatgggaggctaggcaggcagattgcctgagctcaggagttcgagaccagcccgggaaacgcggtgaaactccgtctctactaaaaacacgaaaaattagccgagcgtggcggcaggcacctgtagtcccagctactcaggaggctgaggcaggagaattgcttgaacccgggaggcggaagttgcagtgagccgagatcgtgccactgccctccagcctgggtagcagagggagactccgtctcaaaaaaaaaaaaaaaagaaaagaaaagaaaaagaatctgtaagaatatccagtgtggcttctgcctctggaataagtaatagtcttagtgaccatggctatgggagtacccgggttccatcagtgtgccctgtgtggttttggtctgggctgcattggcgtggcctgtttttttgtttttgtttttgtttttcccttattactgttcgtggagtgttttagtttgcttttttgtttgtttggttggtttttttttggactctgcgaatggatgtctaatgctctcgtctccctggcaggacctccttcctgtgtctgcagtttctcttgtagccacaccgtctgcccgatcatcagtgctaggaaaataacgatgagaacagacctttcgaagcccgattatcagaaagagtgtcttcatgcttgaaatctgaatataaaacagacgcccctgaagtgcatccctgtgacactgcctgtacagcaccgttaaatatctcatcggcagtaatagcttaagactactgtgctcagtcacttctttgggtgtcactcatagcaatccccatccctgccatcatcattatcacacagcactgccataatgacaattataaagatgttagaaagctgagacaagtcattctgaattaaaccgcagctcccataggtcctctgaaattacccgtttccaatatctccattgtttccctacccaaaagcaaaaaggggagacaaatgtctcttgagcgatgcacaaaatacattataagcctgggaataatcaaagctaactgtgttcagtagagagagatgcactgtgactaagtttcactgaattttaatggcataatttttagcccagaaagcaagctcatgtgtgccggagtgattaatgatacagtttatgcagctcattggtcatacttaaattagtttaaatattcatctgttgttttgttataatgaatctccatgtttctttttatttctgttcccctgagtgtttcctcttgtctggttggaggatgtttgcctgaattgggaaagaaatgccaatagccctgtaggtgacaatgcacccaggctgctgaagatcaggggagatgaggcaataaacgcttcatttcacactgtgaaatgcacacacagctgcaccagcttcttgagtgagatgtcttggtggattctgtgaggtgccaggtcagagattaaacttactgatttgtggcacatgaagccattggatgaagttggatgctgtttgctgtccctgggacttcctttaaagtccacacatcaatttttataccaactccctgaaagtcctccttttatgagcattcataatttacattttgagttggaaagtcctgtaactctaccttctgggattttatgaattttcctcccaaatacaaaactctctagatgctgaaattgcatttgtggtgaagaagggaaaggccataagagtaacttaataagacttcatgttacagaactgaaagatctttcaaattcacataaaaggaggcctgcacttgacactgtcctgactatataacaacatctagaagtagacagtgttgcctttttatgctatatccttgggagtacaatttacaaatagtctactacacacttcttgcacttgtgaatcacccatatagatcaacctttaaagtgtaaaaaaaaaaaaaaaaaaaaaactttataacatcctgagaattaatccttggagagctggctagatacagaatgaaaaattccagacaccacaagtagttagagctcagcttcctggataaatcagttaatttggaaattgtggcctccatacccgctaggcatgtttgttcatccattgttctcctccctatctcctagccacagtgaaagaaaacgaagtgtggtgtacacacacttctagctatgaaagcagctgcatgatactggaaacacagtgtctccaaatgtttcagccttgggggcttccctcattattactatctgaataaagtgcttcagtccgctatgatactttactctaggaaacccagctttgttcctcacattatcaatgacttccaggagtgttcaggaaggacccaacttttacactcactattcaacatgttattaccatgctgctaatgtttagctttcttctacattatttgacccccaaaacagacactataacccaactaatataattctgttatagcatgttacaagtttttagcaaaggtgagaatcatcaaattgcatacgggatgttattattcttcatatccatcaaagtacaggaagtccttcacaggcagccatctttttctctgggccacaccagagaagccccctgccttctcctttctttgagtttcaaggactgaacttcatgtctcacaagcagtcagaggtggaagcaaatgaaattgcctttgcaaaaattctaacagtgagaggaatctcacctgactccatcttgcttctaacctcacaagctagctgactttgttagctttaaaacaaaaatgatacatcccttcctgaaactaacccctccttgcttagggactgaaaccatgtttgtaagtctaatgaaaggacataagattaggattatgggaggggcctgaattctgctaagatatatgcatagttaaacaataaccagctattgttccagaggtacaagatttgtaacttctccaactgctcctttagataatatccatatggtcaaaacctaagattgggctttgaggtattttccagacttttgcatttggtttgaccagctgatgccacctgaacccaagactcataccagggaactggctcaaccagtcctgtgaccttcatccagatactgactcagtgcacaaagaccattttggacattcctatgatttaatccccagtcaatctgcagcacccattccccatccccctacccaccaaattaccttgaaaaacactagcctccaagttttactatctctcatccttctcttggctggccctgcaataattaagttctttctttgctgcaatacctgctatactcaatgcattgacttttctgagcagcaggcaagattaacccatcaggctgctatacaaatacttcctgttaccttagtactcaaaacaatctatggtccctcttctcaacctttctttcttgattatttaatctctgttaccattcttacacttacttacttgcaataacataatacttactctttctgtaataacttgcaggttataattggatcatgagtgacctctccccaaattcatttatctcatcttaagcctaatgaatgaaaaaattatccataatgagagaaaacagcaggatccttttcataaagagatgtttgaaaacaagtatttttggaaataatatattaagatgcatatgtggctatatgaccgattctaatgtgtttaggccttgctaatatatcggtatgggacaatctccttcttaaaattgtcacactgtattgtttgcttcagtccaggatagcaggactttttgacctgaaaggaaaaggtaaggcaagggcagaggttggacccttgtcccttaggacaaagcaggcagatttacatcactgccttccaggaaatgacagcttacccccaaaagtaaagaaaaagtgtactttaaaaaatactagccaggtgtggcggctcacacctgtaatcccagcactttgggaggccgaggcaggcagattgcttgagctcaggtgttcaagaccagcctgagtaatatagtgaggcctcgtctctacaaaaaaaaaattttttttaaattagtgtgatggtgcaggcctatagtcacagctactcaggaggctgaggtggaagggtcacttgagtccagggggtcaaggctgcggtgagccatgattgtgccactgcctttcagcctgggtgacagaacaagaccccgtctcaaaaatatatatatgttttatacttctcactatagaaaagccatttaaagcattctgtgtagggggaataaagtgagacacaacctgagtattataatgagcactgaatttgtagtaaaaagagtaagtcagattcttgatttgcctcctgcaggctttgcactttgaaaaaattatttacattctctgggctttggatctcttgtttttaaaattcagagtttgaaccagatacccgcccacctcatacagcttgaaaactctacaagactcaagtttaaaacttctgcattccaataaaagttagaaccctaatcctcttgctacaggctagcaagatttctcgtatgaaaataatgacactgcaaatcagtacctgaggtctaccaaaacctcatgttgtcaaaaccaaattgtcatctaactatttgaaacccgccacaaccctttctcgtaccattaatgtcaaagcacaccctctgagcagaggcagcagtcactgttttttgttgttgttgttgtttttttctgagctttctcacatactaacagaggctttgatgcaaaatatagagcagtttccgacctaagggactttggaccaacagatatcatgctagccctaattttttctgtgggttttcacacgactgtgtgtgagaaaagcaagagatttcagatctaaacaagacccactatacgaactaatgaaaatattgggtgtgtggtctacaaaacagcctaaataagtacttctctctgaaagatccctttctccataggcctattcagattaatatctagttttcttcacattaaagtgtatatgacagttgtcatgataacttagtgaaaagtttagccaatagaatctatgtagcacttttaggcttctcctgctgtctgaattttttcttaattttctttctctcaaattcagcccacctaaagtttttgacagtctgtttaccaatcaggaaaagatttaattcttatttgtcttaaggcagacatccaggatggacagtgattatgggttcatggaatgttacaactggaagagtttataggattcatctggtccctcattttcctacttgtcaaatgaaaacaatcaccagggaatgtgttgaaaatatagatttttagtctccactccaacctgttgggtcagaatctcaacagacacaagagaatctgtacttttaacaatcataccatcaagcaaatttgagaaacgctgatataatcctatgattttattttgtaaagaggtttattttgattatacatggtcatatatgaaaaaaagaaaggatttcatagcctttcgtgaaagagttgactgcttcatatcagttataaaacataaattgaaaattattcctgaggttgaaacactcaacttgggcctctcaatttctgaaactcttgactttgatgatcgtaaaatgacaatgattattttatgttaattacagaagtcaccttccattctctcccaacctcaataacacctatagatgatatcaaatcgaggcatgtagagccacacactattttaaaaatgtagcattccttcatactcataaacattctcttaaccttaacatatgaaataatctccaaattctcacaaaaatgagtgcccacctgaactaaagtttttttacacctttaaaaatgtaattgtacagacgaaatcggtgtcataaggttactttcactaaaatagtatatccctctaaaaacaactttcacccatttgcaatcactggaaagtcatagaaggtgactagagtaactgatttctctcaagagcaaattcatgctctccaaaggagatcagggtctgtttagaaaactgaggtctaataatcaaggttgccacctggtagatctcatgttccacacatttggatgacttggctgatttcaggaatatgggaaaaatcagtttaacccaggctctctgaaccaatgtctcagatcaaactgatgacccccggacagcaaaaatgtgaccaaggtggaaggatcacttgagtccgggaggtcaaggctgcagtgagccatgattgtgtcgctgcctttcagcctgggtaacagaacaagaccccgtctcaaaatatatacatatgttgtatacttctcagtgtagaaaagccatttaaagcattctgtgtagggagaataaagtgagacacaacctgagtattataatgaacactgaatttgtactaaaaagaatcaggcttagccttcacttcacaacccaggttcacatgggtccttcctgtgcatcccaaggtcaggtttaaccacatcaacctcaaagccttccaaacagaaagcatttggaaacaacaccatctccccagatcattctacagtatgaagccgtgaaactgatggctctcggttcccctattcctggaacacaagtcttcagtttcagatttgggggaagagaaatcatcatagtatgacaattgggagaaaattacgtttttgttttcatatgtctccaaataaaatcccaatcatattttgtacaaaatttccatttttcattattaaaatttcattattttcaggcagccattgaaaaagattgtgccctaccagaatctggatatccttttgggcaacacacttttaacctctcttaggagatgttaatttgagtgagttttcaccattctatctactgcattcgtaaatttccctttttgattattctagtcatgtaacagtgagctcagcaaaacaaacacacgcacaactccaaagttctatgcttaatgtcagtgataaatttcaccaagtagctagaaaagcagctataataaagaatattctaattagtcttagaggcattatgtggcagaaaatatggaattttttttcttatgccgagtttgctaattgcccccaacaataggtgtgaatctcttttgttatacttgcagaaaatatataggtttgacttccatctgggacactctagagaaatgaaggagttgcataaaacttttaatgctgtgaacagctagacacaagttacatagctgctgaaatgaaactatacaacaatttctctatataaacacattctgaaaacacgttgggtaaatggagatattgttgccaccctagaattgatggtttccataaatatcagcatagcatccatactatcttttaattacaattttaaacctgcgaatataataccttgactcgatggtagtctcagagaatgtatgactatattttattccaccacatataaatttgtagaatagggtcttagtgcttagctctgtgagaactatctaactgtctgatgataaaagttgaggagttgtttctgtgaccaaatatgaacataagaccaattatctgcaaatactcctgtaaggtatatttccagtactgttttatgtttggcaggattgtggtggagaagaacagggagatgttctaagtgtttaaaattatttttacatcctagaatcaatgtcttcttaatatcatactctctggttggaaatcttcagaggacagacactcagtgaataacctttaactaatttccaacccatttgagtatgccaggaaaatagcatcttccaagttctagtctagttgttgtatctgtctgtgttgctttccggctgctatagcccagttaaattaccaagtgctgctgatcctttggagcttttcttaatcctcttttgacctctctaatttgaattattctgtgtcatcaacaaagatgtaacagttaggtctctgtgaaatcacaaactagaattgcaattagagtttcttaatcgttgtgcatattgtattgttgcatggggaaagaaagttttggaatttaattaaaagaaaggggaattgtcaatgtacttaatatgccattatattttttcttttaaaatatggagttaaagaaaagtttgattgtctttaatagttgcagttatctaccaatggggactactgaatacatatgctggggaaattcaatgtcaaggaataatgtatgcttgaggaaagtgtcattaaaaaagaatcagaggattagggattctctaagtttttaaaaatatatatattcttagttcttccggttctgggcccattcctttgtttgtagagttacaaaaaacatgattgtttggtagtaattttctttatccagctctttttttttttttttttggcaggtggtaaagtttattcttgtaatttcttgagaagcgtacagcatattttcatttagatgaagttcaaaaacaaaaataaactattaagtgagttagggctacaaaatgtggtcaactataaagaatatcaagggaaccataaacctgaaatctgggagagcagtttcatctgagtcaggaggaaataagtggatggaatcaggcggaagcacgtagcgtaaaagaaaaattgcaccagacactcattaaaaatggcagagagactttctttgaaacgattgtaatatggattaagactattgcagtaggggagagattgaactagactccattggcacaaaagactggaaagttttcaagcatgaagtgagccagagaacaggtactggaagatggtgggacgatgtgattaggccatctgcatttcctaattggcacttccagaatttaggctccttacccttccacagagactgagagactggggccctcccttcttgataacaacatttcaaagggatagctcccgggtccttaagaaaaacactcctgggctgtaaaaggtttacctctcaaagggcagagtaagaatttacaattgcaagttttctaatgtaagtgctctaagaaaagagaagtcaaaggcctagagtcaggaagaaagctgtctgaagtttagtcaagctgaaaggaacttaaagcctccttggtcaacagtaagcttcagtgataatgctgaagtcttgttttctaaaattaggtgggaagtccgctggtcattgtatcatgacaccttacaccttacacatactttaaacattttctttagtatttggtagaaacagaaatactacttaagtgctacttaatagaaagtaaatcaatagtattcaacagaagcagaaatgtatttaatagcactaaatagaagtattaatagcatccagtagatacagaaatgttcggcccagggtcagtggtgttgcccaggggaatagccttcctgggtaacatacgctgagattgctgagtggacaaggtatttccatgtgccgaatttacacagtgcacctctttcctttttcctggctgcactcggtctctctgaagtgaatggcagtatttttaccctcgatttactgaggaggagactcagtcagagaggacattaattgtttcttcctaatatcacaataaattctcattccctaaggctatgtcactccctagaactaagttatctacttagggaagatcattcgtcactgccaggtctccagggtaacatcaaggctttattgttgcaagtcgacaaatcgcctcccatctgtctgccctgactctgtgactgcagccgcgcggtgccctagatgtttccccagtggtctgaaagaattaatgtgcctccctaaacatctaacttaatgctagggaggggcttaggcaatgggggaaatccgcctggaagagatgttctggatgtcagtaggttgtgctaatctggctgtggtcatggctctattggggagacattgacagtccatctatgtctcactgaaagatctttgtgatatctacaggggcactggggaactaacatttcaagaaaataatagcgccagcaggtacagatggtgtctcagacaaagtttctgggctctccctgaagcttgacatcacatcagtgtgtgtgcaactctgcatgtggttggtgagtacaagggcaagagacagagagggtaggagtcagaccgaaggagctaccgtgctggagcccagtgaaaggtgccaggagaactcatggcctctctgctcagatctcaaaatcagaggaaatgacaaagaaccagaagaacaaaggagaagtgacatatgggaggagacacccaagggaaacgttcaaggtcccaacatgacaccttatttgcagaacatcccccaaaacaaagaaatcctctgcacttgttcagaggatttctgatcaacagcagccaacccacagaagcagcagcccttgggcgctaagcagaagagagaaccaatgaggagccattcacctcacctgctgacgcgaaggctgcttgccagttttaggggttttctatgttgatgagcactttggattgttctgagaaattccccctcaacacaaaacacactctttaatgaagagatcccatattcctggctcaaaaatttgacccttgaatcatttatatcatatcattttgttgtagtccatgaattcatgaaaggcacagagtgacccagggctggatatcagccaggttccacgcagacagagtgactgggatgactggatcccaacactcggtgactctcccattcaccaagctccctagtggtctagaataatacccagccacacacctagcgagggctcatagatcttaaaaagttaaagaactactgccactgagcagatttttcatgtctgtatctgcttgcctgccagatttccttcctcttccatctcattgctgaatttaaaaatacttctaagtctatatacattataattgggtaaaataagaaattcttcgtaatttagaagatgtatctctttcctgaagacttcctcctactccacccccaatctccagagacacatttttacccttaagatccttttttttcctttatttcttctaaaaaaaaaaaatgggatacatgttcagaacgtgcaggtttgttacataggttacatgtgccatggtggtttgctgcacctattgacccatcctctaagttcccttcctctacccgccactccacaaaggcccttgtgtgtgttattcgcctcactgtgtccctgtgttctcaatattcaactcttacttatgagtgagaacatgcttaatcctgagattctgagcaagacaacctcctttagagatgtctattgcttggaatgttttaatctgttagatttttgactgcacatattagctttaagaaattagaattgagcattaacatgttcagtttgttttcactattaatttctccataaattatgttagattgcattttttatagtatgtgcaagtgtatgtgcatatacgtatacacacagagagaggctttgagctaaggatggtggattgcccacatctgtttaaatctccctaccaggaaactagcagcaagcatattacttcttcttaccccctcctatattcctgccaaggagggaatttaaaaactctttcaaggagaaacaggtagccagtgatcatcaaacattagagaaagcattcaccgtgacagaggcaggaaaaagaaaattctaaaagaaaaactctagaataaacaaagacatagtaggaatcataaaaaaactgttaagtgagcaatgctgacatgcctgctcctggtaccattattagcagaaaagtagatacaaaatgctttgatataaatgagacatctatatctatcaggttaacatagagataaagtgaacagatgaatttcaagtgatagaatttcctgtgtgtagcacccacattagaggttataagaggataaaatttaaagtaaatttggaatcacccagtcttacgtcctcattatcagggctatggtttaattgttccccccaaagtgcatgtgttggaaggttgacccccaatgcagggatattgggaggttaagcctaatgggaggtgtttgggtcataagggcaccactctcatgaagggattgatgctgttatcttggaagtggattcatggtcttgggagtgtatttcttataaaagcatgagtttgaccccctcttgccttctgccatgttatgacacagcaagaaggtccttacgagatgccagcaccttgatcttgaacttctgtgctttataaattacccagtctcaggtattctgttacagcagcacaaaacagacgaagacagaaaatgggtaccagagagagcagtgttgctatagtaaatacctgaaaatgtagaagtagctttggaactgtataatgggtagaagcctggaaaatttggaggagtaggctgggaaaagcatgcattgctatgaacagaacatttagggtaattctgttgagggctcagaagagaagaaatataggggaagtagagattactaagttgttgtgatcagaatgttggtagaaatatggacaataaagggcattctgatgaagtctcagacagaaatgaggaatagcttattagaaactggagtaaaggccattcttgttataaattggcaaagaacttggctgaattgttcatgccctagggctttatggaaggcagaatttaagagtaatggactcggatatctggtggaagaaatttctaagcaaaatattgaaggagttgcatggttacttttaactgcatatagtaagattagagagaagagaaatgatttaaagacagaacttataattaaaaaagaagtagagcagaaagatttgggaaatctgtggcctggccatgtaatgaacagccatgtaaaggtgctgccaagcaaccctttaataaagggattagtacagctagaaagaagccaggtgctatttatcaagacagtgggagaattacccgaaggtgttttggagatctctgaggctctccctccatcacaagcccagagctctaggagggcagaatggtttcagaggagagtctcagagtgccctccttggtttctctgcccagggcggcctagggactctactccctgcattccagtgtagcagtcctcgaccactccagctgtggctcaagtgggcccaggtgcagctggtgctggtgctccagaaagtataagggtaatctttggtggtacctatatggtgcttattttgtaggcacacaaagtacattagctgtggggccatggtagcctctacctagatttcaaaggatgtgttggacagcctcagggcccaggcagagacatggtacagacagaagtcatagcagatttcccactatggcgatgcctggtggagccgtgggggtagggcaaaccccacaaccctgaccccagacctatagagctactagcatgtagccccagcctgggagagatgcaggtatgaaactccaacccatgagagctcctatgtgggctgaacccagcaaagctatacgggtgaggctgcctgagactttgagggcccaacctcaactccagtgtgttcagcacaagaagtcaaactttattctggagtcttaagatttagtgttcaccctgttggctttttggacttacctgagaccagctacccctttttccctgcttattcgtccttttcaaaatgggcatgtctatactatgcctgttttagttctaggattatattttggaagcacataacttgtttaacttcacaggctcatagctagagggaaatttgcctcaagtgaatcatgctgttagtctcaaccatttctaatttagataacattctggactttggactttgagttggggctgggatgagtgaagagtttagagtctattgagatagattgaatatattttgcatgtgagaaagacatgaatttggtggaccagggatgaaatgctataatttgaaactgttccccaaagttcatgtgttagaaacttgatccctaattcagcagtgttgggaggtggggcccagtgggaggtgtttggatcatggtggcactgccctcatgaaaatattagtgccattatcttagaagtgggctcatggtttctggggcgaattgcttataaaaggatgaatttggcctctcttgctctctcttgtgatgctttccatgtgatgcttttccaccatgttatgacacagcaagaaggccctcacaagacacggatgccttgatcttggatgtcccaggctccaaagggacgttttcattccaatggaatgaaaaacaattccattctttatacgttactgagtctcaggtattctgttataacagcacaaagtggactaagacgagcagttatgttatttacccataatcatataatatattagctgcagaatcaagtctagaattctgattcctaatttctagtcccatgtgatttctattacctaactccataaaatggatggaaatgtctgattctataaggaatctcaaagttccacagagtcaacatatagaacacataaagccaactttatgtgtttttttaaatgtaaatgtgactgatatctaatagctaaaaattcttatcaaatagctaattgttacataattagcacaagtggtaataattctaattactttctttcagattttagaagagctatgttgagaagatttgctaggcctctttaaaattttatcctaggaagttttaaatgggggctttacttttctcttgttaaattttccttaagctcagaatccagtattgcccactgatcaatattttcaaagatagatggcatagcactcaaacatttgaagacattactaaggccttgtcttgtgagttttcagaaagcagaagtcacttatatcttgctcccctcccccatcatctcaaactatgtcgaaatccttccaaaatggcaatcttcatgtaaagaattatttaaaaggagcagccattggcttctgacttaatataatggaaggaaattataaggcagatagtatgtgtatcagactgtctctgggccatgtccaatccgcagctgtgtgcccacttgttgcttctcttggtttgtaataaattttaatgggttacatctaggtcaataataaaaaataagcacaatgatcattcaattcactgaactctaagtctagctactagtgttccaactcgtataaaatctgtgttgaactataaatacagtagtccccccttgtccgtggttttgctttctgcaatttcagttacctgtggccaaccatggcttgaaaatatacagtattttgaaagagagagagaagaaccacataacataacttttattacaatatattgttattatttttctattttattattctcataatctcttactgtgcctcatttataaattaaagcttatcatagacatgtatgaataggaaaaaaacatagtatacacagatgattcttgatttacaatgttttgacttaaaaattttctcagctttacaatggtgggacagcgatccatgttctttgacttacagtagatttattgggatatgaccccattgtaagtggaggagtatcttttaggatttggtactacctgtggtttcaggcatctactgggagtcttggaacatatttcccatggataagggggaaactactgtacaattgtaggacttcagtatgtaattaggaaaagaaaaattaatttgttttcataaacaaatagatcattatagtttacatctgtaaacaatcatggtattcttctgtcaaaacctttccatatcttcttattagttacaaaatacaatctaaactatagagcatggtcttcaaggcaattcagtctgatgcctcaacctgtccatcaaccccatcaactgtattgtttcacttcaaccccagatgctaatcactccatatcatccagactgccttgaacgctgtatgcatttcatgaatctgtacctttcccaagctgcttccgcagttaaaattctctgatcctttgagactcagttcaagtatctatgatcctaggaaatctcttcaacaccccctctttgtcccctctcgtctcagcagaatccattgtttcttcttcattaaagttcccatagcatctaattctatttttatgaaagcatttctcagtcacaccttttttgccatttctgtttctgtttccctccccaaatggtgaatcactagaggaagtcaaggatcatcttatagtatccttgtgtctcaagagtttagtctacccctccacatgtttggtacccattaaatgtttctttaattggatttatgtaagagcttaagagtatttcccatgatttcatttgatgcccatagaaactccattaagcaggatggtaactgactccattaaagcaagtaatccaactgttttaggcttctccaaagagagagagagaagcaataggatggatggatagatggatggatggatggatggatggatggatggatggatggatggatagatagataaggaatttattaggggaattggctcatacaattatgaaagctaagtcccacaacaggccctctttttgttaaatcctttttgtattagttaagggcctccagagagacagaaccaatagaagatatacatctgtatctgtacatatgagaagagatttattaggagaattggctcatgcaattgggaggttgagaaatcctacgctaggctctctgcaagctggagaaccagggaagctggtagcatggctcagtctaatctgaaggcctcagaaccgggaaaattattggtgtaactcttagtctgaggctgaaggcctgagaacccaggtggccattatgcaagttcaagtccaaaggccagacagcctggagttctgatggccaaggacaggagaaggagagtgtcagcgctctgggagagacaaaaaaagaatttgtcttctgccttttgttatctctgggacctcagcaaattggatcatgcctgcccacatgagggaggatcttcctcactcagtccaccaattcacaccccaatctcctctggaaagacccttgcagacacacccagaaataatttttaccaactctccaggtatttcttaatccagtcaagctgactccttaatttaaccatcacagcaactgggcaccaaaaacagattagtgatttacctccaggtcatgtggtcagtcaatggcaggaccagtaccaacccctaggttttccaatcctccatcgcatactttgcaccatcgttgctcagcacctactgagaagtggggacatggtaaagagctaaggatgcttgcaacccaatattcatgtcacttcttgaggtttcagcagctttttcatgcatgcattggctccatggtcacatacaagaaccctctgctttctcatctaagagtttcagagatgccaaagtaacaggattgaggctgaacaatcaccttcatttctaatgtttttcctcacaaaccaattcagaaattcagaaaacatcttactatagtagttgtttcctgaattactaaatggaagctttattaggaagtattctctgttctttctaccaaggcagctttgttccttgggcataaacaaaactatcccttctctctctaaattgaccacagagccaaccttatataaattagaacttgttagttttggcttcagatgccggctctttctcttgaggttttcacctacttaaaattcacttgttgccctttaaattcacatctagcttaaggcaaatgtttgaatttctaaaataaaaccatgtgcccaaaataagcttagggaaaaaataactgaaataaatggaaaattctccaaaataagcaaaagcattaaaatgataatgctttaactttctgaactaaactgaaaataatgtatgctcaagataagcttacaaccacggagagatctctcttctacaaagccttaaagaaaaagcaggaaattacctcagatgaaacttcattacatggcatttccattcccaggatccatcctcagacacgttgacttaattgctctggaaaagagccccagcatcaatatttttcaactttctaggtggttctaatgtcggtcacaatcaagaaatgacatgaacaatattctgaatcatttcagtagatgttgactgcatgactgtgctttctaccagtcctatcccacaccccgcctttttcctaaaataggtatgcatgcagtgtgtgctctgcacacatgcacatacacaaacacacacacagtttcattcatttgtatattcattcaatcaataagttgaattttgccttcgtgcaaggaaccatgactatcagcacaaacaagaaactattcctgaccccaagagattcccagtctaggtgtggagaatatgaagcacagaaatgggaacaactctaggtaggaaatggaaagagagcaaatttttttttttaagaggcagctgggcacagtggctcacacctgtaatcccagcactttgggatgctgaggcaggaggatcattggaggcaaaatcaagtgtacctaacagttttagaaaattgtacatcgtatacttccactttccatcgtgacttctgttcatagtttatagatgtacaacataaagacataattcctaaataaacaaagcttctgtgaaagcataatgtgactctgcaggcctgctggcctgtcttattattgatctgaaaacaagattgacactactgtgattattctttagtgggaagggacattcatacttatttagccattgctatgctttcaggcaaatcaacccctcagtaactccaggcaaatgaatataggcctttcataaaaagtgtcttggagagaaagcccacaactgcaattaacaggaaatagctgatgcagtgtgacagcaagtccccaaacccttaatggaaggattgactgtcatgtgcatggagatgtggttagagaggaaataagttactgggttttgtaaggcaccaacttgaaaaacatgaaaagctgtggcaggccacaaacatggagcccatttggagtagaggcaggcaagtagaacggagaaccgtggcatttcaaccctagattaatctgagtgtcgcttttgctgccactacttaacaagagtagctgtagagagtgaaacatttttcctaaaatgtcatattttctctggtagctcctgttttcttctttgtatcacattatagctccacaaagttcatgcaaatgcataactaaattttgattatgagaggtctcagaatgcaacttgtttatgggaagaatatcattagtatagtttcaggcaattccttgcaaactatccccagtttaaaacagtcacaccttagtcaacaagcatctattgagcaacccactttcgacctggcattatggtaggtgcaaaggctaaaaaaaggtagaatgagatagaacctccacggaatatatacaataacaaattatttttttaaaaaactggatataacttgagaaactcttctgtacaggcattctggagtgagctgcaatccatcattattcagaaatgcattcatgcattacacctttgtcaagccaagttccaggttctgtgcttggtgctgggaagattgaaaggtcagctgaagttacagaaggccacgatgccagcacagctgctgcctactctttcgcctgatttatttctgttatttcttttacaattgtgattaaaaaaacacataacaccaaattgacgatcttaaccatttttaagcacaagcagagtcacgttcagtgactccacttcagtcaagttcagtagcattaagtagagtcacgtttacgtgcatctggtctccacaactctttcatcttgcaaacccaaactctataccatgaagtatccaaagtactcatatgtatcaaaacagagagtaggtggttgccaggttgccagggcatggtggagggggaagggaggagttgttgcctgatttctttttaaagctcagtcttccctttggcttctggttctaagcgtgttagcatcacggccccttttcattatcctaaaggacagacccagccctggttctgcaggtgctgaattctacttgactccaaagaggctcagcctctacctgcacccaggttctgctaacttggtctaccctctgttgtttttcctctctgttttgttcccatttgtaagatctctgccaaacttacttatttgctgcttttcacagacactagaccataccacctcctgggtattcacgatccatgcctggcccagctgactgttctcttattccaggctgttcgctgtttacctcgtccctcttcagcatcctcaatatgcctgcataatgcatatccatttttctccccaaattaaaagctatggccactgtatgttgaaaaatgcttaaaaccccacctaaacattccaggaagcaggaagccatgaatgactttaaaccaagaacagtctcaaaaatgttgtggtttccagtatgtgagtctcggacttcagcatattgctgttcatatgccacacaaatgttctgtaaagtcccattgagaattatgtgcaaatttaaatgctctccagacaatttcaaatatcagctttgatgcaagacttcacctgctaaaagcatctctttatggtttgacactacatctctgacattttgacgtgatacatattccatcagcctgatacattgccacctcccagtgagtcacagtgtcactaactcagaattaaatatgttgctaaaccactttacagcccttgcaaagcacataaaggctgtttgacaattacccccaggaaggcaaataatcagtacacctctgattctcttattattaaccattataaaatcatgtgctgtgatcaaggtgtgtaacaaagacattgatttttataagactacccaggaagcaaatacatattcttgatatacgaaacacacaggaggcctcttcattttcctttgtgtctttaatttgctcagagctgctcctcatacagcactggctttcacctgtcaagctaaggctttaattactgagttatggaaaaatcattgccaattgccttaactacaataataaagaatatcttacaaaggataagaaatcttttttcttcggctctgtagttaaaagactagttctagttttaatctgaacttttctatttctctccctatatttccctttcttcctattttaattgctggttagataattaagtaggtacctgacctgcaccaaatgtgcttgggaaagtctctcgtattttcgttttgctttgttttgtttctgcatgccattgaaacccctgtgttaattattctttccttacttgaagtatcttatacaacctttcttcaccagtatccttttcactaggccaaatacttattttggagtctcaaggatgattttctaaatcttttcataaccgcttttagcccttactcagttttattgtgcctgcccctcattgcacaaagggatatatttgactattccatggcatatttgactttgtaattcgtaaattatttttcatgtcttacatggttaaagatacgtttcacttgagcttgtaacagacataaaaatgacccatggtaaacctgtcgtattagaaaatcaaacaaaaagcataaggagataacacggtaaaaatgaaaagagtacaagctttagacccgtgtggatccgagttcatatctaacttggccaactaatagcttgttaattatgttaccttaggttgtattttttttttttttttttctaatttagtctcggggtctccgtgttctagctccgacccaagggggttcccgggacgtggttgtggatgttcagtgtgcctttaactggatacttctttatcctggcagacggcctgatgcccaggtgtgacttgtggccaggtgtcccacaaacaggaaaacctgtttacactggcagatggccttgtggcgtgctatagtctgaatgtctctatcctcctaaaatccgtaaattgaaacctcattcctaacgtgatggtgttaataagtggggcctttgggagatgattaggtaatgagggcagagccttcatgaacaggattagtgcccagacaaaagaggcccaaggaagcttgtccacctttgtgccatgtgaggacactgctggaaggcaccatctatgaagcagagagtcggccctcatcagacaccaaatctactgctacctctgtctcgggcttcccagcctccagaactgtaagcaatctgctgttgttgttgtttacaaattacccagtctaagatattttttatggcagcccaaacagactgagacatggcttttgtctgctctgtgtctagtgtatgttttgttttggttcggttttaagtttgtttggtttttggtttttggtttcgctttgtttttgtagacaacatcttactatgttgcccagactggtcttaaactcctagactcaagcaatccttcgcctcagcctctcaaagtgctgagatgacaggcgggagccaccacgcccagccaccctgtgtctagcttattcctaccaagagaatcactctctgtgaaagctctgagcagaaggagagttaggttcgcgtgtgttgctcaggtgagacaaagaggagatcatacagcaaaacacatgaaataacagaagcagcgtttgactcacagatccagagcagagagggcagcctgcctctcagggccaacaggaaaggggagctgtcctggacacgcaggctccaccagtgtggggagcaaaagagatcacaagagacctcagggcctaagactttgttggggtctcaggagttacccaagcaggtttcctgctgagagttctaatgggggtgggtggtggggggcgttacagcaacaattaccagtttcatggagccacactgtgcctgagcggtagtaactgtggcatctccatgcagtccatgcagcgggaggggtcttgggcgtgagtcaggtaggttgtattgagctgtcccctggggaggtgggcactagcagatacctggattgaccgccttgaggagctaggaggaagcagagaactagaaatcatgtcaagattcactaagccctgcatctgctatgagaaagtccaacttacaatcaaaatggatgcccaggcaacataaaattgtaagatttcgctacgccttaggcaatgaaacttggctgccttccagtgaatatttactgagcgtctagcttatttgagaaaccataatagacactacagggactgcgaagaatgggaaataaaccaattacacaatcacccacatagcagcgatacaaggccagccatatcaaacaacccaacagataaacagttcatatgttatatggtgtcagaagtaagacacatcaaaaaatggtaaaatacgtttgatactactgtccttataaaatcaccaaccataggaaaaatgatttttattaatgacagggatataatgaaaatagtttatgtgtgaaaacacataagtaattacataatacattatgatcaaaattagatacagcattgctgggcaagacctttttctcctctaatgctgtccttcaatattattaccaaaatatagcaccagtttttgtttttgtttgaggcagggtctcactctgttgcccaggctggaatgcagtaatatgatcatggctcactgcagcctcaacctcctgggctcaagtagtcctcccatttcagccttccaaagtgctgggattacactcgtgagccattgtgcccagccagtacctggttcttaattaactatatgaaaggcaaaatctgttttgctgctgagcaattatagtactatgcattatgtgtgtgtgtgtatgagtgtgtgtataacatgtagtttatatccatatataaactacatatagtttatatttaattgagtgtagacaatttataggttataatatctttagttataacattcacatgggtgtaattttttatactattctaatttatcattcctttctgttttaccttcaactctggttgaagtaatgtagttactatctgttttccgagttagacttccacttttcctctctggctacctgacaccccaagctagtgtaggtggctatatcattgcctggaattgaagtttttaagcctctgataattcagtctgtagaagctacccagctcaagaacaaaggggaaattacatatttcataacatgcttcaacatgaatgcatttaattagtatttataaatttgaatcaaaatgcaggaaatattctaaaaatataatttctctagaagagttatataatctctattaatgtaggccaactgcttctgtttcaaacacagaagaatgttcttcaatttttcatttgtgaaactgaatagtctcttctgaaagagtatatagtatttttccttttgggaatacaaaagcttttacaaaatgattatactaatcatcagatataagagtagtaccaattctctacctagaatagctgttaaccatggcacttggtgaattgggaatagacttaaatgatgcttctccttgggcccccacctccccaactcctacctttctcgaaaccaggctatttctctccaaatctcctttccttttgattcttcagttcgtgctacatgataactacttgccattggtcattaattatggtcgacgctcattattcacaggagtatgacccataaaatcactgcaaacactgaataagttaatactgaaccattgcccctagagggaattcagggttaagttcctgcaagcctctggtcacagtatattcatcaacctatcaatacataacgttattttatgcatgtttctgctttaagacatcttacttaacatatgtttttgattcattaacactgaactcatggccaacagctctataactaatgtctgaaaaaagcttatctaataggcatgttttccccataaggcacatcacagccttcttgtgcttaggaacactggacgacactcaacactgcgcttgggggccatttgaaacagtaatatcaccaataaaaaaaaagcacaaaaatgtcagggggaaatgtggcagtaaataggctgtgaaaaagacatttgtttgcagtatgagctaaaagaaggcagggcatcaccttgttctacatcagtagggatcatgagtgttatgccactcaatttttttgccagcctgtgtgtacacgtgtcctcaaatgaccatgaaagcactgcaagtatagatttggggattacaaataaatttcaacaagtagatgagtttgcaaacatggaatccgcaaataattactgttgactacaccatccttttgaacaaaaataaaagccacaattcaacttgagattggttatagatggcaactggcatttagtgagcacctgctatgagctgggtgccttacttttttttttgttttgagacagagtctcgctttgtcgcccagtctggagtgcagtggcaccatctcagctcactgcaagctccacctcccaggttcacgccattctcctgcctcagcctccccagtagctgggactacaggtgcctgccaccatgcccagctaatttttttttttttttagtagagacggggtttcaccctgtgagccaggatggtctcaatctcctgacctcgtgatccgcccgcctcggcctcccaaagtgctgggattacaggcgtgagccaccacacccagccactgggtgccttacttttagtaacacattgacctgggatgtgatcaactcgagaaccacatcactgtcatgtagctgcatggagctgtatcactcaacttctgggggcttatgtttcataacaattatcttttataaatgttcaatttaaaaatgaaaaacttccccaccccaatcaccacctcctttccccctctcccttccctttaatgaaccatctaagggaaggacatgtgtgcttctttgacatttcttcacagaatccagtccaatggcagggaggctgggtgagggtcagtgtcagcctagccagtagggaatccatggagctggggcatgtcaggggagtgtctcttactgagaactctgggtcctcttggatcaaagaatgtgcaaattgagctaagagatagaggggaattcgagaagatcacctaaaatgggcaaacaggaggaagctagatccaggtagcctgggagtcaagaacagtgagccctgtgtgagctaaaaaaccagaagcaaaccttggccaatggctggagctggtgtttttgctcaagcctggctttcatgggctccccttgatgtgagtctcagagtagggctggttaagtggccaggacctgagaaataaaatctcccttatatactcttgagagaacaagtctaacatatcagtaaggtaatagctataaaaatgtggctaggccgggcgtggtggctcgtgcctgtaatcccagcactttgggaggccgaggctggtggatcacctgaggtctggagtttgagaccagactggccaacatggtgaaaccccatctctactaaaaatacaaaaaaaattagccaggtgtagtggtaggtgcctgtaatcccagctactcgggatcctgaggcagaagaatcacttgaacccaagaggcagaggttgcagagagctaagatcatgccattgcactgcagcctgggcgacaagagcaaaactccgtctcaaaaaatagaaaaaataagtggctaagtcagtagtgaaactacgaagctaacttattacatttttcaccttttgaactttcaaacttgagtcatttatggacatctttgaagggaacagttattataaactctcactgttgacctaattaacattataatgtcaattatatatgtatagaaagaattctagatatacactcctgctaatatatttctaagattttttaatgttttatgatatacaaatttggatataagaaaaattataaaaccaacaaaattaaaactagtaaagtgaatgtaacgagataggctgtatagttcacaccacacaatgtcgtttagtcgacagtggaccgcacagataacagcagttccataagattatagaggagctgaacatttcctatgcctagtaacatcacagctgttgttaaggtcctatcacaacacattactcctatgtttgtgatgacactggtgtaaacaaacctactgcactgccaggcatatagaagtgtagcttatacaattatgtacagtaatacttgataatgataatatttgactatgttactggtttatgtatttgctatattatattatacattttatcattcaagtgtattccttctacttattttaaaaaatttgctgtgaaacaggcagggtacagtggctcatgcctgtaatcccagcactttgggaggccgaggcaggtggatcacctgaggtcaggaggttgagaccagcctggttaacatgcagaagcctcatctccatgaaaaatacaaaaattagccaggcatagtggttcaccctatgatcccagctactcggaaggctgaggcagaagaatcacttgagcccgggaggcagtttgcagtaagccaagatcgcgccactgcactccagcctgggtgacagaacaagactctatctcaaacaaaccgaaacattaagtgtgaaacaacctcagcaggtccttcaggagggattccagaagaaggcattgttaccataggagctggcagctctgtgtgtgtcactgcccctgaagacctcgcagtaggacaaggtgtggaggtggaagacagtgatattgatattcctgaccctgttaggcctaggctaatgtgtgtgtttgtgtcttagtttttacaacaaatatttaaagtacaaaaatgaaaaaattcaaagtagaagaaaaggctgatagaataggatataaagaaaaaatatttttgtatggctgtacaatgtgcttgtgttttaagctgtgttatcacaaaagagtaaaaaagttaaaagaaattaaaagtttagaaagtaaaaaaagttacagtaaactaatgtgtattaaagaaaagtatttttttacaaatttagtgaagcctaagtatacagtattttttaagtcaacattagtgtacagtaatgttctaggccttcacgttcactctccactcactcactgactcacccacagcaacttccagtcctgcaagctccattcatgataagtgccctatacaggtgtgccattctttttatcttttactctgtatttttactgtactttttctatgtttagatatatttagatacacaaataccattgtgttacaactgtctacagtatttagtacaataacatgctgtacagatttgtagcctgggagcaacgggccatagcatatagcctaggtatgtagtaggctatacagtggcagtttgtgaagtgcattctgtgatgtttgcatgacaacaaaattgcctagagacacactcctcagaatacatctccatcgttcaggctcagcaatgcatgactgtattagtaaactaaatttccactttcaatgagaattttttcagtgtagcttgttttgagttcattttgcctatacactataagtttgtgataattcaattttgctactacttttttctaatcaaactactatcaaatctccacccacagagcatacttttatgtaatttgctttcacttgggccaaatatcatttttgtattaagttggcctatgttcttttctcaataggtaaccaaaattaaagcagtagcatttggcagcaattacaaacagaaatgagagcatttatgtcctggcgggagttggttgttaagtggccatccggaagttatgcaatatgttttctttctcttttcttttctgtttttttttttaagattgctattgaaatgaaaacagaaactgcaccaactgatgttaaagataaatacaaagccatcgtaattaaaagagtatgtcacaaatgcaagaataggcagaaggatcactggaactgattagaatgtcagaatactgtttacataagaagtagtgcatactgaaactggcaatttaaatgaacggggatcctgcagtgtaaaactctgaaataaacaaacaaataaataaacagggatgaagacaaattttgctaagaaaattatgtgactatactttaaaaaatagtttctattttacgttagatgctaaaatgaattccaaagaattacagacttcaatgtgcaaagaggaagaatgcatagaaaagtgatactaaaagcaattcagtatttttctgttctctaaattttaaaaagcccttgtggctgggcacagtggctcacgcctgtaatcccagcagtttgggaggccgaggcgggtggatcacgaggtcaggagatggagaccatcctggctaacacggtgaaaccctgtctctactaaaaatacaaaaaattagccgggcgtggtggcaggtgcctgtagtcccagctgctcgggaggctgaggcaggagaatggggtgaacccaggaggcggagcttgcagtgagctgagatcgcaccactgcactccagcctgggcgacagacagagccagactccgtctccaaaaaaaaaaaaaaaagcccttgtaagcataaatacaaaggaaacttggtagatatggcaacataacaattaaaagttcatgtaagtacaaaaatcaacaaattaaaaactgagaaactggaaaaatatttgcaatacattgatataaaaatcataatatgtttttaaaaacttttaaaaactagcaacaaaaagtaaaagatgaacaaccaggtgatggaaaaaaaaaaaaaagatccagaattgttcagtaaaggtgtaaaaagtgtttccaatcaaagaaatacaaactgaaacaagaatataatattttattttggttttggttttgtttaataagcagaaaatggtgaggcatttttgacaagcaattttgcaagacagatcaataatctttaaaacgtatgtagttcttgagcaaggattttcacctctaaaattatatttcaaagaaataattgtagaccacatgcaagattttttttacagattatttgtcataaagttatatataattgtgaaaaatgcaaatcaatgatatctgtcacccagaaaggaaggaaatggttaaatacatttaagtttagccgtataacagtattccttaaaaataagtctcctaggccaggcacagtggctcacgcctataacccagcactttgagaggccaaggtgagcggattacttgaggtcgggagtttgagaccaggctggccaatatggtgaaacctcatatctagtaaaaatacaaaaattagctgggcatagtggcgcacgcctgtagtcccagctactcgggaggctgagccaggagaatcgcttgaaaccaggaggcagaaatttcagtgagcctaaatcacgccactgcactctaggctgggtgacagagctagactccgtctcaaaaaaacaagaaacatcacctaaaaaaaagtctttgaagactattaacatggaagcatgataatggtataattttaataagaaattatgatagaacactgatagaatattatcccagttttacaattccacatgtatttacatgtacctgggaaaattataatgaaaatgttaacacatttttttcttgtcagtaagtgcaggggaaccttacattttctttatggttttctgattattccaaatattgtaaaatacacattattcatatacttttaaaatgtggatcttaactgttttcctttaatctgctatcttacctttttaaatctaggaaatgtatgtatctcaaaatggtaaaactgaatatttaatattctagaaattaatgttttataaatcttaattttcttctcagtaatattgtataattttaaatattggcagattgtcagctatggctgtgcctatttaaagccaaaactcctgccaattttgtgaaaacttacgctcattatctagatttttgtttgtagtacgataaatattttcaccgtactttacctgctttggcaaaagatagatggcagaagaaggagctgattaaataaccaataaatacaagagaaaatctgggacattttttgcttttattattactttttataccattatgctggtaaattatttataatattatgattatgctaggattatagaacgaaaggtaataagttttatggattgtcagtaataataattactgtaaattgtcttttaaaataatgaaggctaaaatacttaggtattgagagtgttttcttcttgctactctgtgatgtatcgttgcagcaggctgagataatggaaaaggctgagagctacaagccaaaaagactgggtgttgagtctctaattccacttcttttttttttttttttttcaagacagagtctagctctgtcgcccaggctggagtgcagtggtgtggtctcagctcactgcaaactctgcctcccgggttcacgccattctcctgcctcagcctccagagtagctgggactacaggtacccgccaccacacccggctaattttttgtatttttagtagagacagggtttcaccgtgttagccaggatgttcttgatctcctgacctcgtgatccacccgcctcggcctcccatagtgctgggattacaggcgtgagccactgcgcccggctaattccacttcttattagctctgggattgtggacaatttctctaggcagagcttcctcgtctgtaaaatatgaatgagtctaatatgtatgcatctagtaatctgatttaatcacaaaatgggactagactatacagtccttaaagaatctatcactatgacttctctcagtggcctttttttttttttttttttttttttacagagctggataataaagagcttagaattttattcctgaaaggcaactagagtgctaggcattctgggtttctgatagaagacatgcacataagctttagcaaacactcagaactctatgctccctaactacaacttcgccagagtgcagaggccaactcttttcctttaaaaaactaactccaggatgtgttcacatggtcaataagatctatagttctttgctgatcatcccctgggaaacttttaaaatgaagtctgacacattacaaaccatgcacagaaacaaacaatatcagtaaaactctcaagtaatgcgtggttttgagccatgtagagtccaggtaagccttccaagcttggttaggtgcaaaacatactttctccagtatgtaaattaataggaatctttttttttttttttttctgagatggagtctcactctgtcagccaggctggagtgtagtaccacaatctctgctcactgcaacctcttcctccctggttcaagcgattctcctgcctcagcctcccaagtagctgggattacaagtggacaccaccacgcctggctaatttttttgtatttttagtagagacgggttttaccatgttggccaggttggtctcaaactcctgacctcaggtgatctgcctgcctcggcctcccaaagtgctgggattataggtgtgagccaccatgcccagcctataaataggcatctttgatggccttttaaaacaaccagactttgtaggctatctgcaaaagataatagtttgaaattttaatatttatttaaatagtcctcctgatggtaactgatcactaacttttgaagtgcgttgggttggactcagtaaaaatctcagcaatagcttataggaaattattcttctgttttctaaggcaggaggctatgcacccgtgtcatctaaaagagtggcccatggtgctatggagcaagccaaatcttcattgcagtccagttctgtcatttaccaaatctgtgacctccagagagctgttttattaatctacccctcagcttcttcatctgtaaaatgggacaatgatagcccttctcttccagattaggcacctaatgcagaacctagtgagatctaaatatatattagctacatctattattatgtttataaagacaaaggataaatggtagtcctgttttgtcccactcaaagctgttctctgagccacaaaaagactgtttcagctgcatgccaagttaacacattgcagttaagaaggaaaagcattgcagttaagaaggaaaagcattgcagtagagactagtccgtgaacatctttgtcctcaccattcctatcgccttcttttaaatgaaggaggcagtgggtttcttatattttggtccccatgattttgcaatttatagccttgataacctggccacagctaattaagccaaggttcggggctcattccttaggccgtgatgtgcaacttggcctgtaccctctaacatggcttctcatgagaactctacctaacagaaagttctgtgttgaatagcgatgaacggattcactccaaccttctctcagtgactttgaataaaagatatgcagactgtatagcagcctaaagagtgggctctgttccctcgcaaattttagcatactcattgagaagggagggagctttggggagacagtgagagaagagaatttaaacattgtgggcaatttcttctgcccttccatttgctgtggaattttccagccattttatgttctgtggatttttcatgcttgatatggttggtttctgggatgtgtttcagtcaacattgacccaaaaaccatgcagtcagttttctgtctaaaagccaaagctgtaacctcactgatattgcagaaatgtttctatcactttctgacccctaaaagtgcatgtctcttagatcatagctttgctggtatcaagattacatttttaacagtataaaccttttacatatgcagtagcaattagaatgctctccccaagaggaggacattctctgaaatcccaagtaggagtgaacccagagtagcatagcatatctgctaacttgattccatctgtctttgttgcaacatgctcactgagcatatgcccctaaatgaatatgagatgaagacaggatctgtggtccctcccgcaacattgatggggtaagtttttttgctaggctgagtgtggttcaaatatttttgtacaatatatatcctaaacacaaacaactacttcgtctgttgcccacccaaaaatatgctgatctgttttgtgctgaagtatgatcgttcgtgttggcgtccttgagaagtaatgggataaggtacttgaagggcgatttaagagctttccagagcagcccttggcttttcttaattttccagttttgcaacaacttttagagcccaatcctcatgtaagctttggatccactggaattaaaagctcagactttatagacaaacagacctgggtttgaatcctatttccatcacttgcctttaggaaagttgctcaacttttctgagtcttcattttctcatctgtgcccaccctcttattgcagtgaggcttgagtggtattcacagccctcggtgcagtcacttccatacataagagccactgttgttgttaacatagtttagaagttaagagagtcacaggcgtcgtaaaccctcagatagtaccagtcatgaggaagcagaattcactaagcggtgggtaggagggtgcacaagtagccaggtatacaagtagccgggagctgctgagtgtcccaggtctccatgaggatcaatcgctcaatagcttggatagtctgcgtgtggataacacatcagcaaggaatagagacaacgccttaaaacagactttcagcatttctggtgtcgaaaggtcctaacatgaggtctcactaaattcgagatttcatcagcctgagaagaactcagggtaaaataagagtagtaatacacaccccttttaacctgggttagaatgcgtttatgagtgtgaggtgatcttcaagtataaagccctatgtggatgtaacatgatagcagattataaatattaatagcattttaagtcaaagataactatttagaattgtgaataatagagaagaaagactgtgggcatcactgtacctcctaccctcagttaaaacttactgaaggaactgaaggttaaacattcttgataaccattgtatttctgcagtgtctcagaagtattactagaagacaagcatgggatttagagttaaactaaccttgggttcaaatcataatgctgccactccttgactgtgtgatggtggagaagttatttcacttctctaagcttcaaattctctatcagaaatgttttttctgtagctatctgcttaggaacaaagagaaaggcagcttcctgcatgactcagcttccagcttattattattattattattattattattattattattgttattatttgcttttgacaaagtgaactgaggtcccaagtttttatttccctttcacagagtcaagtttattggtataatcctgctaagaagtacttaaaacaaaaactagctattcacaaacaagtcaaatatataccctctagagtgtgttgataacgtgacttagtacatgaagagagagcatggtgttcaattgtgcaggtcaggtgaagctagtctttcatgcctcatcacaagtagcagatttccattaagaattggcaagctctcaaagctcagactctcccagagcagagcaaacaggcagatgcgaatacatgcctatcccagcagcatctgtttatgccagtggggagaaaccatcccctccacacacggttaaacaagtcagtgtgcagcctacctccagggcccttctcgttttgcctgggaatgtcctgggtggcttgtaggagatgaggatgcagcttggggcagccaaacctggggcatttcagaggcagagtataattcatgtggcaatacctggctctttatggcccgtagttttacacctaccatcctctgcacacagaaaactttaggcagaaatggagcatgcacaaccaggtctgcatatccgagagtggtcatttccttgcaaggcgtgtcgcttgactgaggggactagggggctgcagaggggctggcagatgtttggcttttggtgcagatatgagccaaataaattgaaaataggaagaaggagtacatgacctcacccaaattttaattcccatagaatagttttttgtttgtttgtttttagcgttgtatgcctaatagggtaaatgttattcaaaaaatagcccaggtgttagaaagacaaaatagttgttacctttagggaaatggttgtgaacaaaaggggcacacagggggtgtctgggccactaataatgttctgtttcttgatgtggattcgagttacatgggtgtgtcactttatgaaaattcatcaagggccatcaagggctcggtggctcatgcctgtaatcccagcattttgggaggccaaggtaggcggatcacttgaggtcaggaattcgagaccaacctggccaatgtgatgaaacccaatctctaccaaaaaaataaaaaataaaaattagctgggcgtggtggtacactgctgtagtcccagctgcttgggaggctgaggtgggagaatcacttgaacccaagacgtggaggttgcagtaagtggagatcatgccactgaactccagcatgggtgacagagtgagaccccatctcaaaaagaaaacaaaaacaaaaggtctggcacggtggctcacacctataatcccagcacttttggaggctgagcagactaggatcacctgaggtcaggagttcgagaccagcctgaccaacatggtgaaaccccttctctactaaaaatacaaaattatccgggtgtggtggtgcatgcctgtaatcccagctactctggctgaggcaggaaaatcgcttgaacccgggagagggaggttgcagtgagctgagacggtgccccattgcactccagcctgggcagcaagagcaaaactctgtctcaaaaaaaaaaaaaaaaagaaagaaagaaagaaaattcatcatgctgtatacttataatctgagtatttttcttcatgtaggttattaaaaaacagcagaaatattcttctctcaaaagaaatttctatattttaaaatatgcatatttatactatacatatatttatatttaaattatatatatatatttagtaaggaggggaatacatataacttgatacaaagtctgcactaagttagaatatatctaatgcaaattaatacttgagtgcatattaagatatatcaaaatttaaaaattggtcaaggtttttaagtgctttgacagttacagtaaggtaaggttctacataaaataacatgagtattgtcagcttccaccttacatttccaggaatagtcatttttcatgcattcattatattcttttcagcatcatttgcagagtttttgaacttctaagctgtaccacacagaaatgccataacactcattttgactatttcaacaaagtattataactaagccattaattgatccactagctttgctgttgggaaaatttacttattttgtaaatacagccacattgacttttaaagtcatctaaataagcttgttattaaataaaaatgttttgaaccttaaaactgctttaaatgattttaaataaatggtttatatttttttctcagtagtaataatttttctgaagtatttgcttattgtttttaagtgatttctttatacatatatatgtatatttacatactatgtgtatatattaggcaatattaaatgacctgaagcttttgatcaattctaatagaacagacaattgcaattctaaattagctctcataaaatggaacattttgcaagtagctaataaatatttgttgatcaatagttataccttgaatcctttatctattagaattttccagacaacaaactcatattgtttctcctttaggttcatttggatgtatcaacatagtaactcttgttacaaaaatattttaagtttaaaatcaattatttggttaaattctgtatgcatattttaatagttaatagacaaggtaaaatcagctcacttccatgtgttcaatatttattgcttgaaaattaaggcttataaattagagtatgctaactatgcctttttgttatagatcctcagcgctgttggttgtattatggaatagttaagtataggctctgctctccagacaccaaaggtttaactcagctctgtctttcaccaggcttgagcaccaaaggggaagtcagagaaaaagtaacagcaagtgaaataaaaatagaattctcaaaagcaatagttgaaagacaagaccacagaatggtatgatcaaagtgttgagagaaagagaaacagaaattgagagtttgagaccaaaaggtttttcattaaagcaatctctaaaggatttacttaatttttttaaataaaagaaacccagaagaaatgtctgaggtgtaagaagtattgatcaaagacattaatgaagatataggttaaaggtttttaaaactgtgtaataaaatattaacatcaaaattaatgtgttttaaaaaggagtaaatgaaacaattaaaaatgaagtctgttagaaagagaataatcaaaattacagttttttaagatccttgtattttaagaggatttaaaagagtgattaactttagactttcttaagtatgtaagatagaattccaaagtgcccactttttaaattttttattatttattttttgagacagactgtcattctgtcacccatgctgtagtgcagtggcatgatcttggctcagtgcaacctccacctcccaggttcaagtgagtctcctgcctcagtttcccaagtagctgggactacaggtgcacgccatcacgcctggctaattttttgtatttttagtagagacgaggtttcaccatgtcggccaggcctatctcaaagtcctgatctcaagtgatccacctgcctcgccctcccaaaatactgtgattacaggtgtgagccaccacacccagccttcaaagtgcccacttaatattaaataatatataacttcaaaaccagaatgggggaggaaatggattaagaaaacaaatataaatcatctattcagaaagactaaacaatataagacaataggaacaagtctgtctttcttgcttttacatgtgtgcatgtgtgtgtgtagtctagatacctagatagttagataaatagatatagatagatagataaacagatatagatagatagatagatagatagatagatagataaacagatatagatagatagatagatagatagataaacagatatagatagatagatagatagatagatagatagatagatagatagatagatagatgatagagagagagagagagagtgtgtgtgtgtgtgtgtgtgtgtgtgtgtgtgtgtgtgtgtgtgtgtttagtccatggcagtggactaaatatactagctaaaagatcttgtcaaattagtttaaaaagaagctaagtggtttttttaagacacatctgaaataagaggactcagaaagcctgaatggaaaataatgaaaagagacataatatgcaaataataattaaaggaaaaaccgggtaactataatagcaggtaacaaagacttcaaaaacctttttagaaggtagaaaggatactgaattatggcaagcgattcattttgccagaagaacttagcaattttaaacttgaattcgcaaaatactctcaaaatatataaagcaaaaattgacagaagtgcagggagaaattgataactcaaatatcatagaagaaaatgtggcatattaatttcagaactgatcatttaggcacacgacaataagtaaaaatagaggtttccaccaatataatttaaaaacttgattgacataaagtctaaacaaaataaagaacacacattcttctaagatataaatgaaatgtttaaaacatttatgactttctaggggaaggtatcttaaaaatacttagaactgaaggacaataaataatcctataaataaatattcatgagatgcaagacaaagatagttgtagttattttacactttaaatgcttaagtaaaaaatgagttaaggctagaaactcatagctaaattcaaataaagtaaaagtatgtgatgatgtaagagcagagcttaatgaaataaaacttgaagttatagtagggaggatcaacatagtcacaagttagtttcttgaaaacagaaaatcctccagcaaaattggttaagaaaaaaggagaacaccacaaataatcaatacaagaaatgaaaatggagataattataggtagcagacactttaaatgacaataagagaataccatgaacaaagctggccaaagcatttgaaaatttaggcaaaatggatgaattccatctatagtatatatgtatcagaatattatttttattgaaagatattgtcactgggtatcgagttctaggttgacagttcattatttttttctttcttattttaaaggtgtggtcctactgtcttctggattgcattatttcctgtgagaaatctgtcattgatatgtttgctcctttatgggcaattgtgtcctttttctctggctgcttttaagaatggccttatgatatacctcagtgtagtttcttccattcatgttttaatttaaagccattatctcttcaaatattttcatcactctcccaacccccacttttggaaattcccattatacatattgtaccacttgactttgccccacagctcattggtgctctttccttttttcttttttcttttctagtagcttttttttcctctgttttttattttggatagtttctatcactgtcttcaagttatctaatcttttcttctgtagtgtctaatctgctgttagccctttccagatattttttctttttttaatttttttttttatttcagtaggtttttggggaacaggtagtgtttagttacatggaaaacttctgtagtgggtgacaacccactctttgggttgtctgtttactctgctgattacttcttttgaggtacagaagctttttagtttaattaggtctcatctatttatctttgtttttgttgcatttgcttttgggttcttggtcatgaagtctttgcctaagccaatgtctagaagggtttttctgatgttatcctctagaatttttaggatttcaggtcttagatttcagtcttcgatccatcttgagttaatttttatataaggtgagagatgaggattcagtttcattcctttgcatgttgcttgccaatcatcccagcaccatttgttgaaaagggtgtccttttcccactttatgtttttgtttgctttgtcgaagatcagttggctgtaagtatttgactttttttctgggttctctattctgttccattggtctgtatacctatttttataccagtaccatgccatttggttgactgtagccttatagtatagcttgaagtcacgtaatgtaatgcctccagatttgttatttttgcttagtcttgctttggccatgtgggctcttttttagttctgtatgaatttaggattttttttctagttctgtgaataatgatggtggtattttgatgggaattgcattgaatttatagattgcttttggcagtatggtcattttgacaatatttattctacctatccacaaggatgagatgtgtttccatttgtttgtgctatctatgatttctttcagtcctagccagagcaatcagataagagaaagaaataaagggcatcaaaatcagtaaagaggaagtcaaactgttgccgttcactaaggatatgattgtatacctagaaaaccctaaagactcatccaaaaaacctcctaaatctgataaatgaattcagcaaagtttcaggatacaaaattaacatacacaaatcagtagttctgctatacaccaactgcaagcaagctaagaatcagatcaagaactcagcctcttttataatagctgttaaaaaaaaaaaaaaaaaaaactcaagaatatacctaaccaaagaagtgaaagatctctacaaggaaaactacaaaacactactatcttttgtatttttgtttcagtttcattgagttttactccgatctttgttatttcttttcttctgctgggtttgggtttgctttgtacttgtttctctagttccttgaggttttaccttacattgtctgtttgggctctttcagactttttgatgtaagcatttaatgctatgaactttcctcttagcaccaactttgctgtatcccagaggttttgataggttgtgtcattattatcattcggttcgaagaattttttaatttccatcttgatttcattgttgaccaaatggtcattcaggaacaggttatttaatttccatgtatttgcatggttttgaggattccttttcaagttgatttccaattttattccactgtagtctgagaaagtacttgatataatttcaattttcttaaacttactgagacttgttttgtggcctatcatatggtctatcttggagaacgttccatgtgctgatgagtagaatgtctattctgtggttgttgggtggaatgttctgtaaatatctgttaagtccatttgttctaggatatagtttaagtccattgcttctttgttgactttctgtcttgatatccagtgctgtcagtggaatattgaagccccccaatattgttgtgttgttgtctatctcatttcttaggtctagtagtaattattgtccaaatttgggatccccagtgttaggtgcatatatatttaatattgtgatattttcctgttggactagtccttttatcattacataatgtacctcttcgtcttttttaactgatgttgctttaacatctgttttgtctgatatatgaatagctactcctgctcacttttggtgtccatttgcatggaatatctttttccactcctttaccttacatttatgtgagtccttatgttaggtgagtctcttgaagactgcagatacttggttgaattcttatccattctgcaattctgtgtcttttaagtggagcatttaagtcatttacattcaacattagtattgagacatgaggtactcttctatttatcatgctagttgttgcctgaataccttgttttttgtcaccgtgttattgtattgtatgccctgtgagatttatgctttaaggaggttctattttggtgtatttcaaggttttgtttcaagatttagagctccttgtagcaattcttgtagtgctggctttgtagtggtgaattatctcagcatttgtttgtctgtaaaagaccatctttctttcatttgtgaagcttagtttcactggatacaaaattcttggcttttaattattttgtttaaggaggctaaagatagggccccaatcctatctggcttgtagggtttctgccgagaaatctgctgttaatctgataggttttcctttacaggttacctgatgtttttgcctcacagctcgtaagattctttcctttgtcttgactttagataacctaatgactatgtgctaggtgatgatctttttgtgatgaatttcccaggtgttctttgagcttcttgtatttggatgtctagatctctaacaaggccagggaagttttcctcaattattttctcaagtaagttttccaaacatttagatttctcttcttccttgggaacaccagttattcttaggtttggtcatttaacataagctcaaacttctttgaggctttgttcattttttaaattcttttttctttttttctttttttttagtttgagatggagtctcactctttcgcccaggccggagtgcagtggtgctatctcggctcactgcaagctccacctcctggattcacgccattctcctgcctcagcctcccgagtagctgggactacaggcgcccaccaccacacccagctaatttttttgtatttttagtagagatggggtttcaccgtgttagccaggatggtctcgatctcctgacctcatgatccgcctgcctcaacctcccaaagtgctaggattacaggcgtgagccaccgcgcccagccttaaattcttttttctttgtctttgttggattgggttaattcaaaagcctcgtctttgatctctgaagttctttcttctacttgttccattgtactgaaactttccagcgtatttttcatttctctaagtgtgtctttcatttccagaagttttgattgtcttttatttatgttatgtatttctctagagatttttttgtccatatcctgtattattttttaaatttctttaagttggttttcacctttctctggtgcctccttgagtatcttaataatcaacctaccgaattatttttctggcaatttgaagatttcttattggtttgaacccattgctggcgagctagtgtgatcttttggggtgttaaagaaacttgctttgtcatattaccagaattgtttttctggttccttctcatttgggtagaccatttcagaggaaagagctggggtttaagtcctgctgttcattctttggtgccatggggtgatgccttgatgtggtgctctccccctttccctagggatggggctcactgagagctggactgcagtgattgttattgcttttctaggtctagccacccagtggagctactggactctgacctggtactggggagtatctgcaaagagtcctgtgacatgatctgtcttcaggtctctcagccatggatcccagcacttgctctggtcgaggtagtagggaagtgaggtagactgtgtgagggtctttagttgtagttttgtttagtgcatgggttttcttgaatgttggttgtgctagcagttagttggcctccagccaagaggtggcacttttaagagagcatcagctgaaacaagcttgtcctaagtttgcctgaataggtatttgggcttctcaggtgatgggttggaccatagcgctcccaagagattgtattttctgtcttcagctgccagggcaggtagggaaagaccactgggtggagccaggattaggcgtgtctgagctcagcctccccttgggcagggcttgctgcagccactttgaggatggcggtgtggttctcaggccaatggagttatgttcccagggggattatggctgctctgcagtgtcatataggtttccagggaagtgggggaaagtcgtcagtgactggcctcactcacttcccacacagccagcaaggccagtctcactcccactgcaccccaccgatagcactgagtttatatccaggtgccggtgagcagagctgaggtcttgtcccagactacaagcctcccagctgagaaagcaagcaggactttcaggccccacctctccccacctgctgtagcttctttgctcatatctacactttctgttcaccccctaccccacccctgccccagattgtgcccagaaaaattcatatttggtcaaaattattacaaagttcagctagaagtttccttttccctgttgtctttccccagttccactggcagccctccccaagaacctctatgaggtaaagtcagaaacggcttccctgggcaccaggaatgcctacagggctctttctgctgcttcttctagttttatatttcactgggctctctaaattcatttcagctctaggtaaggttaaattcttctcctgtgatctgaatttacatgttccccagtgagggtatgtgttcagaagtggactttccctcctcacgctttgggcactcacagtgtgaatttcactttgttgagtgtagatatttttatatcctatattatgcttaagctttgttctgggatgaaattaacttattgaaaacagttgatcctttggagacttgcttttagacttcatgaggtgagaccagcacagcccttttctagggctgattttttcccaataatgttataatttccttttgagtactgtacctaataccctgagttacaaggttttgcactcagactggtgggaacatgaattattcttaatctgtgtgagtaggttgttccctcagctcctttcaggtgagttttctctgacccaggttgttttattacacacatgaatttattggtaccttgctgaagacttaagggacacttctgcagatcacttaagttttctctctgtacagctctctcctgtctggtattctgttctgaagaccctagactaccaactctgtctcctcaagtaaggagctcaccaggttcctaagtttcccttccctgcactgagacccagaaaattttatcaggcagtaggctgaagcaattgtggggttcacattgtttgtgtctgtctctcagacataactgccctgccctgcctgatctctatgactgttttatatattttgtccagtcttttagttgtttcagacaagagtaagtcaaatcctgctactccttctcggctggaagtagaagtttctagtcttatgatttttaactgttgtcagctaattaaaatgtaaagttttataaggacttcataagtgtatgcaaatgctcctaaggctttcctggatgtcagtttaggcccccaggcttcaggattaatctttaattaatactctgagtggagacagggaaaagaagggtgaatgaagtttctgtggtctaagaaatcccaatagacaacttctggagaaatgacaagagagggacataagcaatcaaaaagaagggcgaggccgggcacggtggctcacacctgtaattccagcactttgggaggccgaggcaggcggatcacgaggtcaggagattgagaccatcttggctaacacggtgaaaccccgtctctactaaaaacacaaaattagccgggcatggtggcgggcgcctgtagtcccagctactcgggaggctgagacaggagaatggcgtgaacctgggaggcagagcttgcagtgagccaagattgcgccactgcactccagcctgggtgacagacaaagactccgtctcaaaaaaaaaaaaaaaaagaaagaaagaaagaatggggaggggacatatgcatctccatctcaactctctaaaactaagactcagacagagattttggtgaaaaatgtgtgcctaataaaatacttgctctaaaaattagattctagatattatctgaatatgtgccagtcactattctaagcattttacatatgtggatgtatttaattctctgacaactgcataagtaagctattatcatctccagtttatggataaagaagcaggctaagcaaattccccaagatcccatagttaaaaaatggcatggctcagatttcaatccaggctctgtaactaatatattatctgctaagaatatcagtcttatcatgtttagttctctggcttaaagtccacaacataataaaagtgaattgtagatgctgagatgaagatattaaatgtaaatacaacaaatacaaggaaaaataaaaactgacaatttgtttaaaagggcaaggacatagaatcctctgaaatagacattgcactgagaagtctatcactagcatattaaggaatgaagactcagataatgaacttgctgttaaaaaagcaaacctctgttaataacttttaattaaacctttgattatatttttaaatgttttttatttcttaaaaaacagttttgggctgggcaccgtggctcatgcctgtaatcccagcactcgggaggccgaggcaggtggatcacctgaggtcaggagtttgagaccagcctggccaatatggcaaaaccctgtttctactaaaaatacaaaaattagccaggcatggtggtgcacacctggtagtcccagctacttgggaggctgaggcagaagaattgcttgaacccaggaggcaaaggttgcagtgagccgagatcacaccactgcactccagcctgggtgacagagcgagactccttctaaaataaataaattaattaattaaattaaataagaaacagttttgcatttgaataattctgacaccaaaataatttttatcctggaatacactattcaatagtggtaaactttgttatatggaaaacatttcttatttctgagcaatatcaggtaaatgaatcaggaattatttgaattagaaggtattgttactaaccccctcatacctccaatgtactaaaactaatacatcttaaaattccttttaatcatttaatttttcttttttccaaaattttccccacataaataaagtagaatttagcctcttctacttcaaaaataaagtattttctaacaatgtttatcattataagtttctcagggctcaaatgtagaacatctttttgatagcttttcactctttccccaaacatatcccagttttatgagaccaagtacaaatatcttcctgtcacacatcatcaggagaatcttgccaggtgcagtggctcacgcctgtaatcccagcactttcagaggccgagacgggcggattgcctgaggtcaggagttcgagaccagtctggccaacatggtgagaccccgtctctactaaaaatacaaaaaaaaattgctgggcatagcagcaggtgcatgtaatcccagctactctggaggctgaggcaggggaattgcttgaaccaggaggtggaggttgcagtgagccaagattgtgccactgcactccagcctgggtgacagagcgagactccatctcacacacacacacacatacacacacaaaatatggataaaatatctagtgtgagaggaacagcagaaggagaaagtaatgtcttgaggaaggtgcgaatcatctgtaaatactttttagagtaatggaattcctagacagacagcttcgcaggcagtattgccattcagtatcattggcaaccttcctaaaaggaaaagagtaatgttaatgccatttctgaaggtatgaattgaggattttgattctttttccataaatacttaccttgtgaaaactcctctgcaatctctactgtcagtaagttttataaatgctgtatacaagtcttcaattcaccattgcctgcttgaggcttatttattttttgagaaagaagctggagaagtcatttgaaaattcatgggtagttcactcttcaaggttgtggtgtgctcttcaaatagctataaaaatttccaagagacaggaccactgaccctgcgcttcgtagcaaatagctttacttactcattatctgactagcgtattagttaatcatgtaaacaattatctttcttttcaggtggcaataattcatggcatctcctcccccttccaccccacacatatacttatttattgtcacagcctgatttataattgttttttaggatttcttcatatcctccctcctacctttacccctgagttcagaaaataataaacactctaaatctccaagcaatggaactcttctaagagttaagctaaagtctatcctaccaccttgctatattaatgtcagctcatttgatgtgtctgtagagcaggatttgtttggcaagctttttctgtaaaggaccagatagtatttcaggctttttgagccatgtggtgtcggtcacaacttttcaactctgccatcatattgtgagagcagaagtagacaaggtatgtttaaaaaaaaatgggtatggttgtgctccaataaaatcttttttatagacactaaaaacttgaatttcatgcaaattttatgtgtaaggaaataattttttaaaaatctcttctttaaccttttaaaaagacaaaagccattcttagcctgtgggtcgcacaaaaacaggcagcaggccatgggccatagtttgccaacccattatctaaacggttaacagaatgcttactacaggttttctgaccctcagcactagtaatactttgggacagataattctttgttgtggactgtcttttgtttttgttttgagacagcatctcactctgtagcccagactggagtgcagtagtgcgatcttggctcgctgcaacctccacctcccaggttcaagcgattctcctgcctcagcctccccagtagctgggattacaggtacccaccaccatacctggctaatttttgtatttttagtagagatggggttttgccatattggccaggcttgtctcagactcctgacctcaggtgatctgcccgcctcggccccccaaagtactgggattacaggtgtgagccaccgtgcctggcctgtcttttgtattttaagatgtgtcatatcatctctggcctctgcctactaaatgccattaacaccctacatcccccaattgcaacaactagaaaatctacagacattgacaaatgacctttggggacaaaattgcccccagttgaaaatcactggtctaatacactgaaaacttagaatacaccgcataaaatatgagctggtaggctgcgtagtataagatagcgtcatgtgtcacctgagagatagccattggattctcatgcttctaatgtagaaaccataataccgtggtcttccccttacctacagtttcattttctgtggtttcagttaccagagatcaaccaaagtctaaaaatattaaatggaaaatttgaaaaataattcatcagttttaaattgtgtgctcttccaagtagtatgatgaaatcttacaccatcccaccagagacttgaaccagccatttgtccagcatatccacgcggtagctgctacctgttcctgagtcacttagtagacttctggattattggctcaacagtagaggtattgcagtgcttccattcaaaaattccttactttacttttattatggtatattattgtaattgttctatcttattagttactgctgttaatattctattgtgcctcatttataaattaaactttacatagatgtgtatgtattggaaaaaaatatggtacagctgacccttgaacaacacagatttgatctgtgtagtcttcttttatgtgttttttttttcaataaatacagcaggccctccatatcaatgggttctgaacctgcaaccaaggcaagacacaaatatagtattcacaagatttgaaacccatgtatatagagagctgactgacttttcatctgggagggttctggatggctcacttccatacttgaatgtgctcggattttggtatagaagggggtcctggaaccaatcccccatagatagcgagagatgacggtatacatagggtccagtattatctgaagtttcagacattcactggggctctgggaatgtataacctgcacataaaagagaatttccgtactacctccaagttaataaccactgaagaaatcctaggcttaagagagcccgttattggaacttagatggtggcgttagagtgcttatgctttggacttaggagtcagtatcccttccccccagctttgtctctttctatattcctttcccatttttcctctttccacctccttacactcaaaccatacagtgtgcacctgacagtggactacaaagattaatattcgatgaaaggactttgtccatttgaccagaccacttgaatgatgaggtgggagccacagaatacatagttgatattaaattaagaatctaggccagacccggtggctcacacctgtaatcccagcactttgggaggccgaggcgggttgatcacttgaggtcaggagttcaagaccagcctggccaacatggtgaaacccgtctctactaaaaatacaaaaattgctgggcgtggtggcaggtgcctgtaatcccagctacttgggagtctgatgcaggcgaatcgcttgaactcggaggtggaggttgcagtgagccgagattgcgccactgcactccagccggggcaaaagagcaagactgtctcaaaaaaaaaaaaaattgagaatctaaattaatttatagaaatcctttttccataaatttatcttttctccaagttttcttctgatatgcaaagtgtgagacacctactcttagcttttagatagtttacaggccaatgacacacagtagatgatgttctgccatgatgtctcaaaggcagagaaacattcttatttttatcaacactttctcatccccatctttaaattattggtataaacaaacttctgcttctcactttagattataattttatcattttttacaattcatcaaagaaagtttttctaaattgcacggaaagttctatagaatgctgagttatgtattctaaagaatatttctccttcccattttttcatagctaaactgtcaatatttttaccttaacttcctacaaagtcctatagctatttgattacttgatgtttcagtataaaaaaaaattaggtcaggtgtggtggctcatgcctgtcatcccagcactttgggaggccaaggcaggtggatcacctgacgttaggagttcaagatcagcctggccaacatggtgaaaccccgtctctactaaaattacaaaaattagccaagcctggtggcaggcactggtaatcccagctcctcagatggctgaggcaagagaatcgcttgaacccgggagacagagattgcagtgagctgagatcgtgccactgcactccagcctgggtgacacagcaaaacttaatctcaaaaaaaaaaaaaattaataatgctgcttctgcctgaaatacatgatttccagtgagtgaaggaccacttgctctactgaagtaaagctactttactcaagtctctgaaggagtaagagagtcctgcagggcacatttgaacagctcactttcagatacaagtgataaaaaatggagcctcagcaacaacaacaaaaattataacttttaaagagatagaacaacatggtttgaaaaggaatctggatttttgcctctggttgctgtcattgacagggaaagtcttatattttctgaacttgtttttaaatccccccaaatagagggattagactgtgtaattccacaaatccgttgattttatgacctggctatagcttgggaaagcaaccacatagtaccgttgttacactccagagctattcaaatattgttatcaaagtggtgccaaaaatttctaatcaaatatttggaagagtttggtgatgagtcgaaagtagcctgtatgtctctgaattctgtgatgtttctcatttttcctccccgtacagtcttcataggtatttagacaagtaaacacctgtaaaggaagaatgtgggcaataagaatgaatataaatgataaatcacataatctgatgtaatgaaagacttaagttattacagaaaacctagaattaaatgaaatatttaaaaagtgatgtcttcaggaagtctacagttcagattcaagggtggcaaatactgtccatggagaccagtagttctcaggagggtgactttttttctccaggagacatttggcaatgactggagatatttttacttgggcatgttgttgatatctagagagtagaggccacggatgctgctgaacacctccaatgtgtaggacaatgccccgcaacaaagaatgatctcgcccaaaatgtcaagaatgccaaaatggagacaccctggtgtagacctatgatagctctgacttctttttttttttttttttttttttttttttttgagacagagtctcactctttcacccaggctggagtgcagtggcccgatctcggctcactgcaggctcgatctcccaggttcatgccattctcctgcctcagcctcccgagcagctgggactacaggagcccgccaccatgcccggctaattttttgtatttttagtacagacggggtttcaccgtgttagccaggatggtctcgatctcctgacctcgtgatccacccatctctgcctcccaaagtgctggagtgctgggattacaggtgtgagccaccgtgcccggccgatagctctgacttctaagtcaactgtgttcatcagtttcatatctcccctcttactttccaccatcacaaaagcctctgcctcctaccaaatgttagtaaatgcagtgaatgttagcaatctatttgaaacaaggtttcttggcattcatctagctgtatggataaagttttaccagcacaaactctgtatgcatggggtagactggatcagacagagcaatctgaaccacaatgttggatttccttcaagcttgagaaatattaatactaccatatatacaggcggggcatggtgggtcacgtctgtaatcccagcactttgggaggccaaggcgggtggctcacctgaggtcgggagttcgatactagcctgaccaacatggagaaaccccttctctactaaaaatacaaaattagccaggtgtgggggtacatgcctgtaatcccagctactcaggaggctgaggcaggagaatcgcttgaacctgggaggtggattttgtggtgagccgagatcacgccattgcactccagcctgggcaacacagcaagacttcatctcaaaaaaaaaaaaaattaccacacatactaacaatatgaaagttctaattcatatttaaggaaacatctgcttctacatgtgtttctatctgtggttctgaaaagcaaatcctaatttttatgaatgataatttctgggcctctttttgtctttccccagatgttccctgctttgttgcttaagagctgcatggcacagaccataaaggttgtgagctcttcccatttcaagaaaccctggggagattcaaataaacaaattcaaaatgccccttagagtctttaacagaccagaattagtacgttgtttgtttgaaaatctttctttttttcggatataaaactatacactcaagactaaatggaggcagtacaattacacattttgactgaattgtctcatcagtaaaagtatcacctggctaattgtaactctttagaattggcctaaactagaaaataaacaaggaccttattcaagtatttcctattatgttacatacatacaagttaccaattagaagttgatatacactattttgtttaaaaataaaattcagcaagcttctgatgatttattctgttcttgtttttcttaccagttttactgccaaaataaactccttctcatacaaagtctgggattataccacagagttactataattggattcaactttaatagaatattacaatattaattttaatagagtatggtttcagatattaaaaagattaatgtacccaaaaacataatcattgttttgttttttttttagacagaatcttgctctgtcacccaggctggagtgcagtggtgtgatctcagctcactgcaacctccacctcctgggttcaagcgattctcatgcctcagcctctcaagtagctgggattacaggtgcatgccagcatgccaggctcatttttgtatttttagtagagatggcattttgccatgttggccaggcttgtctcaaacttctggcatcaagtgatctgcctgccttgaccttccaaagttctgcgattacaggcgttgagcaaggcattgagccaccccacctggccacttcttttaaattgcataattttcctgttctctatttcatccaatctaaaataataatgagttttaaatacttatttttaacattttttttacacctatgatttgagaatatatatatattaggccgagtttcatttttgttgcccaggctggagtgcaatggtgccatctcggctcactgcaacttccacctcccaggttcaaacgattctcctgcctcagcctcctgagtagttgggattacaggtgcccaccaccatgcccagctaatctttgtatttttagtagagacagggtttcaccatgttgtccaggctggtctctaacccctgacctcagatgatccaccagcctcggcctcctgaagtgctgggattataggcataagccatcatgcccagcctgagaatagatttttgacatttttaacttgattttccgagaagaaaaaattacatatttttaaaaataataaatacattgaaatctagattttaaaacatgtttactttctctcaaatttgttagaaatgtcacaacaaatagctttttcaacctatgaacagtatttgtagaagggaaaaatgaggaagaaatgggcacatttttctagtgattgaatggtggtgtctacatcttgaataattctcactgcatatcgttgcttgaattgtagatctgtatggcatgtgacttgcctgggtctatgatgttgtcaacagaaagagtcaaattctgtaaaatatttgaagagatttcttctgagccaaatatgagtgaccaatggtcccgggaaatcctgaaaacatgtgcccaaggtggtcgggctacagcttggttttatacattttagggggacataagacatcactcgatacatgtaagatatactttggttttgtctggaaaagcaggacaactggaagccaagggtagaagggggccttccaggtcataggcagattctcatgatgttgcccagatgtcctattgtaatttcaattggttgagtttatctaaagatctggaatccatagaagggagtgtctggattaagataagtggttgtagagaccaaggctcttattatacaaagcctacaggtagccggctttggagagaatagattgtaaatgtttcttatcagacttaaaaaggtgccagactcagtgaattctctcctggattagggaaaagacctggaaatggaaagggattctctacagaagttagatttttccccacaagagacagctttgcagggccatttcaaaaattgccaaagaaatatattttaagacaaaatacttggatttctttcaggacctgctatctgtcatgtaatgctatactagagtcaggctggatttgggtgtcttattgctacagaaagtcttaagatctctattaatgttaatgctggtcagctgtgcctggattccaaagggaggagggtataatgaggcatgtgcaacccccactccccatcatgacctgaactagtttttcaggttaactttggaatgcccttggctgagaggagaggccaattcagatggctgtggggcttaaaatgttatttttggcttatgatgtggaggcagaagtaacctgtatcactgttgtgccaaagtctctaagagctaatgtgcagttcaccaagttgtctccctatgagagtcagccatcactgcaaacagcaacactccaggttgattgtggttctgtcagcttcatcctgcaccccagagtaaagatgacatagtggggagcctgtcttacaatgagcatatagcagatgcaagaaataaacatttgccttgttaagccactaagatgtcagggttgtttgtcctgcagcaaagcccagctcatcctgactgataaacttatccattcaagtgatcagcttttggtgtaaatgcccctaagaaaactgataaagcggccgggcacggtggctcaagcctgtaatcccagcactttgggaggctgaggcaggcggatcacgaggtcaggagatcgagaccgtcctggctaacacggtgaagccccatctctactaaaaatacaacaaaattagcctggcgtggtggcggcgcctgtagtcccagctactcaggagactgaggcaggagaatggcataaacctgggagacagagcttgcagcgagccgagattgcaccactgcactccagcctgggcaacagagcaagactccatctcaaaaaaaaaaaaaaaaaaagaaaagaaaagaaaactgataaagcctgatgcactacctacctatgccttgccaaagaatggtaataatccaaaaactgtttaatttagaccttcactatgcaatgcatattttatctaggaacacttttactggtatcagtgatcaaaattatagagcagggggggaaatgtgaggaaacaaatctcaaatgtcaacatacgtggggatcttgtttgcagatgaggaagtgcattctcaaagctgtgtgaattgtcctcatcatacagctattttcattgtattctttcacaaaaatatgtatgtggatggattcttaggtgttagagacggggaggaaagaataaaggagactcaaggcataggtggaaaccgtgcatacagatggtatatctttatgtgttgagcatttatatcatgcatctgctaagtactgcaatggaaacaaggataagacgcacagacttccctaaagaaatgtaaaatctcaatgacaaagaaacatgtgaagaagttagtatcttaagcaaaatgatgcaattcatagtaggccactgtgtactggaaaagtaagggctattctattccaaagtgtgatttttttattgggtgagggggacctgagaaagcttcatggagggtgtgatagttaatactgagtgtcaacgtgattggattgaaggatgcaaagtattgatcttgggtgtgtatgtgagagtgttgccaaaggagattaacatttgagtccgtgggctgcaaaaggccgacccacccttaatctgggtgggcaccatctaatcggctgccagcacggctagaatataaagcaggcagaaaaaccttgaaaagactagactggcctagcctcccagcctacctctttctcccatgcttgatgcttcctgccctcaaacattggacccctggttcttcagttttgggattggactggctctctttgctcttcagcttgcggatggcctattgtaatcatgtgagttaatatttaataaatttccatatatatatctattttattagttctgtccctctagagaaccctgactaacagagaggagaggatatctgaactaagcctcagaggaggatgaatggcaaggagaagaaacatgtctccaggaaactgaggcctgagggggtagtaatttttcccgagcatatgataaatgacagtgatttgggaagacttcatggcatgaatgtatgtgagaaagtgggcttgcgagagcaagattggaggagttggttatggaaaggcgagtaaccagatataggctgatagatggagtaagcatagagaagggcattgttttgtttgcttgttttttttaattttttaaatgttttatagatatgggagtcttactacattgctcaggccggtcttgaacttctgggctcaagggattctcctgccttggcctcccaaagcactgggattacaggtgggagtcatcaggccggcttttaaagaagggcattgcagtaggaatagaatgaaaggaagagatgaatgaatggaagagatatatgagccatttcaaaataagaatcacaacagtggaactgagtggctgtggataaaagctaaaagggttaagtcagggttgggaccaacagaactagaacaatacttgtattttggcccagatgacaagggctgaagggcatccagtgaacacccagaaactgaggacgctagactgaagcccaggggaaaatccaagctagtgaggtttttctcttatgagttatgggaggagcaacttggagggaacacttattgattgcatctcttgtaatatccacagcaaaggcatatgaggcgaggctagggaaggagatagaggaggagtgtggtcagagacgcaaaaggcatcaaataaagctgatgtggaagagaaccaggacgctcattgtggtatgaaagtcaagagagagagcttcagggaggtgggggattcgcaggtttaaggagaaagcaaagagaatgaggaccaaggaaaggccattggatttgaagtttgagattttctttctttttttttgttttgtgacagagtctcactctgtcaccagcgtggagtgcaatggcaccatctcagcttattgcaacctccacctcctgcgttcaagcaattctcctgcctcagcctcccaaatagctgggactacaggtgtgtgccaccacgcccagctaatttttgtatttttagtagagatgaggtttcaccatgttggccaggctggtgtcgatctcttgacctcgtgatccacctgcctctgcctcccaaagtgctgagattacaggcgtgacccactgcacccggcctgaactttgggattctcttggtggttgtagagaatgcacttcattagctttagattctgggacagtcacattataaaagacaaggggaaataaagagggtatacaggacactggtgtatactgtccactccagatcagtggatgaagaggatctgcaccctaaggggacagcagatttatcccattgctttgttgtgttgctttgtcgagatgggagatacctgaaagcagaaggaaagcaacataggaagacgctcaaaaataatgattttcttaaatgcacatgataatttatggctgacactgacattttctcagttacctttcataataacattagagaaatgacataaggttgcagagtggggggcagtgggtttcttctgactccacttcggttcccttcatagcatgaacacatttgtaagggagaaaacgaggcaggaatgatgcacattccgagggtgggagtgaagaattaggagtcacaggtaggttagcatgtggaagagaaggtgactgaaaccagaggcagagaggagaaagtggactgagatttacatgttttactccctgaagagactagcagtccctatttccaccaagggcagaaacattcaaacattctgcatacctttccttttatgcatgaaataaaatactggcatttgaaggaagaggttgataatgtttatttcttagaacattcaagcttggcagttatgtgacttatctctagagcctctcagaagtctctggggacgcaggagtctttggagactcacactttctgcaaaagtgcagaaagaaatacaattacttaatgaatacctactgtgtactcagcaaatcctttatctgtcacttgtgttaatttctagaaattacataactaagagtctccatgaattgcacttgttttcttaagagggaaagagaaaaaaataccttctttccttaccatttaagccagtgctttttaaaccaggatctgacactccgtaggtgaccatagatgtagtatcacagatccgtctgtttccaaaatgttacattctgattttaagatcccctgaaagttgaaatttctcttttgctgcaacaactcacacttgagaaaaattttcacaggagactttattttcttaaagcagagtttgttaatatgaattctcacaggactgtggcaattcatttttcttttaatgcgttcattactctagaccaagacatcaatttttgtgcaaaccttgtttcctgctgccacctggtggaagccacataagagttttacagaggctttggtggtgctaggagaggggccagggctcttcctcagtcacagaatcccacacagtgatcaaagagcagatctttctattaaactccctggcagcaaaacagtagaggcttggctctctgccccgggactgtgcagaatgtcacaggtcggaagcccagagcatttttctcttcttttatctttagactcttgtggctctcagaccttgaatataattctttgctgaaaattctttaaaatcattatcttttctttcttccttttttctttctttcttttttctttcctcttttttgctatgctagacaggaagaaagaagggaatggcattttaatgtaaagaagattgcactgaaattatattacttgcttaattgtattaattcactgcaataacaatttaataatatgacaggtcatttacatgctaatcatttgggtctcttgtccagagaaatcatgaggaagggctgggaagtgctcttattatgatcaaaataatccacactctcctagaggagtgcataggtatagaactgacattgtttgtttaataaagtttcattcaaggcaatttggctggttcttttatcaagtgtaatgggaaaacaagccagtcctgatgttaaacactccaatgatccctcaagctttttattctgtaataagttttacagcattatgtgttacccacgacagtcatttagtcggtcaatttcaggctagtgataaaagtttgagtaatgggaaagctgtgttgatgttccatattctttgtgagatgtctatgaattaatgctcccaggtacacactcaatttatatttaacagccattactaaatgtaatatctaagtaaaacccagttatgacctatatatatggaaaactaattaaagctgttggaaacaacctatttccctttggattatttatgtaaatacatcgaggtctaaaaattcagtacaagtcagatgtgttcctgcctagggctattatataaagctcagaaaattttatgagaaaaatgatgattcttaaggattgagcttcaaatgtgaatttttctattttataaggatatagcttgggttgttaagcatcaacatagcttttcaaaatagttttttattctcacaagtttaaaggccttgtaaaatctcttctattaaatatacatatatacatacatattacatatacaccaattgactaacccctctaagtgctgtatctgaactaattttaaaagaatacccgtgtttttcagctcccaaattgaaaagattattagttagtaccgtgatttctgaacttttaatcaaattttcattcattttataattttgaaattttgacaatctgagaatcttctatgattaaatatattctttcttcctttcttttttctctttcccttccttccttccttccttccttccttccctccttccttcctgtcagtctgtcttgctctgttgcccaggctggagtgcagtggcatgaacatggcacacttcagcctcgaactcctgggtgatcctcccaccttggcctcccaagtgttgggatagcaggtgtgagccaccaagcctggccttataaccaattaaatgaaggaaatgatactatgacacagacaaccatttttcaatcaagttattctgccatattaaattttcagtcacctttctattgcatttattgaatttctactttttaccagttctaagcctagatctgtctctcttaaattattaaatgtcttattttcttatgaaacaaccttcagatgtaatacacagaagaaaaaggagtctcaggaagtttagtttgcccaactagaaattgagcacaattacttggtgtgttgagggggatttgaaactatgtccttatgataattgatagttatgataattgatgacaaaggggttttagaaagacctcttttgcttttagaaacacttctctttgcactttctttaatgcccattttttagttttatgaattaaataatatacatttatttaaacaaaagtatcaacatttctcaagtatctataggttacttatctactcaatgcaactaacaatcaaaaactagtgctccaacaaattaaattttccaaacactgaaatattgatcacaatgtctctaagcatttcattgaaataaaaattttgatgtatctaattttcctaaatattttaaatgcatttcaatatgcaaaactctcacaaaattgttgtaaatacaaaggtaatcagtatttttagattaaaatcagttataaatgtgctaatatagtgaatgtgacccttgtccggactcacatttttcttcttagtcttttcctgggttatattcttaacatatcagctatttttctatttttatagcttcttagggttcaaaaatattaccatatccaaatgaaaactaactacctgagagcagccaactgcaggatctgtgtcaggatccagctgattcttggtgaggacacagatccaggtgtctaaggagattcagacactagccagtcatcatcagattaagctgcacttaaatccacatatatcaaattgtttttttttatttttacaatggtgcgttactaccatgatgtcttcacaactgatttgagcagtgttgcaaatcccatttcattatcccatcgttgtgatatatagacttggcctgttggaataccttcttggaaatttaaaaaaatagtttattaagattattagggccattgaagaatttcctcctaggagataatgcattgagtctacctttcagtcctcctcctcagaacacgtgcccgaactatcatttttgagatcaccattgatttctttctacagcgtggtcactggtaccaataaaatgctagtcttcattcctatccagttattatgtggggccccatgttgttagtctttctgatttcattatgatactaagttttaagggaaacttgacttcctatttttgtgtctattgtactacccactatagcgactatatagtaaggaatataaatttgttttcataggaaataaaatacccacatatattaaatccccattaaacataccctatttcatttacccttctttaaattataactatctttttatatggcttatattaacttttctctctcaagcatcattttaagctaatgacctttcagactagacccaacttctttcagtcaaccataattcatgctcactttctccctctctctcatcaaatcatcgaaatttgatcagcaggaatctctttaacttgactccattgattttttagtgttttagtacagtctccaacattcttaaaaacatatttgttttctagcaataacaagatgtcccagactcattccaatttgttttgttttactgccccaaaacatggaatcagcttccctaccataagtagtaaagagtagtagagaatactattaaagtccaaaatctgggaactagggataaacaggagagttgatggtaagtaaaaccagtgctgctgcttaactatatttactaatgtcagagatggaaaatacaagttattttaatgtcataagctcacagtaattttttccaaataagattatatattgctatgctctacttttctcaaattatgtgattttattgaaaatgaaaacttttattttggaattgaaatatttgaccctcttctttctgcttaggggaattatttggaaagatttcttatgcctagttctgtagggttccaaaccatgtatactttcacaaaatgcatgtgtgcaatagcacacatgctatttccagcagcaagttgaatccttgtatctagcactgatggtcaatatgttttgcattttgctttcccacctccaatgaattagtataaactatgaccttcattgatatttctttagtttttatatttgtatgaatcagctacttcaaacccttaataaaatctacaacctctccaataaacccaaagttactagatggaaggaaacaaagattagagcagcaatcaatgaaatagaaacttaaaaacagaaaagatcaacaaaactacaagttggttttctggaaaaaaataaacaaaatcaataaaattttggctagactaagaaaaaaaaagagaagactcaaataaatgaaaccagaaatgaaagaggagacatcataacctataccacagaaatccaaaggatcacaagaaactgttatgaacaattacacagcacacattgaataagctaaaaaaagaataaattcttagtctcatagaacccaccaaaactgaatcatgatgaaacagaaaatctaaacaaaccattaatgagtgaggaaattaaatcaataaaaagcctcctatcaaagaaaatcccaagacctgatagctttactgctgaattctaccaaacatttaaaggataaaataccaattttttgcaaacttttaccaaaaaatgaagatgaagaaacattctcaaactcattttaccaggccagcattaccctgataacaaagccagaaaaagcaccacaagaaaaaaaattacatgcccatattcctaatgaatatagatgcaaaaaccctcaacaaaatactagcaaactgaattcaacagcatactaaaagaatcattcatcatggtcaggtgggatttatcccagagatgcaaggatggttcaatatacaataattaatatgatgcaccacattagcagaatgaaggacaaaacccatatgatcatctcaatagatgcagaaaagtcatttgacaaaatttaactttctttcatgaaacaaacactcagcaaattaggtacagaataaatgtatctcaacacaataaagagcacatacaacaagcccatagctgacatcatattcaattgagaaaagttgaaagctcttcctctaagattaggaagaagacaaggatgcccactcttgccatgtttattcaacatagtactagaagtactagccagaacagttaggcaagagaaagaaataaaggcatccaaattggaaaggaaaaagttaaattgtctctgtttgcagatgacatgatcttatatgtagtaaatcataaagactccatgaaaaaactgttagaactaaaaatgaattcactaaagttgtaggatacaaaatcaacatacaaaaatcaacagcatttctatatattaacatgaattatccaaaaaggaaataaagaaaacaatttcatttacaatactaaaaaagaaatacttaagaaaaatttaaccaaggaggtaaaagtttataatgaaatttataaaacattgaggaaagaaattgaagaacacaagtaagtggaaagatatcccattttcatgaatttgaagaatattgttaagaattcagtactacccaaagtgatctacagatttaacataatgcctataaaaattccaataacattttttacagcaataggaaaagtaatcctaaaattcgtatggaaccacaaaagaccctaaatagctaaagcaattttaagcaacagagagatatcacatgacctgattttaaaacctaccacaaagctatagtaataaaaacagcatagactagcataaatacagacacatataccaatggaacagaataaagaccccagaaataaattaatgcatttatggtaaataggtttttgacaaaggtgccaaaattatggggaaaggacagtctcttcaagaatgtatatccatacatagaagtgtgaaactaggctctcattttacaccatatacaaaaatcaattccaaatgaattaaagacttaaatgtgacacctgaaactgtaaagctactagaacaaaacatagggaaaatgctctatgatactggtctgggaaaagattttttggctatgaccccaaaagcacaagcagcaaaagccaaaatagacaaatggaatgacatcaaactaaaaagcttctgcacaacaaaggaaacaatccaacagactgaagagacaacctatggaatgagaggatgtattcacaaaccatacctctgataagggattagtgtccaaaaggtataaggaattcaaataattcagtagtaagaaaacaaataacttgatttaaaaatggacaaaggacctgagtagatgtttctcaaaagaaggcatacatgtgccaacaaatatatttaaaaggtttaatatcactaatcagggaaatgcaaattaaaaccataagataccacctcaaacctcttagaatggccattatcaaaatgataaaagacaacaagtgttggtgagaatgtgaagagggaaccattacacattgttggtagaaatgtaaattagtacaaccattagggtaaacagtatggaggttcctcaaaaaattaaaaatagagctaccatatgatccagcaatcccactattggctacatatccaaaggaaatgaaattagtatgtagaagagataagtgcactcctatgtttaccgcagcattattcacaatcgctaagatctggactcaagtgcccatcaacagatgaacaggtaaagaaaatatggtatatatacatgatggaagcttcaaaaagaaggaaatccagccatatggatgtacctggagaccattatgttacataaaataaactaggcacaaatcaagtatcctatgatcccacttacatgtggagggtaaaaaagttgaagtaattggaacaaagagtaaaatagtggttaccacagagactgggaggtggtgggattaggtagatcttagccaaaggacacaacatttcaattagacaaaaggagtaatttcaagagatctattgtacatcatagtgactacagctaatgacaacatattgtgtatatgaaaattgctatgagagtggattttatgtttccattacaaaaaaagataaatttttcagataacgcatgtgttaaatacctttatttagccattctacaatgtgtactgtgtatgtacatgtgtatatgtatataatctcaaaacatcatgttgtacaccatacatatatacaatttttacttgtcaatcaaatagtttttaatttttaaaaatttacaccttccttttggaataaatatcccagctctcaaagctgataagtaatgaagtaaggatgaagctacctgatttggctgatgtatggtccagagaaggcgatgcatatgggacaaaatcatgaattaaaaaggcaatttttctttagattaaaaaatgtcaacaaatagcaatgtttgttattctaaggaaaaattatttatgatacatgaaaacataaagaacatccaaagctgagaagtattctttcttcattctttttatagtcttcatcttaagtgacttcaatacataccatttatcagcatgtctgttacatcttatattgaactgtttccatggaacatctccatgggtcagactgtagcctcaaagatactacaagcaaaagagaatccagcagtgtagtgggagaaggaggaaaaccttccctgactgcttggaaattgatgtatttatgacatgaagaagttaaaagactaggccaagaggcacaggatccagataaaacaacttccctcgggttccagagacatgaaaataaagaatttatagttatcaggaaggaggtaatttgctgaaattcccatcacagatccaaaaacgaggaaggaggcagacatgtgttaatagctccgaagtggcctggaagtcttattttgccagtgatttaactgaagatcaaatacactcatgtaaggaaagcagagaaagcttgcataagtctctggcctggacctggaaacccagtctgctttatttccttgggggagcaggtttcctaattcttccacgacatttgttggttaaatgttgaccaacaaaagcagaatgttacattgtgtttgatgggaggggaaagtccttgttttctatctagtctggggaatcatacatcaatccacacaggaatatgcatcaagtgtttccatcttaatgagtggcatgattccagaagggcaacaggccaggagagctctaaagcttccctgaaaaaatggagaggctggttgtgttttgttcttgccttggatggatgaagaaatggaagcaggtgccccattgggaccatggatcaaatgcacttaggaacttaaaggaaagtctaggggctctgagtgaaccagcacctcctgccctgctgggggttagaggcttcactggctagtccgaagcctagtggttttgagtaagaaaagaacttcaaaacattttactgtgatttaaaaatcctccatggtgagcatgcccagcttttgttctctcgatgtacctccaatctctcaagaagacataatttagtaacgctggggttgctgctactataaatgctttgattaacattagaggaagaggacgacagaaagcagcttctgtcccagccaattaaagagcttgtttaaagtatgaaaatgatttattagacatgcaaagagggttgcaaagaagaaagacacacagtctcaatttaaaaaaaaaaaaaaaaaaaacaaccacaaagctttggtccaggtgcctgccttctgacaacacagataaacagtttagttgataatcccccacatcttcttcttcagcacagcaatttgttccagttatcatactttctaaatagaataaaagaaaatgatgctcctttataatatatatagggtttagataaaaataaatagcacagtccacatgctttaaaccaaagattgagtctgtgtgaacagaaataccagatagctgtttgatacagcatttcccaaatagatatatctgagagctctgctaaaaaaaaaaaaaattaaatttttttaaaaaggaaagctagaaaaaataataataaatagagccttgtgatcatatatgtgcatcaacaccggctatatactcctttcggaaaatcacaatgtacgtgactcttgcagtaaagaaatgtgtttaacatttttacatttttaatacagcatttctcatacatatttgactgtagaaaccttctctgatatgacgactattgtcattccctagaattagtattctgttcaacatacttggaaaatacttaactagccaatctatttacaatgggaagagctataaagtccctcagtcattaacagctaatacacttgaaagattgttagcagaaaaaggaaaacatgacgtcaggaagctggggccatggattttgtcccttacacataccttcgttttacagacatcacaatgacaaattcaccctgacccaactgaggtcacatcagcaactgaatgtaggtggattgtctgaaacccattaccgttgtccacccaccatcatagaaaattattttaaatgtatgtattatagtaagagtactcttgatagtattattttttctttctttcttttgagagagagtctcactctgtcacccaggctggggtgcagtggtacaatcacagctcactgcagcctcaacctcgcaggctcaacctcccaagatgctgtaactacaggccagtgccaccgtacctggctgattttttgtattttttgtagagacaggatttcgcaatgttgcccaggctggtctcaaactcctgagctcaagcgatctgcctgccttggcctcccaaagtgctgggattgcaggtgtaagccaccacacccagtggctaatattacttaaaccatataaaactaggcagtggagaaagggagtaagagtacaggctccagattcagacggactttctctgaagtccctcctactgcccatggggacttgaacaagttacttaatttctctataagcctcaatggcttcatctgcaaaggagaataatgacagcatctattttttaatgttttgtgaaacatatggaataatgcatagtaagtgcatagcacagtaaatgacacatattaaacatagacaaatattagctgtaatattttatcatcattttctttacaaataatagtgtttttggtaactaagactaagaagaaaagaaggaagacagaagttgaatgtccttgcagatggggggcaaatctgctggcaagatttgtgatgtgtgttgctaattatctgtgattaactggttaatagattagttaaatcatcctgttggctctgcggaggatgatctggaaggggtggtactagagtcagggagacaaaagcagtgggaaaagataacagaggatgactggagagactttggagctggaattgacagaatttggcacctgattttgcatgggcatgagatttctggcttagaagagaccctgaagtttcataatatggacggtgatattactaagatgaagaccacaagagaagccactcttggctgagcgcaatgagtttggttttagacttgctcttgcaagcttctggtaggaaatcttaatagttaagcacgttctgatagaattttggcacttggctctaggaaggaccctgattagacatagatggagctatcaatgggaagatagttgagatcacatagataaatgatacacagagagaagagcacagtggcatagtggagctcagaggaatgtaaatatttaagagataataagaggcagtggaaccaatgaaatgatgaaccgagagtaaagtagaaagatgatgagagagaataacgtcctgaaagttaaatgagcttgagtcaacaagcacagaaatcagggctacaggctacatgccaagcctctgaacttcctccgtcctggaccatggaccaagctcagtcctgttttccccagagacccacagaaacgccagtttgcctcctagtgtaaccctgcaaagaaagcaatgtcgttctgcatcaatgctgatgagcctgcgctgttcagtatctgtggggcttgccaagctactcctgctcatggaaacctcagtcaggagcgaggattccttggcagatcgtccctgtgttctctgcatgaggtctctgatctggctgcaccaataacaagaactaatgtcatgtttacccttcacaaagttcaaaataacggtacttcgaaattagccaggcttctaataagcagtctgagaagtacacagactccaaaacagtgtttgcagagcttctgtagaaaagatcatctgcatcagaggcagctgagatcctaatgaaaaagaactgcaagactgagtgattggaaatagctagggttatggctcagcaagctgccttttcagcaagccttgcagatgattctgatgctcaccaaagtttgtgagccactgatgactacagaaatagaatatcaggctgaaacacacaaaaagagcaccatcggggaaaaataatatgaagaaaatactacatttttagtcctggtccctaatccttcaaagagttgttatgctttgtggaaactaatcaggtctagtctcccacctttcaaattatttctgttaaaatgttctcccctcctgcccagaattttctaatacacagtggaatgctttattgctctctttaagcatgtcaactagagcaggagaaaagtttcccatgtattttcttcaaagaaaaagatgtttaaagtttaatattaaaagaaagagtcatgaagtagtttaacatttttttcacagggcgcagagagttgcttctgcatggttatttttactaagtactttccaatttatactttatttttctcaagtataaaaatggatcttcctacttaaaaacaccaatgtccaacttcatggtcaaatgtaaactttggaaattattacttgatttctgttagtggaggaattagaagagtttttgttccactatgttattccaacctcatctcctcgtttgtcaagattcttaagctgaacgtttttctgcgtgcatgcatgcatgtgtgtgtgtgtgtgtgtgtgtgtgtgtgtgtgtggtcacagtgaaacatagattaaggctgagaagtaacaaccagctaattattataagtatagatataggccatggatattaaagtacccccattttgtgttgatacatgaaatcatagaaatttcatgtatcatagagattaatcacatagagattaatttagaccataaaaacatttcaattttcaggaatcccttattaaaataatttttgaaaaaacaggggtgaatattcatgaagccaccacgtcataaaggtttggttgatgaatagtgagagtaggggtgaatagaggtaaagcaggagacacattggcaaggtcagggctgcaagagacaggagagcatcgaaaccaaaccccaccttcccacactcctaaagactgtccagtgagtaattttcccatttatacaagagcctggtctatgaaggcaaataaaatggaaggatttaccctcactgggcattgaagcacaaaccttgcccaaggccctgtcccgagcaaaagagcttccctactgggaaagatcaagatcttaatatcccttaatataactcaaataatcattagccaacctgagagaagaggacaggctctgagtctgaggagaagggttggaagggtctggttagtgcctgaccttcctataatataaagctacttggagatattagagctagtgaatgccttctcccagccaaatccatgctccaggaatgggcacagagttgcaaactaaagatcaattgttcatcgtggtacatgtctttgtgaggtattatgggacaaacttcagttcatatgggaaaaccgaacccttcccacgtggtccgtgaaaacccagttgcacattttcagacaacttctttatgagtacagggcattaggaagttgaaccagcccggccaatttagaacaactggtctctttaacatgagcattccccgtcagtgctaccaaactcctttccatgtgtcccatgcaaccagaaaatgtgttgtttaaattcagctcgtgtcatttgtaaaaaaaaaaaaaaaaaaaaaaccataaaaaataaaaataaaaataaaaaaattaaatagtttgacaagataaatcagggactttggaataaagagttagtaatatgttgagtagtttgtcacatgatatcatttttaagctactcttttttgggggggcggggcacggagtcttgctctgtcgcccaggctggagtgcagtggcgcgatcttggctcactgcaagctctgcctcccgggttcacaccaatctcctgcctcagcctcctgagtagctggaagctactctttctaaataacttcaacaaatattactgatgtgataacaaggcttgatttcatcaagcagtaactctgtctccatgtggatagcggtcttttgaagccctcctcggctgttagagtgcataacccacagctctcaaactggtggagacaaggtggtatgtttgactaattcagtgacgttcggtaagcacctactatgtgcccagcaaggtgtcaaaaacagagcaaagaacaaaataggcaaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatgaggtcaggagatcgagaccatcctggcaaacatggtgaaaccccacctctactaaaaatacaaaaattagctgagtgtggtggcacacgcctgtagtcccagctactcgggaggctgaggcaggagaatcgcttgaatccaggaggcagaggttgctttgagccaagatcacgccactgcactccagcttggtgacagagcgagactctgtctcagaaaaaaaaaaaaaaaaaaaaaaaaagcatgcttgtgtgactggagcctaataagcaagtgagagaatagaattggatgatttcagaggcagagacaaaatataaggaggtcctagctgggcacagtggtgtgcatcatagttccagcaactcaggaggctgagcaaggaggatcacttgagcccaggagtttgagtccagcctaggtaagatagaccccatctctttaaaaaaattttttaaattttcattaaaataaatataaggtctttacgtgctatgtattccatgaagtccagagctatgaatgccatagagtaggttctcagtaaacatatgagacaaaatatggctgagggtgaccttagatcaggctttctgaatcttacagaaaaatcttcttttgaatctcttttagctgaactttgaagagaaggataaagtagcatctgtttcaggtgccagggaagcccagaataaaaggctcaggatgacacagccgcatcaacatccagtgtttattggccatctgtcccctaggaatgtcttaagagctcatgctctatttacgagaacagccggggacagtgagaggaaggaagaaattgctttataaaaaagagtagctgcattcttttgtgtgtggaaagagcactattgtggaagcgacgaaacccaggtgtgtaaaaatagaaccgagtgttcacattaaactttccgtgcctcagtttccccacatgaaaagtggacataataacagcacttgagtgagaattaattgagataaaacctgtgttgaaatactgcttagaacatgggaagggtctgagctactatttattaataatgccattatcatagattttagctacatttattaataactccatgaatttagaatgttaatggaataaggattggagaagaaaaatttgctatggccagtgagaattccttgcaagaaaaaagcattgcaattgtgtgtgtgtgtgtgtgtgtgtgtgtgtgtgtgtgtgttggatatgggcagttgtagtgtggaacacctcagcagcacccaggcctcacttgtggatggtacaacctcaggaaacttactcttcctcagtataaatgagaaggtccccttttcccccaatggctgcagtgttggtctaggatgaggtcttctctaccctcatctgcgtagttccaggatggactttctcctcaaaatcacagtccaataaacaaaagtaatgaaaagggtctaacttccgtttgtatctcatgaggagcatcaaaaaccagttagttcctagcatagcacacagcactcttgaattctttcagccattcccagggccctcgcttctctaccctgcccctcccatccctgtcaggtcctgagctcctccttgctcctccctccttttttttttttggttttttttttttttttttttttgagacggagtctcactctgtcacccagacttgagtgcaatgtcacagtcttgggtcactgcaacctctgcctcctgggtttaagcaattctctgcctcagccttctgaatagctgggattacagacatatgccaccatgcctggctaatttttgtatttttagtagagacggggtttcaccatcttggccaggctggtcttgaactccttccctcatgatccactcgcctcagcctcccaaagtgctgggattacaggtgtgagacaccgcgcccggccacgctcctccctcttttgaagacttgttggactcttgtctttccttctccttcctctttccttttccttttgttctgtctaaactcctacagaacaaataaatcaatgaacgaaacacctaggtccttcccagtgtgaatcctttccattaccatccacaaaggtgaccaccattaaagctgtgtgtgaaggcttctagacattagtcctttattctgagtttaagcaaatacacacacatacagatgcatgtatgcatatgcgtgtatgtgcatattatatatgtggggtatatacacatatctttgtatcaggcacataaacaatgcacacatacttaataggtttgtgcaaaaaaactgcaattacttttgcaccaacctaatattactataataaaatggagctgtgatatacattttattctgaaaatagcttgtcccttaacaacatacaatggacaatttacatagatcgattttatggtttatgccacattatgtcacattttttgtccaaatgaatgcatgtttcttcaaatacatacagtaataaatgtatacattgtggttacttccattttttgctatttgaaactctttataaacatttatatacccaaaggattataaatcatgctgctataaagacacatgcacacgtatgtttatagcggcactattcacaacagcaaagacttggaaccaacctaaatgtccaacaatgatagactggattaagaaaatgtggcacatatacaccatggaatactatgcagtcataaaaaatgaagagttcatgtcctttgtagggacatggatgaaactggaaaccatcattctcagcaaactattgcaaggactaaaaaccaaacaccaccgcatgttctcactcataggtgggaattgaacaatgagaacacatggacacaggaaagggaacatcacacaccggggactgttgtggggtggggggaggggggagggatagcattaggagtaatacctaatgctaaatgacgagttcatgggtgcagcacaccagcatggcacatgtatacatatgtaactaacctgaacattgtacacatgtactctaaaacttgaagtattataataataaaattaaaaaacaaacaaacaaatcactcacaccatggaagcacaaaactaaaaagttcagtgtgtgtgtgtgtgtgtgtgtgtgtgtgtgtgtgtgtgtgtggtgttctacttgaggtagaaggtaaaagattaaggagaaaaccaagtggattgaaatctgcaataaagcgaccattctccagtactaaatgcacttgaaatttattcccctgcatctgtaggtaaatgtccttctgttcttgaaacaataaatccccataaacttcccataaagttctgcagaagtgaaatgtgagattggttcccttggaatccattcagtgctttgtttgtgcatcttccaatcttaattttagagcccttgttcttcgtccagagcccctagactgggaaaaggtcagaatgcaacatgtttcaaagctgctgtgctctgggtggctgtcagactgttggagagaattgctttcaaaacccagagtatgccaccatctactcagtttcagattagcgtaacccacagcaccatgctatggcaggggaagctataatctttgctttttgttatcatttaaattcacttttaaaaatattaagattctcaaacagccagattctgaacatgcagtcttccccattgctatcaattatgtctaaggcaaaaaaagaggaccaaaacttctattttttctaacttttattttaggttcaggggtacaggtgcaggtttgttatatagttaaactcgtgtgacggggggttgttgtacagattattttgtcacccaggtactaagcctaatacccaatagttattttttctgctcctctcccttcttccagcctccaccctcaagtaggcccctgggtctgttgtttccttctttgtgtccctgtgttctcatcatttaactcccacttataagtgagaacatgtggtatttgattttctgtgtcagtttgctggggatgatggccttcagccccatgcatgttccctcaaaagacatgatctcattcttttttatggctgcatagtattccatggtgtatatgtaccacattttctttatccagtctgctactgatggacatttaggttgattccatgtcattgctgttgtgaatagtcctgtgatgcacatttgtgtgcaggtgtctttataatacaaagatttctacgcctttggatatatacccagtaatgggattgctgggttgaatgcaaaacctcaattttacaacttgaaatattgaagcgggaaatgtaagtgaaatcccaaattggcatgccatactaaatgttattgtaataacttatttaatatttgattatccaagcacgtacttttgtaccacattctgctcaataaatgtagaaggaagtgccgccattttggattgcagcagtacctcttcgtgcagtgaaaatcttttatgttgtggcccagccagaccctcagtgcagtttgcatatagctttggggcctgtagtgctgtggtaaccattgttgaaccccaaatatccaagacaggtctcagtcaatttaggaagtttattttgccaaagttaaggttgcgggcccatgacacagcctcaggaggtcctgatgacatgtgcccaaggtggtcagggcatagcttggttttatacattttagggagacatgagacatcaatcaacatatgtaagatatacattggttctgtccagaaaggcaggacaactcgaaatggggagggggcttccaggtcataggtaggtaagagacaaatgcttgcattcttttgagtttctgattagcctttccaaaggaggcaaacaggtatgcgtttatctcagtgagcagaggagtgattttgagttgtgtctgtcctttgtccacaaggatattccttgtgagggaggtatgtagctttttttttttttttatcttagtagctatcgtttttaggaatacagtggaggcaggtttgccctaagcagtacccagcttgacttttccctttggcttagtaattttgggggtctcctttcacatcatccacgcagcagcaacttctggtgaacacactgttcattattccaggcaccacttatgcagtctgtctttccctgatacaaattctcagatttctttgaaattaaaactgttctaaatctgcatactggatattacttcattcacattatatttattttaattatgtaacacaaagttgtaaaacttctgttagtcttaatatagactcatatatgtcctgtgtcatcaatgtgaattccattttcaatcctcacctcaggatgattacgagcaaagcacagtgtgtctaagctccaatgcttcacactaaaaacagcaacaaaggccaccagttgcaaaacagaatcgttctcgctctcagatgtgttctttttatccttaaaatcagagcattcatttccgtttggatgcactatttatttttatatcagaaattattttcacttagcagttgaatggaatttgtttgcaggctttctttcaatagtatttccttcttcttgaggatatatgaattctaaggaaactgcagcacattttgtaaaaatccaaaccaattatctcacccctgcctacaaagaagtctttgttatttttctattattattaaaatatatcagcaagattttttggcctttatagttctttggtatttcaaaatgcttctgtatgatgttattgctttaaatcatcacaaaccctgtgaagaaagaattatttttctaatttacaaataaagaaactgaggtcttagaagactgaattcatttcctcgtctctctttctttgcactatgggttatcttgatgctttactgatcctgctctcccctgagacatgtggactctgttactgttttcagcaggaaaatcatggttctattaataggacatgtgaatctttttatttcctgtaatgaaaagagcacaaaaaggaaactttgatttgtgtaacgtaatcgtatggatcatatcaacccattaccctgggtatagagcagtttcccagtttcacatccgtcattctgctgaaatgggtggcttttttccacattttactcacctgatggatttgatataaaacctgtttttctatggatgtgaggctctggaggttttgtagtctatcaacacataaaggctgcctggcattacagcactcctgctctgcacagtggtggagtgtagctaaatgcagctcagtctttttacagctcagctatgaccatccttcattacaacagggcagatgataaaatggaaacttaatgctattagatcatgaattccaattatatgaagagagatggaggtaagagaaattagatgccaaaaggagatacaataaagacagaagtgacgttcacagggctggcagttctcagaaccattgtcacccatcattgtcagtaccacctgaggacccggtgaagatgactagcatatcagatatctgagaagggaaatgctgagtgtgtccaaacatccaaacaaataatgccaaacctagaaaagcttctgtccatatgggttaaatagctcttcaattctgaaactgtcaaaagtaggctttgcagatggtcatgtcaagcaatgataataactggtagtggaattcccatggttcaaatttattaaaaaaaacacactattttcatttattcaagaaacacatattgaatacctgtgtgtcaagctagatattacagttagaaatatatagaaagcacaatctctgctctctgaaatttgcagcctagcagaggagaggaacacatgaaagtaattataataacaagttagatgcaatgatagatacaagatatcctaggaggacagggaaatagtaccatgcccagtccggggatacgtcagaaagactgtctggaggaggtggcatctgaactgagtcttaaagaatgagtagaaatcaagtccaatgtggtatatgaactgagagagagaaggggaggatgttgtagaaaaagacaatccaaaaagaggaaacagtgcaaataaagctggaatccacacacaccattgtcatggtgggaacaatggtagctgcatgttgctgaaatatacattctgaggctaggagtagaaagagataaggctggcaaagcaggcctatgcttactatgccatgtcaccgagcttgcaatactatatattctgcaagctatttggaaccgttgggatttgatgcatgagagtgaaatggtcggttttgcattttattttattttttattttttttttttatttttttgtgatggagtcttgctctgttgcccaggctggagcgcaatggcacactcttggctcaccacaacctccacctcccaggttcaagtgattctcctgcctcatctcccaagtagctgggactacaggcacctgccaccacactcagctaatttttgtatttttagtagagacagggtttcaccatgttggccaggctcgtcttgaactcctgacctcaggtgatccacccacctcggcctcccaaagtgctgggattacaggcatgtgccaccatgcccggccttgttttgcattttagatggatttctctgttggctttatcaaggatgaatttgagatgagcagcagcaggaacagaaccaagttaggaggctgctgccacatccaggcaagagacaatgcagagccaaggcagcagaaggaatggagaggaggagacacagcacagactatttagaaggtgtggctatcaggccttggggattgactggatgctaaggaagggctcccaggttcctgccttgaatggcagagtgggaaaagctctaccttctgagatggagaatactgtggatatagttaatttggaagaaaaatgcttgctttcagatatttagagttagatctctactatgagtttaaggctaaaataggcatttcttactggacagctttaccttgatgatttatactgaagatctaacttatgcacaaatttgggaatcgttaacatatgattagtacttgaaatcatgaaatgggtgaaaattactcaggaaaagaaaaaaagcataaatattcatccctgggacacaggaacattttgaagttgtcattccccagagtcacccccacccccatggcacttcagtgtactgcacactttgagatatatatatatatatatatatatatacatatttttttttcctaataaatagagacgaggtctcactatgtcgcccaggctggtctcaaactcctgggctcaagcaatccaccggcttcagcctcccaaagtgctgggattatagacctgagccactatggccagcctgatagtctactccttaacctacaggaagcagacatcaatttgttttacaacctctacatgcaaaaaatactacatagtcttatttttactaaatcaaaactttgtttcttgctaaatcttcttcccctctttgccagggtgtaaaagattcagtcttgttattccccgctttctggaatcaatcacatagcaacctttagggcttacccaggacagaaattggagtgaggacaggaaggccacaagttcccatgacacacctagctattcacgtctccgcttctagttattaactttgagccccggtagacctaggattactcaggcataaataatagccccccaaatgaaaagtgggaaattgtagagccctaatgtggagagcctgaagagcttcataaaaaaatcttagacttgttcccaccctccaaacatgtgaaacacacaactgtttcaaacattttaaatgtaccgaaattacctcataagtaccctttatatttaaatgcactaataatgggattgacatgtaagaatttccatgactaggaacaagcccgttttaccacaagccccagaacctggctataggtcagctcacagcagtgcaggaagcacctcaactgctttcaccagcatattctttttctctgtgggaccccatccccattctagcccaaaggacccgaatcacagagacacacagggtgaaatatttatgttgttgactcctcccgcaaacttgtcctctgatcattttgtgttgcagccgtgaaacaggcttgctggacgggaagaaatgctgcagagagagtggctgactcaaacccatggacagcattttattaataacttgcagcccttcattctaagtgaagcttgcccaataaaatgaggcctagagctgaacaaagctcctcttacctaacctgaatgtacaaaaaaggtttaattaaggaagtaatttttttctcccgtaaggaaatcttgacaaatagactcaaatttgcatgcaaatgaagccatctggttgattgttgtccacagtccccagctcacaggaaacaatagaaggccctttgcataactcagagaatctgcaaatctctaacatttgggtcactaataattttcagagtaattagtctcttcagagctgctatttacattggaaggtgtttgccatttacagcagaagctatagatattcttctaggtgcagccccagtgtgagccatttggtgacctgaggaaatcactcaatctgggaggggaatgacaagaccattggccactggagccagcctggcagcgacactcctcaccaaactgcagcccagagtgccttcacgcagtcttctccatgcgagccaaacgcagactcttctagccaccatctcttcccccttcctaattccccatctcccctctggggagggaggagacagggcaggggcaggcacaccaggcagggcctctacttctcatcacctgtctctgctactctgcagttatctcccgtaaacatttgttcaaatgcaatcatgtccattgcttgggtaactctaccttcttagtcgtcaggtccctcctcctttcatcagatttttacttaatggctactctacaaagcgtaacacagggctggtgctcaaggatgatagctctgattcatgtgtcctgaatggaattaccaaaaaattaaaaaaaaaaaaatcagtggagatgaagagatagggagtacagagttttggaagctagtgagggagcagaggaaggaaagagatgacgaggacaaaagggcagacatgggtgaggttgagaggagtaaaccagctgaggaagtgaccgctgcaggcttagctgtcaatcctggggtttgctgctccccgtggttggaactggaggacataatgctctgtgaaataagccaggcaccgaaaacaaatactgcaagctctcatgcatgagtggaatctaaaacaacagactcagagaagcagagaggaagatggtgggtacagaggctggaaggtgcagggaatggggagatggtcaaagagtgcagttaggaggaacatgcttggttggttaagttgtattgcacagcttggtgaatgtagttagtaatagaatatgtatatttcacaattgctaaggatgaatttcaaatgttcttatcccccaaaatgttaagtatttgaggtgatggatatgttaagtaccttgatttaattatttcacttcatattcataaatcataacatcactttgtaccccatgaatttatacaattatacattgtcaatttatgatttctaaaaaagcattagtacctgtggtaaatcaggctcaggggaaaagcctcagggtttgtcgtcttactgttcacacattgaaggaaaagaggctcctcttccatctttccccattccttggccaagcccttgcacaggctgactgtaagtgaaattaaagaatatcagtgtagtagtaagtaatcacatttgttgatcttttgttttgtgcctagcactctgctaaatgtatttcatgggttatctcctgagattcttaccataccctataaaagaggttccactgttattctgttcctggaccaaatagggtcgagctgcttattctcaccacccaataagagatgcagatgaactgggaaagaagagaggtgttttgttttgttttgttttgttttgttttgttttgttttgttttgtttgagatggagtttcgctcttgttgcccaggctggagtacaatggtgcgatctcggctcaccgcaacctccgcttcccaggttcaagtgattctcctgcctcagcctcccaagtagctgggattacaggcatgcaccatcatgcctggctaactttgtatttttagtagagacagggtttctccatgttggtcaggctggtttcaaactcccgacctcaggtgatctgcccgccttggcctcccaaagtgctgggattacaggcgttgagattctatttctgtaactgggtacagggagaacacctggaaattatcgccagatcaactcaaacttacaaagttttccagagcttacataccttgtaagctatatgtctatgagtaagtgtgcatttatctaaagacataagtgactcacttcttttaatttataactaagatctgagtcctgaagaccttcctctggagcctcagtaaatttacttaatctaaatgggttcagatgctggactaatgacccttgtctcctgctaaatcatggaggtttggggagttccttcagacccccattaaacttgtttgtggaggcctggggagtttcttcagacccccaatgaaacttgtttaatcctaaacaggtcctgttaagaattccttcattatcttgccatgtttcaaggtccagaaaaggcctaggcaaactctcggtgggcttttgttacatcctaacctttgtataagggcactgcttctttcagcttttaatatttaacttaaccattcagtcagtgctgaaacagttgttatggaggcctgcattagtaagacctggtctgccacaattccactgtacacatgaggatttaggaaggccaaatgatctgcctcacgttgcccagtaggtggagatggtagagccagaatgggaacctggaggtcggcttcctcagcctgcacacggaaacagtgcagggaagcttcaccaggtgacagcccagagcagcccagggactcacttcctgtcatcactcccaccccccaccacctcatcctggtagtaccacccgcgccaatgcttctagggctcttgctggacccacaggtggactgtgacttcagtctgttacctccttctcttcattctccacgaaagaacttcagcacatcacaagttcagttacttcactactggcagtaaaggaaaatctgtaagtccaggctgttgacaggcaggtgggaagcaagctgtggagctccaagaggcccaggaaccggaggcaggcaagggccgggctcagagccggaggaatggcggaacgtctatgtgagggtcagtcacaccccagctccccgctatgaccctgccagtgactgtcctactctacccatgcaggaagtgggggttcacactccagacaccaggcaccaaaaaatgggggtaaagctccttaataaaaacagaggaaattgacttaataaggttgacccctctccttagccttcttcctgtcagcttcccaagcactgagcaacagacatatattcctcatgaggaaagtagcggattcttctctcaagatattgaacattcagtgaccaaaacaagtcacagatactgacattcggagtcccttcaatgggacaggggactctccatgtgatcatgaagcccaaacatcaaatccaccaccatcccagacacacacactccagattgcagtcagctgtctagtacttgactgttcggtataaacagacaggtgagagtcaccaactatgtaggataatgtcagagatgtcataaaagaagggacccccaaactcacaatccagggtaggggtgggtggcaggaggtctgggaagaaacagaggcgacagagaaagcagaagaaaacttttgataattaaattaatattctcagagagacaagagaagatattgagatattgcctccaaaaaaattagaatggggtgctatgaaaaaggggactatcagagaacgagaaataatacttggaaatttaaaatatgatagctgaaattaaaacacaatgacagtattgaaaataaagctgaggaaatttccaaagaagtagaacacaaaggaaaaagatcaaaatgtggaacaaaattagaaaaaaaaaaatctaaaataaataggtgtttgagaaaagggatcagagaaattattaaagtctcagacctcatatgggagaaaaatctatatcaaggcaatcatgaagttccaattaaaagagttaaagaaaagatcctgaaagtttccagaaaggaaaaaaatgtaggttgcatataaggcttcgtaaacagaaagcagttgctttcccggtagcagccctgacagcctgacaattttctttctggagtttctcaattaagtgcgaaagtagaataatgactcatcagaggaacatgggtttagaaagttaacctcgagtatctcttttctcaaggagctacctgagaatgtgtttcaggaaaatgagagtgtagacctaggaagtggatgtcatgagatcctgaaacttggggatgtaataccaaagtgtggcaaaaggaagtccctgcactaatggcagagggaggtcccaggacaagggctgtgcaggaaccctgagaagaccccgtccaggtgggaacagaggaaagagagccatagaagatgcctccaggggacaaaaacgtgactgcagatggcctgatgtgtgcaatgttggaaaatgtttgagaagagttttactgctgtgttagagaatctggagagaattcgtggcagatacatagaaaaataagcaaatgaaaaaaataattatggattttaaagaaactaaatacaagaaaatacaattgcaacaaacaaaaatataagaaaatacaattacatacaacaaaatgcaagaaaatacaatttaaagaaaatacaagtagattttattggttggcttttaaataatattacatagtcctaaaatatgaatactgtgctaaattttagtattattattattattattattattattatagtgtcttactgttgcccaggttgaaatgcagtgacatgatcacaattcactgcaacctcgaactcctgagcacaagggatcctcctgcttcagccacccaagtagctagaactacacagctattttttttcagagacaggatctcactgtgttgcccaggctggtcttgaactcctggcctcaagcaatcctcccacttcagcctccccagtcactgcaattacaggtgtgaggcaccatgccaagcttgaatttcaatataaccaaaaatctgtgatttagctatttggggagaatatagagaaaggggctggggaagcaggcttataaaagtgctaaattctcatcttatattcaggaaaatcagtagagaatatctaaaaggtataaatcaataagtagctccagaggtttttttttttaaaaaaaaatacagctgtttaattgaaagagttaaaagtgtgagaaggtgtctctaaggaattgggaaggggcgggaagcagggaactgctttttgctttagtcctagcaccactagacttttataactatgtacatgtaatactttgttagaaacaaaaattaggttgaaaatgaaatgctgtccatcagaaaatgtgctcagaaagcttgaagttggaatcctatactatcttagtctgttcttgcactgctgtaaaaaaatacctgagactgggtaatttataaagaaaagaggtttaattggttcacagttcccgcaggctgtacaggaagcatgatgctggcatctgctccgcttcttgggaggcctcaggaaacttacaatcatggcagaaggcaaaggggatgtacacataccccgtggatggagcaggagcaagagagagaagggaaggtgctgcacactttaaacaaccacatctcataagcactcaatcactatcacaaagacagcaccaagggcaatggtgctaaactattcatgagaaaccgcccccaggatccaatcacctcccaccaggccccacaacattgggggttacaattagacatgagatttgggtgggaacacagatttaaaccatatccaataccaaataatcactggtcggattcaagtaagtggctgctatgaaatttgtgtgaagatatgatagtgcattttctattgatgcttaattggggtttaaaatgatgtgatgatggagaccagcaagcctgctttgcaggctcagccccgctctcctgcactagctagaggtgcctccctggttcctcttgccacacgtgatgagccctggccttgcctaacatgcagtcacaaagcttctcatgtgattgactcacttccaagctgcagagccttcagtgtcatctcgatcattctgtaaagcttttgactccagccccgggctgggtctccagtccctctctacctgcctcattattctgttactgttgactgacccttccagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgacttccccgtgaatgagtctattcaagagatcaaattagattgaagttgcttagtgagcatagaattagaataaatggaattgtggtctatagagatatttcatcacacttgaataactgatggaactacttttctcctctctgcggatatttctgtctgaataaccagtgctgggcctcaaataaatactgacatgttttacttttagctttcctttttctagaatcattttagacaactgcccttctgttaatacatcaccacctcagaaaataagaaggtacttgattggattgaaattttaaaatgttaattgcattcgtatcctggggatacagcctaaagagacagaattgctttgcttaaggctgaagtctggctggggactttgatctctgcaggctctcgggtccttaaagggctctcacccaattaggatgagctgaatccttctggccctgggcctcatctttattccctcccagcttcaggactctctgatgagcgagagcgtagatttaggttttctcacagaggtgcacctgaacgcctcttgctgtgtagtaaggcagatgttgaggggggaggaaggcttacccttgataactagcaacttgagctttgcaaagcgcctttctgttcctgttaccagtagcctacactacatcatacaatattctcctccccaagaagaaagcaacctatttgcctattttctcctactgaaatctatgattttatactttgtttaaaaaaaaaatagcagccgagcatggtggctcatgcctgtaatcgcagcactttgggaggctgaggcaggtggatcacttgaggtcaggagttcgagaccagcctgaccaatatggtgaaaccccgtctctactaaaaatacaaaaattagcctggcatggtggtgtgtgcctgtaatcccagctactcaggaggctgagacaggagaatcgcttgcacctgggagggggaggttgcagtgagcctagatcgtgccactgcactccatcctgggccacagagcgagactctgtctaaaaaaaaaaaaaaagaagaagcttaagactgcactaagattaggaacacattaagaacagtttttaccctaatgaagatatttacaaacatattttgcactagttccctgtttatgtattacctgcgacagtaattaataggaatgccattggctgagacagcttcagagccctagatacctagggaagcaagccaaatcctcttcaatgtaaatactgaaacgaaactaagcttatcagcaatcagaaaccaccacctaacctctaactaaagactttccacattaaccaatcaaacggtttctttgtcttgcatccacaaacacatttctctctctccaaccccgcaccccagtagacaacttgaattctggtgctgcccaattcacgaatcactgaatgtccaaataaacatgttaagattttaatatgcctaagtttatcttttaacatgcctggggacttatctagatgttgctatattctagacatttctaaaaacaaaaacaaacagcattaattaaataagaccatattttaatatttcataatttaaaattatgacttaagcatggcagaaccaacacaaagtaacttttatttgaaaatagtagctcaatttaatattgcatatgtgtataatttgcataaaaggaaggaaaaatatcatttgtgtatgaatagaaactaatggagtgcacttagttgattcattgtgccttttggagaaaagatatagcaaataccgtgttttttaaaaagcatacatttggagtttagtatcagagctcaaggctttagtaactgctttaaatcacacccatatattttagtctttagctgtgacagtaagtgtactcagaaatgtgcacattaaaaaggaatttctcccctgaagatgaagttgagagccaactcttgatcccatattaaattcttagtccatctgtcctaatggagtctgagtaacgcagtttggtgtttttattgcatcctgcgagctgcttttctcctggaaacactggctgctctgtcaggcaatgagtggggagaggcagctggtacaatcacatcttctccaagagctcaaggacagaggctggctgagagccatttggtgggctcactgcctcatccccatactatacaacaatcccacaggccagagcctcacctgcagtccccaggaggaagtaggaagggaagagaaggcaactcacctctgagagtttggcgcaggagaggtgaggaaactgccctagcctagtctggtcacttctgcctcgttcccggctcctcacctcctccaggctccgtcagttgtattcctgaagcacctgcaccaggtgtctgggtggccgttgacacaggagtgagcactggctcttccaaggcagaggtggatgaaaagcaagagcaaactaccaaaaactttgttcttactttgtcatcctgaggtttatctcagatgctgcttgcaccagaccaaagctaccagtacatatgcaggagttcaaaacagcccccacccacccacagagtaaccccaggggcttctcccaattgttgtgtctattggcatttacttcttagagtcccataggactccttggtaggaaccccaactatatcaatctttattgttatataattataaaatattgtttatcataaatattataaaatattttattgtacaatttatagaaattctatattaatatttaattttatatagattgtatatattaatactttaaatatctttatatgtaaatgaatattatatagacacacatataacttttggaaagtcaaaaatatatttgtgaggatttggtccaatgttgttcaacagaatgagagaaaataatgactattgctaatggtacttattaaactcaagcaatgggtatctgttacatgactaggctgatcagggtgtgagttaacctgatttttttgttttcttcccacagggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtgtgagtataagttgcttgtcaactcatggggagccactttcgtcacctcagggtggtccgggtcctgattgtggaaggccttttgattcaaacgtggaaggtttcctttgttccaggagcaggactagaggtggacacacaagcctgagtttgggctccaacctcagtccctgtccttgggatgctctcagggaagcaggcacatccagattctcaagcaattagtcaagaagatgagagagaacacaccgccctgagaatgtgggagaggaatgtttatcttcagcttcatgtcttgtgtggctgttttccaaagagacagggtcaaaaataggtgaggggtgtgtgcattgacccgaggagcagggagtgaggaaaatcatgtcaaggtcaaggaagacaggaatgataactagtgacatccgtgtgagttcaggaggccacggagaccacaggactgggcaattccatgacacagagtctgcaggattcctacagaggacccacacctgcccaccctctgcaagtgagttctggatgtcatgtacttagccaaagatacagagacaataagaggcagagcaagagaggatgctgcttagctcagctcagctggccttggagcaaacatcctaagggggcgttcaggcttggggagctccgtcagtggaaggtgggggttagctgcacaagacttgagaagcgcaatgcttgccctacctggaccctttaaacatcagggccccaattcagctttaggaagttacaatcccctgacttccaggccagttgattatttgcaaatgttgaactccgttggctgtgagagtcagggagactccactggctgtgagagtcggggagatcaaccacaaggacgaggccaggctatgtcccctgtccctttacaaaacctcagccttacactcagcatatcaaaaagtctcccttccggccaggcacggtggctcacgcctgtaatcccaccactttgggaggctgatttgggtggatcacgaggtcaggagttcgagaccatcctggctaacacagtgaaaccccatctctactaaaaatacaaaaaaaaaaaaattagccaggtgtggtggcgggggcgcctgtagtcccagctacttgggaggctgaggcaggagaatggcgtaagtaaacccgggaggcggagcttgcagtgagcctagattgcgccactgcactcaagcctgggtgacagagcgagactccgtctcagaaaaaaaagtctccctttgccaagtctgtcccctttaaatgagtgcttatgttcctgggtctggtctgagaatgatcccaaatccatttcccatttctgctgaaatgctattggattcacagtagcattcttaggttcaattccacaccgtcaggtaaattgctcaatctctttgaatcctaattttctgatttataaaaaggaaatgttaatttgtgggattgtgatgagaatagaatttaaatactcataaggcatttattttggtatctagtagttattgtaattatcatcttctgaggatgcccatggcagatctgatctgagccaggtctgattgaaagggaggctaaggctatcctggtcctagaattaaaattaactaattaattaaaatcccccctttactgaattctggataagaataattgaaaggggattcttgcttccctcagttaaaattaactaactgaatcaaactattttctgacttctacataagttggatcaaattttagaaagattttatggccacaaaagaaaattgccagttctatatttgagtggttctgtaagtttctataaaagtgcttggattcccccatctttattttatgtcctcaagttttgtaaagccacgcctgggtaagaaggaacacatactagatagagggagagcaggtgtttctactcagccctcggggtcaaagaatttctctactttcttctacttttttctttttttttgagacagggtgtcactctgtcacccaggctggagtgcaatggtgcaatcatggttcactgcagcctcgaattcccaggctcaggtgatcctcccacctcagcctcccaagtagctgggactacaggtgcgtggcactgcacctggctaattgttgtggtttttgtcactgcgggatctcgccatgtcggccaggctggtctcaaacccctgggctcaggcagtgtgcctgccttgacctcccaaagtgctgggattacaggcatgagccactgcacccagccactaatttctaattatgaaaaatctttagagctgtcttcagagttttccaggtctttccacagtatgaaaaccatgtggcccatggttcacagtatgaattacagcctccttttgtcaaatacctttactttcactgtatcctttactctgggcaaaaacatgtgaaacgttcaagacccagattcgagcctctaatcttccctcagagccccctgtatctactaataaccagagagggtggaaagacattttcacgatccccaaaatgtcacatattagatgcccatcattatatgtcatctccatcagggttcaaaggagcctcatggagagggaggcagacttctgtatttaagaaaaactacaaagcaaaccaaaagtggtgctttcatgaagaacatggagaaaaaaatggccatgatggaggcttgttgctgtcgctgtctcatcaatcacactttttctttaatttttttttatttttttttatggtgtctcgctctgtcgcccaggctggagtgcagtggtgcaatctcagctcactgcaacctctgcctcccaggttcaagtgattctcctgcctcagcctcccgagtagctgggattacaggggcccgccaccgcgcctggctaatttttgtatttttagtagagacgggctttcaccatcttggccaggctggtctcgaactcctgacctcgtgatccacccgcgtcggcctcccaaagccctaggattacaggcgtgagccaccacgcctggccgctgatcatactttttcagtcagacacttcgccatcaggattcctgagacattgggtagagaattctctcaggcccacttccttgtgtgaggaatcactctgcaaacctaattgttttcacaacagtggcgggctaccagaggggcctcaggaaacgttgattctgaagttaaactctttagaactgtctctatgtttttcccatttagcttgttaggccttctgatctctttctgataggaattcacattttttttctctaagcgtgtctcagaggaatttggtcacagttcatgactacatattgctttccagaatgacagttctgttaattaattacattgtgcccttctgtcaagagtggaagattctcgactcagaaaacaatgagtcagtgtacactaagttaatgagataccatcagcatcttatgcacaagtagaaaaacacagagataaaattagggcaatctcactcattagcatgctttaatggtaacattttaaccctatacttcatgtatttactattcatatttattcattcatttaatgagtatttactgagtatctactatgtcccaggtacagtgctagtgctgaggtaatttagtcaaatcaagtgtgatttctttccctcaaagatctttctgtttgttttagaaagcaggcaagtaactcaggagttatgataataacaaaaatagctcagcttcattcagactttcaggcctcgttccaggcgttttacgtgaatcatctcacactcctaaccaccctgtgaagtgcatactagcattcacatctccattttacaaacgaggaaactgaggcacagggtgagcaagttgcctggccaaggtcatacagccaggaagtggcagagctggtgtttgaccccaaacattatgtgtctgtcccaaagtcattgctgctaaccttaaagcacactgcctcacagaacagatagcaagaaagaggccgggagcactgaggggaatttttaaacctgactggcttgacaaggagcgcctcccagggatggaatgctttaattaaattttgatggataagtagaagccagtaaggtgaagaagtgggggaagaacaggagccagggaaaaaaggaagtttcaggataacaccaaatgaacgaaggtgtcggagactgaaccgaaggacccaggaggggacaggtgcagtggggaggggcaggggccagcaatagcaaggtgggcacagatgagcacccaatgcactctgccagggggagcatctgactcaacatgaccctgaaggctatggagagccagggcgtaacttgatcaggtttgcattcaccagagaaaagactggaagccagacaaccagccatgggagcctctgttaagacagaggcagaatgcatagaaagagaggaagacagtgatgaagcattgtagatatgaaagatccttcaatgagccgagatcacaccactgcactccagcctgggtgacagagcacagagcaagaatacatctcaaaaaaaaaagaaaaaaaaagaaagatccttaacagatagattccacagacattcaacaaatactcgtgagggttaagtggacgggaagatcctagaatgaaaccagtgtttctagttttgatgttgtgtgagtggggcacctttcatgaaggagtctgacattcaagagcaaaatacaaactgcattctggatattttgagactgagtctctgtgggctataggaggatctaatcaagtggacacatctagaggatgctgaatggacaagtccagaacccaacagagaggtctcagaaactcagtttgggagtcatcatcacttagaggatcaggaaataagcattcagtaccctcagcatggatgagattgcccaaaacaaatgtgtagagagaggaagcaagatgtacaagaaagacaaccagctcacacctgtcatcccagtactttgggagtagcagtaggtcacacctgtcatcccagcactttaggaggctgaagggggagtatcacttgagcccaaaagtttaagaccagcctgggcaacatggtgaaaccctatctctacaaaactaaaaataaaacattagccaggcatggttggctgcacctgtagtcccttagcctcctgcccagaggctgaggcaggagaatccctcgagcccaagaatttgaggcagcagtgagctatgatcacacagctgtaccccctagcctgagtgacagagcgagacctcgaggaagggagagaaggaagggagacaaggaagggagagcaggaaggaaggaaggaaggaaggaaggaaggaaggaaggaaggaaggaaggaaaaagaaagagaaagagagaaacagagaaagaaagaaaagaaaaaggaagaaagaaagaaaagaaaaccacattcaaggaatagaaggaagaaaactagtttgcagaaaactaacagagaagtaggaagacagtggtacccagaaaccaaatgaaaaagacatttcaaaaaggaaaaaaagagggttagatattgctgagaggtccctaaaacaaggacataaagtgaccatcagatttaacatgtagaggtcacggtcaaaaagtcaggtatcactagggtgagtggaagtggatttggagatcaagagagggtggttttgttcattctagtttgaggatggtagagactttagcattcatatagttgaaggagaaaactatggtagagaagggggattggtaatacaggagataaagggactggctgaaggagcaaggtccccatggctgtgggcatgaggtagacccagcatcgcagcacctcacaggggtgagaggaagaggcggaagtaaagagaacagcgtaaaccgcccactaggaagtgcctttccaaatcagaatttgttgttgttgttgtgtgtggacgtttgtttgttagtatttttgagatggcaaagaaatattgttcaaaaaaaatttatggagcagatatcagaaaacccagactctaaacttttcttcatcactaacaaccatggatctgtccatgtattttttcagttacccctaagggattagcttgactgctctagatcctttttctgactgagagggccatcataaccagggtcccaacctcgggccaccacctcctgagcacctgccctactgctggtgctgggaggcgctggggaagctgaggtggaaacaggagaacccagcatccacctcctagtgaaggagacaaacacattagtgacagtgtggatacataatttcattgagagctttgcaagtgccaggccctgttctaaagcttttgtaggttattaacttttgtagtttacacagcaagttttatacacattttacagctaaggaaatgagagcatagagttgacactgccgaatccagatatggtgcatttaatcgttaaaataagtaaattacaatgataggcacaaagtattatgaacaatcggtggagaggtatgtgacctatcctgggaatgaaggggaagatgagggaatgcttcagttgggtcataaaaatcaggcaaaaaagttaaaggaatggggaaaagaattctaggaggaagaggcaatgcgaacaaaaacacaggaatggggagtgtgatgggcgtttgggaaactacaagcattttgtattgttagagtgtgaagtatgacacaggcagtgaagatttggggtcaagtctcagatctcattctaaatatatggtcatctaaatatttatctagtatttattgagtacctgctatgtgtgtacctaaaatgaacgtaagaagaagacatggccccatcccagaggcacacaccatctagtgggaaagactagtaatcttaatctctctctgtctctttctctctttctctctctctccctctctctctgtctctcttttaggttcaggggtacatgtgcaggtttgttatattggtaaattgcatgtcacggggatttgatgtacagattattttgtcacccaagtaataagcatagtacctgataggtagtttttccatcctctccctcctcccgccctccacgcttagtacacgtatccatgcgtactcaatgtttagcttccagttataggtgagaatatgcaatatttggttttctgttcctgtgttagtttgcttaggataatggtccccagcttcatctatgttgctgcaaaggacattatctcattcttatttatggctgtgtagtattccatgatgtatatgtaccacattttctttatttgagactagtaatctctgttattataaaactgtgtgtgtgtgtgtgtgtgtgtgtgtgtgtgtgtatatatatatagttttttttttttttggacagattctcactcactctgccagctgggctagagtgcagtggcacaatcttggctcactgcaacctctgcctcccgggttcaagtgattctcctgcctcagcctcccaagtagctgggatcacagacatgtgccactatgcctggctaattttttatatttttagtagagacagggtttcatcatgttggccaggctggtctcgaactcctgacctcaagtgatctgcctgcctccacctcccaaagaactgggattataggtataagctaccacctacagccagcctataaaataatattttggataggataatattagaggtacgaacaatatgctgtggttacttagatgaggcaatatttacttctgactggagaaggagaaaagtttccttgaagatgctaacattttaaaagagccacaaagtaaatggaaaaggaagtttcaggtttagaatgccaaaggaaaaaagcacagcatcatagatggcatgaacacatcaaaaaggtgtggctccgtcatacacccatgctgcgagggttacggaacattagttaccattatatctccagggtcaccacaatgcctggcatgtggtaggaactaaataagcatttgttgaatgaatgaaatgaatgaatgaggtgctagtctgaatggagagccccagaaaatctaggtggagaagcagatcaccacgactgaggtgctggcgatccaaatatagacaaggaataatatgtggaaaggtggaaggacaggtcacggttagtgaaattttggaactcacgatttcacaggaaagcagtttgggcggtaagaagaatgaaaattgaaatggaattttgtaggttgtatcaaaaggctgcggagaaagtcagggcactgggaggccagagtagtgttggttggtcacctatgtcactgttgaggtcatcaatggtgaagacaagaggtgaaatggacagggaatccatgacccaaactttactgtcctggggttcaaacagtgaccacaatatgaacggggagaggacgagtcacaggtggacgcgaagccgtttgaagactctggagccatagagtggaagaagtacggagaagggaagaataggccaactgttcgcctggccccaagatatgggccactcagaaaaggggttacaattctaagggttgtaagttagggtccccttagggtggactgcaatcagaggaaggaagtgtttgaaagtgtttaatgatacaacaaatagtgaccatagagtctatttttgtttaacaatttaaaagagattttagtctgggcacggtggctcatgcctataatcccagcactttgggaggccgaggtgggcagattgcttgaactcaggagttcgagaccagcatagccaacatggcgaaaccccatttctactaaaaatacaaaaattagctgggcgtggtggcacacccctgtgatcccagctactcgggaggctgaggaacaaggatcacttgaatccaggaggctgagattgtaccactgcactccagcccaggtgacagagcaagaccctatctcaaaataaataaataaataagattttagaggacatttgtgaaggggatttttggagggaaattttgaaggaaaagctcactgagtaggtaacattcaggaaaagcaaccagaaactgttgtaatactttaacataagcttccatgttgcccaagtttgagatttttaaggtatcaggataacttggagggaatatttgcatttagcagacatatctccacaaaaatgtgcaggcagcggcctaatgtcctactaatcttaggaaataatatgaggaaaaactttcatgttcaagatgcagccttatgcaatatacatgctcaagaaagtcagaagaaaatattctgcaatatacagaaactgatgagtcagaagaagtaaactaatggcaatttatcttccagtatttcaaaattggaacaactttttatttttaaatagtttcactcttgtagatgtgaagaatgtctaattccacttaactgggctgttgttctgttggggtgttatttaggatgttttaaaaaatattgtgttttttattagtacaaatcaggtgttagcacctggatttttcacacatatattatatttatttatttagaggcagggcctctctgtcgcccagcctggagtgcagtggtgcaatcttggctcaccataacctccaccttctagacttaagtgatcctctcacctcagcctcccgagtagctggtaccacaggtgcacgccaccacactcggttaatttttgtattttttgtggagacggggtttcgccatattgcccaggctgatcttgaaacctggactcaagcgatccacccgcctcagcctcccaaaatgctgggattacaatcgtcagccaccatgccgggcctctggatttttctttttaattatccaagccaacttgggttatcaacatggatttaggaagaattttagtgtttctactactttgcaagtctaattatggtttcaatttatattcaacatttggaatctgaaaagtgattctgacttggtcattactatacataagaaaaaaaactattctctccccaaaaataaaatttgaagacctgaatatttaataacaacacttgtgattaaaaagaaattctctaacttctcgatttaaacctttgatttgaattacagaccaaaaagaagtttggaagtgtaaactaaaatgaaatttgtgctatattaaagcttttcatataatagctttttgttcttaataaatattaaaagatatataaatagttggtaaatcaatttagattaaatttatccagatttctttgccaattacactgaagggacagttatttgaatgtacagtagaggtatcctagagttatgaagatggattttagaatagaatgtcttctggatataaaaatatttcaagttactttagagtttactggtccactcatgtcctgatctggaaatttccagagaagattgggaattcctcctaagctggccagacagagtgacatctctctacagattctagagttctgcctctctcccactacacttcagaggtggctttgaaagaccacccaggcctcctgaccagccctctcacgtggcagctcctatgggtgccacataaccgcagtctctccacatcgcctttcctccccatcgtggagggtaccttcctggtaccaggaaggatcttccatttgaagatacaactgccttcttggtaataattcctttgccttgggcccacatcctggattccaagtaaccaagggcaggctacttccagtcacacccaaagagatggcttgtccctcggctggggctcaacttctgctttggaaaccagctgaagtccaggacacaggctccccaagacctcactagagatctggtgtccttagactctccctattaaactccagcttatttacatagtcacgggcattttaggacaataaaaagaaagtaaacatcagaggcaggatttcctcaaagacattacattgtacatacatgacggtatgtcctgatttctttcatgcgatgctcgaaaataacctaagtaatccacatcgattactgcagagaagccagaagagtaactattcctggggatagctgatgtcaactaggagggggtgcaaaggaactttctgggtggtagaaatagtctttatcttaatgcaaggaatgattgcatatgtaaaaatgtatccagctgtgcattaagatatgcacattttaccgtgtataaattacagctgaatggaaaagtagaaaaagagaaaaactctgctctgagaaaatcttgaatgacaaaaaagttaataaatcactcaatttttcaactacacttagagagaccaggattctaagctgactgaccagagaccagtccttgaacctctccagactttatcatatccacttgtaaaacaagaaggttgaacaagatggtatttaaggtctcgtctaccatgaacaattcggcaaacctgccggagaccatcagccatccagtgtggcttaccacctcccaacctaagtgaactcacagccaagcagcaccttaacttttcatgccagggttctcagttctcctaaggatgatggggggagggatgtgccacaataaaacacatctgcttccagtaattccagtcagcatatatgctttcaccaaacgtagtcaggagatctcctaacattattgccacctaattgtaaatgctaactaaggagccatcagaatggcccacgatacctcaagctcaacatatcgaaactgaaatccatcattttcactcaaaagcccccttctgtgctcccacttagttaatgtcatggccatcttcttcattattcaaattagaaaactcaatgtcctatttaaagttttactaacctccccataggggatagactgttttatcttgatagaacactgcatttttaatataaagaaatgctattcttcctgtaagccatcataccagaacaatgccacagaaagcatcaattcctactagtcataaaaggcagctggaacatagatgtgaacataatgaaatcataccaaatgtctctacctcccaggatggctttgctagttgaaatccctggattctggattcagacaggctcataatttgactccctcactccagtccctctatcctgataaccaccctccctagtgaggccaaatttctacagatctggtccagttactcctttccttacagaccaccatgattccccctgtgccttataagacaaagtacaatcccaagcttggtaagtgatttacggcctaacttaattttcaagtttttttcccctactccatacaagctttgcccctcacccaccagcaccatgtgccacagcctcagctatgtccagctactgatattccctggacaccactacagtttcctaagactgactatgtgtctgcctgttccggaattgcttccccttcattgaaatcctgcccacacaaaattttttttatcattttgcatcttgatttataatataaaaaataagacagaagacttcatttccccaaaaataccaaaatttttacaagacaattcattaggtgcattgcctggaaagtagcaggaatcctcattagtcagcatcttcacatagcatttgtctgaatggagtagtttatcattactccaaagacatactgaagtttcattaaaattttttgatgtaatttttcttctatctcactctcttggattctaacgttttcttttctcttttcttcttcttttttttttttttttttttttttttgagacagagtctctctctgttgcccaggccagagtgcagtggtgcaatctcagcagctcaccacaacctccgcctcccgggttcaagcaattctcctgccttggcctcccgagtagctgggaccacaggctcacgccaccacgcctcgctaatttttgtatttttagtagagacaggttttcactgtgttggccaggatggtctcaaactcctgaccttgtgatctgcctgccttgacctaccaaagtgctgggattacaggcataagccaccacgccctgccaacactttccatattatttactctatgtggtagttcatgaaacctttcccttctaaaagatggcctgttaaagtgtcaaaaagaccaacaactagaattggcctgcctatgaccatctgtaagacaacagaccctctaagagaagaaatcaaagaagtttgaattcacacattctgagacagacggaagaaagatatgctattattgctggataatgaacacatggatttatgagaaaagcagaaatatatatgaaaaatttaaattataataaggttagagactttccatctgccattctaggagctaacagtatctccataggcttgatatttttataaaaacaagtgcttcaagaaaagagttaacagtcagtcagtgtgtgttgctaatgctggagaattgattcaactagggatgacacttgggaccaattaattcaaagctggctttaaaaaaaaaaagtagatacaataaatcagggagtagagcttcatttaaatatagtgagggactgggatagattacttgaaaaagctcagaaccaaagattgtctcaaaaggccaaagacaactataagtaaaacaagtgctaggtttctataagctatcaaacactgaaatcaaaaccatgaaagaaaatactggccaactggatgtcaactggaaaatttatacaaagtttgttaatttgtacttgtatcccctcaatctataaaaattttaaaacatgttttaaagcaacaagaaataaaaacagtttgttataaatgaaaattttcaggaagttatcgttctcaagatgcattttactgaaattacaagacaatttttaatagcaatcaagtaggaaccttgaggagaaatggggaaacgtaaagacttacatgaaatcttatacgggagtgtggtcacagtaaaaatatatcttctttaaaaagatgtttctatttcttttgtattgctgttttacctttaattttttaattttttttttttttttagtttaggtacttctcaatttttaaggggattgtgctctagaagtttctgatctagttgttcagaacctgaaatgtattttaatgtagacaccgcattgtatatagcactcacattccatagctaaccgtaaagagctctgctgttgctgtagttgagtgttgattcaaggtacacaggacaggctgagatctgggtcctggcttctggaggccatgagatgtagaatagaaatgttgaagaacaaaaagaattgtttcttgtatttctgaaggtcaagcttgagcatgacaaacttctccacagggaaagtttttatttgcctttttgatagtcaaatcacggtcctgcctctccttttgttgggagcctcattttggtgggttagtaaagggaacatctccaacattcataggagcatttgtttaaagggctcccacgtggcttccagccacttctctccactctgaaacttctatgaattagagaatccccctaattcattcaaatatattacggcctatatttttttaatattacaatgatctgacacagttgggtattgaaaatagagtaaaaccattacaccacaattatcccttcatccctgatgaacatcctcttgtccatttttttaatcatacgaataaatgaaaaaaatgtgataaggtcataagagagttaggaacattatgtaatcttctttaaaaataagataagctgctctacccagtaaaaccctaggtttctgcagccatatgacagtctgatatgcatgctatggtcggtcacggtggctcacgcctgtagtccagtactttggaaggccgaggcaggcagatagcctgaggccacgagatctagaccagcctggccaacacggtgaaaccctgcctctactaaaaatacaaaaattagctgggcatggtggcgtgcgcctgtaaccccaactactcaggaggctgaggcaggagaatcgcttgaacctgggaggtggaggttgcagtaagctgagatcgcgccactgcactccagcctgggtgacagaatgagaatctgtctcaaataaagtaataataataataatatgcatgctatgctctggtccatgaagaccttccacacagtgatttagaggttcagactccttttctctgtggctccaccatcgtctagagcccgggaagtctagctggcaaagagagaaagggaggatagagaagcattctctcttcttgaccacactgaaccagcgtgaacacattccttgccctcctccctttggtaagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaaggtaagtttccaggagatgcagcatttgatttgcattgaaggatgacaggcaaaaatgagataagggcatttttctggagagaaaacagcataggcaaatgcaggtgggggaggaagaccgtgcaacatagaagcaattgaaaggaataaagccgaagcccaaggaccacttcaaagatacctctctctagagaaatgacccaccgcctatctgttaagagtttgacaaatgaaatctggctgaacctcaggccttgtcggaaattagtcattttgcttgcctttgcggatggtgttaaaatgatcaaatttggttttctgcatctctgagtttgattcctctgatgagaactgatgcgaatgccaactgactttttatgaagagtggttgatatttagtattctacagagtctttctgggtaagtgtaaccagagccagtgaataatagaagcagtgtatatctgtcaagtgtaattataacactgaattatgctcatcctgcattccggttcctgtatacattagtttaaacatcagaacatgctggcatttcagacctgtgaggattttactttgaaaaatagcatgcccttgtttttagccatttttaacaggaaaaaagaacttatatcttgttcaaaattattttatggtaaagtttgaccactctgttttttaaaaaaatcttctcaagtttctaaaaatagggaagaaatgaggaatatttcagtctagttttaaatgccctctaattttctgtatttaaataaaatcgtatacaataaaataatatcttattttgataaactgaactttctgattaaatagttgttaaagttacagaatagagttgcttataaagtcaccaatctttgccagagaaagtggaaattatcagattgtaactttaaaattatgcaagtattgtttatcgttgaatgatttaaaaattcagagcagcaaaaaggacaaaacaaaaattcagctataatcccatattccaatatatttaaattatcattttggtgtctatatttctaaacatttttctatgcatttatatatactttttttttacaaaaatgagatcatagggtacatactgttttgtaacctacttttttatgtaataatattttaagaacacattttcatgtcatttttcttaagactccataacaatatttttttttcaactgagaacaaggaccataccagaatctccaagagggcatgtgtagtttgaaaacttataattttatatttagaaagaaaacccaaaaatagctattgttttggtaatataacctacagaatataaagcatagaaatttccaattggctggtcggatgtttatctgggatcttctgaggtttgttatattaccattagcctcctacatggggcatgattagattactatgtcaacaaatgggagcacagattttgaaagattgtgaaatacagtgcctcaactgccaagcattccatttaacccacagtcccttgctgttgggcttaacttttgaaagataaatttccacacattctgatccactggcttctggttgctcattcccaatcataacatatgatagcatactatctattttaagtatgtgatatgcgattgctttttatcacatactcacatatcacagcctcaagctgcagggcagctcaaatgatgaaagtggaagacaggccgggtgcggtggctcatgcctgtaatcccagcactttgagaggccgaggcaggtggatcacctgaggtcaggagctccagaaaaacctggtcaacatggcaaaaccctgtctccactaaaaattgaaaaaatagctgggtgtggtggcaggtgcgtgtaatcccagctactcgggaggctgaggcaggagaatagtttgaacctgggagggggaggttgcagtgagccaagatagtgccactgcactccagcctgggtggctgagtgagaagaagagaagagagcagaggggaggggagggggggaagggagggatggggaaggaaggagggagggagggaggaaacaaggaaaccacactggaaggaggaaggaaggaaacaaaccacattgggaagagagggaggaaggaaggaaggaaggaaggaaggaaggaaggaaggaaggaagggagggagggagggagggagggagggaggggaagggaagggaggggaagggagagggagggggaggtggaaggaatggagggaacggagggaggaagggagggaagggagggagggaggaaggaaagaaggaaggaaagaaataaacaaacaaggaaaccacattgggaaatccaagcaaagatgggctcagcaggtcacatggtttggatatttgtccctccaaatttcatgttgaagtgtgactcccgatgttggaggtgggaacctagtggacagtatttgggtcatgggggcggatccttcatgaatggcttggtgctcttcccatggtaatgagttcatatgagatctggttgttttaaagagcttggcacctcctcctcctctctctcgcttcctctcttgccatgtgatgtgctgctgttccttcaccttccgtcatgagcataagcttctgaggccctctctagaagtcgatgccagcactatgctcatatagcctgcagagccaagagtcaaataaacctcttttctttataaattacccagccctaagtatttctttatagcaaggcaaaatggactagaacagctggatagtactgctaaccgatgaccctatccccaaagctgtttccattcattctctttgttgagagtatgtcaaaccatcccaggatggaggctggagatgagtttaaccccacctgcaactgttctctcgatggagctactctacagaaaaatcatgttccattagttcactaaatcgtaacaaaagtaaatgtacttgtttgaacattgtacaaactagtcctaaaagggttctcacgtattttatatgcgcagtctttagggaggcaaaaatgttttatgcaatctatacaagaaagttatattttcagctgttatccaaaacaaaggaagcgtactctgtgaaaaattggtattattgtttaacaatatccatttccagaggaatgcttttcttaagtagaagttggctgacacaaccataagggatgctgtgaagtgatttctgtcatttttcatacatggaaacatatgaactcaagggtctactaactcttctacaactttaaaggagcacttatcctgggatactttcaaacctgagattctgagattctatatttttaatgttcaacccttagtttcctcatttctaatattcattactaagtagacgataaagatcaagttaagcatagcttcagaaaaactaataaaataatttaaattggttatgcatctcttgtgacgattctaaggcaaaaggcacttttatagaagtctttcacactttaagaaagcttgctatatagaaaatgattcagttgggcacagtggctcacgcctgtaatcccagcactttgggaggctgaggcgggtggatcacctgagttcaggagttcgagaccagcctggccaacatggcaaaaccccatctctactaaaaatacaaaagaattagccagatgtggtggcgcgtgcctgcggtcccagccactcgggaggttgaggcaggagaataatttaaacctgggaggtggaggttgcagtgagctgagatcacaccattgcactccagcctgggcaacagagcaaaagtctatctcagaaaaaaaaggaaggaaggaaggaaggaaggaaggaaggaaggaaggaaggaaggaaggaaggaaggaaggaaggttctcctttcctctctaatgtctctccattcccatttaaagtctctgttgatctgcagcataattttacttttttctccactatttgtccaatactgcaaatgcactgtagttgaagagaatctgttgttgtaatggaaaacagaatcaatctctttttatactctgagcctatagcatgtagtatatatgtcctcatttggcactttttaattttcattacagagatcttctctgaagtcatatcaaggtgacactgaaaggatttgatagaaaggaaacaatttgtggcaaaacagagagagaaaaatactacctgtgatacaacctatcggcagagtcacaagtcagtccacagaaaccagaaaacagacgtccccttggctgctttccttctgatagacttatctaaagctctcactagcaagcatgctccttccaaagccatagcctttcatcctcagagttcatctttggcttttcctcattatcagtgtccctatcaagatagccatgcatagcacagttatttagaaggcacaattaattgacttgtatgctgtctccttgtaagcttcagcttggtctgtgttgaaacttgtcagcttttcccccaattcatgttgtttcaacctgcagttttattacctcctttggatgccaaattctcctttctccttgcactctccaaagccatgtattttgatgaactggctctctctgacatcacctcaaaccaacttaataaatcacccctagtcttctaccaaagcacatttccttaaatgagttttctcattttgccgcacaacctgaatatggtcggaagaaacacttctttgaagtccatcccctcctcaatctgctctcctcttcatctctaggggatccttaggtatgagtttcagagtttctctaaagcagcttctgggtttccctttattacaacactctatccccagagtaaccatctgggacctttatctattcttccaaaatgggtactgtctgcccaatgaacagctgtgctctttccaaacaagagggtatttaaaacccaactgcaagtcctacatggggtacaggggattgttgccagccacatatcattttggaactatttttgccttctttctttttaaatcatataggcctattaatattcaaggagttattctcaaaaggtggttaaatgcatagaaaaactaaaattagaagagctttgcattttaaagacagctttctgtttttgtatggccaatggtatctcccttttgcttccttttctctgtggatgtctttgtttgtgaagttattttttaaccataataaaaagcttaaaggccaaaatacataaagagaaatacttcttatactcaagaggttatcgagataccagagattttaaaatgagttcgtaacattgattcctaagctccaggcatttccttgaagaatttccagaagacttcaaataaatttttcttgccaatgttcattttcagatgtgtttaacaccaagttttctggtgtgaatatgcatatatgactctaaaaatctctacattcagaaactaaaactatactaaaagaaaaataggtcattttttatttccttcataatatgacaggcaatacagtagttaggaaaactaaagctctatatctagtcattactggattttagtgtctctcagcctcagtttcctgactaatcagtgagggtgggctcaggggtcgaagtctattcactgaagcttttaggtcttaacattattggattcaatcacatacttcttttttttgagacagagtctcacactgttgcctggtctggagtgcagtggcgtgatctcggctcactgcaacctctggctcactgcaacctccgcctcctgggtcaagtgattctcctgcctcagcctcccgagtagctgggattacaggcaccctctatcatgcccagctaattttttgtatttctagtagagatggggtttcactatgttggccaggctggtctcaaactcctgacctcataagccacccgcctcggcctcccaaagtgctgggattacaggcatgagccatcgtgctcagcctcaatcacatacttctaagctgatgtgattgtttctgtttttgtggagttacaaccagttgcaaatttagagagaccacattccccataagactgcatatgcttctgacaccaattgcaagttcagaagttccccaaaccacccccaggtttgatagttctgtagaaggactcacagaattcactgaattctgctgccgaaggctgctatactcatgctgcattatgggtgaagaatgcacgtgaaaatcagacaggggtagaagcacagatggcagagtccaggaacagtaccagatgctgagtttacagtcaacctctctatatagattcaggagcacatttctttcctggaacgggtgtgtaacaatttgcatggggtattgccaatgagggaagcttcctgagcctccatgttcagagtctttactgagactccgttatataggaatgattgattgcccacatggctgacctcagtttccagcccctcagaaggctggagaatataagccaaagccccacacccttcatcacattgttggtcaatctggcatggtaaggccccatcttttttctttttctttttttttttttttttgagacagagtttcgctcttgttgcccaggctggagtgtgcaatggcaccatctcggctcaccacaacctccacctcccaggttcatgtgattctcttgcctcagcctcccaagtagccagattacaggcatctgccaccacgcccagctaattttgtatttttaatagggatggcatttctccatgttggtcaggctggtctcgaactcctgacctcaggtgatccacccgcctcagcatcccaaagtgctgggattacaggcatgagccaccacacccagcccaggccccatcttaaatgccatctggtgtggccctacccctaaaacacaatgttagactatctggaataacccaaggctcccaggcaaatgaagacatgcttaccaggcaggacatcccaagggcttagatattaccttcccaaagccaaaggcaagggccagacctcttgagggcaaggctaaattctctattacacagttctgaaaatctctctgttgaggacaagaaagcaaagattcctaggacttactactagaaggaaacctgaaactcctaatgtttcttaaagtaagattccaggaccacttgcgtcagaatcacctggcattaacaaaatgcagactccaaagccccaccccaaacctactgaatcagattctctgtaacagaagcattggaatatgcattttaagcattttcctttagcagttttttatgtaggccaaaacttgagaattgtaattaagatccaaggtccctgttcctacaagtagagtgaaactagcatgcaataaagcaaagggagaaaattctgcttcttattccactggtgagtttatcttgggcaagccattagtcctcaaacatcatatgtttgaaaataacgtttagctacatttgttttaaacagacataactaatgtagcatgctcttagactgagaaaatattcattgagttactttgtgctcttgggaaagatgcttgtggaatacaagatggaactccatctagttcggctggccttgggaaaatgagtggatttctcttttcagagtatccatgtgatcactgttgccttcctaggcaggagtagtttctattcatcctttcattcattcacaaattggtatctactgtgtggcaggcaatgttctcagtgctgaggagagaacaatgaacaaaacagaaaatgcctctgccttcctgaggccaggaccacatatatattattccagatagtgatacatgctatgcagactttttaaaaatcaggattaaaggggaaaggacagctgagagcgaagtttgttatttaacatagaatgtttagggatggagtttctaatatgatgacttgtgagcagagaagtaaacgctcagccacagagttatttgggtaaagtgaacagcaagttctaaggccctggggcaggagcagtttcaaatgttgtgaaggagaaagtcctatgtggtggaattagaggaagactaagaggagtggaaatagatatggggagtacagacatctctttcaaggaatttggaaacaaaagggtgcatagaaatgaaatggtaacttttgggatagataaggtcaaaagaaaggttttatagtgccagtggttgttaagagtagagatatgtctctgtgtgtgtgtgtgtgtgtgtgtgtgtgtgtgtgtgtgtgtttgtataacaacccagttgtagagggaggggagaattgtcagagtggtgtccttgagctggtaggaaggatggcatcccgtgtataggtgcagcagttggccttgaattaggaacatagatgaactctttacttctttctccttatctctctgattcccatggcgaccttattttcagccttcctgcctcttctcatgaccctttcgtgttaaataaatccttttatcttctgatgtacagttagtacttcattcagaaaaaaaatacaggaaacaaaaaaagatattgataacactgttcaccatagagtgaggctgaaatatctgttctaccaattaccagttttgttgtatgactcaaatgagatttattgtacagaagatcccccaggaagctgccacccctcgaaccttattttagaatggaaaaaacgtatcattaccaaaactaaacagtgttagctggtctgcccatcatgctcatgctatataactttccttctcttttctcttatcctgttctgtactgaatggccaaattttttctgctacttcaactgaaactgtggtctaatatctaaatgctccctcacctgctgagaaaacttagagccaaaaacacctggtattggtcagttgttaaatttatcgctcaatatactaagcttggagtgatttgttgagttagaatgagagcaaatagtgccacctgctggaattacacttggaaggggaagcgtgaacatgccaagagctctccatggttttgtcccaatcattactttaagcctttcagatgaagtcatgagcctgctttattagaaagtaatttcttccacctatattcttttctgatggcaatatgccaccttatgtatttctcttttagtatttctcttttctccctgtaatgattcagtatctaaaattaccattaagaccagctgtatttcattttatttctcttagaatctcttgaaaaattatagaatgttgccatttgaaagaaccttagaggttctccgtagtttcaaacacattttggacacaggaacttttgggaaactatggatataatcctcactttggacctcaaactgaggcctgaagcgtgaaaagtgaaaagaccaaacagctgaggctctatatcagttaagatgctttcagttacaataaaaatggcttgagcaataacataacagcatatctcacataagaaatcctaaggtagatggctctgggattaatttaaaagttgagtagaccaggtgtggtggctcatgcctgtaatcctagcacactgggagtctgagatgggtggatagcttgagcccacgatttcgagatgagcctgggcaacatggcaaaaccccatctctacaaaaaatacaaaaattatctaggtgtggtggtgtactcctgtagtctcagctacttgagaggctgaggtgggagaatcatctgagcccaggaggtcaaggctgcagtcagctatgatcacactgccacactgcagcctgggtgacagaacaagaccctgtctcaaaaaatacaaataaagaatttttaaaagttgaacaatgtcagccatgacccaggctcatcctctgtcctctctgtcctctgtatctctgacatttgtgaggcagctccagcaacattaagaaccacagcttcccacccaatattaaggggcagaaaagggactgtcttttccttataactcaccaaaagactccactcatgtttcattggctagaagggaattatgtgtctcatccaaagtgggtagctggcaaggagcctggaattgccatctttgccttcattaaatccagatccatcctgtgggccttgggtagggctgtccttatgcaaagtgcaagactctggaaacacagagattccagggcaaaatccggttagctcacaaagaaaaaagggaaagtgactaattattgggagaaaaatctccatgggtctcttccacttttgcctgccttctgagcaagaagcattgacagctttgtttataccttttttaaggatgtgtgtatagctaacagccttggaagatacagatagtgtcttcctctgggacagagggtagatttatttcatggccagagtaagaaatataatgtcactctccggggcagaaattgagcaagtttgctagtagctactgtaaaaagattggggtttcctaagtccagggtccctcagctgtgaagcaaacttattgcatgtgcagcatccacctgggatgccctgcattcccctgcaagggaaagcaatgtgaacgggaagctcaggctgcctgctgtgttgtgagtaaagaagtcctttgtctctgacccaggagtttcatgtcttctgccagcatcatcagactgtggccatgttaaactatggttctgccagcatcatcaaaccatggctaacttgttagcctgcaagtggggtaaagtctcagacccttcccagttcttgatactcatggaaaggcaaccattcatgtttggcacagtgttctttccaatgagccaggctatatgcatccaattctcaaatacttatttctggaaatgagaatttgttcggtatataagaaattcctttttcacaggcagaaacagggcaacacttcagtctccaactggagacacacattaagcgaggacagtgtcattggctcaagtgtcttttatgctgtctcccttttattcgctcactctctctataattatctcttttaaaatgtcagttgctctcacccagaagaccaagagcaatcagccacaaactgaacttagaagcttttaaaacacactggctgtctgactgggggatgggatttctcaaaggcttcccgcagcaatgtcagggaagctgacattgagtggctgagaaaaaagagccctttccttggctctcacagtgggtctttcagatccttcctgaggaagcaacggaaggggtgtggaatgtgctgacttcataaatatttctccagcagagcctgaatggaggctgtttgggaagaaagttgctcgtggggtcctttggccttgagtccctcttactgtatcccattagggtgagaggctctgagctacggcatcgtcctggcaactttcttcccttctccagaataaaatattgatgttaaggtgacggtgaagaaataggggatctattgggacaagcaaaaagtatagatattttctagcgacttctggcactcagagtttttccaagtagtgacagtttgaagacctggacacgaattcatcatagcagtaggagaatcacagaggaaattagaacagcatttatccctacgagtcaaaccttagggttaaactcaatttatccctaaattctatttccttgatggcagttgatgcctttaaaatgaaacaatctttcctacttagcccaggaaccctcgttctcttgctgttctgacaacttacatttaaaaaatgctcctgctaaaatacagtgttatgagaacagaacagatttaatctgaaaccaaggctactttttcctcatctgctgtatcagaactacagagaaagatcacacagcctgtgggtcatattatcatcttcctgcattctgatcatacttccatggaaaccttgatggaggtcactggcctgcaagttcaatccagtcccaatgacccctggaggcaggggcttctaatttagatgagatatttttctgaagtgtgtgtccaatgaccacaggtgttgaaatgaaagttctctcgctaacgacatgaaggatcaaaattccttggtacaattaggttgattaaattgagctctgtgtctaatatccctgtagctcaataaagttaatgcagctttccaaggggcccaacacagaggcagggaacagtctaggtcctgagagaatctggcccaccatggtttctaaattagaagtttgattgcttgtgacatcgtcttaaaatggtaccagccaaaagaagctgaattttccattagcccaggaaaaaaaaatgacagatatttaattaaactgcttagagattaggtggaaagcttattgatggacagaggggctgaatatctttataagcaaagttaggcactggtgtgccacatctttaatgttgagaagaattcacccagcctaagggagctgaagacgtgtgtgctgcttcagcctgaggctgcctctcctgtcaatcacaagaaaaaatatacatttaaaaagcttgtttataaagcactaggtggtcactgaggaacttaacataaaatataaaatgtgaaattagaaagctacttatagctaaagttaataaagcaaccacccaatccatttgccaattgttgagaggtgactaattgcagaggaaggttgatttggaggtgatctctaaaaaaaagaatttgtggtcagtgctagagggtaggttatgagaaggagcctacaacccagatggggaataaccaaggtttgcaacagacgatgtacgacagggattattctccagaaatgttgtgctacctttcaggtaggcacaggtggtcataaaatgtaggtcaccctcattacaccaacaataggtcaccctcattacaccaacaataggttaccctcattacaccaacaataggtcaccgtcattacaccaacaataggttaccctcattacaccaacaattcaagggtccccaactttcaaaagagtataaagatcaatgaaatcaagtttcataaattcccccaaagcagtagctctcaactctagctatgtgttaacatttcctggggagtttttttaaaataccagtgccaactcttgaccaactgagtccaaatctctggacacaggtgtttcaagagatctccaggtgactatgaatcacttcccaaggagctacttactgaaaaggtaaattgtatgtggaattagaagatatcaggctctgaaatctgacaaaccttggttcagttcgtgactccactaacttactgaatctaagacactcaacatgcgctaacttctccagacttcagtctccttatctggagagggtcaatgatggtcacatcttggaaggcttctaaaattaaataaggaaataaatatatacctgacacatagaccccccaaaacacccttggttattaatggttaatgattgacattttatccttcttccattgattttgccatcgacctttgtaggacgtgacaggcttagatgatttttcctctccctgctttgtttgtcgtctagaatttactgctatttggtatctgggagaaaaatactcatgtttttcatgctttctgctcctccagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtaagtaatggaaaggtaaccatggcttccctctgttgatttttaagagcctgcacaatacaaaaaaaaaaaaaaatcagcctatgcaaggtttgatatagagatccttccaaaagtaaaggtgttggcctcttgtagtctccttcaagacagaatggaataaggaagaagtttcaggagacctagatctcgttccacttccactcttgggagctcactgtcctcagctataaaatcagagtgcaggctgagacatctctcaggtctctctaatatctgcaattttaggtttatggttttagaagtgtataaagttatttgatcatttggggcacttgtaactgtgtggaaggaaaggaaggaaggaaggaaggaagggagagagggagggagggagggaggaaatgggctaagttcagatttttttgaaatgataaatataaagccattcctttcttgcctattctcaaggttctaggcagagaaagatttagacttttcctgacataggaaaaaagatcagtacaaaaaagaaatttaaacagatcaaaaagttaaactacctatgcaagaagtggatccagacacccagtctaatctttttcacctgtctttctgctactgacatatttcagatgaacctaaaattacttcaaattcatacctgcttcccatggctagttgaattttaaattttgtttttgagaatattcatatgttaggaaattagcaacttttcctctgttgaatgaaataaagaagtgagtttgaaggactttgtggatgcatcatcttagacccctctctagggggtcaattgatcagtgcagtcaactgtggaagtctcagacaaagcaagataagaatgtgacttggttgctgttcatattcataacacctgccacttgggctccaccctacgttacagcctcactgagagccagttaattttaacaaggggcagagtccccacagtgtctttcatagttgtgttgggaagcttgaagagcggtagaatgtcattaaaggaaaggtaaaattagatctccattcattttgtgtgatgtcggccaactacaaaacaaaggtgtgggtcaatgagctttgaaagtgagactgacttttaacaaccacatcagctggggctataaaagagttatagatttagaaataaagtatttcctaattacaactggaaatcagccctttccaaatccttccctcaagttatagatcacaaaattacacattattttttaattagctaaatatcaggtccattgatccctgctgagcacagtgaagaaatttcacttcatcaacatgtgtggcccagattagctaggacaagtttcttcctaaatactgttaattctgaacatgctgggtagattctatctggttttcatcataacaggtgaccctacttgactcaacttctcgtttttttgaccctgcccctggatatagaagtccaactttagttttgttcctttctgttggctaactgtggctgtgtgtaagaattttgaagacctagtaaggttgtaaaatgaagagatggaagagtatttattatggtcttggaaggaacatcaattcacttaaagaaggtgacccaataataacttaagaaaagagcaagggcctgagatcagaattctacagaaccatggaatataagggataaacagaaaaagaatatctcaggaagaatgaagaggaatagaaataaggaaaattaggagagagtaatgtcacaagaggaggaggatttgattaaaaaggtaatggcaaataatatcaagcaccatgagtaaaataaggctagaaatgtgcgtgtgtgtgtgttttgagatggagtctcatcctgtggccaggctggagtgcaatggtgtgttctcaactcacgactcactgcaacctccacctcctgggttcaggtgattctcctgcctcagcctcctgagcagctgggactacaggtgcatgccagtatgcccagcaaatttttgtatttttagtagagaaggggtttcaccatgttggccaggctggtctcaaactcctgacctcaggtgatccacccacctcagcctcccaaaatgctgggattacaggcatgagccaccactcctggcctgtgttgttttaatttagcaattgtaaaaccattgatgaccgcagaaacagaaatttcagaacaggaggctgacgtgatgagtcagcaatttcttttgactagaaaatagtctctagtcccagtttctaattcctgtcaccttaaagggaggcacaaggcacatctctcagatatgagctactttagccaatttgtgaaatattgttcggcaatagaagtctacctcaggtgaagtgagaggggttgttacaaaaaaaaaaaaaaaaaaaaaaaaaaaaggacggccacggtggctcacgcctataatcccagcaatttgggaggccgaggcaggcggatcatgagttcaggagttcaagaccatcctggccaacatagtgaaaccctgtctctatttaaaaatacaaaaattagggctgggcgcagtggctcacgcccgtaatcccagcactttgggaggctgaggcaggcggatcacgaggtcaggagatcctgaccatcctggctaacacggtgaaaccccatctctactaaaaatacaaaaaattagccaggcatggtggtgggtgcctgtagtcccagctactcaggaggctgaggcaggagaatggtgtgaacccgggaggcagagcttgcagtgagccgagatcgcgccactgtactccagcgtgggagatagagtgagactctgtctcagaaaaaaaaaacaagactctaaaactaacacctagttcaacagctatgaatttctggagccacttatctccaaactattcagttagaatttagggacttaggtgttagtctcagttcacctctaatataaaagcattttcttgaccaactattaccatcttccctctctgagtatcttctatttctatgttttgtttgtttgtttgtttgttttacatggagtcttgttctgttgcccaggctggagtacagtggcatgatcgtggcttactgcagcctcaacctcccaggctcaagggatcctcccacctcagtccccaagtcgctgggactataggctcatgccaccatgcctggcatgaggtctccctatgttgcccaggctgatctcaaactcctgggatcaagtgatccttccacctcagcctcccaaagggccggaattacaggcatgagccaccatgcctggcctcttccaatattagacattttttattacatgcttggtaatgattgaacaataccagggttgccaagtggtcagtcttctcacaatggtgtgtggttaacaatatggtctttgactaccacctctgcctcttgccaattgagaaaccactgacaaattgcttaatatttctgtgttaattaggaatacagctcctacaccacagtattaaatgagatattccatgctaagcactcaggagagtgcctcgcctagggcccataattattatcattattattaataatagtagtagtagtagtatttgagacagggtctttctctgtcatccaggctggagtaaagtggcgtgatctcagctcactgcaacctctgcctcccaggttcaagtgattctcctctctcggcctcctgtgtagctgggattacaggcatgtgccaccgtgactggctaattttgtacagaaagggtttcaccatgttggccaggctggtctcagacccctgacctcaagtgatctgcccgcctcagcctctcaaagtgctgggattacaggcatgagccactatgcccagcaggtccattctcattaaatgtgagtttctttttcctttactatcctttaccttttattccctttattttcttcttcctccatgtaatagttacccttctcttaaagaagcctctttcaatgggctcattacttctttcttgaaatattgacttgaaatgtgatcacttccactcaccaaccctacaggaaagctcacatgcagagatgtccctcaatattcagaattattctgctagtcctcagcttacctgcagaggccacagagcagcaaactaaggcccaaggattttttcacagtcagccaagaaatcagaagttcatctgaaaacatcacaccagcatccctgcaacagctaagatatgtgacagaatggcccaagagctccacctaggttccggaaggaagggctttcatacaaattaaagctgaaacagactgcaaatagttcttggctttgcacacagagctctacagaaggccaccttccacccactaacctgtgttaatgtaattgcctgaagggtttttcttgcccgctacacaggtaaaccaaattcactgagacaatgttattgcagtaaataaagcgtttaattaacacaaggacagccaagcagaaggactggagttattactcaaatcagcctctctgaggactcagaggctagggtttttaaggacaatttggtgggcagggggctagggaatgggtgttgctgattggttggagatggaatcataggggtgtggaaaattgtcctcatgtgctgagtctgcctcagggtgacagccacagaactggttgagttctgcgtcccaagtctggatggaggcaggtggtttccagaatgcaaaaatctgaaaaaaaaatctcaaaagaccaatcttaagttctacaatagtgatgttatctataaaagcaactgaggaagccacaaatcttgtgacctccggccacatgactcctgagcattaagggattctagaaactacacctacattttaacagagttcaggcctctcccataattctaatctcatggcctttcattggttttacaaaggcagtttcaatcttccagccaggagggaaccagttttaaggagggacaattatcatccttgctttaaagctaaactctagctgggcacggcggctcacgcctgtaatcccagcactttgggaggccgagatggggggatcacgaagtcaggagatcgagaccatcctggctagcacggtgaaaccccgtctctactaaaaatacaaaaaaattagccaggtgtagtggcaggcgcctgtagtcccagctactcgggaggctgaggcagaagaatggcatgaacccgggaggcggagcttgcagtgagccgagatcgcgccactgcactccagcctgggtgactgagcaagactccgtctcaaaaaaaaaaaaaaaaaaaaaaaaaaagctaaactctaaaccaaatacctcccatggttagtttagcctgacctatgcccaggaaggagcagggacagccaggctgtgaggctagaagcaggacggagtcagccatgctagacttttcttgctgtgtgatctttgcaaaggtggtgtcattagcgaggccaggctcacatgtccttttgcaaagtaaccgaaaaaaaaaaaaacagagaagacacagttcacctcactgcacatctaaaatataattagaagctgtcatcccaaaagggttaacacaggtcttttggaagttgtaagaatccagagattattctggtttaatcaaaaagtaacaaatacatttaaaaactaagagacacagaaagaaaaaaagcacttgctggtatttgtctgaaaagtgcaggaaacttttcccattttttgatccaaaatgagtgtccagcatatgacgagctccctggatggcccagcagaagcacttaagccacatgttgatctgaagcctcagccagcccaggtgttcggacctgggctgtccgtgggccagatttttcttaggcggtggagaaagcaaacaagctcatggtcattgtctaagcatgaacaatgccaggctggattgagcaaagccagctttggcagagacatacaaggagtttggagccctgacagctgatagcagcggcaggagtgggagaaggcaagatatctgctgggcccccagcctgggaggctggctgccagcccagggcatggccaggagctggcaagcaaacaccactgcggggagccaagcaggctgttcaggtcagggagctaggacagggttagcatgcagcaagctagacactagccagagcatgcaactgctcttggcagtcattaagggaggagatcagagttacaagatctggaggccatttcagacagcttcaggaagaagtcaagctcctaagtggctccttgacagaggctaggtcatcttaactcatgacaaatgtccgtgctcaatttacttggctctggcctcttctgatatctctctagaggttaaagggaaccatctcttttgtgcagtccaaaaaggagttgaaaaatcaccctcagtgcttcaagctcttttgcgttgggcagaaagcctgactgagactcagtggaaggcacgctgtcttcaggaggactcagagactacctgagagtggggaagcccgcagcctcttcttcctctgacagtttgtctatcaggagacttttttctcctgggtggcaacctgagtttatggaagagttgaggtttattaaatggacgtataagcaactacagactgaaatgttataaccattctctgagtccaacctccccaaattctaaaatacagcttgtttggtcagctgcttctcatactctctgtattccaaaattgcaaatggatcattccagtgccatctgaaatgcagtatcattgagagaccaaagagaaaatcgcatttgtgtgtgaaggagaaaaatagaattctaataatgaaattcacccaaatctatgtatgaataaaatggctgtttctcatatctaagaaattgataataaaagatgtacaactcaggccgggcatggtggctcacgcctgtaatttcagcactttggaatgctaaggcgggcagatcatctgaggtcaggagttcgagaccagtctgaccaacatggtgaatttctgtctttactaaagatacaaaaattactcaggcatgctggtgggtgcctgtaatcccagctacttgggaagctgaggcaggagaatagcttgaacccagtgggcagaggtcacagtgagccaagattgtgccactacactccagcctgggtgacagagtgagaccacatctcaaaaaaaaaaaaaatgtacatctcaaattgcaggaattataacctagagaatgtgtgcctgcccctgtttcctgcaaacctgcctcaaaagcaaccacgtgaatgctgactgagacaccccggtgaaccccagggccaagtgcttcccatgcttcccctcaatgagtccacacgagtctataacatagataacattgctaattcttgttttattctcacattaaagattagttgacttaccgaaggtcgtgcatttaggaagagacagagatgggatttggttccagacagtctgactccaaagactcagcgctttaatcattcctcttgtcaaagcaaaaattgcactgggcaaagttgaacaggcaaggaagatcttcattcagggctgttgcgacagggtagagaagccagaatgcagtcgagctcgcctccacttcagctaagggcaggagaattttgtttctttattttgattttttggttttttttatttcactaaaatacaatgggaaagtttttacaagctgggataggagggatcatagggtgtctgtgtttgctgattggctctacccaaaggaaaagtaaactttcacaacttggagttaggctcccaccctcccgtggaggggagacagggtgctattttccttgacaattaccatttcaaagagatgactcccaagtttttgaaaaagccattcctgggttgtaaaactggcaaacagctttttaaaaaatttatatctcaaaagggcagagaaagaattaacaataacaaattttctaaagtaagtgctcttaaaaagtgaggtcaggggtctagggtggaatggaggggtcctatgtaaagtttagtcaagctgaaggcaaagttcaggccctcttggtcagtctataccagcgtcccctgactgagatgaccctgtggcccagagggtatgtggaaaggtgcggtgacactgggtgctcccacagcttcccacaacgtgcaggagaatccatcccaaggaagatttgcaggccccacgtgcaataccggccccttgtggagcactctcccagttatggagtctatgggagagactgaagttgacaggcagtggtgaggctggacatcaggcagccctggctggtattatgcagattataaagtcgccatggcaaagatctaggcctgcagagggccactgtcaaacgcaaagggtttggtttaacgagaagttaatgcaaaagcactcttctcagggaatgagacttcttacttgacagtctctatgacatggaaataatgttttgtttttgttttgttttgttttgagttcctttggtaaagcttttataaagtcgtcaaagtcagcatggatctctaagtctcagacacattcttcggggctttgcagactctctcagcagcatgtctcctgcgctctttcctgaaatactttcttcccacagattccacagccgtgtgctgtcctgcttatttttcctaccaagctggccatcacttagtctctcctgcattccctccttcctccgcttgaccactaagcattgcagtgtcacagagccttcctgtcttctcatccgaatattgtcttggatgatctcattcagcccaccatccaatggcttctgataataatttgtgccaatgtctctcaaatttaaatctccaggcctctcttctctcaggaactctagatccacttatcctactttctactttgtgtttcaacttagatattaaatgggcatcttagaataaacatgatgggaaacaactcttgatgcctcctggaaatttgttcctccaaaagccctccccatctcagtaggtggcatcaccatctaatccacccatccaccctaaatttggagttacccttgatttccttcttccctttctttcttctctttccctcatcacttcctatccaatagtaagccctgtgagtctacctccagactgtccctcaaatgcagctgaggcaggagaatagggtctggaggcagggaagataggcagattcatgctgacttcttggaactaaatcaaatgggaacgcttcagcaatgacaggaaggtgaacggctgtgtagcttcacttcatcctctccatttacttatgccacacactgagtaacatccttgccatttacatagggtgcatactgagtaaatgactttgtcacttgacttcgtcttcttcatttacatagggcatataccaagtaaccaatgggaaacctctagagggtgttgaaaccccagaaaattattattattcagaaataaatgaatacgtttatttatgtgtcctccccctagaacgtaagctacatacagcatagacggaggatagggtccaataacaactggtcaatggttacccaataaatatttgctgagcaaacatctggatgaataaataagtgattgtgatttttctgggttaatatccatattcaaaattagatcatctcctttccaaagcaagaagggtttttccttataaactttctccagaattcttttctcaaaatgtgatgatatttaccatcttgggaaatatctttttactgggaaccacagactgaaatcaagcatgacagaagcagaagcagcaaaaaaaaaaaaaaagtcacagagaaagtcagcatattatggaagacagcatttcaaatcagtctagagcctgagcatagttttcagtcttcctgatatcaaattggggtcttgcctgtttggcggtagctgtgatgctggctgcaatcctaatgcagagtttctaccccaacctttgtaactagttcttggttctctctgggatagaaatagggagtgatgtcgtaattagaaaccattgccatacattaaagagtaaattaatttgctggacaaaatctagcaaaaaaaattactacattgaaatcaatcgaccatatgcaaagcaaaaatgcaaataaaatatagaagctcctccaagaaatgccttctccttcacagttgttcactacaagggttaccagccctctattcttttctgaacctgctgggccaccacgctcagtcggctgctatcttctcaatagaaccatctccacctacgacccccacaaagggcaaaggatagccccttcccacttacagttgccatgtatgttttctgccctttgccctttagggatcaaaactaattgacttttgcaattccagctacctttcagtcagagcattaccataggaagtgagtgatgataggtacaatgtttgcgctttttttttttttttttttgagacagagtctccctctgttaccaggctgaagtgcagtggcacaatctcggctcactgcaacctccgcctcccgggttcaagcaattctcctgccttggcctcccaggtagctgggactacaggcacacgtcaccacacccagctaatttttgtatttttagtagagataggatttcaccatgttggccaggatggcctcgatctctcgagctcatgatccgctggcctcagcttcccaaggtgctaggattagaggcatgagccaccaagcctggacaatttttgctttttttaaaatgtgctcccaaataatcaaatcaacagtgtacttttaatgtcttttgagctcccaactaactaaaagataatctgttaactatattatatgggtagaaactttacggtgaacattctgaacctaagaaactaaaggttcaccttctcatgtgtcacaagaccaaatgcttcaggaactctggtctttcttccaacatcctcatggcaattggaatggtctgatgcagagaagacattttaatgtaacggtaccacttttgcaatcaatatggaaaaatgtttttcaacaaataaataatttcttatacagattttttatctttccgataaggactgaactaaacttcatgataataaatggcaactgtcccacagaaaaagattgtaataaaataaattagtatcaatgacacaaatattgaagaagggatagatcctcgcagccccatagttcctcccacagtacactatgagcgtgagaaaaaagaggcccacttttagtattccgcattcagataaacagggtcgtttcccatcagacgcttccctctcatgtttttatctcacagtttggtttctgctccttcgtgttttcaaggccccctgatgtgcaggatattgcgtgggtctctcttcctttcatggtcctattgtcacatcctgacaatgttcctctttcattttaatttcattttattacgttttttcttcaccattgccagcttcaccctctcgccatcgccgacacccactgaaacgtattttatggatggtcttctagtcccaccctctatatatttgttcaaagtatacatatcattgtggaaattcgtgttgtctcttgtgtgccatgctttatatgggtggcattgtactacagatcccattctgtttcttactctcttccctctgccttacattgttaagatctatttgagtagttctctgaatactatgtgcatagtgctccattatgtgtatttaccacgcatcatttattctatcccctaatgatgaatacctaggttttctgcaactctgccaccacgaataaccctccagggaatatatttatgtgcattctctgccacctgtgtgaggacgtcttgtgtgtgtgtgtgcctctgtgtgtccccagaattactgagtcatagagtatgtgtgtacctaatttcactaagcactgcttgacctatcagtttctgagtataaattttaaactttatttactgaatttctatcaatagttctatcagtggtagcttcgggtaattgaagtctattttgctagttagatgtgttcatgatcttcttgatttattgttccttgtaccagtatataatttccatctttgttccttatgacatttttttttaaatctcacagttttgtctctgctcttaaaactaccacactgctgggcgcggtggctcacgcctgtaatcccagcactttggaaggctgaggtaggcaaatctcttgtgcccaggagttcaggaccagcccgggcaacatggtgaaaccccatctctaccaaaaaatacaaaaattggctggatgtggtggcacacacctgtaatatcagctacttgggaagctgaggtgagaggatcgcctgagcccaggaggtctaggctgcagtgagccgtaattgtgtcactgcattccagcctgggtaacagagtaagaccctgtctcaaaagaaagagaaaatgactacactagccaggcataatgatgtgcgcctatagtctcagctaccctggagctgaggcagaaggatggcttgaacccaggaggtcatagctgcagtgagccgtgatcacactactgtactacagcctggggacagagcgagaccctaactctaaaaaaaaaaaaaagaaaaaagataataaatgaacaaactactatgctagccttcttgttgttgctaatattcctgttataacctggtattttttgtacaggtgtttgtatccttttgtttaaatgttcctcttagatttcatattgctgaaccttttaaaaatccatttggaccaattactcctataattttgacttggcagtgaaaataaagatgcaatattttttccatctatgttctcaagacttgtgactcctgtacatggatcggaaggatccctggggctgggggtctctggttcagatccacagctattgatgaaggtgttgttttttggttttggtggtggttgttgttgtttttcttacctaccctgtttaaacacttcatgagtgccttccatttgaactctaatattgtttgttctggaaataccagatatttcttcagatagtttcttgcctgtgtttattcttttcttatgaagctactattgtgcagatgttgacacttctaccctccgtaattcttgacttttgttttattcttctaatctctttattcattcctattgtcttcatggaaggtttcttgacccaatatcccaacccacgaaaatgttcatcagctttatccgttctgccattcagcccctccaaggatatctttattttgacagttatagatttttcacttcaatatctccaactaattcttattcttatagtttgtcattgtcctgtgtctccaatatcaggaaggtgggattctgctaattttgctgccgcttcatgtcggcaccataacgcaggtgtcttttatgcaaatcctacagttttctgctgtcattggttctgtgtcttcagcgctgcttcttgcccttatttcgcagtgcttgctgtcctcagaggtcctgtcatttcgccttctgagttcaagcatattcccttgagatttccaaatgccacctttgttattgtcttcctacaatgaaaaacaaaagttcagggcctgcattgagctcctcctggaaagttgagggggcaaagaaaaactcctgcctcaggacaaacctctggcattgtcatccctctcaaccctttcttgtttccagtccatgtccctcacccacctcccatacacacacacaacttcagagtacctcactcccacctagacaggggacagccatcttccactgtcattgattcttaaaccagtggtgtatctataccactaaatctagcctctcactacccgttcctccactaataagcatcttattgctatattgaagtgtctgtctcaaaaataaccaaatccaatagcctgttactgttgtctgattttccttgacttcttgctcttatttaacaattgtcactgtgccctccttgaaatcttgacatcaaaacactccagtcttctgttttctcagcctctctgccaactcgcctcccttttcccttttcctcaatccccaagcttctcttctttttcctccacccctttgcttggatggctgacatacccatgaggcttggtcatcagagctacactaatccctcacggatccatcccaggcttgacctgggactagcatccgcaaaggcttgtatgtgaagtctgagagtgaagagaacagggtgccagcttggataataacaccagggattcttgactccggatttaaaaaaagactagatacaaatgtttaaatagagactttaaaagacagatggaagcaggagagggggagggggagatacatgaagatcagcagaaagaggatgcttattttacttcaaagatgacaaaactcaccagcaggacacttaatatgaacaataacctaaagatatttgcaaaaatgtatttagacaagagttctaggctgatatatttgacatctgggtttattaaagtttactaaaatagctgttaataattttgaaatttggatccaactagaaaatatccccactttcagatgcaacttggaactgtaggtcccacagtaaagcaatggcttctgaaatcagtgctgtcagactgagcttagggaaagtatccatcatccaccattttagcagtggccaaagcccataactgccttggtttcaaaactgtagtactgagcttttgcactaagaaataaatatgatcttaatgacagcatcaaaaaagtgtcttctctttgttggcttagagattaatttggacattgacattcctggctctgtgagtattgcatttcccctttcagcttcagccatccttgtagctttagagacaatggtctgcccaggtgcaggggctcacacctgtgatcctaacacttttggaggccaaggcaggaggagcccttccatccagtagttcaagatcagcctgagcaacatagcaagaccttgtctctacaaaaaaaaatttttttaattaaccaggcatggtgacatgtgcctgtaaccccagctactcaggaggctgagacaggaggattgcttgagctcaggaggtcaaggctgcagtgaaccatgattgcgtcactgcactcggcctgagccaaagagcaaaactgtgccaaaaaaaataaataaatataagacaatgttctggcaggtggtaaatgtcttgcctcaggtattaatcactctatcagcattttgtatacctaagtacaacaatgtctagaagcatatcagacgtaggagaagaaagtgccttatatgatgtaagcccaaaaatcaaacggtggccagagcatagtaagagtgcaggcttaaaagctatccagcctgggtgtgagttctggctacttactggctatatgacagcaaatgaattaactctcttattctcagttcactcgtctgtaaaatggagataataatatctagctctgagagtaaagttctggaatagtgcctgatacttctagtatttaattaatattagcttttgaaataaccaatagtttaccatgcttatcctgccaccatagcctctacaatgaatcagaccacttagctccacccccattgcataacatttcacatttggacacataggagtgctttatactatggaaacccagtgtcccttcagtctctattttgaagctttcttctagtttaatagtttggattcacatgttctgcatgtcctttactctgaggacacaagaaaatccatgcaataataatgaactgaaaaaaatccatcctattgatggagttatgaatgagcactcatgagtgtcatctgaaaaagcaattttccaaaccccagttctctcagtatgtgaaagcttttttcatacttgccctccaatatctagctgacagagaaactactgatcaatacttgtcaatcatgcagctctgcactaaagaatatggagcaatttcctttaactctctacaccactgaagactcttggccattctgctgttctcagttcaaccagataactgggtttatattttacacacctgcactgacaccacaggtattttgttttgttttgttttgtttttttgagacacagtcttgttctgttgcccaggctggagtgccgtggcacaatctcggctcactgtagcctctgcctcccaggttcaagtgattctcctgccacagcctcccaacaagctgggattacaggtgggcaccaccacacctggctaatttttgtatttttagtagaaatggggtttcaccatgttggccaggctggtctcgaactcctgacctcagtgatctgtctgcctgcctcggcctcccaaagtgctgggattgtaggcataagccaccacacccagcccaccacaggtttttttttaacgggttcaagttgatgcttcagacctaagaaacaatggtagcatatagaacaggagaaatagcaggtacagaattgcaacttgggaaggcccagcctgcccaaacacatagctgcttttgccccctgacctagccagggcagctgtggctgccatgccagagagccaaggtcagggtgggtcacctagacacagaggagtcctagctctttttcccaccagtcactcacaccattccagtggcgggctcaagacctctatgctaattcacagctctccagtccagacacagccctccacgaatgataagatagcaacgacacccatcctaactctgtgctttcttttctctctctttttttttttttttttttttttttttgagacggagtttcactctgtcacccaggctggagtgcaggggcacagtcttggctcattgcaagctccacctcctgggttcaagtcattctcctgcctcagcctcctgagtagctgggactacaggcagatgccaccacatctggctaatttttgtatttttttattttttattttttattttttttttagtacagacagggtttcaccatgttggccaggctggtctcaaactcctgacctcaggtgatccacctgcctcggtctcccaaactggtgggattacaggcatgagccaccatacctggctctaactctgtactttccatggaaacagtgcagtgagaagagggaccccaaggtcactttctcagggaggtctagatcagcccgagcctgataacccttcctcattgtcttggtctgcttgggctgccctaacagaataccatagtctggtggcttaaacaataaacattctcacagttctaaaagctggaagtccaagatcagtgtgtccgtagggttgctttcttctgaggcttctcttcttggttttcagactgctgtcttcttgccgtgtcttcacttgatcttttctctgtgcaagagcatccccagtgtctgtccctcttcttacaagaacaccagttctattggattaggtctcacctttatggcctcatttaatgttaagtacttctttaaaggtcccatcttcaaatgcagtcacattggaggttagggattcaacagacaaattttgaggggacacagttcagtccatagcactcctgatacctctagtatcagatttatatacacatcatctcagccatatttaatttattccaactatgtgcttctatagaatgtgcctatactcaataatagcaataatcgtaacagctaccagtaactagaattagtgcaaagaagtgcattatctgttattaacacactcctacgcggtgcatattgttatgccaatgccacacataaggagactgaggcccaaataggacctgggaagctcacatgccatgagcggcgaagccaacacatagaagtagatctttgtgaccacagttcatgctttcttcatccctgcttgctgcctcccatacatcaaattgtgcctggcatcatcgtgcagctatttgtgatcaccttgggattaacctgcaggcaagaagcacgtcctcatcatcattttacaaatggctttcctgacgcctttcactcatgaactgatcatgcaacagctttgctcttctgagcatcctgcaaccgctctcatctcatgcctccttcccttccaacaggcctcccctacttgcaggatggtacccccttacctttttcctgaagccctctctccatggacgagctcatgatcccctttctgtcacttcctcagtggggcctatcctaaccaccctacttgaaattgcagcctcccccaccccactccaactctggatcccagctaaccctgcttgacttttttctccatagtggctaccaccttctaacacacagtatattttattttcttattgagtttgttgttaaatttctctttctgcctgcaagaatataagctctacaagaacagagacttttgtgtgttttgcttcaatactatgaagcagacaaacaaaacatctaaaacaaggcctggctcatagtaggcgtgaaataaatattttttgaatgaataaattagattttatgtgtgtgggctttagtgtgattccttctatggtgaattagtggccagtctctttgggcaaaagtactcaggaacccaacttagctctttattaagttctgaatttgaggacagtgtttttttttttataattcctcttgatcattgtttttgccctttttgtttaatttaatagccgattattttgtcccagtcttctgtgcattttacagttgtattattcattatgggtagttccagcattttcataattaatctttaattgcaatacttgcaaagcatttcacaagaaaaaatgatttacaaattaaacccacatctcaccttggataattatcacaggtctgactaatgtgcgtgaagcccttgcatggcagggggctctctacaatgacaatgtgttgattttctaattaacaaaggttaagtagcgtttttgcttgaagacctataatttaaacttatgacgtttgtcaccaagaaagatttctacagagcgcagaagtggaactcaaataattttcactgattctagtgcattaatgtcttttacataatatataatgaccgttttcaggacagaagatttttcttcatattgactagatcaggaaaagtaccttctagctcactgtcccatttaaataaatcagggactacctaagcaagaaaagagcctaatttatttagttttcctttatagagcgagaaatggcatttcactcacctgctttataaattatgaagagggaggacaaaactttttatttatttatttatttagagacagagtttctttcttttttgcccaggctggagtgcaatggcatgatctcggctcactgcaacctctgcctcccaggttcatgccattcttctgcctcagcctcccaagcagctgggattacaggtgcatgccaccacgcctggctaattttgtattttcagtagagaagggatttcaccatgctggccaggctggtctcaaactcctgacctcagatgatctgcccgccttggcctcccaaagtgctgggattacaggagtgagcaaaactttacttaatgaacacaacaaatacaaactagactacagtcatatgttacacccagttaaaagagggagaaaaaaaaaagtcagacatcggtgcaaagaaagaaaaagcaagcaaggaagagatttaatagaatttgagagtgtttactgaaattcagaaaaaaagacacaggcccagagggagagcctgtgaaccgtgagccagagtaattcagagctggaaggagtcacagacaccatctagttcagcctcctttatctgtggatggggaaaccgacgctgagagagactatgtaatttgatgaaagccacacaactgagtagaaatagttgatgatcctgagaaggaaagatccacaaacacaagtgcaggaagagagatggatccatgtagaacctaagaagtccaaagacccaagaatcaagacagaagcagagggagaaaactccgccccactaaatcctttctgaaatgaaccctgtatatataaataattaagtatccatgaatagatctaaatatctgccttaatgatataataaaaatatgatttactctagatttatttgctctgccaattgaccctttgaaaaatatctccattctcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaagccaaatgtccaacaatgatagactggattaagaaaatgtggcacatatacaccatggaatactacgcagccataaaaaatgatgatttcctgtcctttctagggacatggatgaagctggaaaccatcattctcagcaaactgttgcaaggacgaaaaaccaaacaccgcatgttctcactcataggtgggaattgaacaatgagaacacatggacacaggaaggggaacatcacacaccggggcctgttgtggggtggggggaggggggagggatagcattaggagatatacctaatgttaaatgacaagttaatgggtgcagcacaccaacaaggcacatgtatacatatgtaactaacctgcacgttgtgcacatgtaccctaaaacttaaagtataatttaaaaaaagaaaaatatctccattcttcatcatgttaacattcagagtcttttcaaactctcaatcattgctgaagatccatgaaataccaattgtttccaaattaaaatacatcccagatagacaaaaggttaacatgtggagagaagcaaaatcacaaacatgttagaagaaaatatggttgaataatcatattattttgtattgtagaaggtctttataagcctctgaccaaaggcaggaatcacacaaataagacaggtggatgtgactacaaaaacatgcaaaactttcatcgggaaaaagaaacaccatagagaagtcaaaagacacaaactggaaagatacagctgcaataaagagttatttataaccaagagttaaagctcatattgttattaatcaataagaaatatattctcttgtattcccagcaaaaagcgaagaacacaaagaaacaaaaaataagaaaagggaaaacattaaaattactcagctcacagtatttgaggtgatgcagatttaaacagtgaatcctttttgcccccgtcgagcagactggcatgaatacaaaaaggcactgaccaatattagaattgtgtggagaagatgaaaatctcataccctactggtgaattagaagttggtaaattcttcttagaagaaaacatatttaaagtgcctttaaaatgtatatgcccttcatcctagcaattagacttaaaagtatgattaactaattttaaagaatgaattctaaggaaaaactggacgacaagtgtgcaaaggttttcataaagattatattattatagtatcatataaaatggaaaattttaaaaacttaaaagtccactggtggtgcaagagcgaaataagtgatagtgcattcacagaataggatgctatgcagatactaagcaagatgttctcgttgtacatttattgcttggaaaatgttgcaaaggctgggcacggtggctcacacctgtaatcccagcactttgggaggccaaggcaggcagatcacgaggtcaggagttcgagaccagcctggttaacatggtgaaaccccatctctactaaaaatacaaaaattagctgggtgtggtggcgtgtgcctgtagtcccagctactggggaggctgaggcaagagaattgcttgaacccgggaggcggaggttgcagtgagctgagatcatgccactgcactccagcctaaacaatagagtgaaaatccgcctcaaaaaaaaaaagtttcatgatatgttaagtgcaaaaagcaagtttcaaaacaatgtgtatattatgattccatttcttcctttttatttacacatagtatgttcatagaaaaatgaaaaaggctgttccctaaaagtgaaagtagttaaatctgagtagcgtaacagaatctgttttgtattctgcttctcagtatgtttatagtgaccacaatgactattacattgatcaccaggcagaaagagatggggagatctaaaaatgatttctacattttagcatattttgatagaatataattgtcttaattgactagtgataaaaaatttttaaggccagacatttatttaataaaatgtcttttggaaagcccttattgcaaggacaaaagccataatggctaaaataatagaagccaaattgaaattctaacacacaaggtgtaactagagggttgaagttcttccaaatcaggcaaaggccctcattctcttcagcgtagaggtgtgaagcccagttgacaaacagatggcagaatgggaaatccttcaaagtagttgtttttaataacttcttttgccatctactctctcatagctttgatcaaaaaaggcactggactctcttcacttctctattccaatatgttagaagaaatcaaatactcccaagggagtcatgattaaaaccaatgagtcacccagtgagagaactgcaaggcttgggtttgcagagatggtacagcaactcatttgccacttcactgatggggttttgcaggcataagcagatgctaattcatctctgccactaaagcctttgatattccagtcctgtctgaccaatctactggagtttatgacttttcttaagataatagagtaagtgatcagaatcaatccccagcctactgatcttacctgaattccagtaaccctactgactactccatgtttaaagacctccaaatctacatctcagaaacatgtacatctatgagacccctgactggaaagttcttctcggtattaagtggtctacacagaacagggcttaagacaataaaccctgtttgttgccttaggaataagacagatctgatacagttgccactcaggaactatgagtccttgagtaaacttcttaacttctccaagcctcagtttctccatctgtacaatgggaataatgcaaataatatctactttgataagttgttgtgaggaccaggtgagtagcatatataaggtactgtatatagagtgcctagtatgtagccctcaatgaaggagaaacttgggttttatttttattaacagtattttcttttctaaatgctcatcacctatttctttcaacagttttacctactattcattttagattagtttccagaaaagttgttactctaagatgcaagcatgtatataaatttgagttcgtccttttataccagctgctttaaaaagattatagctaagaatactatagacacaattaaatccatttgtgatagaatgcctcaatgaatctttctgtgaaatttcttgggaatattttaatattttcatgctcatgaacctcagtccaactctataacttactccaaaaatcacagtgaacgtgcttattgtgctatatgtcgtgtaatgacatttagacaaaagcaatgaaatctgatctaacctagcaataaatgtggtatagctgatttctgtgtaaagttatcagttccagcttccagctaccccagacaaggagccttgggtagtcttgacatgaacttaaaagcaaagcctctcttgagacaagaaccaagatctacaatcacatttcaaacggatttatgtcttccaactaattgacttgttaactatgctaatacattcatgtctctgcctttatattttttcaataagtaatgctacagaactcgatgttgtgagattaaagagcaaagaatctagagatttctgtaaacgctttttctataggaaaccagattagacttccaaaacagctgatataatttttgtgcatctccaaatattttatttctgtaggaaacgtgttgcttctcagaagatggctcttttaattaggccttatagcctgcagggagaaaagcttcaactttctctatttagataggaccaacttgatagtgacaatactagatgtgctatgcagtgtcatctcctaccacagttgttcaaaatatgaagaattaagcaatagcagaggttattccctctgaactctgtgccttctgtcattcccaggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaaggtaaggtggaacccatttccagagccacttttgcgtgtctttttaagcccaaatcatctatttaatgatttttcatatgtaaacaagtgtaccttattctgaggttaagatgatcagaatttttctctcaacttaggtaggaattttccaaccaaaatcatttcctaatcatttttgtttgataaaatgagagaagctctgtgtatggtgcagaatttcttccagattctagcaaattattcactgcccgaaacactacaaaggcagtctcattacatcttaatggtgagtgataaaataggtggccttcaaaaggggaatcaggcctgaccctcccacgttaggatctccaatagatcaattgatcagtcaatttctgtagtgaatcagccagtgcaccccagtggtcttgatgcccccaccccctgcagttgctaagagactggattcaagctacactcaccagaaagctcctctggtcagtcattaacatcattattattactcttactcaggatgcctttgagtggctctcagcctaagctaaactgcagaaatgctgaaaaaccacatttaattggtcagcttagagcatctgttattacttggttattttagtcttgaataattcctttaatccccagtagattccgcagagccaatgagcagagtacaagagcccaatgcatatgcatgttatcatttgaactataccctgtgatcctgcttgaccagaagaagaaattgactcaactggtctgtggcttaatttcccatatataaatgagggatgaagagaggaggagctggtgcttttcctaagccacaattgaaatgcatgtaaatcactcctctctttctaaatgaatgtatagcatatgggtaaagttttctgtgagcggttggtgcatctcttaataagaagctttacataagtagcctgttcagactctgatgaatacatggagggttgtttacactggcattattcacacaagatgccacacacagaaggaggaattgttccataacattctctgtacctccaggctactgtttggcagcgctataatatgagcatacaaattaggccagacagggtatgaaaaatgagcatgagacaacaacaaaggtggaaaggaacaccattgcagaataataccaaagcacattaacagtgctattacagtgcatttttctgttcagaacaacatggttccatgattttcctgcggcacacaattgaatgggcctgcagaacacattaattttgcacttgtagaaatgacagtcttgcaattaccattcattgtgcttgatgctaatttaatgcagtcatttccttgccaaagtaatgtctgaatgcaatcaagtaagcactaatgcctgcgagattccactacataagtaccagtttaaagaaaatcaccatccctttatttttggagagttaggttaaacacagtagctcacgcaaaacctctggagattaataggcaatagtcatgaatagaaaggcaggggcatatcctctccaggttaggccacattgcagataaagtgaaatgacgcctgtgtgttgcctctgacattatttcaacatgtttacacaaaagacatctaaatatttccttattatctgtttagcagaatgagttttcatttgattcaattagtgactttaaccaaaaaatttaaatagaagactgcaaaacatatttggaaatcatttatgagcatccttctgagtcaagtacctccttgacttggtagaatgacagtggaactgtttcagaggaatcccacagctgtccaggaaagctttgtctgcactgaggcaagctccatcagggactggaaggatctcccagcctgatgctgtctctgctctggacctcactctccaggtagcctggtgcctgcacagcagttcctgtgaccgccccccacctcaggctggtgcttcagccaaacagctcagcctctacaaagagctttggcattggccgaagaatgagctccatgcaaggccttctctggccttcctttgggagtataggtctatgcttgcagatgtggaaaacatcgctaatattttgccaagtgaatgaagcaaggcccaacctaccacacacagccggactacgtgtttatacaaaataaaacatgcatacacgcagagatgaggcaaacaaactgtgagaatacacgccaaaatattaactgtggttattttttgcaggaggataaaaatactagtattttttcttattttattttgctttaagttctgcgatacatgtgcagaacatgcaggtttgttacataagcatacgtgtgccatggggtttgccgcacctatcaacccgtcatctaggttttaagccccatatacattaggtatttgtcctaatgctctctctccccttgccgccaaccccccaacagacccctgtgtgtgatgttcccctccctgtggccatgtgttctcactgttcagctaccaattatgagtgagaacatgtggtgtttggttttctgttcctgtgttagtttgctgagaatgatggcctgtagcttcatccatgaccctgcaaaagacatgaactcattctttttacagctgcatagtattccatgttgtatatgtgccacattttctttatccagtctatcattgatgggcatttgggatggttctaagtctttgctgtgtaaatagtgctgcaataaacatacatgtgcatgtttcttattttgtttttgcttagctacattttccagtctttgcacaatgatgtatttcctctaacatcattattttttcttctttggaaaaataatagtaggaagccaagttcttaccccagacatttgagggataactatctctggtcataaaatatctagctatttattagatattattggaccatctagttgtactttctggaatggagaagcatggtcaggtgaaaattttatgtaattatattgtccctgagaatctcaatacatttaacaatgcatttgttaaatctcaatacatttagcagaactcattttccacaagcagctgaagagatcacccttcagatgggcatcggaggaagggctgccttgttggggtcaggttgcatgaaaataaagacctcaagacactagtatcacactcagctatgtgagaggctcacactaggacaggcttgggacccaaaatagcccaggtcataaaatagcccagggggacagataagctaagtctcacccctgtatattattagcccatccaggagaatggtgggcagacagcccatactgtttgaattctgtttttccctcctctccttctccccctcctccccatcctccttatcatcctcctcttcttcccttctcttcctccttccttctccgttcaccataagcacaatctttatttctacatcaatccctgtctctgtctctgtctctccatattccatacctactttccctctctccctttcttttgctggagtgtatagttgaatatgtaagtgaaattaccgtgtcttgtcactttgttgaactaggaagacagggctggatttgagtaggttcctcatgatcatctcttctgctttgtagatgatgcactgatactcactattccgcactagtcaaaaccacacaagaaggggacttcctctaacctcttatccaaaacccttttttcttttctttctttctctttttttttttttttttttttttttttgagatggagtttctctcttgtcgcccagactggagtgcagtggcacaatcttggctcactgcaacctctgcctcctaggttcaagtgattcttctgcctcagcctcccgagtagctgggattacaggcacccatcaccacatccagctaattttttatttttagtacagacggtttcaacatgttggccaggctagtctcgaactcctgacctcaggtgatctgcctgcctcagcctcccaaagtgctgggattacaggcatgagccaccacacccagcccagagccctttttcaaagagatgcctaaagatttgaccaccagttaaagtgttagctctcccagggctacttgaatctttagtaggagtgctgactggggaatatttcatggtttggagatagcacaagggcgttgtggaaaccctacaactagaccatgcaggcagtctcctcatctgtcggcagataactgagcagcatcccatcttctcagcacgttcatcaatgaggagcagtttaactcagtggaggtaggtcccttccaatgcagaattccttggcaccccatcggctgaggctgaggggagaatcatcccagactacatggaaggtttaactgtgggtctgtcatccccaggattattggggaccgaatggatagttgcttggtcatgccaaagatagttttctaacattaaaactgctccttcttggagagtcagatcccaaaacactcaagaattctataattatcaatgtcacttttattactaaccagaaattagagacataatttgcagtacactctctgtgtgtcttctctgtgtgtttaagcaagagagaaaataacatacctatagtagaggcagcaatttctgtgtttacttttcgtggttgaatgccatagtagattgaatagtgtcccccaaaattcatgtccacctaggacttcagaatacaacgttgtttggaagtagggtccttgcagatgtgattatggtaagttgaggtcatactaggaggttggccctaaatccaatgactgtgtcttcataggaagaggagggggcacagaggtactgacagacatagaaggaaagccatgtgaagacggaggcagagatcggagttacactgccccaagccaaggaattcctgaggctaccagaggctagaagagtgaaggaaagattcttccctagagttttcgaagaagcgtagccctgagaacaccttgctttcagacttctggcttcctaggaaaataatacaagttcgaagaaaaacctaccatcttcttaattcttgctcttaacaaggatagcagctggtatttattgagaacttgtctgctaggcagtgtgctaagctttctaattgtgttagcatcgtttaatcctcaccacaacctggtgaaatgattgctattactagtgctcctattgtaccaagaaggagatggttgtagtagcctgccccaaggttcacatattagtaagaggcaagactccctttcctttcattttgtagcaactaaaagcatagcctctagtcttaaagctttttgattattgtgattgagtaaaaagaaattagaatattactggatgcagagtttatcataaaaaataggatacaagaattgaacagacactgtttttttttttttgctacatctaggtgtaaggtttattcatttattgactcttattgagcaaacattcattgaacacctaatgtgcccagaagtcttgaatgtatagttgaatctgactacactgaaatttccaaagcattttaatggtttacagatacaaaatcaggcaagtctagaatatatgataggaatacatgtgaattggatatcacccaggctgctgaaaacagttcttcattatgatcctttcaccaagccaagttaagcaagaacttatcatcaagagacacaaagatatctccaaattcactcatctgcactttttttaactataaaaatgttcatgttcatatgccaaaccaggactgcagttgaaaaatacatttctttaatcactctgaaaccattttctgagttagggagttctgttttcttctcaaacattcatttgtttattgcttagaaaaaacttgaagaataaaagtcacaggattactgagtgaccaagatttgaatagtcattcaatcattgcagtgtttccatcatttacagtcacacaaataatgtgccaccctccctgtgttccagctaagtctcctattctccctatgagtattgtgaagttagctaatattttataatctgtattattaagatggtagaagaaattgtttatagcaaattcaagtctcaacctataagatgatgatggaattagatgtcagtttgaatccatctttctcacatacctgttacgtaaccttaggaaaattgtttgtcactgagccttatcttcaggaatacatagtaactacctcttaaggataccttgaaaatcacacagaataatgtgaatgaatttccacatgaaggacctggcacacagcagtccaacagcaaatgtccttttcattcttagcagctctttgctttttggtttgtgtttttgtttttacttaattcatgttgtcctttaatccttccctaatagctttaaatgtcaaatgcctaactggcattatttcggtgatccttgagtattggattgtcatttcggtacttcaggagcagtggcagtgtcctaaaatgtcatttctacttaattttggtcacagtaaaagtattctgaagccctgaagggctgagaagtatgcagagattctggaagatgcaactggaaaccacacccaccatatcggactggttttgtcaatagcgcaagtcttggagcaatgtatccagtcctttcaagaaccaagttgggtcaccttagtaactcctgcatcccttcctgactcaaggcccatcaggagacaagaaagcgctgattagccaggcacactggctcacacctgaatcccagcactctgagaggccaaggtgggaagatcatgtgagcccaggagttcaagaccagcctgggcaacatagtgagaacttgtctctacagaaagacaaaattagccaggtgtggtggcacatacctgcagtcccagctacttgggaggctgagatgggaggattgcttgagctcaggaggtcaaggcttcaatcagccgagattgtgccactgcactttagcctgggcaacagagcaagactgaggaaagaaagacagagggagagagggagagagagggagtgagagagggagagagggagagagagggagagaggcggggtgcgggggagagagagggagggagggaaggagggaaggaaggaaggaaggagagaaagagagaaagagtgagaaagagagagaacaagagagagaagagaaagaaagggaaagaaagaaaagggaggagaaagagggagagaaagaaggaggaggagagaaggaaggaaggagagagagagaagcagagaaagagaagaaaagaaaagaaaggtcccagactcctttttgctccaagagacctcaggctcaagtccacgttatacctctaaggaagagagggttttccacttgcctcctagagaaacatttcttgttggatgtgaggtagtgggtttgccaaaagcggttggaagactgaacaaattctgttccacagctctcagtatgaaacagggaccagaataaatgcatggtctacccttttagagcaggttggagagaaaattaattaatacaaaatatataaacaaatagggagaaaaagaagagaaatgttggaagtatgcatcttagaatttcacccctatgtgaaatcagctaagctgttagtgacaatggccatttttcctcaggtctacctatccagtcttaataatcccagcttggaagacactttcacatcagtagggagagaaacttttcacaggcttctttttcattttcagttggaacaggaggtttgacagatttggaagaaggcccaaaggaacaagaatagaaccctttttttttcttttcttcttagagaattattcaagtagagaaaatatcccttctctcttaatgtatttcttaaatcttcagaccttaggatgcaatttaaaagtatcatggtaactgtgatggttaattttaagtgtcaacttgactggtgttccatagggagcaggtctatgcaagcctacctccaaaggccaagggagctgagaggccaaagaaacagtctgacaaagccagtttctcagaagaaaaaaaaaacaaattgaatagggacttaccaacagaagttgcgtctctggtatctacaagatgagatggtggattcctttacctcctcagacccagggcctatataccatagagaaagggtctacatgcttcagaagcaagttaccctagagcagaatttgcagtaaacagtagataaggtggaaaacttagtggcattctgcaactgggttattcagaagccagcatggtgcattagcatccaagaaggaggtgctttagcccctacacctagaaatctgtaaagcattactttgaggtgggtctgtgaggctgtttccagagaacattagcatgtgggtctgagtggatgaggtggggaagagctaccctcaatgtgggaaggcattatcctgtctgctaggggctgcagagaacaaaaacagagaaaaggtggtagtgtctatctatctactagagatgagatatactgttttggggcaactccaggctccctagcctttgggctccagaacttataccagattctcatgcttttgagcttgggctaagagttacaccattggcttcttttgttctgaggcctttggacttggacggagccacaccactggtaccccagggtctccaccatgtagaggacgtatcatgggacttctcagcctccacaattacatgagccaattcccctaagaaatcccctctcgtatgtctatatctatatagtctgttgattatgtccctctagagagaaccctaataccataacgcatgaaaataatctgattaaaagcttaaaaaataaagagagaaggaagagccaaaaagtcagaaaatatttatggatgaaaatccataagtggacagaagtccacaaatatgtatggaaaaagaaaataattttgacttaattcagaaaagtcaaagctgcagagatagctgccaagtttaagtggctttgttatagaattttgtggtggtaaaataacattccccctagcctgaggttctctttggggtcccagatatttgagaaaacctggccaattaactttcttagagaaagagatttaaaaattcagtgcagaaaaagcaagtcctccgtaaactgttctaaatctaatacaggacaaagtgttcggatttggctttggttgtaggataaataacttttgtttcaagtgtgtgcccttttttttttttttttttttttttttttttttttgagacggagtctcgcactgtcacccaggctggagttcagtggcacaaactcggctcactgcaagctccaactcccgggttcacgccattctcctgcctcagcctcccgagtagctgggactacaggcgcctgccaccacaccaggctaaatttttgtatttttagtagagacggggtttcaccatgttggccaggatggtctcgatctcctgacctcgtgatccgcccgcctcagcctcccaaagtgctgggattacaggcgtgagccaccgcgcctggccaagtgtgtgcccttttctaatccccaccagtgtggggacacagctgaattttttttcctgagtgttttatttgtatatgttgttgagtgtttttatttcctgttcttcagcaatgatcagaactctaaataatgtgaagttcacagaaataacactctttatcttttcccacatattagctccatgacttgagctgaaactctatacatttcttttcttttcttttgtgagccaaaaaggaactggtctgataaattgtcctgagggttttgcttttagattgctcacatgtttggctgccctgcaagcaggtccattcaccaacgtccacgctgcccttgagtactccatcacgtctatgggccatgaagacctgcctctgacatgcaatttcttcactccacaaccatttgcgcgcttatcatttccaacaggcagctctggccttagcaactgggctcattccaggcattccttggctacaggaaatttactttcttaaataatcaagcctgagactataatgctatagcctacccattttatagatcaacctggctttgaactcactcacatatttttacctctattaattccaactggttacaagagtgtttgatttagataaataggcattttatatttttctgtttaaaaccaaatcctgagaaaacaaattatgaagagccagctgctctctctgagccatccttttcttggcattttaaatgtattaccttcattttctcaagaggactgggcacaggatatagtgaaatgtttaacttgactaacaatactttctagctactcttccaagggatatgtttactaaatataaggtggcttttacagtattcaagttctataaggcaaagactctcaattaaattaaattattggcagtacaatttaacattctacattctgtgtgaacgaagtaatttcaagcagtttgatcattaataataattttattccttcctatacactgagcacaagtttagtgaaatacgggaacatgtacagagagcctgctgtgggggaagcagtggattgccagcaaggaaggacaggatgaataagactaggctgggaatgcaatggaggggatagaaccaactgcagcatgcagggaaacaagccagaaggccgagtgagagacccccatggatacccacgctgaaggttctactgggagggctgcctgattcaaagtcttgtccaaggacagcatggcagatagtggtgggttgcacctaattctgagggcgtaatttgggttaagggagaagactctttggaaaacatatatcattaaagcctaaagtctaaagacaaaagttttaaagcatctcaatttttttaaaattgtctttgaaataatacaattgatatttacaagaaatacttatttgctttttttttttttttttttttttgagacaggctttgagctttgttgccctagctggagcgcagtggtgcaatgatggctcactgcatcctcgacctcctgggctcaagtgatcctcccaccttggcccccagagtagctgggactataggcatgtgctaccataccctgctaagtttttaattttttgtagaaacagggtctcactgtgttgcccaggctggtctcaaactcctggcatcagggtatgctcccacctcagcctcccaaagagctgggattacagtcatgagccaccatgcccagcctacttatttgcttttaatattacaaaattgaattgctttagacattaatagtggacaaaatattttaggagttagattagcttaactatttttcaaattatattccaccagccaaaaatatttcatgaggctttgccttctttaatttctaatatgaaaacagtagggaattttttccatttttcaaaaagttattctaataattaatatgattttctcaaaatacacgtctccttgcagttttttcccttactcccacctccagataattttatatgaacctagtggacaccttccccttgagtatttctgccttaaagataactttaaagatacaacttcaaagatagatcaacaaattgatatgtaaaccaggcacggtggctcatgcctgttaattccagcattttgggaggctgaggcaggattgcttgagcccaagagtttgagaccagcttgggttacacagtgagaccccatctctataaaaaaaataaatatctaaaaataaattgacatgtaaataagtttatctttgctttttgttaaaagaggtcttctaaaaacttgcttttatcaactttaacattactaaattttattttagtattctgaagtttagaccttaactaatgcaaatttgcttactttagactagtacaaatgacttatgatttacctgtgccagtagccaatctcactttctgtgcttctccctagggagttgggtcaagtatagcttacagagaaataccaaattctagcccttatgtgaatcatttctcagcaatcctcaaaggcaccaaaatgtcctttcacatcttctatttctttccatcctggatttatgaccagaaacacagacaacactattctaaactaattttgtttaaagaaaggggaaatttgtactttttgagtttatcccaattaaagagggaatcttatattatatagaacagtggaacaagagtaacttgaattccaatttcaacattattaaaaaccaaagtgaacaatcctaactaggcattctgtttctttataaattgcactaattatataaaattcattattcacaaggctgtgaggatcaaatgagctgatggatgtgaaagtgctttgaaaagcattaatgttataaaatgcaaattattattaagtttattaatcattgagtcactgaaagcctctttagtgagaatcctgcaaaatgtaaaccattatctttcaagagctgctaggaaatcctagacagaacttttctatctgtgttgttagtgttgccataaccaacagcaaaacttttccctctcaattgttgacattagtgctcgcccgtctctctgtacagcactgaaatgcgttatccagaagctccgtgctcacaacaatccagcaagactttagacctcagagttatactagttcatgacaggcagtactgtattcatagtcagccaacccttgaatgcatggccctgattaaattcctgtctctgtcatggaattggcatgagtcatttggcctggaacatcattaaagcagcaaacacacttgagattaaataagaatggattctaaaacatcctcttgaggttgttattgagatcgttagcaaatcatgttggttccttgagtatcttatagagtttcaagaaataaaaagcaactgctacattgtagaaagtacatctaaaattttcctcttatcccaagtgattgacagtctctctgcatcctctgccccgttaccaaggatgataactcctgttcagatgaatgagtccagatttttctcaggtctaagccaaatgtaacccaaatatttgaacaagtccattgctagtcactttttagttttcagagatgaataaagctataagtaaaatgctttctaaagctttactattgaagtaatttgatttaaatcccttttaaataggtctattttagcctgttgacttttatatttccttaacaaatgtctcttataaaggaatcttgtaaattcagttaaaaatataaattaagtcatgtaagtcaaattaaagcagtagatcaagttataaattgaaacaagtttataatccctctcctctattaactaagttaaaatgttatcttctgtggcctcatacaacaacctcctgaatcataaaccacctgaggttatgacaaacacttaataacttcttttaaaatatcaaggactattccaaaagacttttatttctgttactataatgaatttatgattactcagactttcagcttttgcgctaacattcaaatgtcattgggttacttattccaacacttcttctattactatagatggttaaaagttcaggaggccccttttgtcacaaaatcaaagtatgtcgtggttgaaaggactatttcattcattcatattcaactgatattttattaaacatttcctgttatgccaggcactgaactaagtgtgttcacatagtttaccttatttaatcatcacaacaacattcaggcattgatatgatcacctttatttacaaaatgaagaaacagagacttctagaggttaagtttatcatccaaaatcacattgctagtaaatggcagattgagattggaatcctaggtccctgactccaagcctagtgttttttccaccatatacactagaatgatgtcctctttataacacactcactggatcagatccaagttgtgttcatggagagcccgggaccacatgaggcagccctcttcctatttgagcatttcagacaactggaaagatttccctcatcctgaaccatcatctctattaaagatggagaatgtctccatgaagaaacagtgggtgtctggctctgggttcaaattcctgtgcctgtaagaactcagaaacacctatgcaccttcaaaatccccaactctgtggagataaggaagagcacctggcctaagtttgacacaaaaggggtatttaatagctgattcattccttactcttctgtttcctttaccaaagtctcaatggcccttaaaactaatatgctgacacacggtcagtggtccaatttgctatggctattctcccaatgccccaggaggccttgaaagatattggccttgcttgttgtccaatgtagaatggtaaattaatgagatccttggataccagataacacagcttgccctgtgtgtcctctttctatcttatcaccctgatgactcagggcaggcctaagtcctaaaagttctgaagaagtttcccttctttctttgccgttctttctgaggccctctctgtgcggttgagcaaggaaacatacacacacacacacacacacacacacacacacacacacaaacagagccaggtgtgagctggacctgtcggtttctaacaataagtcttagataacaagataattctttgtgtttcttagggtgccacccacacaccgtatccatgcttttgtgttaatagcagagacttctctttctgaatatatgaggagaggaataaaacaagggatgtgaccaaataaattcttctgacatgagagaccactttagattgccttattacaaagaagctgatttgcagggtaaacacaggccatgccctgtaagttttcttattgatgaaattcatgctttgaattactgattgatggttgctgaaggatggcaatttctctgttccagtctggagactgcgctacgtaaaacgagcttctgatgatggaaattctaaaatccaaacaaaacatggaaacaattttttaaaactcgacatctatttctatgaggagctaggagggtggatgcaattggtcagctccagctgtttccttgcttttattgcacagttgttacaaagaggaattcagtgtacaactatgagcttccggccgctcaagctactgcattacactacatggccatactctgatcccaacatgagctttttttcctctagccaaaggataatgtaaaaattatgacacaaataaaatatttatcctctaggcatgagtaaaggaattcacaaatcagaacatagcttgcaagcatacaagagtatgcttgagcagtcccctctttttaataaaaatcaaccatatgaataaaaagctgccctgccccaacttcaccccctacccatcacagaccacaccaccaccccaccatccccgcatacatgcgtgcacacacatgcacacacacacacacaaagccacccactaccattgcagcagggaatcactgatttttttaaattaaacttttagagaacccatgagtttagatggaaaaaatcgtgggagagtaggaatagtttaaggaatgtgcttggagaccagccactcttcacccaaaatgatttcctttgaaattcctgacttgttccctttctgtcctgtgacctattgttctattaggccattctattctattacagcatcatttgaatcagtaggagtgggtctgggaggatggtaataccatctctttaatacctcaatgtggacggaattgaaatggccaagtccttacccagaagagctgtcctgaagaaggagcattgagtttgaagggaggagccaggtgtaatttaggagtggggaagacattggacaagctttgaggagatagttaagatgacttccatgaaaacagagagctgaagcctgttagtaacagactggaaggaagaaagatactcctttctttgctgatcttgcctaaagccagcaggtctgcactggcaaaaagagaggaaactgtctttctctcccctctggcagtttctcttctactaagatccagaatccaagctaatggcattagtgctataatttggtttcactactaaataatctttagttattgatccatgttagaattttgtactattggaaaatgtattctgagttcctaaaatcaatttatattattataatgtatgtaccgtactatcattatgtacatagtattagcatatatagcatttcattcccttgaaaccacttggtcttcatacccatcacttaaaaatactgcttcatattattccacccagtgggtttaccaaaatttatttaacctaaatatttcacaatagggaaatggcaatttcaatttctgttcttaaaattgtttccaatttttttattgtaaataatactgcagtaaatgatttttgcaagtggcatttcaatattttacattatttattgaggatggattgccagatatggagaggtagagttagaggatgtaaaatgcttaggcttttcacgtacaaagctagtaagattttctaaacacagtgccaaagtacatgcagtatacactgagaatgccttgttctctgaacactaccagcaatgtttttcttttttttatttttatgaagataataagctaaaatggtaacctatttgcctttacttcctccaaaatccctagaaaaggatttcaaaatttttttgaaggtaagagtcaatctaaacaaagaggacaggagaggacagcaacatttagaaagacggcaagcaaatggaggaataacacacttagtagacaaagggaggccaacccctaagctggttgagggagaagctcaagagcaggcaattataaaagggcagttccttttataaggaaccgactcctgcaattactgccttaactcattcatgaaggtggaaccctctgggtcaggctctggtgagggccctcttctgggtggcagaagctcaagggcatggctcctcttctctttgcccttctgccatgggatgatacaacaagagggctctcacaagacgacatcccctcgatcttgaactttccagtctccagaaccacagccaagacatttctgttcattgtaaattatctgcggtattctattatagcagcacaaaatggactgagacaggctgctatagcggactgccatagcagtctctgttgcactagaaggctcagaaatgggtagcccctggcacctcagaaagatagacttaaaaacggaaggatcagctaaaaatttctatatgaagacaatcttctcctcactcttgcagctgggtaactgccccagagccaaataaggcagaagacccaagatttagtgtctggaggggcttcttttatctcttgaagatttggaagattgtgttttccaaggacggctgccacaaaagctctcctgacacctgtgcttccagagccaagtgactgctccatcaagacgtgatatctagttttcctctccaagaatctggacagccttgggacttgcttaagccaacagaatgtggcagaaattatgctgcctgacttccaaagctaggttatagagccaaggtgacacgtgccttggggactgggccatgcacattggagtactgattgcccaggaaagcagtcaactgccctgaggccaccatgctcaaggaactgcactaggttacgtggatcggacacatgaaaaagctttgagatgacctaaggaggtagagagaggccaaatttctgattcacagaaaccattagagataatgaaataattgttgttgttttaaaccagcaagtttggggagcaatctgttaggtagcaataaggactggaacagagaagatgaataatagttttttggttttccaaaagaacttactctccaagtattatctttgtttttgctaaatcctttgtattagtctaggctcttagagcgacagaatcaagaggagatatgtacctatatctgtatctctatatatgaaaggagatttatttggggaattggcacatgcaattatggcagaagtcccacaatcggccgtctgcaacctggagaaccagggaagccagcagcatggctcagtccaagtcttaaggccacagaactagggaagccgatggtgtagctctcagtgggaggctggagccctcagacaccgggcggccactggtacaagttctgtagtacaaatactggagaacccagagttctgatgccaagggcaggagatgtcccagccctaggggaaagacagagagagagagagagagagagagagagcaaaaaaagaaaaatagaagaaaaaacatgcattcaaatcattttgtaactcctaattattaggacgataataaaagaagattccagattccagacctagagagcaaccagtacagactgaacaaggaagatgaagagctccatggggactatctttgtctttagtctctttgggctgtgctaaggattgaatgtgtcccccaaaaagcatgcactagaaatgtaatcttcaatgcagaagtgttgggaggtgaggcctaatgggagatgtttaggtcgtgaggactccaccctcatgaatggattaatgctgtaattgcaggagtcaattccttataaaagaacaagtctggtccccttttgtgcactcttgctctctctctctctctctccctctcctctttcctctgtcttctccctctctctgtgtcctcttctctttgtccttctgccatgggatgttcaacaagaaggctctcacaagatgccatcctcttgatcttgagcttcccagctagcttccagaaccatagtcatatatttctgttcattatacattatctgcagtattctgtgatagcagcgccaaatagactgggacaggttgctatagcatactgccatagactgggtggcttccaaaacaaacattgatttctcacatttctagaggctggcagtctgagatcagtgttccagcatggtcaggtgctggtgagggccctcttctggattgcaggctgctgacttactgttgtttcttcatatggcagaaggagagttcagagagctctctgggtctcttttataaggggactaaacccattcacaggggctccaccctcatgtcttaatcactttccaaggcctcacctcctcctaccatcaagttaggggttaggatttcaacatgtgagttttgatgggagacaaaaacatctggtccataacagtcaagaaaaatataaaacagtttacttctgtttccttccagtggtgagataagggatgagttagtgatgagtgtgcagaaaacaaggcaaatgaagaaacaaaagattgcactggaatgtaaatgcaagtgttttacaacatatatgatcaagaacaatgcaagcttgttacttagaaatatgaagttgatgccaaaaataagatggcttctgaggagtgggaagtggggaggtggagtggagacttccgttaatgtgtttcagggcttacagaagcacttgagtcctttcttaaaaatgtgtaaatttatggcgtacaagggtaattttgttgcatgcatggattacatagtggtgaagtcagagcttctaaggtctccatcactcaaacaaaatacattaaataaactctcgtcatccacccctacacccttctgagtctccacactctatgtccatgtggacccattgtttagctcgcacttataaatgagaatatgcagtatttgtctgtctcggtctgacttgtttaacttaaagtccttagactatgtatgtcacaacattcataaaaactgatcaacttaaataccacattaaaatgattacagaaaaacgcaagcaaaaatataataaagtaattttttcccctccctcaaagccaactgataacgaaaagaaagaaatggatgaccaaaaaaaaaaacaaaaaacaaaaaaactctccatgcagtgagccgagatcacgccattgcactccagcctgggctacaagagcaaaactccgtctcaaaaaataaaaaacctccaataaaatatggcaatgctcattgccacaaaccacaaattaggaaggatacgtgacacatgccaactactttgaaatttgcatcagaatgagagaggaggcagttaattcatgttttcttaacttcactcaaagttcagcaattcctttagctctatttcagtttcttcatcctattgctttcttatgaaatatgactttatttttttcctataaaagtagcagaaatgattgaaagttctttgcattttttggcggtgtttgaatttttaataagggccacatgtgtctttctaaaaattaacctattctctttttaaaaattaacaaataaaaacttgttctctttttaaaaattaacttatttgttctctttttaaaaaatgaagatttttttcctcaaaatgaatatacttttgaggtaagaggattttcacctagtattctaaaatcacaaaaacaagtttattatttttattttattgcaaatatttttcctacatggttattttcagatcaaataataggattttggaaataccagcctgaccatactgcacagattgagaggttaggtactaaattataggcttttagagggaggtaaagatattagagtccatctccactccactccccacagataagggccaaggccaacctagccattaggtggggtggacacaacccacgttttgaggggcccacacatatatgttaaaatttctttagaaatcagaagaatacaaatgaacttcggggtcaaagaaaatattttaatatttaacattaatacattttctcttgaggccaacattgtcatgaaatacacattttcataatttttttttgtggaagaaagggaccacaagggcaagtgtgcctggggcccatgaaagtcataatgtggccctgatgaggattctgggacctaaaaagattcctgtaattggtggtggcagagtctggaccaaagctcagggcctctaactcctcctctatggtgctttctgccatgctgttctctggcttgggtattccacacactccatggtccagcccacactccttatctgaccttacctctggccatcagtcatagttcatcttctgctccagttaggtaggcccagcctcatttcctgtaattcatcacaaacactctccatcccagctccatggagcctcccattgttcctagtccactgctgttcattcccagcactggctctcactcctcccactctccccatgtggagaatccttcccgtttccttctgcttgttcaagaggatcctcatctctggagactttgtcttaacactgcctttttttttttttaactgaaacagggtcttgctctgtcgcccaggctgcagtgcagtggcgcaatcagggccaactgcagccttgacttcctgggctcagatgatcctcctgcctcagcctctcaagcagctgggattacaggtgcatgccaccatgcctggctagtgtgtgtgtgtgtgtgtgtgtgtgtgtacatatttttttttgtagagacggggtttcaccatatggcccaggctggtctcaaagttctgggttcaagcaatccacctgctttggtccccaaagtgttgagattacaggcatgacccaacactcctggcctctttcaagtacctttaaagactcctccagccttgagtgatctaccctatgtataaaagcatttgccatttagtaacaaattatcttttcttattcatatttgtcttatatgtcttagttttctttccccaattatcttgtcaggtccttaagctcagaagcgatattagtcaaggttccccagagaaaaagaaccagtaggataagtataatatagataagagggaatttattattggaagtgacttatgcaattatggaggccaagacagtctatgatatgccatctgtgagctggaggcccaggaaagcccatggtgtaattcagtctgagtctgaaggcctgggaacagggagccagtgtgtaacctccagtccaagacgagaggcctaagaactgaaggaagtggggtgggcggagtcccagggcatgagaagaaggatgtcccagctcaagaaaaaaaagagacaacttacccttccttcacctttttgttccatctggcccctcaatggattggatggtgcccacccttattggtgagggcagatctactatactcagcctactggattgaatactaatttatggcaacaccctcacagacacaccccaaaattatgttttaccagttatctgggcacccttagcccagtcaagatgacacatgatattaaccatcacagaagccatgtctcatatactcactgagcatatatatgatcagcactcagtcaacacccaaatgattgtcagaaatctctcacaactccccctacaataatagggtcaagtgctacctcttctgggtgtcagaaataggcttggctttcctttctctttcttgtatttgtaccctctgtgatgaaagtcacgctgtctgattgcacattccttctgggcaagggctgatgtcttctcattatgtattgtcagtctccagcacagtctgtgctacaaagtaggtgtttggtaagtatttgatgaatgagcattttctagaaccaacttttaaattgaatttcttggtcctggagatgtttatttttcatgtgagttttccatctctgaaaaaaataggaaaagaaaagacaaggaaatgagaaagcaacttgaaaacaggaaaatattggtgaaagttattttcacagaagtcttagttgacctttctctgtagcattaaattccttccctgtagtattaaattcacaacctaagctatagctagctttccaaactagacaagcatcccacttaagcacaattgatctcatttcagtttgtgtctttgggcaatgaaataccgcaaagactttttctacctatgctttgatgctttttaaaaagtattttctaaatatttttaaaatgtttgaaatacacaatgataggataactccaaagctgtcatatttgtcaaataattcaagtcagaatttaatatatcctataactgagactcttttataaaattgagacaggcacctgaagaccatttttatttctgtattttcttggtgtcccaagcaaccccctttagagaaatcactaatatttcctgagcaattgaaccacaataaagaccgtggaaagaaaaaaaatgggtctgctcagacattcagagcacgcatccttacaaatgcattctactgacctgcaaaatgttagtgggaatttataaatgcctacaaaaagaatatccaagtcaacatttgacctgtcaaatctaatcagtttggttttgatcattgtaccgggttgctattcgcaaacactaattgaaagcaaaaacacaaacagcatttttaaagagtttctaggagaatatcccatttgcacacacgtcagattaattttccccagagttgagcaatttcaggatcaattgattactgatcccaaggaacaatcaaaaaagaaattccctgaaaaatttttttgactgtcaagactcagcatgggaaactatgccatgaaaatgcagtttgaatagcttgtcttttaatcccaagtgaaataaatcaatcatctattagacttttctagttccttgtgtagtcagggatagaagagttcgctgcagcaggattcggaggaactggggggatctgggtccaggaactcgtctgatcactagaatggggcagggagtgagcagaggagtttgcagcacacagtagaggaagctggtaggcacagaatagtaactggcaggcttacagctgggaccagaggggtccagcaatgataacagctcccggcactttctaagtgtattaattaactcatttattcacacaagaatccaataagggagatagttttaatagacccattttactaacatgaaaactgaggcattgataaattaagtagcttgctcaaagtgacccatctctttggcagagcaaggatttgaacatagacaattttgctctaacacctgtgcccttaaccactgacttgtaactgttccagggagaagatgagcctcttttgggcagcagggcagtggacagccactgaaaatgtgagagctggcaatattcaaagaggcacattgagatccttccaggaaagtctaactgcttgcaccagggtccaggctcaagggagggattcagggagcagcccctagaagtaagtgctttcacttgctaggcagtgcttccctgactcttaggctgcaaatttctaaaaggaaaaaaaacaatgttaaacacgagtgccagtttatatacctttatatattcagttatacattttgtaaatatattacagaattaatgtacatcataaaatacacacaaagggaaaaaaatcattcctttacatcaacaacctactataaatttacttcaaatagcattcatcagtactagcactagaaatgtgtgtccctgacgaaaaatatgtttttacataatttagatcttttattttgaaatttatcagaaatttcttgattagaacccagttttcctagaattattccctacttgttagattatttatccacatatagatgattccgtgaaaaaatgcaaagcaagacccttgatatattgtgtaatcctgaaactatatattaaaaacaaaatagtcttttagaaagcctgcagcagtaccccaaaataaaggtcacccaagaagaaaaattctccctagaataatgcctttaaatcccggaaacgaaagctcaagtgtttacccgttctttttaacattttcagagcaatacaacagagtcaatgtatgaaataaggcattggagttcagtgtaagctaccaccaatgacagaacatgtccattcagggcaaagatttatttttctgattataccaatgacccacacatacacaaagaaaaattaaattgaattaaaagaaagcatttcagcaatcttgacaggcttgagccctctgacagctcctagaattctatcagccgatcatcatcgtgttgctaaagccagctgcctcttgaaaccaaatttaatggaaagaggaggagctcaacaaagcagcttaaacatctcaccttcaaagctcattgaaaactaggcttcctatcagtcatgtgtcaaaggttcccctcatcctacaccatacagattagttcttcaagttccatttgtgtggtcatcctttgagtttccttgaagctctaaaaaggctaaaaggttatttccatctggagccactggagccttaatccatgtatcttttccctgcgcgaatctcaacatggcggaactggaaagtgagactcccaacttccatgtgaagggaacgatgtcaggcaggctgagaagcctgagggtggctggttccaaagggactgacccaagcctgtagcgagcaaggaggctgcctgctacccagagccaccaccccccatggcagcagatcacagcccctgttctttctcttttgaagcttcaggttagggatgggcaattcatagcaatttgtctttgaggtgataggtttggcaaaggggcatgatccaagaagtaagaaatgtgtgagaagtttcataaaggttgatggcgattgtgaccatgtgacctgtgcaatctttaactcatcgagtatctaatgtagattcttaactgccttgagtgcttttaagggactccttctgtgggggcttcatggggatttttcctaatggttaagctatgtaaatgtcttccacagctcctgtaaaatctcccatgctgaaataactacatccctgctctacagctatgaggattgtgaccgtatgtgtcccagcaagtggtagccaccatcataagctttggaggacactgtgttcttctagatactccctgggccatcttttcagatgtgccctttcagaagtggtcgccctttcagatatgtccttgtcttagcagttggttaaagcttcataggatatttgtattcaaggtgctagttcaaaaacatgaccttgaattcatagctgcgaagctcaactgagagaaaacatatttaggaggatggaatccacgcattgccgtagaaaactccttctcaccctggtggatacaacttttgaaaaatattgatacctgggccccatctagaaattagtctcatgtgggtgctcagagaacatagggaggtcattggggatggagtagaatgagcaaagaagagaagaaaatagggtgagagaaacaatggggtgtggaatggggagaagaggtgcagattagggagggcatggcaggccatggtaagggcttggcttttgcccagagggaggtggagttcatagagggttttgagcaaaggagtaacatgatatgacatatattataaaatgatcactctggctaaattaattccttttgccattgcatccttaaaataaacctaaaaatgcagaaaaactgaaaacaggaaatgattttccaagctgctactcaaatgtctaataacaagaagtgactagaatcctaaatcccagaatggtccacgtattatctccccagattcctgatagagatatgtagaaggcacatttcaagcaggcttatattgttttattctaagagggctgaactgggaatgtgaggtttcaagtccttctttgcttaggtgtatccagaggtaatacccagaaactcaaatttagtggtttgagatagactgtagacatcctgttgttaaaatgattccaatgcccatgtcgaaaacacgtctccaaaggctggaaaaatcaactgacattgacaaatgcttttagttttcctttcttggactctatatagctgtactgtctatacagtaaccacaagctacatgtggaggttgggcacttgaaacggggctagttcaaattgagattgtgctataagcataaaacactcagtagattttaaagacttagcatgaaacaataggtttatgtgttagtcaaggttctccaaagaaattgaaccagtaggatagagagagatacataagagggggtttcttaatggaaattggctcatgttattatagaggccaagaagtcccatcatatcccatctgcaagctggagaaccaggaaagccactggtataattcagtctgagcccaaaggcttcagaaccagggggacaactggtgtgagtcctggagtccaaaggctggagagctagaagcaccaacatctgagggcagaagaagacggatgtcccagcacaagagagggtgaattccccttcttctgcctttttattctttccaggtgctcaatggattgggtgatgcccactgacaattatgatcctctctattcagtcgactgactgagatgctaatctcctccaggaatgccctcatagacacactcagaaatcatgttttatcagccatgtgggcatctctcaggccagccacattgacacacgaaattaaccatcacaatgtaaaatgtctcaataatttttacatagattacatgttgataaaatattagatatactaaattaaatacaacatattattaaaattcatttcacttttttactttttaaatgtggctacaaaagaattaaaattacaaatgtgggtcccattacacttcttttctttctttctctctctttttttttttttaaagacctctgtctcccaggctagagtgcagtggcacaatcatggctcactggagcttcgaactcctgggctcaagcaatcctcccttcctagcctcctgagtagcagggattacaggcatgcaccaccaggcctggctttcacattatatttctactggacaggactgatgtagagcttttcaaagactcctcttacataggaatcatagccctctatgataaccttcaaaatacacctacgatgctaccattctccgcagtaatttttttaaagaaaaatgctaaattgcttttttagatctttcttgtaggcaagatataaatagaaggctttgaaaggcaatacaacatagtagttaatagtaagaacttggtagatgtgtgactgcaggcaggttgtttaccttctctgaatctccattccctcgcctgtagaatttgaataatatgtaccccatggtgttgtgagactaaataacatagtccttaatgctccataaatggtagagcctttgtaattggtgctgaaatttaaagacaatgtggagttatcttggattcaggtgatgagattcaacataagaagcaatgcctcaagtccttgcaccaacagaggtgcagaaattcatcatctccctaatgaatcttgagttttctttatacttctgtcatttgattagaaacaaactctcagcatgtcagatttatattcaaatctcagaataaaaataattacagaagcaaaatgtcatttggaaagggtgtgtttggtggtcagaattgtggttgccacgtgccttcgctaaatatcatgactaaaagggaaagacatgcagatctttgctaggaaggcaagagaaagaagaggtgaataaaaggcttgaagctcttgctactctaatcaaattgttttatttgtgagagttcgctttagcttgctctttatgtttgaacctaagtcttttcacctgtgacctcatcaccatttttctaatattgctcagctcattagccttgaaatttataatttagtttttacaccattttatcctatttcttcccattgccaagcacaaacatttactttgtaaaaaaacgtgactgaatttattaaaccagtttgtcttcaaaagtttcccttttttatagacatgggaagactcaaatagttggtttccctaattctcaggagacaaaccagtgaagctgaagccagttttgtatgcaactaaactttgtgccccgtcctttgggtctccaattagaataaaatcagggatgggcaggcagcgtgcattttaaatcaccatccatggtcactattatttccaaactcaaaggcaccattagaacagggaaacatttgcaggcatttcattacaccttgaactattaaaaaaaataagacattagaaagaagtgattactttaaaactttcacacactatggaacaaaagaaatggcaatacacagggagatattatagtaaacaaattgacgcacacggttgttgttagtgaaggacagtattacaagcagatgaggcaaatgaatgagttgggaagagagtcaatctcacttcctgaagcaggggcccttgagaagcctgtgccttttaggctgtttctttgtaggattggcctgggtgctgaaaatagcatagagccttttgcagaatcctttatttcaaggagttgcggtatttcatatgtggcacggcccctcccttcaatggcctctctcctgccactggaaggtgtttttacagttccccttgtgacaaaggacaggtcagagagcaaacctgtgagcaaatcaggcttggcacgcacatcactaagcaacagatgctttctggaaaaccatttgggagtgtttcagatagtagtatgtgtgtgtatatacaaacatatacataatttctggggaaaaaatacatacatacatgtgtacatccatactttctgaaaatcacacacacgcattttccagaaactcatttgaggttgattttatgtgtacggagacagagaaagccatccatccatatagaaagccttttgcaagtatttttaatttatttcatagaagcctgaatttatttcacacaacaatgaataaatccattcttttgccacagacgtggtgcaaaaagaggggtgtgcttgaagcatctacaaaggggaaaaagctgctgatacagggaaaaaatattaaagtaaaattttagttgtcagctttgtaattgaagctgtctcctcacttgaaaatattgtttccactgaagtagaagacaaagggggatctggcaaatgcccccacgatgttcatttccccagataaattacacacatcgtgtgtgcatgaagatgaccagaggctctcactgtgctggggatacagtccaatcattcattcaaggctctgtgtagtcatacaacaaacgcgtggcctaaatccattctttttcttctttttcctttctcttctcattttttcttttttcctccttcttctgccaaaagacagataaagtataataactttgatgacaacctcattttcaggatctctcgataaatcataatccttcagttgtattttccaaaacctgcagttagccaattacttcttggtttccttgaggtgaatctttgctttttaattatattttatcttcttcaaagaaaccactattgaaaaattatagctaatggtagaaatacatcactaagatgtcttggattttcttttggggaggagaggtgggggaataaaatgaaaaaaatatgtatatggccaaattggtctgtgataccattaattcatgttcattaattcaaacagtgtacattgcatacctactatgtgctaggagttgggttgtactccagaaataaaaagtcaaataaaacgtgtttccctcaaggaaactatgttctccagcatctgcacatgtaaactaccaattccagtttagtatgacaaactctttggaagtattatattttgaatgtatttcatcgagaaatgaatgtgggccaggcaaggtggctcacatctgtaatcccagcacttagggaggctgaggtgggtggatcacctgaggtcaggagttccagaccagcctggccaacaaggtgaaattctgtctctactaaaaatacaaaaattagctggaggtgttggcctgagcctgtaatcccagcttctcaggaggctgaagcacaagaatcgcttgaacccggtaggcagaggttgcagtgagccaaggtcgtgtactccagcctgggtggcccagcgagagtacatctcaaaaaaaagaaaaagaaagaaaagaaaaggaaaaaagaatttctaagtctggttttcatagaaacaagtgcaaaacaagccagaggggtcattgccaaactagaaagaagcccagggccagaatatgcagggttagtggagaagcccagtgctcctgggcctgaccacctcttggactcggtataccatcataaacagcattcagtaaacatcttttttgaagaggcatagtaaagaactacctgctaagagtccagaaaccctgtgaggcctcagataactttagtaggaaataaccaagctcttgagttgcttgaagtagaatcccattagcttctaatgcttcctgtatttgcgccccattcaaggaagcaactctagagaatttctttgaatcctgttacttccatttgatgagtgagactcagctgtgatagtctatctgctttaagactgccgatacgatgtggcatgttctctaaagaaggcagaaggcttgaggacggtttgtgttgattgaagaacatttcagtgatgagttggaatatttagacaaatttcaaggcttaattaatatatgaaataaagtagttgcagagataacgaggaaaaccaaagttataatctatagttcatttaccttccttggtcagggcaaatattacaaaagatatgtactgcttttacaataatcagcaaatgggaatgactttgaatttcagaacacatatgggaatgtcatcaacttcgactttgaaatgtggctttttaaaattaaaatataaatcattctattgttaacaaaagtttatcaaaagtaatagggcttttgtagatttttggtttttcttttctattaagatctttactggtagagaaaaataaaattttattaattcaaagattccattgtgtttttatgtttgtgagtaataatcagtggttcctggtatctcatttcgtttttaattcccaaagcaggagctaataagcaaatcgctttgtgggtttctgtgaaaacagctagagtttgcacaatcgtcgcctagacagagggaggagtgtgggctctgaagttcagcagatttgcatttgactcttgactctgtgattagctgggtgtccttgagtaaactactcctgtaagcctcagttacctcatctgtaaaatagggatgatgacatctgctcaaagcgttgctgttgagtaattaggttaaatgagataaaaagtgcccattggcacctattggaactcagtaggagctcatgtcttcatggtgtgtaaatatgtacctggctcccatccacaagagtcctcgctgaatcaacaaactcacaagtgcctcttttcactagactgagactaaaaccgcgaattaaaatggtgtttgtcctcaagaaccactagggtcaagaattctacatggctcaggcagatcagctgagcacgtgagaaaataaggaatatgcagtctaagtacagagctcagatgaagcaacttgctgcctatcaacagaaagggtggaaacaccctggtgtgtgcaacaggcacaaatcatgtaattcagtaagtctacaaatatgtagttaaagaaacaatataatttctaaaagcagtctcctcgcagcaaactgtgaagttagcagcacagaagcaaactgaggcagagtcactggattggagacaagctgatttgtgaaagctgcttgagtaattgaccaacctctgcacaactatgttgcagtttactaaaccagtataaaggagaaaaaaagcagtagaaattaagagcattcgttaagctgtaagtcctttcattcttttggatatattattctaaatgcatcttataacattttcattaataaactgctgttttaattaatgatgaggtctcagtcaactgaatgacatttctttcaagaagcccacttcatacgcacacaaaagaaccctgaaatttttcactaaaggaaaggccaatgtgatccaactagttgaagaatatactattgcaattaaaaaatcatttaattccattcggctcaactcaatgaacatttattgaatatctgctggaggccaggggctagctgggattagacacagttcttcctttcagaaactcacagtctagagagaagcctggtgcatgaataaggcattcacctttaacctccttatccctgttctgttccttcccttctcttcctggtaaggcacgcttatttgcaaaagactttctacatgaaaaaaatatatatatgcatataggcatatacacacacatgtataaatattcatatataccctcaaagtagtttcccaaaattacttgtgtgtatacaaatattcatgttcatatatatatttttttatagaaatgggactatggtgttgtattaatgttggtttcctgactccaacttgctctcacatggttcaggaattacatataatatatattataatatatttaatatactagatatgtaacattaaaaattattttaattatatataatataatgttaaatataaatatatttaaatttttaatatttatatttaaattttgactaccatttgtattatatctaaatataacatatttaatatgagagagaaaacaaatatagtgaaatgttaaaagttagggaatccagatatggatgatataggagttattcatactatttttacaacttttcaaaattatttcaaggtatattggtcttgtaaaaaattttaaaataagggattcaagaccttcctggcctcaatcctgcctttcttcagcagcacctgcagccgtacatcaccccacatttaataccaagttatgtccaacatcctcccgctgtcgttcctgacgctgactgcacattagactaatctgagaaaatgctgaaatatgccaataggcaggcctctccccagacaatcagatcaggactcctgggagtttgctccagccatggttttttccaaaaacatagcctaggttgggaagcctggaggcctgtttcccaaacaccatgctgctgcattcctcatgccttggtgcctgctgtttccagtacttggagggtccttgtccacctcttcagtactgtagattcctattattttgtcaggatccaactcagatgtcgccttccttagtgaaaccatccaggcatcccacgccccacccacaggtagatcccatccttcccgcctcctgctatttatttctacacactctccttctacaggtttcccacactgttgtaatgctgtgtttgctctgtctcccaacccaccgcaaactccgtttgggaaaagtatatatcatgtttgcttttgtcatcagcatgagcctcacatatagtaggagtctaagaaatgtttactaaattaaatgcaaacaaggttatacttgttggaataaagttataacaaggagctatgggacacttgaggatgtgcactcttacagtgcaggcggcacttgcggaaggagatggagctcacgcagaatcgaagagtgaataaatagctaagtagtcgggcaggagagggaaatgggaacagcccgcctcttaggctggctggagccacgtggagtacgcgaaggagaatggccgctgaggccaagaagggagccagtccagacgatgaaggggaccaagagcgttagtcactctggaagcagagtgagcacctcgcactgcgctggcacacagatgcctctcagtcaagcattttagagaaataatgagtgaattcttttttgctctttttctttacatttggcaggggagtcatgggaccggattgaaactaactttcttcccagaagaatgtatttgcacatactttcccgaaaatgtcagaagatttacaggttttctgaaatgtattcagtgacacttcccccaaaatgatatgccacattctaagaagagggatatattttaggtttaagaaggacatggttagactaggatgtaaggcgggtcactgaaagtctgtgaaggacagattataggaggtaagatgcccattggaggacaccctttaagaagtcatcacagcgtggtggctcacgcttgtaatcccagcactttgggaggccgaggcgggcggatcacgaggtcaggagatcgagaccacggtgaaaccccgtctctactaaaaatacaaaaaaaaattagccgggtgtggtggcgggggcctgtagtcccagctactcagagaggctgaggcaggagaatggcgtgaacccgggaggcggagcttgcagtgagccaagattacgccactgcgctccagcctgggcgacagagcgagactccgtgtcaaaaaaaaaaaaaaaagaggtcatcacaggtgccaaagtgaaacccaagtgcctgaaccagaggcatgacagagctgtgcccaagagagaacagatgcaaaaggttacgaggcaatgcaaacagagagcttagggtgtctctaggctttctgcctttgagtgaccatgcagatgcagtgtcattggtcaaactagaaaattcggggagaggatcagatttgtgggaaaggatgaattccattgtgtgaagcttgagtttgggtttcccatgaaagaacaaggcggagtttccctacagaaagttgcaggttgggagtgatggagatgaggctctcctgatgagtgagtatagagtgtgatggaagaggagcactggagggaaaacctcagtgccccaacattttcaggatacacggaggaaaaagagccaatgccttacagagaagctgaaagaggggaaaggaaaaccaaagagagtttccaaaggctccaagagttgagtaaatcaaataagggcagaagtggtctgttcactttggtaactacgaagttcatgaacacctcagtgacagcaacttcacttcagtgaatggagttcaggccaaaatcaatgattaggaagtgaaaatgaggagatgagaaggtttctagaatttccccagttagattgggaaaatctaactggacctctgaacagcattctaacctattggtcagctcctctttcttgaaaaaccctttttccttggcctcattcagacctcgtgttcaaggggtccccggggtgccctaattacttcctctctgttcttcctttgcaagctcatttccctgtcccagtttgaaaagggtgacttctcagggccctcctgtcttctctcttcacacacttctcccagggaattctatccatgcttgcattgtaaataccatcataaaaatgattttaaaatgaatatttcagcccagacttttttggctctttgacttctatgcttccctgacacaaaggcacctcaaacttgacctgttcaaagctgaactttgttgttgttgaaacagcatctcactctgttgccccagctggagtgcaatggtgccatgatgggtccttgcagccccgacctcctgcactcaaatgatcctcccgcctcagtagctgggactacaggcttgtgccaccacaccggctatttttttcttttcttccttttttttttttttttttagcgacagggtccccctatgttgtccaggccagtcttaaactccagggctcaagcgaccctcctgccttggccttccaaagtgctgggattaccgtgtgagccacagcacccagccaaagctgaactcttgatacctgccatatccccaaccccaccaagattgcctgcctctgtgttcccataatcagaaattgtcaccaccatctatccaaaaatccgagtctgtcttaacactctttccttcacctttttaattcctaaacatcatcagattctgtccactctactactccaaaccatcattatatttattctgtcccattgcatagcctattcaatggtctacctatattccctcttttctctttccaatgcattcaccaaaatgcagccagaatgagctttcaaaactgaaatcagattatgtcacctttgcttaaaacctttcaggagttacccgttgctttctgtgtaaaaaccaaaatcctcagaataccacgacctttctatctagcctcacttcctactatggtctcccctgagggtttgtcatcttggcctccactacgttcatcctcgacattctcttcttcctcagagcctttgcacatgctcttttctcttcctagaatactttccctacccccgttaccagcaaaatctcactggccttcaattattaacttaaatgtaatttacgacctgctaaatctctgtcagctcatagttcacagatggcagttattacatatttgaaagaatggattaaaaagactgagtgctagccagaggaaaatagaggttcagggtaggggggcctttaagatgagaatgatttaaagcccacagcaatgaaatgatttgcctggccaaggtcaaaaagcgagttggtggcaaagccagggctgcaatccacgacttttgattcttggcctccccatgtcccacactaatcctttattatatgtcttagatgaagttagctgtagtgaagccctcatctcatttgctgtccccaaaacattctaacctgttgaccaccatgcacaacaggaatacgtattaacacagtttcaggagcatgacccaggaaattctataatagatgcaaactatcttcctgtttaagaccctagtagagttgttcagtggtgctgctcttaaattccaatccaagaaggccacccggctcccacacagtcaagccatagctgattgatgtgtttacagtaatatacttcacacttgtgtcttgtgggccacacgtgccactcaggataaacttagagatttttctttggcattttttctccattgtacagattcagacacttaaagcttattacatagaaactgacctagaagtgaccgggcctttggagagaatggcaggaaattggttacaatagatatggacccacctggggaaacagaactagcagaggtgaacgttaacccatcccaggtccaatgttgttagtccaaaaagattacagtaagttgaagaaaacatcaaacaaacagaataaaaaattcagcaaggaaattcagagtggtacacttggggagaaaaagcagattttgccaatgtaagaccaggagaaaaactggttgtgtttcagcattgcagtatcttgggagaataacaaaacaagtttaagcagagttgtgccatgcagattgcctggaaggaaccaggcctgcctgatgcagaatcatgatgcatgcagaggatgatgtccaaggtccccgggagcagaactccataaaattcacttaactcttttactaggtgactaattaaaaagcagttaatgagagtgatcattctgggcaatggaattcagccatgaaagtggttaatgacctgaggctgcagctcagttctatgcctcctctagcatggttctggctcccaggagagcctcctagactttagcagaagctgcacagagcttcaagaatccaggatatctgggaagaggtaggagagcgcattgggcgacagaaaggagtaagcaaatattaaagggtttatttacagcagaaggtaaaaagaaagaagctcaccacaatgggagctcaataaatgtggtttgcttgagcgactaccttgctgactgaaggagtggatagagcacgtgcatgaggcagcttgcacagtctgggagacctcgcttctcagctccttatttaatgacatcatgttggtagcttgaagtcggacaaggtggcagtattgacatcatgggaaataggcaaaaactataaatcagaatttttccctccccctcaagccagttgcttaacatctaccaacttaccattgggtcacttcgttgaaatccctgtgggagcagagttccctggggttcttaccttaagaataaacctgaaggcgttttggttttgctttcctattttaattactaatatacagtggcactcttcagtaatcttttattacacaaccagagtggctcagcatttgtgaagtctcctggcaaactcaccatcatttaaaacattgtttctgtggggaagttttccaagttgcaagttactgagtctaaaataaatttttggaaaagagcccatttgcaagttgggagctttcaattctgagtcctgataggaaagttagaaaacaaaaagaatcatgccaattttaaaaatataggttgcaaaatataggttgcaaaatcctaagtgaaaaggcaaaaggaatagaattatttaacttggagaagagaaagatgaagagcaattgaataataggagtgagtgccagctgttgtttgcttttggtttctgttttttgtgggtttttttttttctcccactgtaagcctcggggatttggttaaacaaggagataaatatctttatgttattattctggaatgaataattggtggattttatgtcaaacatctgcaaacttcttttcctcaatcagggataatttacatataacctgtgatgaggaccaagaaatagttaagacaaggttatttgtctacttgaaggttaactgtcaactttgtgaccctgagtccacagatggcataatgtatttcaaaactttgagaaacatgatataattaagcaaatcctttttatatcatagaatatctaaatacagaatttattatttttctatcaaaaatgattataaaacttagactattagcattatctatagtagtattatattgtctatatctgttagtattgtctattactagtatctatattactagtacaaaaccttaaaccaagcattctaaatcaatactttttgataattttacgagggaaatgatgctattttgggcttgttaatttagagttattttcagttattcattcagaagagatgagagaattgctttcttttagaatatcttttagatattgcagtaccctgatttggcattttcttaaagagatgtgaaacaatgaaatggcagctgtaaatctgccacttggagccttagagggcttacatcactcccaggctttgctttaacagttggtttatgatgtggtttcagaataacacttttgaacatggtatatcccttcctgcaaaactgacataaatccataaagcttttaatgatgtctctaaaatacagccaaagtagtctctgaggcatatttttggattgtttatctgaaatctctagattgctgaatctcccttcatgatctgccttggaatggctgtctccagggcagctgataaacgcatcatgtctcacccaggcggggaccactcagcttcgtgccccatcaggtacactaccctgcctcagctttcaccccaagcatctcacacccttgtgcgcataagtatcacctggggacctgcgaaaaatgctgcttctccagaacccctgagctaaattctgggactaggcctggggaccagcattttaacaggctcccaggaaagtggtcacagaaatgatgtgagagtctcagctctacatgctctctgactccagttctggcttcgggatggagtaactggagagaggctgacaggtggaagctgaggttcttgccggtgacacgctgcacctgtcactcaggtgctggggtctctgctgcccagacccttccctccctaggccaggttctgtgctcctcagtcttgaatttcaagcgcctggtatgcgtgtcttctcttgcacatcatcctgcctgccccactgtgattcatttgaatgccccagcctccatctctagcctgcctcccaccctccctccaagtcccaggtccacctcttctcacccccgccagagcctgttctcaggtaatgaccccccacattctctagcagaacctctctctgtggcaaactgaactgctcagtgtgttttctccaggcggcccgccctgcctgcccttcctgactcctcctccctcccctgtcctctgttagacacatttacagaagcctgtcctaggagtgtccatctgccccatcagactctgaactactgagggcaggggtcacctgtgccttgctcacgggatccccaacacccagctgaaatgtggtgggagcctcgggggtctcaagtgaatgactgattcttaaaaagaagcacgtgaagtttgtccaggcggcatgatgcctcagacttcagaccctctcactgccaatacactgtgccttcagctagaaagctagtcttcatctccgccacctacctgtacttggctacccacctctggccctccaggtcccagcttagatgtcttttcccacagcaagtcttccaccacccctgtgttccagggggccctgtgtctacctgatcctgcacttacccctctgcattctaataatctgtttacctgaatcctcctccaggtccggagctccttcagagcaagagttgtcagcacccagcatcgtgcccagggtgcagtcagtgctcaatagatgtttgctgaaagctaactcagcacatttaggtagtgagatggggttctcatcacatagctgctaaataaaccgccataacattcactgtattgtactcacactgttgatgcgtctcctcccacaaccactgctagatggaaatcttctcatgggaagtgattgtattttgttcatcttcacacttcagtaagtcaggcagcaatgagcatggattaagtagctgttcaatcctatgttttccaagaaggatagttttggcatgtggagcaggagaattctttttttatttttatgtatttatttatttttgagatggagtctctctctgcggccaggctggaatgcagtggcggatctcggctcagtacaacctccgcctcccaggttcaagtgattctcctgcctcagcctcccgagtagctaggactacaggcacctaccaccacgcctggctaatttttgtatttttagtagagacggggtttcaccgtgttggccagaatggtctcagtctcctggcctcgtgatccgccagcctcgacctaccaaagtgctgggattacaggcgagagccaccgcgccccgcccaggagaattcttaattgcataagacagccccacacattgcaggacatgctgctgtccttgcccgtgcccactaaatttcattggtatcccaatcattttgacaactaccccacctacacacacagttacaaaagttttgggggtaagaggaccaggaggaaaattgcactgcacatagttgaaaagctatagttaagtcttttccttacaacttggtgagaagcaatggactccgtaacagtgccatggtggattatatgtgtcaacataattaacagaaagaggatctctgaaatataagatatttatctggaaataaagcattgcaatgggaatatgcatgccatagttaactacatgcatattcagggaggtgaagacaaaagtttttaaaggaaaaaaggaggaggattacataattgttttaaaataattatccttggctacaaagatcaataacaagggtgacaccagtccaagtttggacaggcaaattcagggcagttgttcttgtagaaccgtttttttgtgtaaggttgcaatggtgtttgggcaatgttgtgctttttgcagagtctctgtgatagttcttttgatcaggcatttattcatggccttccccagctccatttctcagggctttcttttttttttttttttaacattagtgacttcattttgattctgacaactttcacacatgtgtgtggtgatgtgaggtgggggccaggacatgtcaccctcaatatacaacggtaacctgtctttgtaataatagttcactaatctttcctgagcacttatatattccgggcactaagctgtgtattatatagtttacttaatcctcacaaccacctatgaggtcccattttttagggacgaaattgaggctgagaaagtttcaagacattgacccaagttaacacggctgctacagacaagggcaagatacacccccaggcgtcggacttcgctgctctgtgccgacctctttaacaagaacaaacatcaaaattcccagttggaagactcctattaaaaactgtcctctcccattaattataacgtagagcagttttgcacaatatattctgcatagtgttaatttagtgggatgtcaagtgttgtgagattaacggttgcatgggcgatggagtgtgggaaatgctttcagcaaggcccttgtagaaggccgtgaaacagaaaccgtgaagaccacaggatccctaaggtggcacagcccttcacagtgagtcggagtgatttagaacattgctgagcaaacagcagggagaccggcaacaggagcttgctggccatgaagtgcctaatatccagtaagcactgctcaggctctaggaaaaggctgatgcaggaagggtttctttcttctaatttctcaataataataaaaatagatactatttatggagtactaattactctccacttcatagatgaaataccaaggcctagaaaaatgtgttaagtaacttctcctaaggtcacacagctatttagtggcagagccaaatttgaacccagttctctctaacttcaagacatgtgattgtaaaccctatacacaaagtctctaaggacgtagggcttataaaggctttcctgtatgaatatccaagcaaattcagtctcaaagaggatgcccctatgggttccctgtaccagggatttatttttggcatatctcttcaacctgacaattcgttccttggtctgagtacatgaaatttttttcagggtatgtgaatttttttcttggtatgtgaaatttttttctggtataatgtaagtttcttaaattttactatttttttaattttatagatttctatatgatatggtttggctctgtccccaccctaatttcaaattgtagttcccataatcccctcatgttgtggaagggacctggttggaagtaatttaatcacaggaggaggtctttcttgtgctgttcttatgataatgaataagtctcacaagagctgatggttttataaatgggagttcccctgcacatgtgctctctcttgcctgccgccatgtaagacatgactttgctcctcctttgccttccaccattattgtgaggcctccccagccatatggagctgtgagtccactaaacttctttctctttataaatcacccagtctctggtatgtctttattagcagcgtgggaacagactaatacatcataccctgttacatgctttttttttttttgataagagtatttgtgttgatgcaatagcatctttctccatagaacttactcagatgcccttcctggagccagtgcctgcactccatgaactgctggagaggtcattgtagggtatcggcatcagacctctcctcatttttcaattctctctctcctttataacagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggtaaggacaaggatacccagcctctgccatttaacatttgggcagacagaatgttctagcaagagtctatagattgttcttggtttgttatttattccccataggcttttttaagcaagtcacataacttctttgaaccccatttctctccatgaatatcaggaaaacaacttgccagctgggtgtgttagagcaaggtgttagagtaataatgttggtgaggcatgttgcgttctttacaagaatgctgttgcatgaataagagatatgtttgcatgtgtaatgattattttttctccctactaaataaacacatttggctggacactgtggctcacgcctgtaatcccagcactttgggaggccaaggtgggcggatcacttgagctcaagaatttgagaccagcctggccaatatggcgaaaccccatctctacaaaaaatacaaaaattagctgggtgtgatggcacatgcctgtagtcccagctactcaggaggccaagatgggaggatcacttgagcccaagatgtcaaggcttatagtgagccatgatcgtgccactgcactccaggctgggcaacagagtgagaccctgtctcaaaagaaaaaaaagactaataagaaagactaataaaacataaatacattcactaaatgtgctaaacagagatgggctttgaatgagtaaaattaattttacataaattaattttatcctgatttatgatagtataccagtaggttgttacagaacatctgaactttcaataggagtagaaaatcagaaatgtcttcattcccaatcctctcagaactttaaattcacaaagtgtatccctgtcataaaggttgcttaaagcaggagtttattttaattttttttgaaacagggtcttgctttgttgcccaggcttgagtacagtagcaggatcacagctcacttcagccctaacctctcaggctcaagcgatcctcccacctcagcctcccaagtagccgggatcacaggcacataccaccactcccagctaatttttttaattatttgtagagttgggggtctcacgatgttgccaggcctggtcttgaactcctggactcaagcgatcctcctgccttggccaaagtgctgggatgacaggcatgagccaccatgcccggcccaggggtgtatttttacttgtaatatcctgggccatcttggtcgtcaaacacacattaagccagagaggatctgagtgcacctaaaattggcatcctgaggagaatatgcaaatgggcttgtgacccttcagcagtgacctctgagagacatctaagaagccctggagtgtacaaacttgctgaacttgagaagtccacttcctctctgaaaatgaactcatataccttagaattctaagatcactcttttttttttttttttttttttttggagatggagtctcgctccatcaccaggctggagtgcagtggcgcaatctcggctcactgcaacctccgcccctcgagttcaagcaattctcctgccttaacctcctgagtagctgtgattacaggcctgcaccaccacgcctggctaatttttgtatttttagtagagacagggtttcacatgttggccaagacaatctcaatctcttgacctcgtgatccacctgccttggcctcccaaagtgctgggattactggtgtgaaccactgcgtcagccctaagatcacttttttaatgaataaaaatattttaagagcatgcaggaacaaatctctctaactcacttcccattggagccgaaaatatggagactctctctcccactgcccattgtttcctgcccttcagtgattattccactgttatggcatcttaaagagcaagaattttggctgggcactgtggctcatgcctgtaatcccagcactatggaaggctgaggcaggaggattgcttgagaccagtagttcaagattagcctaggcgacatagcaagacaccatttctaccaaaaataatttaaaaattaactgggcatgaaggtgcacacttgtggtctcagctgctcaaaaggctgaggcaggatgattgcttgaggccagtagttcaagactagcctgggcaacatagcaagactccatctctaccaaaaataattttaaaattaactgggcatggtgaggcacacctgtggtcctagctactagaaggctgaggggggaggatcgctggagcccagaagttgctggagcccagaagtgcaaggctgcagtgagctatgatcacgccactgtactccagcctgtataacagagcaagaccctgtctctaaaataaaataatttaaaaaaaaagaaaaaaggagatcaagatttttcccatgggagctagaactgttattactaacttaattcagcttgagttttaaaaaaacagtaaattaaactccctctctaggaaatgcactgttgcttaaaaagatggaggaaaaagtatgttccctagtattttccccttctgaaattattcctaaagaaataagccaaaagtcaaagattcatcatgaagatgttcatcataatgtttcgttttgttttttgagacggagtctcgctctgtcgcccaggccggagtgcagtggcatgatctcggctcactgcaagctctgccttccaggttcacaccattctcctgcctcagcctcccgagtagctgggactacaggcgcctgccacaacgcccggctaattttttgtaattttagtagagatggggtttcaccgtgttagccaggatgatctcaatctcctgacctcgtgatccgcccgcctcggccttccaaagtgctgggattacaggcgtgagccatcgtgcctggccaacatcataatgttaactatgaaaataaaaattgaaaagaatctgaaagttcaacttttagtaaaatagtaaaagagggagttgccattttatggaatattatgtatctattaaaatatttatgaatcgtgattaatgatatggggaaattttatgtatgttaaaccaaaaaaacatgaacaagatccagccttgaatgtgaaatattagctccataaaaaatatagggatagaaaaaaaaaagcaataatgtgaacacaaaagtgtttggttggattgtggatgatttttttttctcctgagcagtacttttgtatgcatgtcaaatgctttaatcagaaagatgaaaacagtaagtaaaatcagaaagtgaggatgaaagagagagaagtatggagcccctggtcttcaggagttcatcagtttatttctcctggatcagggtcaataggtttttttgacccactgatgttcactacccacatggaccagcctcccactgggcagataagaaccttgggtttcttctcaggtccctccccaggaggagggctctcacccagagactgtcaagaagttggtgaacacattcccacacatacttttattgtctgctcctcgagtcactgccacactagatttggtcctcaactgtattcgctacctcacatgcccactgctacacacccaccgctgctgtgccttcatcacctgccactgctgtgccctcatgcctgtgtgaggactttcattgtcttcaagggcgttgatcaatggattctgtattaatggccaccatttaatgaagctcactttgtgcccaaagccatcctgaatggtgccatgcattaattcccatgagctgcacaactctatgaagtagatactattattatttcctttctactgatggcaacacatgagtgcatggaggttgagtgccttgcacactcagaggatgttgggccaggctggggtttctcagcctgggtgtccgattccagacccaaagctccccaccggctgtactctccagggcaggcatctctggaactctcagtgttcttggaaggcaaagctgggtgggttctgtctcactgttacaagactatcctcaaactgctggtgaaaattcagctttttcagacttcaaatacaacatgtttttattatttgaagtttaaagttagaaaaaaaaggaaatcattaggaaaaaacatcagtaaggtctacgccaaagtatcaggaaaaagctactagaaagtctccactaaacaccctggcatcactcacatttcacatatcgaaagctctgctcactgtcctccagaaccagctgcccccagcaccaccactgcccatcagacacttgtgttcccaaggtcagtgtcactcaccagtgctccgttcttccctgcttttgtgggtcacccaggcaaacaagtcctgtgaattgaactcatggtgtccttttcctccccaccactactctctgaggcaaatatcttttaattcccagtagtgtttacgtcatggtgtccatagaaaattattatatttgaatggtaccagggtaaatggatgaggtcatgttttggaggccacctgcccagtgactccagctgccatccccttcttcatgtctgccacggtgtgaggggagccttgctcctggtaccccatcacccatctgtaggacagccgtgggcttcagcttgttggctgggaaattctctcccaatccatctctctgcttccagattctccccctcaccctttttcaccacagccagcaccgcctgcctttatagggtgtcttattttctgttgcttgtaacagaatacgtgaaactgggtaatttataaagaaaaggaatttatttcttatagttatggaggctaagaagtctgaggccaaagggccaaacctggtgagggccttattactggtgggaactctctgcagttctgagacagtgcagggcatgacatggcgaggttaagctgccagctcaggcctctcttcctcttcttatagacagtcccactcccatgagaacctgttaatccattaacccattaatccatgaatctatgaatggatcattccatgaatcgatgaatggatcattccatgaatcgatgaatggatcattccatgaatctatgaatggatcattccattcatgaggacagagtcctcatgatccaatcacctcttaaagggctcacctctcaatatacccatattagggattaagtttcaacctgagttttggaggggatattcacaccatagcatagggatattgcttaaaagggatcttgtataatgtctttattaaacactcagtggtgccccactccagcaaaaccaggagagactcctcagtgccacaaacttttaagtttgagacccaccaagctcatgggtgagatggtggcctgtagagctggaccgtctgggtttgaggtcggctttgccttttgtcagttgtcttgggcaatcagttggcagctccatgcctctgtttgctcatccataaaatagtgtctccctcacaggagtgttgtgaaactcaaatgacaatatgcatgtgtcaacagttattatttcccaggtccacggattcaatctacattctaacgcatattcagcaacccctactcttcgttttgagaaactcattacccctcaagcactctgtggtcatatgtgcacctgactttatgcctgcaatactcccttacctagaaatgccccaacttcctctctagccagacacctgcctttcattctaggctgagatcaagtcccacctccttttgatgacttctccttgctttaaactcctattccacttactttcaatgtcatttgtttggcatttaatgtactgtattgttatctgtctctgtgataaatatgccctgtcttcccagagagatgaaaagctcccagcactacatctcctgcctacgatcagtaccctgtaagtgtgtgctgatgataatgatgatgaccaggagagaataaatctgttaagcatgttatttgctgcatccaataaaagagaagtcccttataactgctttaattcacttgggagatgaacatgagacacagaagtgaagcacctcagcatttgaataatgttttattttaatggacaaatactagcattcttcctaccatcatttagcggtcctcttctgctgttatctgaaaggaataaatacatcatttaaattggattattcaagaatatcaccattactgtttatagatagtcactatatataaatttaaagttccaactcatctttctttctcaaagccaataatttctgctgccattaagtgaagcagttataggaatttaaaatcatatttacaaagtccaagaaggacagaaaagaaaaaaaagagaaaacaatgctgattttaatagagctgaggaacataaaggggccagtgacaaagtgacagcagagaggaaaatgtccagcgttttgcataattgccggttcctccgacctctaggcctctgtgtgtttgtatcctcagagccacacacatattgcctgacccatgccaggggatgggcatggctgtatgtgttataagtggactctacacttgtaaccaggcagaaagcctattttcagacctttaaaaaaaaaaagctgtgctttgcacaggaactaaatatatgtgttctgaagaaatgaataagagatgaatcaaggcagctgtatatttaagaaaactggctgggatgatatgatgtcagagcaccagaaataaggcagagagtaaaaacctaagacaatcaacgtgttttttctgcgtgttgccaaacaactgcctgatcatctccgtcattcccaaacaatggactattttaatgctattgggtaaaggaaaaaccgagtaaacactgaggggtggagagagaagcagctcaagaagtaggagcagcatattcaaaggccctgaggtaggaggagatcgtattttctagggaataagagaagttcgtggtagtttgaatgtaaaaagtgacagtgagtggtatgacttgaaaataaagtagcaggaggaatgcacatcagacagggcattgcaaccgctatttggaaagtacatctttattctgtaaagaattggaaggctttgaaggattttaaatgacccaataaaataatcagttacacattttgaaaacatggggaagaagacggtacagaagcagggagactgtattcatctgttctcacgctgctatgaagaaatacctgagactgggcaatttataaacgaaagattttcattgactcgcagttccgcatggctggggaggcctcaggaaacttacagtaatggtggaaggggaagcaagcacgtccttcttcacatggcggcaggagggagaagtgcagagcaaaggagggaaaggccccttataaaaccatccgatctcatcacaactcagtcactatcatgagaacagcacagaggtaaccaccctcatgattcagttacctcccactgggtccctcccatggcacatggggattatgggaactacaatttaagatgacatttggatagggacacagccaaaccatatcagagaccattcagtcatttattcaacaaatatttattccactcctactgtgcatcaggcactattctagacattgggaatagtcataaagaatagaaacaaaaattcttgctctcatggagcttatctttgaataggagaagacagacaataaacaaattggtacaatctatagtatgttgtgtgctaagaactgttatggggaaaatatgaggcagaaaagggagggcctggccaaggggaaggagagggtaaattccacttttaatgaggaagtcacagaaatgatcactgagaagaggacatgagagcaaagacctgaaggagtgagggcatagccatgcagagacctggggaatgagcatcctgaacagaagaaccggtgactgcaaaggcccttgggtaggaacaggaagccaatgtggatggtgaggagtgagcaaggaggagagtaacaggaggttaggtcagcaataatgaggagatcatatggggcctggtgagccattgcaagaagtttgatttttactctgagacggggagttactgggattttgagcagaggatcactctgaccaccgtgtggtgaggacactgtgtatctcagggtcagaggcccagtgggatcagggaaggttggagaaaggacaaaagctagtataatcccagcaaaagacactggtggcttggtccagggggtagagatggagatggcgacaagtggtaagattcagggcatattttgaagatcaagccaagaagacttggtgtcagatgacacatgtcatataggagaaagaggacagtcaaggcttttggcaagaataactggaaggatgaattggcaattcactgaaatgtggaaaactgcaatggaatacttttggggagagaagatggatgttctgttgcatatgttatgtttggggttgccagtaagatatctgagggaaaatatcaagtagacagtttgtgaaagagtctcctcaatgccactgtgtctcctcaaatgaatgtgctgaaaagttatttaactcactcttagtaagaaactactcctagaatttattcattaattttcaaatgataatttcacacttcttgactggaatatcattttgaagattgctgataagtacaggtgtttctgtagcttattaataaaaatatgctattattaaaaaaaaagagtctggagttcaagagagaagtctgactagggtatgaatgtggtgtctgatgggcatacaccttattcaaaggtcctacataggataggattgttggagtaggtaggtagacacacgagcagggcagaagagggtgccccctcccaccaaccaccaagaatgtcagacaaccatcaggtgatggtcaggcagttgctaaactgtctctctctaaaatgataattggctgcagctggcaccaaggaacgaccgtctcccaatagatagaaaacatctggagctggtgatcagcagcttcccaatcagatctcaggagttgggcaagcgggcccaagcatgcacactaagaggcaaaatgatggagtttaacgggtatatgaccttcctctaggaacactcaactggaaaggggaaaaaaaatgcctcaaatgagcatgcgcactacttcagtaaacacctgtgcatgcagcccctcccacgtgctcgcaggccactgcgcatgcagacagcccgccccaagggaagaatcaggggagaagaaaccaaaccccagaactatgccaatgtataaaaccccaaatcaagggccaaacagggcacttggatctctcaagtcgcccgcttggccctcttccaagtgcacttcctttctaaaactttttaataaactttcactcctgctctactaaaacttgccgcagtctctccctctgccttaaacctacttctgcccctcaagccgcattctttcctctgaggaggcaaggatcaagtttgctgcagaccctttgggattttccttcagtaacaggatcaccatggaaacaggcctgaatacaaaagagaatatgcttcagggctggtctttggggactgcaagagtaaggtgccccaaaacgaggggaaaaacaggtagagaaggaaaaccgaaagagtgtgtgctggaagccaagtgttcccgggaggtgaatgaattctgtgccgagtgaagatgaggcctgagagggacaattgcctctacttccccaagggtcacgggcccagcaagagaccgtggagcagggaagacagaagtgagacagagggctcatgctaaaatagggacgggtttggaggcagcaagtgtacccatctcttttcatggggttcggagcaaagaaaagcaaaggataagaggcctcacttgagagtgaaatgaggtcaagagcagtaatttttaaagaggaggctgactaagacccaccatcttctgcaatccaggcagaagatggtgcaggtaaagcacaggtgaggatgaaccaggagctctgtgtggagctgcctcagccagggagcaggctccctctggaattcacacaaggacactgtgggtgccaacagaaagcctgtggttaccgaagtggaaaagagtgagggaatttagatagatttaggagacgaaaatccaatccacggtgcttagttgaaatgccaggggcaaaggagtctaggatgacattctaaggtaaaactcagaaatagtgaaggtttgttgaatttcgtttagaaaacaaatataggaaatgtaattagctcttgattattctaacaaatgttcctttgaaatccaggaacatggcaagtgtaatgttaggatgcctaaataaggaagagcacagcgtgtgtgtgtgtgtgtgtgtgtgtgtgtgtgtgtgtgtgtgtgtgtgtgtgaaagtctggaaggagctactcccaagatgtttagaaaaattatctttgggtggtgggatttcaggtgactttcttttattttttttctgtttactttctatgttttaattagcatgttttattttgtaacttaaaatcagaatatcagttttgttcccctaaaaaggaaatgaaaggtgacaaataatccattaggtgatttgcagttggtcaaattcttgctagattgctggctccatttttaagctctgagatatcaacatgaaaattccaatttgagtaacaaatgagataaaatattgatgtctttaaaactcataactaagatataatatttatgcttgcagattaactaaaagcaggatctacattgtcatattagttattttcaatattgttttttattgttgggacgaagcaaggaggaaaaaaagaatatactgttgaggcaaagtgaactatcattgagggcaaaaagggactcaggggaccagggaaagccatctttcctgttgatttgcatttgattagtctgtaagctaaaataaaatttattacttggtctcaatgaggccacccaaaatctcatctttaagaactatgtttggccaggagcgtcggctcacgcctgtaatcccagcactttgggaggctgaggctggcagatgacgaggtccggagatcgagatcatcctggctaatacggtgaaaccccgtctctactaaaaataccaaaaaaaaaattagcccagcgtggtagcgtgcgcctgtagtcccagctactggggatgctgagacaggagaatggcgtgaacccgggaggcggagcttacagtgagccgagatcgcgccactgcactccagcctgggcgacagagcgagactctgtttcaaaaaaaaaaaaaaaactatgtttatttttaatattgtatgctcatgattcttttatatgcccaatgtcacactttgctgacggggtgagaacatccctgcactctgcatttatttttttatttcacatagtgtttcgtgggacctgcagatgtctcctccctgcagtcctatattgtatatgctctcattctttgtgtccaggcataatcccaacttggatcatttaaactatttgcatcttcaactttgagacgacagtcactgaagttcactgtgggcagattgtaaatatgtgcgagcctggtgctgtcagccgatatgggtcagtaggcctctgagctcgtgaatccaaattcaaatattgaatgttatctgtggacatcaagggagggagtaaagtttaacagaaattggatgggcatggtggctcacgcctgtaatcccagcactttgggaggctgaggcgaacggatagcctgaggtcagaatttcgagaccagcctggccagcatggtgaaacccccatcactactgaaaatacaaaaattagccaggcgtggtggcaggtgcctgtaatgccagctactcaggaagctgaggcaggagaatcgcttgaacctgggaggcagaggttgcagtgagccaagatcgcaccattgcactccagcctgggcaagagcaagactccgtcaaaaaaaagaaagaaaagaaaagaaaggaagaaagaaagaatctaagagcaggaattgaggggatgtgacattaaaatgaaatttagggcaaacaaattactgagctttcttttttcttctataggaagcttacagattcgatacaacctgggtggcacccgagagccatacaatattgacgtagaccacaggaacatggccaatggacagccccacagtgtcaacatcacccgccacgagaagaccatctttctcaaggtatacatacatgtacatataaattacatataatatcgcattatagtccctgtccctataatgcttggccattggttttgttttgaggggatagaagtagaagagatgctttttacactttctcctacaagtgcataactagtgaagtagaaatatatataattctgacaaggaaagacaatgatgaagttgaagacatcttttagggggaaatagaataaatgtttattccgtatagtctttctggttttcccagttctagatccacatatctatcaatttactgcttttatccattgcaccatctttcttcgccaagctctcagacatctgaaacttaccgtgtttcccagcaaaggttattttggtttctccgacctacttctttcactgctccaacacaatacaaagagctgtatttttctctctctctctgcagagcctttgtcttaaaaatcctcaaaacagtctttccccagaatctcagactctgactgtgggctttcggcacacaaagggatggttttattatgacactcaaattttacttcaggttcattgacgaccccggccctcaccactgatttttacagtgaagaaaccagcttgggaaacaccatgaataaaacataatgtgaggaggtctccctgggagctaggccaagacatcaaggatgggaactgtcactgcattctctagaaggagttcaaaatagatgcctgtcaggagaaagaacagcaggaggatgctgttttgtcagtaaagtggagtgtcatttggcaggggttcagcagcctctcagacctcattctgattcggctggatgctgtgggaagttcaggttgcaaagaaaaggcacaagccctatctcttttgagcactggtggatgtcagattcataacttgatatggagtttgcgcgtggcctttagcagtaaatgctagagggcattttaaggagaggcctttcctaggaaactgacatgcactgtttcagcttactgcgccatcaatcaaaggtggcataataaggttctctcatcatggtcgacagagtcccagagcccagcacagtacctggcacacattaggggtgacaaattctttatggagtaaaccaagcccatctttaaccaagttttagtcagaaaagccagcaagtccaggagacagatcgttttacatcatttcatcaacattgtctccctcggcttttgattagagactttttccattttaagccacccaatttgtcacctcttttaaagaaagtgacttatcttgccattttaccattgcgaaataatactaaaacttaaaaagacctaaacaatggcttttcagacagtataacagcagagacccaccacagccatagaatcgtatacagtttaccctcactctctgccacagtgaattagagaaagacttgaggaaggggagaggagtggatgatttttaagacttggggctttggaggcacagaaagccagagatatagacagtggagcagccagagacctgcagagaatccaggggatgaatgggtttgggggagggtctggttctattgcccaagactattttggttgcaaatgatagaaaagcaattcagaagtaatttgttggggaaaattcctagggtaggtcatagaattatagaatttgaaaaagataaaaccaaactttgggaagagaatctagggagcctggagaattaaaactgtggactagaataccactaggtttctctctcccttccttccttccctccctctttttcattctcatctctgcctctctctgaagactggattaattacctcttactgcatgctccatctttcacatatcctaggccatagtcacaggagtactgggctcatgtcttcccaattttgttaccggaagaaggggtcctagtttcttgacactcattttaaaatcccagggaatctctgataggcctggtttgagtcacgtgctcaccttgttgggtggaagggggaacaaagacccatagtccctaatcacatctcttgattagagtggggaacttgggaaactccctcaaaagaacagaatgcagttccagaaaaaggaaggagataggacgacaggagtgaaaattttggatgcacgattctgaggtaggagaggagaaaaacctgggaagtgcttcctcgattccgccctaggttctgcacctggaagtgttgggagatccagctctccctccttctctgtcatgtaatgtaactgactgcagtaagatttctgaatgtcccaacccacgtgagggcaactaggaaagatgtcacggcctggggagctccaatctctcagcccagcctgtcccatctaccctgggacctgcccaccactgagggcaaaaagaaagtaaagatagaggtggtggaggaagacaagatgtagttcctccttatggaaaagcagatcccagggcttctcactcccatgccccactttctttcatgcagggaggccttgcagacgtggaagtaattcggaaagtgctttgcaacaccaaataacactgcaattttttcttaaaacaatctaaaaatccatcttgagaacttctacagcctcaactgtgtgtggaaagagatataataaaatgttcacagtgatcatctgtgtgtgaagggattatcaatggtttgatttcctctagagttttctatttccccattttctattataagcacatgctgcatttttataatcaaacagaaatatgaaacagccatatattctcaacctattctggtagtccccagttataataacatatgataacaaaggcatttcaataatttcaaattaatatttatttatttatagtcaaagaacaaaaataaggctaatgcaaagatgaatggtagatcacagtgctgtggaatgatgtctttggaattaaggtgaatgttgatgcatttatacatgctcaaacatataatttagatgatcctcatcagtgtttatggtgtctttaaaagcaggtttactttcgtagctgggtttggctaaagctaacattaaattaatctgcattccctcagcacacaccctgtgaaacagcactgagcacttgagggaaactgaccttggatgaaacatttgctgccaaaagacaaagtacccagtctccacatagataacagggaactgactgtagtagttatcagacaccagcgtgaaccagaacccatggcatacctccagtggcatcatttgtgaaaactcacagtcgcatcagggagaatagcttaaggcttaatgccagtcaaaatataaacaaacaaggtgcagccagagagcacctgaaaaagtctggcatgcagtgaaaaattatgtcaattagcatgaatccaaaagcgaaacattctaatcaacaattccaaagccttgtgcaactaaccctttcttcttcctttccttccttccgtcttgccatccatgtttcttttccttcctattttttcctttctctcttcccaaccacattgcacaagggatctaagggggtttacagggagaatattaaatgaaatagagagttaatggaagtcacaaaaagtaagtccccaagatcgagaaaatagaacatgattatcaggtcacaaggtcttaccacttggataaatttgactgtgaacttctcggcagccagaagtatgcaacccataaggatgaactaagccagttcctcttgagaattgaaccttttgttattatatcatttttattttatttaattccatggattgtatttactgacatagaaaatgcccatagcatactccacttatacaacatcacatacacgataacagctcacatgtattggtgcttactgtgtccaaggcaacgtgctaagcactttagacacattttctcatttagtcatcacaaaaactttatgaagtatgtgccatcattattcccatctgatgtgttttggaatgtgtccctgtccaaatctcatgtcaaattataatccccaatgttgaaggaggagcttggtgggaggtgattggaccatgggggtggatttccccctagatgttcttgtgatagtgagtgagttctcatgaggtctggttgtttaaaagtgtgtagcacctcctgctttgccctcttcctccttctcaggccatgtaagacatgcctgctacccctttgtcttctactatgattgtaagtttcctgaggtctccccagccatgcttcctgtacagcctgtagaactgtgagtcaattaaacctcttttctttataaattacccagtctcaggtagttctttatagcagtgcaagaatggactaatataccatcttagagatgtggaaattaaagttcataaagtaagatgcaacctgcccaaagttagaaagcggtaaatggccacagcatagtcgaacccaggtccgtcatacttcaaagtgtacacaggctcttaaccttgcttaatagacagatgtctggaaggatgttcacaaaattttagaagcagatacctctggctggtaagaaattaagtgatgttactgttattaccataagatagttcaaaatatgcaaaaacacagagaataataaaccatatgctatgtacccaccattgaaacattacaaatttcgacattttgccctatttcttcagatttttttaaacacagcaacaattaagagtctgttgtcctcctggttacatagtgggccccaataaaagtcagagtcaatgccctcagcagcatttctgcaaatgtatttgttacaaggctgttagatgctgaagctccttgggaaagtaaagcttcccattttgaattcagcccaaacaagtctgtagagagtgaggtagagcaggatgatggacagatgaagaggccaaaggctgagatgatgcagctttctgaaattttgaactgatcctaggataaaactagctggaaaatgataatgaataaactacatgttctttgaataattatccatgacaatcacacatttttgggtttagatgtgagttagacaatagagagttcagggatatattctctggcacagatactcggaatccatattctctacaaatcaaatgaacagatggtaaggatgtatcattttggctttcatctaactagagggccatcttatctttgccaagaagaagctaacagattttctgcaagcaaaataaggcctttcttagaaaataattctaggtcctcaggaacaaatgatgattagatccccaagttcttacaccaaaaagaggatgactttgattattttcactgggaattttcaaaacaaatgttcaaaaatatcactgaattctgttctttaaaataatataagcacggtaatttcttacctgctactaatctgaatttcaaccaaattgtataaaaacaattgcatcaattgttaattgaactaggtcctgtatataaatcttaagaactgtcagagaagtgtcaaaaacattagcaacatgtagtgtgctaggtgctagaagtagaagaaaggatacaaatattaggatgatgccagttgctatacaaattagccctcaaatgtccatgttttaacccaataaaagtctgtcttacatcagatatattttcagaaaaggaaagttctctggtctccagcagtgatgaaattgtgctgggcaggcactctgaggacctgccactgccaccaacttccctgcttccccaaccctggattaggccaaattattgtccattattcttgaagccctcctgggctccatcctctgggaggctcttccttgtgtgtgttcagccatggcctcccctgaattatgtgccggataatgtgctccttacagctgtgcagcaattatttttttttttttttttttgagacggagtcttgctctgtcaccaggctggagtgcagcggcacgatcttggctcattgcaacttccacctcccgggttcaagtgaatctcctgtgtcagtctcccaagtagctgggagtacaggcgtgtgccaccacgcccagctaattttttgtaattttagtagagacagggtttcactgtgttagccaggatggtctcgatctcctgacctcgtgatccaccctccttggcctcccaaagtgctggaattacaggtgtgagccaccgcgcctggctacagctgtgcagctttaaggcccatttcctgcaggttcaaattacactaagggttttttacactcataagccttttgtggactagatctgtgctttcttttccaatacaattccctcaaaacccaaggtggcttctgatcaatttgcttctggtaagtttcatgtgctggtaaatgcaccctaagctcttccctagacatcaatcttagacttactcaatcatttgcctccaggcgcccatgcctctctctctcaaggtaatggcagctactttggggccagtggacacaaaaggcttgggtgggaagtaaagacccttaatttaaatgttacccgtgaggctaagtcagtttgctaaacagaaatcttactgccccattgttggtcaaagcggtttgcagtgttatttcttactctctagtgtaaggctctaaatatctagacttttttctattcttttcattgattattgggaactggtcaattctttcctgaactcatctgctccatgacatgaggagcaaaaagcaactgacacacacgaccattctgtctcttttgaagaactttccttaaagctacttaggcatttagtctgccttccaggttatgtgaggtgacagttttacaaaatattttattgcatactatattagtctgtcttgcactgctataaagaaatacctgagactgagtaattcataaagaaaaaaaaggtttagttggctcacagttctgcaggctgtacaagacgcatagcagcttctgcttctggggagacctcaggaagcttagatggcagacagcaaagggaaagtaggcttgtcttacatggcaggagcaggactgagagagagtgaaggtgctacgcactttcaaacaaccagatctcatgagaactcacatattatcaggagaacagcaccaagagggtggtgctaaaccgttcatagagctctgcttccatgatcccatcaactcccaccatgacctcattttggacactgggaattacaactcaacatgagatttgagcagggacacatatccaaaccatatcacataccattcttcctctgtctttcaagtccctaatattcattcctgcaccacctgccaccttaccacaaagccaatgctacatgtgttaggtttctgttatagcagcaccctgccttaagataccaatgtatgtattcgttagggttgtattcgctgctataacaaaaaatcagaggcttaatacaaataactttctttcccacataatagtaaaatgatttctagttggaaatcgtaagcaatatataaataggctgataaaaaaggtgtttgtactaatgtccaaaaataatagagtaaaagacattgtggttctatgctataactataaggctttgaaggaaggataagatgttaacctgtgaatggggggcaagagaggacatggaagaatatttattatggaagagggagaaggagagggaagatgtgtgttccaaaagagaacatgatgttaaacaaagatgctagcagagtgactatttcatagatttcatcctgtctctatctcatgaatagaaaagaccactggagaagactcagtaaaaagtcttacctggagaaattctcactctgaaatatgtaacatcaaatggtctgaagtcatttatgaatattgaatgctgtaaagtcagtagtctgaggcacatgcagagtggtgtcaaaaattgttggaagaattttatcagcagcaaaatgagagtaattcaattatggactcctagggcagcaccaaatgttaattgacgtgaaacattggtggccgggggagccctagttcaccactttctatatgtggaaaagtgtacaattgtaaggactttcacataacctcctcaagcccagagaaaaatctctgtagacttgagagggccttaatgatcatgttaggtagtgctcaaagccctttcttacatatcgaaatgcttgcccacattgccattctcagccttatgaactggaaatagctggtgctattagtcccattatatacatgagaaaacagagattaagaagtcccaggccaggcgcggtggctcacgcctgtaatcccagcacttcgggaggccgaggcgggtggatcatgatgtcaagagatcgagaccatcctgaccaacatggtgaaaccccatctctactaaaaatacaaaaattagctggacatgggggtgcacgcctgtagtcccagctactcagggggctgagacaggagaatcgcttgaacccgggaggcagaggttgcagtgagctgagatcgtgccactgcactccagcctggtgacagagcgaaactccatctcaaaaaaaaagaagtcccaatgatgaataaggtcccagtgctcacaagagacatgatcttctctagaacccagctaaccagaccccgtttccccacttagtttgctctttgttgtctttgcaagtgggcaagagaagcaagctcactcctgttcatttgccttataaacttttgaaattttttaaaaatgtttacgcaaaattaagtcttttgaggatttgtgttttctttggagtcactaaaagcaatgactttatagcgtttcgtagggggtcataaaaccctaatttttataatcaaagagaactacaaggtccaacgttaaggctagtgtttttacagcacacagtatcatacacccataaaaattccatctcattctttaagtaaatatgaacataacctcttgtctgtccattttaggatccttcttttctgtagaaacatggagcccagactgaaattagatactgaagctcaaataaattatttaaaaatgtgtgcctttattacccttgaactttctgccaataaagaacaatactaacaagcatatggatgtaaacactcctaaaaattttactatcagaagttgttcatgcctttattaaggaaaataacacagtttggaagcactaaattttttagggatgtcagaacaaataaagaaagttgacctagctagcctagggcactgctcttgaaattacatttactgtaactccttccctttggctaatttagtttttatctactctggatgataaactcacagcctgggttgtgcaatacaagcatgcttgacagaaggcaggcaattgcaagaataatgatgagccatttgaacactctggcttcttcccttccagaagaacttttacctattatagcactggctctctattgggattcttagcaagtgtattagcacttaactttccactttaatgaacgactgacatgtataattctatggagagcataggccaatattttattagtttctgatagtattacaatggtttgagtctattgaactgatatagaagatctatgggaagagaagagagagggctacatatattgggaagttgcccattaatttggtctgtatatgagtcagaattcattttttcttctatatttctatgtatccagagaagcctgttcatgattgagagacacatcaaaaacctcatgacctcattagcttttgtaatgtcgcctctggttttgggttgagctatggctcctcggcccctgagaaagtatttgagcacgttttcattatttggttcagaaagtagcagtatttgacaaaatgtttctgaaaagaggaaacaagatgcccaactaccagagcctcagattcctctccctcccagtaccttcaaaccagcttgaagttttaaactcaggccacctccacactgagaggtctggccagcccgtatgcaaggacatggttcctaggagtgtggtggaggcgtgtggtgaagatcctgctgaagaagacagaaggttctcaagatgtccaggactcttctgttatcaatgtacttctcttctacttaaagccacatggggtccctaagaatttaacatgatgatatctaattgacattctctcttacccctgcctaccactaaacccaccacatggtgagaaagttccaaacagcaatcgtttctgaagcctgatttggataaaaccagatggtcaccaaaaccattccattaggccatttactgatgtggaatgcaattaaaattgattccactttaatcaaaataactttgaggagaacaaatatgtgctgagtatctacaatataaaagaaatttggatagataatgatgagttggtggaacagtaggtgactcatacagggatgaataaaatgtatcttttacaactcaaggagtttatattctgggaggggagaaaagatgtgtccagtcactaggcattttgtcagataatagaaacctgttccacctacttctcctctagaagacagtttgacaagtctccttatcaacatgtaaataataaaaagggtatccagcaaaagagaatattagcagtttggggtggtgataaggacacagcacgtaacgagatttccccttgaggacaatgtcagtgtaaacagagaccccacggattacaaactgttgaattcagaggttattattaagacataaatttaaaagggtctttattgataggctaccttactatattagggctctctagcaggacagaactaataggatagatgcatatataaaggggagtgtattaaggaatattgactcacacgatcacaagctgagatcccacagtagaccgtctacaagctgaggaccaaggaagccagtcagattcctaaaacctcaaaagtagggaagccaacagtacagccttcagtctgtggtcgaaggtccaagagtaccaaagctgacgaatttggagtccaatgtttgagggcaggaagcatcccagcatgggagaaagatgaaggccagaagatgcagccagtccagtccttccacgttcccctacctgcttttatcctagctgcactggcagctgattagatggtgcccacccagattgagggtgggtctgcctttcccagtctactgactcaaatggtaatctcctctggcaacaccctcacagacacacccaggaacaatactttgcatccttcaattcaaccaagttgacagtcagtattaaccatcacacttacttaatagctctgtgttctctagcaagttaatgaaatctctgttgacttaatttctaaaattggagtaagtccatcttttctaatgcagtttgtgtatgttaaatggaaatacaaaaaaaaatctagcatagtctatgacccaataaaacggtagttttcttccttcattcccaattcccttctctttcttaaaagcaaaaaataaaatagcagatgtcaggatcagtaccaacaggctctttgggactatggtttctttccattgatttgtagttcaacccattaagcatattctcagcacctagtatattcccagcatgcagcatggctgttgcctccatgagcccagtccagtagaagaaagaccatcagtcatacagatatgaaccaagtgcccattgaagtataagcttgtgctgtgggagcacagaaaagtaggggaatgaataatcctgaggaggaaagagtggatcagagcagtctcacaaaggcatttgagctgttccttcaaggtttccatggtggaggggggaggatcacattagcttatttattttttactacagagattcaacatttgcccttcataaaaattatacagaaaatatgttaagaaaataagttctaagccatcaagcccatctgatctgaaacagaaaaagactcataatgaatatgtcaacacttccacatttttcatttgttttctaaagcaatttcatctgcaaatgaattatgcactccagggctagacagtacctccattcctacactccagaaaaatgtgtttacttcgttttacatttcatgcagctcagtgggaaggcagttgcaatgcaatttctgatccagtttagggtttgagatgtcagtcctctctttctttctccagaatacggctaaagcttgtaagaccaaggttgggagttcacttttttttcctccaagtgcattaaatacataaatcacctctcaagaaagaacataaggttcctggatttctattttgtctggcatgaaaactaaagtccaatctgcaaagcatcatactgttatatccatctgcagtgcactaaaatcactctcaaagattgtaactcttggagcaaatttttagcacaatgggcagagcgggttgtttcttgcccaggtaactgaagcaggttcttatctcacctaaattcatcttctgtctgaaaagtaagtgtatctcaacatgcggtttgaggttctgaagggttccacgctgcccttccactcaggcagggagaagtcagtcctgggattgagtctgaagattttgatggacatggtcctggagcgagttcggagctagtgttaaaatgccctctagtggtcattagctgtaaccagtgagcgtagggaagggaaaatcttgtgaaactggcttgggtgtggttttctataaacaccgaccaaaaccagagtcctaggttatagcgcgggttacttgcatctgtcgcggataccgcgatggcggtaggacttggtattacttatagaaatggaagcttgccgttgcattcaaagggtacaatccagggatttttcttacgctttcacatctcactgctctgtccctgagccctgggcacacacgagagtttcaagaagtgttgactgagtgactgaatacgtgaaggaatccagtttatgaatcatggattctgtgcacattcaatgagcttggctatttgaaagtgcacaaattcttcctgctttctgaagtattaaatatatttgatttgcatcctttccccagtggtcgcttggtgagctaataattgcctttcctcttatatctttgagctgaggaaatataatcaaaatgttaaggagaggggcaacaaaccccccctttgtgggtagaagagaaggtctgggctggcagctcaagagaaaagatgaagaaaggacatccaaaaagaagtggaagtcagagaatgaataaaacacatgagcgaatggctgccatcctatccgagcatccttcctgatattgtcacccagggccaccagcagaggttacatggtgagaacagacagtagaaatcagcccactccaccgatctgactcctggtctcctggggaaatggcattaggatctaggttaccaacatcatagcttctgccagggcttgtgtgcttaaccccaacagtggaacaccacaaatgcacaggggcagtagcctccaacatcctgaccatctctgagaacctgtcctgctagcagaggggacagaggctgtacaaatcagaaagttgacgtattagtccattttcacgctgctgataaagacgtacctgagactgcgtaatttacaaaagaaaagggtttaatggaaaagtcacggttccacatggctggggaagtctcacaatcatggtggaaggcaaggaggagcaagtcacatcttacgtggatggaggcaggcaagagagagagcgcttgtggaggggaatgcctctttttaaacccgtcagatctcgtgagacttattcactatcacaagaacagcatgagaaagactggcccccatgattcgattacttcccaccaggtctctcccacaacacttgggaattcaaaatgagatttgggtagagacacagccaaaccatatcaatggataaaaggaaatgtaatgtcaactaaagacaaaaaaaaaagaaaaaagaaaaaaaaaacttttgaagaattaaagttggttttatttagaagtcttattggggactgtagactgaggcctacaacccacaagcagtcttttacagaggttttatgagactgcgccagcacagtattttagcccactgtgtatatataggtgctaggggtttagcatgtgcaaagttatatgaaacttgtttagacattatattaaagtagaactacgttaaggtttgggtgtaagggtatatctggttctagattatagaagtgtcatcactaatctccccagatgttattttatgcgtaggagaaggtaaggactaggttcatttgtcttttaaggaatatagtgacttaggtaggagagatgggggccaggtgttctgttttattttgtcgttttggagagctgtatgtcatcacagagttggggctttgtgaaattatgttggcacagagacaagcaaacttagctgcttatgtatgtgattttgtctcacaagttctctctttaggtcacaaattaactctggccatatttataaaaacaatattgattgtgttatgtagctgagaaggctgttttttaggaaggttggtaatctttagttgtagttgtaaggaatgagtattgagcccagtgtgtatatttatttattcattggaaaatatgttttggattatatttatgttttaattactaggatttgttagggtttttgatgttgcctttttgggggttttgtgtgtgtgtgttttgggtttttttttttttcaatacagggtttcactctgtcccccaggctggagtgtagtggcatgatctcagctcactgcagcctccgcctcctgggctcaagcgatcctcctgcctcagcctcccgagtagctgggaccacaggcatgagccaccacacccggctaatttttgtattttttgtagagatggggtttcaccatgttgcctaggctggtctcaaactcctgagctcaggcaatctgcccacctcagcttcccaaagtgcaggggttacaggcatgagccaccatgccaggctgttgcctttttttttaatctaatataacattttaataggacattataaggatattatagattacatatagtagtctatatttaatagtaatatgatttatagattttgaaaaaataaaaccaataaaatcagaatatgcatttgtatttttttactaattgtaccttttgtatttatatttactagtattttttatgaaaagcaattttggactggagttgattgagaatacttttagagaagaatttggaataacaactgggttgtcttgtgcatttcctgtgggcatgatgccagccttgctcttctatggcaaaggatacaggttggcacatggaggagcttggcctctgcaagcccacagacctctgggctagctactcagcaactatgtgtcctctagacacagtaacttaatctctgtgcctcagtttcctcaactgtaacatggggcgaataagagtatgtgccgacagagttgtgtgcaattaaaaaaataatatgtgtaaagtacttatggtgggatcccacctgcagttcgcctccaggaaatgttagatgctgatgtggaggaggatgaaggggaggaccagatgtttttcctgctgctggcatattctgcgcgctgctcttccttctcccaaatcctttcagcagcattttctttcttcccgagattgccaagggaacccaggcagaatgccaggaactaaacctctctggaagattgacggaagaagagctgggatttgagcaagatagagcgggctcagggtcaccatgaggttcaaggtctgcagactcccccaagctttctctcgagtagatttgaacacacaatccaagtccaaatccaaatttaataggcttctgtactgagaattcagctcagccaattgtgttagagccttaatgcacatgggtacacacacacacacactcagtgcacacaatgagcactcgtacagggccgggtcacaaaagaagcgaatgtccatcatctcccttcacttcccctggtcttttctagtctccattcctcaccatttctactgaattctcccatccctctccaccttctacttctggaacgagctccaaacatagcattaaaaagcttcagtgtttccagggaacagagcattgctgctttccataaactggcagaactggtcgttaaatggaactttcaggcattcccccacattctgaagtcactctctatgtaatgatcttcctgatacacctttctgctctttcacctggaaaagaatttgaaggatgtggttatcagtcctctgatgatgccaatgtttcgactccatcctgaatattgttattgctgccaaaacctactggtaaagtaatatcaatagagccaccgtactaaaaaggatgtgtctgctacgttgttttctttaatatcaaggactttaactatattacagttaaaatcaatagaaatgtaaccttttcaaccacataaaatgagttcatttttattattattctttttctgctgttacagtgctgtgattgcaaaagcaaccgggtcaacttaagctttattgaaagaccattaaagaaacaaactcaaactcatttaaatactgaagctggtgcattaaaaagatcaataaagtaaaagcaactggggttgctttacttaaacaccccacatacgagaatcattccacaatcacaatttgagcaaacctataaaactaggagaccagccaataaagaagaaaacgctgtttcattactaggtttagacccataaagcccttaactttagtctgattagacatactgcatttaaattttctctcagtattttaaaacatcatccagcaaagacttattgatcaatgaatgtcatttacttaggaaagccattagctccctgagttaggggaatgactcagtggtagaaagtgcagtttcatttatttaaaaataaacacaagattaggctacagtgaagggaagttctagactcacagggagtcaggaaattttctttctatccttgctgagcgtggtatcttgaacatagttatttgtattcaattgaatgtttactaccaattctgtggccatggattagacacaaacctctttgtgtgtgcctcagtttccccagaggtagaacgcattaatatccttttctccctctttctctggataagaaaacaaaaatgattgacacaaacctcttcaagttcttccttaaaaactataatacaaactataaaccttagtggtaatatgtacttagaataattttagaatcagattggtccttattggccatgagtccaacccttgaccagtctctgcttatattactagttatggaaaacatgctatttttcttcttaaaataccatttattgtgtttttctaattatacatttaaatatatttattatagaaagtacagaagagaacacagaggaaaatcaggtttgcttgtgagtcccatttaaaatcagccctcgacccttctccaccaaacccgtcttgcttactccagggcattgctgagcagttctctgtcttcgttctctactgactcattcccatcagcaaataagcatgcagatatttctcttactttaaaacaaaaatttctcctgagaccactttccccacatctttgtttttctttgcaataaaacgcccggcaatagttatctatgcttgctgtttcgggtcagcttctcccattctctctctctctctctctctctctctctctatttatttatttatttatttatttatttatttatttatttttttggagatagagtcccactctgtcgcccaggctggagtgtagttgtgcaatctcagctcactgctacctccacctcccaggttcaagcgattctcctgcctcagcctccccagtagctggaattacaggtgtgtgccaccacgcctggctaatttttgtatttttagtagagatgaagtttcatcatgctggccaggctggtctcggacccctgacctcaagcaatctgcccacctcagcctcccaaagtgctgggattacaggtgtgaaccaccatgctcagcctctttcttcagtcaactttactgaaatgtaaattgcatgcaatgaaatttacacactttaaatgtacagactgatgagttttgacagacgtgcacacccatgtagccaccaccacactcaaaatttggaatatttctaatatcccagaaggttcccctgggcccctttcccacccaccattgcccccaagcatttactgatcaaatttctatttctataaagtcacagattagttttacctgttctataatttttttttttttgagacagagtcccgccctgtcatctaggctggagtgcaatggcacagtctcagttcactgcaacctccacctcccagattcaaatgattctcctgcctcagcctcccaagtagctgggactacaggcacatggcactacacccggctaatttttgtatttttagtagagatgaggtttcactatgttgaccaggctggtcttgaactcctgacctcatgatctgcctgcctcggccttccaaagtgctgggattacaggcgtgagctaccacgcccggcctacttgttctataattttaaacaaatgtccagctcctttcattctgcataatgattctgaggttccttcttcttgtcgtgtgtatctgtggttgtttttttaattgctgggtggtaatacacttatgaatatacccccatgcatttattcattcacctcttgatggatatgtggatcattttggggatattatgactacacctgttaggaacatttgcatacacatgtatagagcagacttttttttatttctttcaagtaaatatctaggaatgaaatcaatgagtttatggtaagtgtatctttaactgttttttgatgtaatattccctctaggaagacagcagaattccagtgactccacgtagtcactagcacttgatattgtcagtctttttaattatagccattcaactggtgtgtggtagtatctcattttgggtttaattttcatttccctgatgactgatgatgtttagcgacttttcaagtgcttattgaccactggtaaatcttctttcgtgaagtgtctgttcaagcctttggcccctttttaaaattggattgtttgccttattattatgttataaggattctttacgtattctggatacaactcctttgccagatgcatgtactgtgaatattttatcctcattttttcttattcccaatcccagctgggctgctgtccaccactgcttaaagctactcttatggatactatcaatgaccttctcaccaccaaacccactggctacttcacagttctcctgctgctccacttaaaggcagcatctgaaaccagggagcccttggcttttagggaacactgctcctgtcctccttctccctcatgggccccttttgctctgtctccttcactgtttctctccttcctgacctccttcagtgggcgtgcttccagtgctttaccatttgtattcactcctgtgatgatctcatccaatgtcgtgctcttaaattttatctctgtgcctcaaactccaaattattatctcaacccaaacctcgccatgaactgccgactcacacaccaaactgactcccagatatctaactgattcttgatgtctgataaacactccgaacacaatatctccaaatctgacctcctgatctgccccttcccacaacctgccctgcttatagcctttccaatttcagctgatggcaactccatccttccagctggtcaggattaaaaccttggaatatcactagaacatcactcactggttctcacagctcacatccggtttttcagaacctcatgctggttctaccctgaaaacatccaaattctgaccagcctcccaccttgcacatctgctgctcgggctccagactccatcctgttctgcagaggcctcctgacgggtctccaagcttcctcccttgcccttgcaggagcgtctctgacatcactaccccatctgtttaaagtacgagttctctgctcaacacccactgacagtcctcgtttctctgaggacaagccaaagtctttccagtgacctgcaggactccacaggaactagccccgtgaccctccccttttcatgctacttgagcctcactggcttcatgccgggaattctcccgccttggctgctctctctgcctgagtgttctttccctgggtttctgcagggctaacccctcgaatccctcaagtcttcattgaatctccttttctcagtgaggctaccctgaccgccttatttagggttgcagtctgacttttacaccaggcctcttattgggctctaatttgagggaaaagacttcgaatttatcccctcctaccatattacatcatttactttttctctgtgtctctctatactaggaaggaagcgatatgagggttaggatttggggctttttgttcactgatgtatcctaagtacctagaacagtcagttcaaggcaccttatgggcacttgacaaacgtttcttgaatgaataaacggacctgtgatgtgactacagattccttcccacacgatgcactcggaggcccctttcttcccacccagccagtgccaggcattctgcagcaacactgctccatcatcctcttttctctgcccctgcagattgacatcttcagctccctggccaccagattatggttgggttcagctagcagaacactgcaggaaaacacagggggaggcacgagagatcggggtctgtcctgtcctcacctctatcctgcttcttcccaaagtgctgggattacaggagtgaaccaccgtacccggcctcattttacttattatagccacaggttcaaatctattcatatttttgttttgctttgttttttctgctctgtttagagtcggagtctcactctgtcatgcagactggagtgcagtcacacaatcacagctcactgcaatcttgaactcctaggctcaagcaatcctcctgcctcagcctcccaaagtgctgagatgacaggtgtgcaccaccatgctcagcccatatttattttttaacccttgttctattattacctcactctctgcaaagacttctagaaccaactacttggagttaggccaaactttacagctccaagggcacagtcctccacaagactggtctcacgtcaaaccccagctgcaagcccaggggtctccaggtgaccctcatttacaagcagctggctacaaattcagaggttcccactactccctcaggtcaataatttgctagaatgatttgcagaactcgggaaagcactatacttatgatcaagttttactataaaggatacaatccagaccggccaaagggagagatgcaggtggcaagatttgtcccaaatgcaaagcttctttgtcctaaggacacactaccctccctgcacatcagtgtgtgacaatgcccagagtattacaaaccagggacatttactgagcttcggtgtccaaagttttttttagaggtttcattacacaggcttggttgattgaatcattggccacaaaggtgaactcaatctccagtccctctgccttatctggggtttgggctcaatgctcccaactctaattgcatgtttgatgaaaagaagggagaaggaaaacataaaaaccctcctccttacatgaatgcccttctctcctcagttctcatcactgctcttctagctagctttctcttggcccaaagtacacaaatggtggctccagcaggttccctattcctggacattttcaattctaagcagcagcctcaggcattggtgatcctattggatgatccagtcacatgttcttcctaaatgccaagggtatgattatgctacattgcttggaggagtgtgcagccttgcctcattctgcagaagttcccagccatgctgtagccccagttccatatacgtaccacagccaccaacacaggagcctgtagggcacagtcagaatccatcttctttacctcttgggttcagataaccaagcaaagttctcctccaggccattttcatgttctctctgtcttcaatacacattctcctatacatgcctcatagtcctgattaggttagcaggccctgtggttgagcagacttccaatttgggaattgaatgtcagtttcttcctacatttaggcccagaatcaccctactcttgcccaatgtctttgaactgtttcttcatccagatcttttcatcccttaatacattctttctctcaagaagaatatcagtttctcaaggagagagatcctggggtctctccagacacaccgacatgtgcttgagtcccaacgtagctacacatgaactaattcgtcagccccttagggtcttgatcaggtcaccttgagccacaattttcaccaacctttcctctctgatggaaatctgaagtcctccctgggatttccaagggttctttctgcttccaggtgctttcttctgtgggtgatctctctgatccagagaatatccacccagaatgaagctcagcacttcctttggttcacaaacacacaaccgcccaaagcattcactgagcagtagcctctattgactatttcagggtcggggagaggggtacacagcacattaacaaatcactgcaagtcatagagtagatattcatgccctcaatagttcctttacccatccttctatagaggcttctcatagcccttcacgccaggcagtgccagtctttctgctttcaccccaggcagtgccaggattttgatttctcctgattcatgctccctggctccccacctgcttcctcactcatctccaggtctcccccactattatatacaataacaagctgactcttcccaaaacagggtccaagcttgctggcccagagtagtcaggtgctcaacagatgcaaaaacttggatttgaccccctttaaaggagttgtggttacaaataacaacaacaatgagaatttgggggtgatcctatgccagaataacagagatagatagatacatagatagatagatagatagatagatagatagatagatagacagatgatagatagatagatagatattgattgatagatgaaaaactgtaaccccagttttgtatagatcaatccaaactttgcatcctagcattcaaagcccttcacaacgtatcttccatttaccttctattgtcttctaccattcttttccaaaacacatcctaaggaccagcatggctggtgtcgtctaccattttttttccaaaacacatcctaaagatcaatgaggctagtgacctcaacacccttagagaaatttggtttattattcctccttcaaaacgcctccactctgccaatctactgtaccatgatgacacttattctccatattacatattttagaattaggggtaacattttacatttaattttagtagattgtcttagaatattattccttcattgtttcatgtcatgttttccaaacaagaatctaaagcgccttgagcccagctgggaacatctgcacgtcatcagctggactccagtcccagtgctcaaggtggctggaccacaaaaccacatggaagcccttgcataatgttaggaggtgtcagcaagatgatttgagtcttacgccgaggcctctctcttcccacagggggtctgcaccacccccagcagccaagttaccctgtgacagtcattcatctgtgctctgggtggcccatgggatgagtgtactactgggcaggtgtaacttcaggggcacacacagcagacatccccagctgacatgacaacctactggcttctcaagatttgactaatcatatatagtcatcccacaatatcctcggggtatcggtttcaggacccccaagtacatcaaacctcatgcatactcaaatcttgtggtcagctctgaggaacctgcatctagcaagggccgactttgcatatacgcaggtcctgcatcccaagaatactgtatttttgatccgcatttggttgaaaaaaaaatccacttgtaagcagtgcagttcaagcccatgttgtttaagggtgaactacatttctgtgaggggatcatcttcaaataaagtccttgtttctgtaccagttacagcaaaggccctgctttgagaatttaacagtcagagtagccacccacttcaaaactgaccagtcccatccgtggcaagcagacgatgtgacatcaacggctcttaccgcaccaggctaatacagttatcctggtcgtagtttcattttactgaaggccttattaaagcgcccccacacaactcagccaggaattcaccaggaaccaaatttaaacaaatcaaaccccgaaaacgtgctcaacaattcaagattacagaagggaataaagacgaaaataagaaaagcctcaatcatatttgtcatatctccatcgtttctcataataattctcaaagttctttattcctttcatttatttaattaaaaacttaggccatgcacgttggctcatacctataatcccagcactttgggaggccgaggtgggcaaatcacgaggtcaggagatcgagaccatcctggctaacacggtgaaaccccgtctcaactaaaaatacaaaaaattagccaggcttggtggcgggcacctgtagtcccagctactcaggaggctgaggcaggagaatcgcttgaacccaggaggcggaagttgcagtgagtcaagatcgtgccactgcacttcagcctgggcaacagagcaagactccatctcaaaaaaaaaaaaaaaaaaaacttaaccataacattatacaatttaagcagcatcatatttgttaatatctattttcaaaagcgactcttcctaattttattgttttcttcctcccttttccacgcatttgtttgtttttcttcctcctagaaagtcatgttctaagttatcaaaatgtgtttttcctcgagctcttcagggaaaaaatgccatataaaattaattcatgattattttatgtaaattattatctaaagtactcactatgtgtaacggttaaagttgattgttactaaagtgattctaaatatgaaagtgtataaaaccatgaactattctcacactacatctcaaagaaatttgaaatttctagtaaatttcaaatttactagaagactagttcagatattgtttttaatgatttacaatcatcttctgaattttcatttgcaagtcaaagtcacaaaactaaaagtgctacatgttttctgaccagattctctgaaataattatatagtgcttgagccattgtgctataaatatctttgaaatcaatgctattaaagaaatgctatatcagctgtgaaatgagaatttctcctcctgtccgttgacatttacaaaaattatacgaacttattgatagaaaatccgtttgcttggtttctttttaaacatcttatgctttaaataatattcagtgtttttccagtaggtggagtattagtctagataaagtaaatcactgtgtgaaagctaattttttcttcctactattttgagaaatttttgatataaaacataaatcacctaatagtttcactaattcttttaattgcatcaatatggtatgatttcaattactctagaccttaagaggcagatatattttactgattacattaccataataacaatggcataatgacaatagcagtaagtacttattatacctctcattttaaaattgcttatcaagccattagagaaacctcctgacatctctgaaacagaaattacacaacaaagaaagatctgtctcttaaatcctttctctctcgagccttaagcatttctgggaaactgcgttccttgtgagttgaatattggttcaaggctgatgctaccacttccagtccaggaatctgagacgatcactacctctccctgggattctgcttccccttctaagtttgtgaaaagatggtgataaactacatctctgaggcccctccctacctgaaaatccccaaatgaacctgaaattgacaatcttatggctgaatgtcgggagccaagtctgccgagatgttttagtacatacggcaaagatggcacttgttatacggtctggatctcaaaatggaaagtgagagaatgatgcctttccagggcaggtggacgcttcctcccaccctccatccatcaccaaaaccggtcgaagttgaatagtgccctgaaaagacaccttcaagtggtaccctagagttgtatcttcacagatgattctgctcaaagcccccagagacatgggaaaatactattccttagggccatggtagcagaacatcttcaaagaaacctcacagaactggttcaacctcctcactttacaaatgaggaaactgaagtccaagaaggcttcctaacttgataaacatccatttaacacgtggcagagccagggcccatctcctggccccattctcatccccccaggccacctctcctctcttacactggaagtctagaagctggtttgcaaggggtccctgaatgaccttccatagaggacagtgccttaccgagaagaggaaacacatactgaaaccagccacttttctctttttgccttctcacagtcaggtgattcgggtttggagagagccccagctcccatgcgcaggggattttctgtcctagaaaggcttaggcacagtggattcacctggatctcttctagttttgcagccagtttttctttcttgctcttggaccggagagcccccagacccaggcgtaggcttaggtaaagggggctcaggagacaaatctgtctgctttggccctaggctaggccacctctggccttgccaacaattaattaatacattagttaattaattaattaagtcaaagtcctccaacgtggttgagcccagctggggactggtaataaagtgagtggtttagagaataattcccagaagaagcacaaattgattattgtatttggtgaaaggacagcagaagagcattctgggcaaaagatacagctggtctaaagccctgagcacacctgggagtgcacagtgcctccccaggtgtgagagtcaggtcacagcacaggggcaaggtctaggcgagggcactgcattctcgcctctccattctacgaagatgccccctacccctctgatctccccagggccatttaatctctcccaaagaggcaaaggctccctgacttatccatctgcagttacctgcaggattcggttaactttcccttcgtaaaggcatccgccgtgaaacacaccaggcacctccaggaccggcatgcatcgctaacccagtgacaaaagcatggctgttgctcgtttattccagagttctgttaggggagagtgtttcttggcctctttcttcttcttgagtatctctataagtcggcaggatttatgagtagctcaaccaaaaacaaattaaggtagacaacgtgacctctaaatgggtcagcctcccaaatggtgtcctctcatctgcacccatggctgttcttgggattggagggatggccgcagggcttggcaatgtaggttgggagggggctggcctgctgaccctcaccctgatgggcttgtggctctcagcaatgtggtcccaaaaacaagttgcactgaaatcaagactctcagagcagagcaggggcaagtgtctcttgcatgaaaattcggagtcccagattcacgatcagccagtctccccatcgatgtggtctgggaggatggagccaagctcactcactcaaactcgatgtcaataaaatgctatgagggcttcagtccactgagtcattcacagagattcctccctctacaaacagaagttctaatggaagtaaaagctaggaatccacaccttaaacacacacacacacacacacacacagacagatttacatacagatacatacacgaacatggctcagccagtgctgacccatttaacacatgttaaatgagcaccttgcatatcacaggcccttttcatgtggatcgtaaattaactggaaggtttattagataacactacagagaaagaaatagccgaaagtccagaggtgaggtgttagccacggagctctgacaaccaggtggatttccactgcacctgctgagcccactgatcagtgtttaacaagcgtgtgttatgccacgctcctggggcaggagtggtaactgaggcagcgtccttgaacccacagggttacggtctcaccaagggaggatcaggaacagagctgcaaccctggactagcaggagagtcacacctaatcctacttctttatctcccacacatctacatttgctccatgtcctctccattatcaggaacaaagtgattctagggttaggaaggggcagaaaacatttagatgaacgtatccttgatactggggtcaaggcctgcttgttcgtattttcaattgcaaatggccctaggcttgtgtatacccttcatagaatggagattccgatggggagaaagagatggtctccactcttcaaaccctctcttctttgaagtctgtgggaatttctagtttagaaggacgggtagacacagataaggggtgcgagttgagctgataattgtttctcctacctgaagtctatctgcatcagcctcttcttatcttcagccttgggcttcaacttggagtaaataaaacattcatcagatgatatgctctaggctgggcgtggtggcctacaatcccagcatgttgggaggttgaggtgggaggatcacttgagcccaggaatttgagacaagcctggacaacatagtgagaccccatctctcctaaaaataattttaaaaattagccaggcagccaggcacggtggctcacacctgtaatcccagcactttgggaggctgaggcaggcagatcacgaggtcaggagttcaagaccagcctggccaacatggtgaaaccccatctctactaaaaatacaaaaattagctgggcatggtggcatgtgcctgtaatcccagctacttgggagactgcagcagaactgcttgaaccagaacttgggaggcagaggttgcagtgagccaagatcacaccactgcacttcagcttgggcaacaaaagcaaaactccgtcttaaaaaaaaaaaaaaaaaaaaaaaaaaaaaagccaggcatggtggtatgcacctgtggtcccagctactcggtaggctaaggtggaaggatcacttgagcctgagaagtggagtctgcagtgagctgtgactgcgccactgcactctagcctggatgacagaataagaccctgcctcaaaaaaaaaaaaaagaaactccttagtcatacacctaaagccaatctctccataatcactttattgggaataaaatgatattttgaagaaaaaagatgatatattctaaattcaatatcgctgagctaattccaagtattccctaaaattaacgattaggaaaaacagcaagaaatcctaggcctttgtctaggccatggaaaaagcgggatctgccttgaaattgtgtccttcatctcaggagatggggcccggcccctccaccggtccaggagaacccacgccatttaggtatttcttctttagcttctccactgcatccccaaagcgtaaacggctgatgaaatcccttcaaactctgccaacgcaaactgtggcttaaaaatggaaatgaatggatattgcaaaataatacctgaatagacgttaaagctttaagctccacgtgtaagacacaaggtcctgcctaaatcagtatgcttctaatggcttcatggcaaatgttgaacaagttagtgttcactcaaggttgtcctggggtacatggagtcacagtctttaattttaatgagcctctattacacaatctcttatcgcctcttaactgccagtgaaatgaccaccagctaaatgtacagcaaaatacatttctacaaaagagctcacttggaccccaaagaaattaccttgaaattattacacttaaccgtggcaaatgcaccagggttcatttgaaaagaggtggccacctggcaatacgagtgaaatcatataatatgtcatttccttaggcttttcatgttaagcttttctcgctatatctgatttaaagtattttctcttttaaatgtaaatatttaaaatgtagctgatcctctccctctcctaattgaggtgactgggctagttcaagagactgtggcctgcagctcaccgttttgtctctggagtcagagtgccagccttggtacttactctgtgactggacactttataatatcaaagatacgagatcatacctatctaatatctattcaataagacaatacatattaaaagatcagcacaaagccttgtacacagcagttgctcaatatgtgcttcctcctttttcctactattgaatcccaccagccaagaccagaactatatctgcagttggacaaagttgggtttatcccttgttgcagtgagggcttagcagtttgagtcaaacgggagctggaaaccacagtcggttaaaatggggtgataaatagaagcattaactatggcaaacagcaactccaagatgtaaggaaatccgtgcagtttcctagtggccccctagggctgagggagcccatccagggacaacctcggtgggtgtctgaccgtaatggaggcaaagctgcccctgtctcctctgacagtctccagctgggcctgagagttaagttgacgtaggagagactaacagaggaaacgcaagccaatgtttacaggcatgtgagggccttcacaggacaccaagatccaaaagcagccaggcctaagtgcttatgcaacagggtgaacaaaaagtagtaattttgaaaaagtaactaactatatggagatactaaagacaagggttattttaacaagagctttttaactgtcaaaacactttttgtttgtaccgatttccctcggcctcaactccccgcctctggagagaagaatgttcttttcttcctggtagagagaagccatcttccatatgaaagtttcatctcctgctttcaggaagaaaaggggaggtcagagtgtcctttgtgcatctgttgtttttctttttttctttgagatggagtctcactctcacccaggctggagtgcagtggcaccatctcggctcactgcaacctctgcctcccgggttcaagcgagtctcctgcttcagcctctcaagtagctgggaccacaggcgtgcaccaccatgcccggctaatttttgtcttttagtagagatggggtttcaccatgttggccaggctggtctcgaactcctgaccacaggtgatccgcccactttgccccccaaagtgctgggattataggcgtgagccaccacgcccaacgcatctgttgtttttcaagtgcctttagctcaaaattgtccccatctcaagccagcatatctggaggtggcgtgttctgaagcccttcaggaccttgctggagaaggtgtgtctgcctggcagagagcagagacccctgcttagccaagctggagctggtccggaattgctgggggagcgacaggctggctgccctctggagtgcaggtgggggagcaggcaatagcaatggcggtgggggtgagagtgaggggctaccagggcggttcagacacacgtccagaggtctgtgggcaggttgccatggctgagacgctagggtcacagagggttctcttaaaaggcctgcgactcagacaggcttcacctcatgtcctcgcactctgggcagagcctctgctatccccctcctcgagcctgtgctggaaattgcagtaagccccttcctcttgcagtgtccctccagagcacgctactgagaaagcttgacattgtgctcaccttaaaagcaaaatctttaaggaattccattgtttatcatagagcttatattgaagggtgcattgggagccaggaagcaacgagttgattgataattgacgcaaagggacccatataccttagagaatgacggggtggctctaagagtcaggaagggcttattttaggaatcaggcttatggtggggagggttcaaggaagcaggtgtctctaatcaactgggtgctctcagaaaagcagggctaattcagttattgggcctcttaatgcatttcatctgggaggcaggaagaatggagaacactaacgttgttattgaagaaattgccgggagaaagagatgttttggttttgggttgtacaaggtctgttattttttaatttcttgtattagtttcccagtgttgctgtaacaaattgccacaaacttaaggacttaaaacaacatgcatttactatctcacagttccagaggccagaagtgcaaagtcagcgcaaacggctgaagtcaatcagaaaggctggtgccttccgcaggctctgagaggagaatctgtttccttgcctttctcagcttctaagagtctcctgcgttccttgggcccttcctcacgtcactctaacttctgcttccgttgtcacatcttctctccactgcgaccctcttgcctccctcctataaagaccctggtggggacctgagacccacccagggaatccaggagaattcccctattatcttaatcacatctgtaaagcccctcttgccaaggaaggtgacgcgctctcaggtcctgagaattaggatgttatctttgggaggcatgattccgcccaccatatctccatattcagacaaaattgcagaatggtctcgtgtcacatggtcaggtcctggagagccctgatccgatgctgctgttctgaattatgttcggcagggggacagcaccacctggtggtaacactcggcaaagcatccgccgtcagctgcagagctgcttttcctttggggtcctcttgctttaacccaccttccccacaatcccactcatcccttccggccacagcccgccttcttagacacaaggcaggcaggagtatgcgagagagaagacgtaaggacgccttgctcgtggtaagatcagagactgatcggagaacgctttcctccttccctcctttgagaatttcctcaggcactgcagcttcacctttgtgaatgttgaaggctttctggatatcctcgtcacttctcatattttcctaactgagcaggtaatttggattagaactgtacagcatgacccatttaggttcctgttcactgttttgaaattaatgacttcatcaatgagttaaggctaggagtgttcattatgttttttagaaaagtcaaaaccgagcaggatcaccgagaagcaagatgacacaatcaacaatcaaaaacctctgagtagaggctattactgtgtttcaaaacaaaatatataaaagtggccgggtgcggtggctcacgcctgtaatcccagcactttgggaggccgaggtgggcggaacacaaggtcaagagttcgagaccatcctggccaacatagtgaaaccccgtctctactaaaaatacaaaaattagccgggcgtggtggcgggcgcctggagtcccagctactagggaggctgaggcaggagaatggcgtgaacccgggaggcggagcttgcagtgaaccgagatggtgcctctgcactccagcctgggcgacagagcgagactcagtcccaaaaaaaaaaaaaagaaagaaagaaaagtttatataaataaatgtaaaatttagcatttttggttaaagccatcaaccacgcagacataggaagggaatacacttatagagatcaactaggaattttattttactgtagctcagcaaaaataatataaaatggctgccaaaaagccaaggccgtctagtctggatctgcagaaacaattcaggaaaaggaaggtacctccactgtgtgggtcatgccaaacctgaggacggatttcccttcggtgctcgcgactttaaaagttgcattaacaactgttaatgtcaattatcaagatcccaccatgtattgtattgggctgtattgggcctgaggacacagaaatgtaaaaacctaaacatggaaatttaatctttaaaactgtgtactatgtatccatagaacgaaatactagtcatccatgacaaatgatttttgttgtatatttattgagacagaagacattcataatatatcgtcaagttaaaaaatatacaaaacataatatgtgttagttgggttccatccctttttacttaaaaagttgaaagaatatacattaaaagttaacattgactatcagctggcagtttttttctgcaaatctatatcattttttctataacgaacgtatattacttgtatccatttttaaagctaagaaaatagaattttgttgtatttttatcgacacagagcgacattcataatatatcatcaagttaaaaaatatacaaaacaatgtgttacttgggttccatcccttttttatttaaaaagttgaaagaaaatacattagaaattaacatttattattagcaggcaactttttttccggcaaatctgtgtttttctataatgaacatatattatttgtatccatttttaaaattctttaagaaaatagaactttgttacaaatttagttttttgttttgttttttttgttctgagatggaatcttgctgtcaccaggctggagtgcagtggcgcgatctcggctcactggaacctccacctcccaggttcaagccattcccatgctacaatctcctgagtagctgggactataggggagtgccaccacacccagctactttttgtatttttagtagagacagggtttcatcatgttggccaggatggtctcgatctcttgatctcatgatccacccacctcggcctcccaaagtgttgggattacaggcgtaagccactgccctgatcacaaatttagtttttaaattgtaagaagtatgaggtggagattatcacctcctaaggcattgccaggtaggctattggttaacaatggcattttgcatttaaccatttaacaaaagagagtaagtaaacagaagtgcggtggcagttacccatgggtgtcattagatggcagcaaagcagctagctaatatttaagagcagaaactgaagagcttttgctccaaagaaacatatatatgagattttaaatatttaagattatctgaacggaataagtgtttttgtttgtttgtttgcttccagacagggtctcactctgtcacctaggctggagcacagtggcatgaccacagctcactgcaggcttgacctcctggcctcaagctatcctcccacctcagcctctcgagtagctgtgactaccggtgcacaccaccacacccagctactttttaaaatttttatagagataatggtctcactatattgcccaggctggtcttgtactcctggactcgagagatccacaagcttcagcctcccaaaatgctgggattacaggcatgagccaccacacctggtttgttttgttaatgatgcatttgacgttatagaaaacttttcaaaatgatagccaagcatgcaaatgtttactttaatagtttttgggggtggggtgcttttggatttttgtggcaatactactcatgcacaaaaacctactgtaccagttctgtgggtcaaaaatctaaaatgttcttgagatgtgaggaccctttgactcttaaccgtgactgtgcaatgatctctaagtttctaggaagcagtttcaagattctgctgcagacagtcattaataatgaatgactattcatcgtagtatgatgtggtgatgccatttgatcacttgcctgccctctttcttcactgccactctctccttcctcccaagagcacagctagcttccagcatctttgctcatctgaaggacagttttttgcctaatcaggcccagtttgagcaaggactctggatcgtatctgcttctgagtctgtgctgctgccttcaacaagttgctgcttgttctgtctccttcctctacacaattgacgtggcccccatgggaatgcccatgtcggaaagcaatgctgtgctttcttataacccgcacctctcgtcatgctgaccttagcacgtattaaactcacttcagaaaaatgaatgcttacaaaagaatgttttccaccggggtggggggcccaaaaaaggcccagaaagctctaagagctcacagttggagaaacacatctagactgtataggtggtaaaaagacagctgagaagataaggcaggaaaagccacacagggacacaaagggcaaggccagtgattctgacaccaccattggcactttgtccacgggcaacaggatcagaaacgtgcgtcgcttccgtggttactgtctgtgcaccgttcccaacagcttcatttctctccctctgctgccaactcgcccaaccacccctgcctgtggcaggagaaatcattctcattgggataaccgagaaaactacaactgtttaccccacttgaccctcagcatttgagtgtgtgtgtgtgtatgtgtgtgtgtgtgatcatgtcacaaaataaaatgtttccgcaaaacttcattgctgtagatgtggcatattccctatcagaggctgacactggagattggatcaagcagatgttactccattaaaaagaacatggatcttaatcctgtaggtaaatcatccacagaaaatgtacatcacctggagagccgttcataaaggatcttcacttaccatcctcagattttttcaaagaaccccagcaaaggaagacatgggtttccattttctcggggtggtgttttagagtcagtgctgatgaaataagatatcagaaaaccagggttcaaagagtgatgtcatccccacagggaagatttggttccacacagggtagagacgtgcttctaaaagtgtctcttgttttcctcctgcagctcgatcattatccttctgtgagttaccatctgccaagttcatccgacaccctcttcaattctcccaagtcgctctttctgggaaaagttataggtaagaatgtggttcgttaggtataaatgcgtgctacaaatacatttgggtaatgtgagtttggattttaaaactatcaggtaaatttctcttactggggccagtcacgaatatcttctctgtacaggaaagttacgtggttgttctcggtgttgcacaagcaaagcgtcaacaaattatctttgggggaaattgctcatgtaactcattctaaagctaattcgcctttgaaatacattgtgattaggctgggcatggtgggtcacgcctgtaatcccagcactttgggaggctaaggctggtggatcacttgaggtcaggagttcgagaccagcctggccaacatggcaaaaccccgtctctactaaaaatacaaaaattagccatgcatggtggcaggtgcctgtaatcccagctactcgggaggctgaggcaggagaattgcttgaaccccggaggtggaggttgcagtgagccaagatcgtgccaccacactccagcctgggtggcagagcgagactctgtctcaaaaaaaaaaaaaaaaaacaaccaaacaaacaaaaaacacattgtgattggtaatgggggcttctaagtcagcgatggtaatggaacaaacgttgtttggtgcgtggcataaactacaacccaagcgaaggcaaatctgctccaggcttctctatgtagaatttggtctattacagacctctacctactagcaatatgtaatttaacgtttcctttgtcaaagcatatcaacatgattctatcttcctctcactcgtaagaaagcaccttgatattatttgcagataagaaggccaataaggaatttgacagtgtgacagaacacccttccccatgtgcgactgtgaattccagagtctccttgtccctctcttcaccagaggagattagcactgtgcaaagctaaaaaatgtaccatgagccacagatatgtgaagattacaccctaaatttttaaaatatcgatatgattggtgaagtattttaaaatatttaatgtgaagccaatgaattttgttcatatgaggctgtgtactgtgaactgcaatgaaaacagtaagatggtggtgatgtacaggtgggagggaggtcactcggcggccagtgtgtagaagtgatcagaatagcattaatggtaaaaatgctcacttaaaaacatgcggcaggggtcacaaaatgaggagtgagtaggagactgaacctataataaaaataatagactgggcgtggcggctcatgtctgtaatcccagcactttgggaggctgaggcaggcagatcacgaggtcaggagatcaagaccatcctggctaacacggtgaaaccccgtctctacaaaaaaatttaaaaaaattagacgggcgtggtggtgggcgtctgtagtcccagctacttgggaggctgaggcaggagaatggcgtgaacccgggaggcggagcttacagtgagccgagatcacgccactgcaccccagcctgggcgacagagggagactctgtcttaataataataataataataataatgtgcacttatgtaagatttactgtaggccaggctccagtttaagcacttgacagatattagcccattcaatcttcgtcacaattgtatgaggtagttaagattatgatctccactttttagatgagaaaactgaaccatgaagagattaaataaccgggccacctggctaatcagtggcagaaccaaaatttgaactcaggcaatcagacaccaagggagctctttactgtgctgtaatccctgtggcagttaatctagaatgcaaagagaaagacagagaggaaagattgggcaggtgataaatgctgaggctgtccaggtaagggataaagcctatatcttgtgccaggaagtggtcaagaacaaaaaggattcctgggtttagaaccaggaacacaccagtccggctggagagggaggcatccagaagagagggggaaagcaggtgtgtgcatgaagcccaagaccacacacctggtgaacaagacagtggggagtggcaagtgataaatcaaagggtggaactggaaaacaaaagagggctaacatgtattgatcactgagccttagatattgtacgatatgaaagataattaaatagcttctgcttaatcctttgcatcctgaaaacagcactcaggcacagtctcaaatctagctttggattacctcaccctgatgtccttatctgaattttctccaacactttctatagttgatgtatttttacagatcttatcaccacttttatgttctgtgaacaagaagagactttgtgacatcacatgttacacgtgtaaatataagaaacaaacgtcacaacaatccaatgaaatgagatccctgattatgaacctcattttgcagatgagaaaactgaagcagaagaaggtcaatttgacaaaagttactcaactaatactggcaaagcagagtttggaagcgaggtctctctgaagacagtccagactcttaagtgggtcaaacaatcttgtcattcatggtgaagctccagaagagggatgtatttgaaagttgagcgatgccatcagttagcaacaaaaagtggctgtttagtggagtagggccttggcattcatgagtcatggatctgagactttggtgagtacccgctttctaccagaggtactcccacggttcagttgagaatactttaaaatgttaagtgctccttcagaaccatatgattccatcaaaacaaacgctacactatgatatggtgatgttcctaaagatactacactatgatattcgtaaagtaacatcaactataaacatacccgaaaataatagactttttattactttgtggaacctgcaaagtcaaattttgatgggaatgttggatgatttctaggttctgtcactatgagtaatattctctggttcctctgttttccaggtcatgtaactagttcacatttcagcacaattccaatatactgtatggcatggaccttcaaggtcgtgaacaaataacatcataaaggccacattttctacaactaagaatgtaccttgacatcaatctgtgcaaagctaaaagtgtaccatgagcctcagatacatgaaggttacaccctgtattttttgtacacccaagaaaaatgttgctgcatacacaaactaggtaactgtgcatgtggcagtgagttacagaaagtacacataaatacctgtaaggaggtccacaattccaagatggaaatggtgttatgcaggtgagagtagttagggctccagcaatgggtccttggtgcactgacttctagtggagattatctctcatccctacaagcctgtgacctccctgcagaccaagaaagcatctcatagttccaccatatactaacaaggagcaagtgctcaataaatatttgttgaattaataaagagtaaaaggggaaggaaacagaaagatatcattgtagacgtatactgcagggtgaaagggtatggatgatcatcctaacagaatcagtaagattcgcacagaggtgagagctgcaatcctcacatatctcacagcctaaaagtaggcatctgacgatcatgaagtagaaagaatgtggacttcggaatcaggcagagcttgttagactggaatccagttctacctctgttagcattgaaatcttgaccatgttgctttcttagttgaacctctcagagcctaggttctctcctttgcaaaatggggaacacaaatgcctacttgcaggttgttaactccctgagggcagaaggcagagactttttttgaaactaatctatttacagcaggctgatcagtgcctagtatacagaaagggctcaaaaaatacttgtggagtaaatgaactactcttttaatattaagctaataacgtcttaagacatacacaacacaatgcctaatacataaataattaccatttttgatgctagctacatgccggttattatgctatatgctgtaagtacaatactgtctgcgtttctcacaacaccacagaccattgttaccctcgttgtatagaataaggagctaaggctcaaaactattaagttttcttcttaaagtggggtttcccaacagcagaactattgacattttggatcagaaaattctttattatggggctgtcttgttcattgcagaatgtttagcattctccctggcctttacccactagatataagtagcaccccaagttgtgacaaccaaaaatgtcttctaacattgctaaatgttccccaggagggaaaaattaccaccccagttgaaaaccacaggcttcaagctactcagcgagtcagcggtgacgctgagatttgaaaagcgtgatttgtgacctaagacctatgctttgcttcctgatgacacctgcaccttccagaatggtgaggaagcaaggacgaggttcttgctactctgaagctaaaattctgttaataaaattgaaggagtctcagtgaagaccccaagaagacatgtaagtgcttgagaagctaatcactggccaccccttcaagccaatactcctttgatatttgatcatttcacaggggcaggaatatgcttaaatgtctctttgaaaacaacatatacttcagtgagagacaacccatttgcattccccagttgtgtaaaaatccatctgtacagacatacagtattgaacttgcaactgatatgtactccggccaggttttgaaaccccctggagtttcatgctccaaagttgttgctttacttttataggatcagtttctgctactcagaaactgattctataaaagaaagagaagaagatggctctaaatacctaaaatgacttcacactgagctctttgatgagcactcctcaaaaagggacacagaaaaaggatgaaagaaaggctacctaatcaaggacaagtgtgatctttataaaggggatggaggatatatattcaagaaatagtagtgtgatcactgccaaccaacagcaaacttttagaacggattcttacataattctgaatgcttctagaaggaattcagaatcactagcaatcagcaaaggttcacaaaggagaaatctcactagacatagttatgtccatctttcatccctcatatccatccatcttttaccagccgagtgatgtcatagactttatctttcagcaacaaatttaatggtctctcaagaaatcttcaaggaagagaaatataacttgaagccgaaagtggggtgttctgtttgctcatgtccttttcaacatctctattaatgccttggagaaagacacaagtagcatgtttattaagtttgcaaatgtcacgaagctgagagggatggtttaatatgatggattataaaaagcatttcaaaaccatcttgacaggctagaaagatgggataaaaataataagatgaaatgtaatagaaataaacttaattgcagcacttagataaaaaaaatatatacaatcacctaaatagaagatgggagacccccagcatcatgaaaaaacttaggaaattggtttgatggaaagtctggtacaagcaatgttacatggtgatggattcttaaatgaatgtgattctgagccacactagtatgagaatcatgtccagagcgagggtattagtcatctgaggagaaaaccagataaacacaagacccgtaaaggaaatgtcagaagacctgggaatgtctgatcagaaaaaaatatgatttgagagacgagagaatcaattttcagtctttggtaactgccacatgcagggtggattagacttagttgaggcttactcagcaagactgacatggaccaaaagcagaagatatgaagaggaaaatctcagctccatataagaaagaacttcctaacaattagagcttttcaaaagtgagtggtctctactttgaggtaatgaactctctattattgagaatattcaacaaaggctaaacggaaatgtgccctgtatattaaggagttgtctggattgagtaaaaccagattagatatagcctaaataaactttgaaactttaagatttgtggtgggagtaattttcttaattaaaaaggtgaaaatgcaatattatagtagagcagggtctcctgttccattggcaactagggggataacatttagggttccttgatataaaacactgttatgatgcatgatgatagatatgaatttagaagaatatcaatgtacagcgatcaccacatcactgtgagttgtgtaattacatacacgacctgtttccaaggtggcaatatgcattttaattttatttctgagccctctttaattaatcgtttttcaaattaactatttctgccatcgctgtaaatcagagtaatataaaaccgtaatgaagtagatctattctgaaataaaaagacggtagcttctctgtgtaaacttgagaagctgtgcttagaaagaagctgaatactaatgcagtgtcgttgttgcttggctgatcattgctgttgtcagtggcgatgtctggggtggtaaaaataaagcgaacttctatccatttgaactaactagagtttgtaagtcatattggtctcagatcctcatatttcccaaactaccattatccaaagcaattccaatagaagtggctagtagcccctatattatttctattataatctaaattgtgaatatcatgatcctacacgactttttattgattaaaaagtcttattctaaggctttctaaaactttctggagctttggcaaagcctcttcacacagaaggaactgacatacttagatcttcatttgttggtgaaatcatatactgtgataaccatgctgctcacagaatatttctggccagagttatgaatggaaaagatttgtgtgatttccaggctagaacatttaagtgctcatgcaagaccctctagagtccttttatccctttggcatggtgactgacaagcctaagacagtgattttttccgtaagcctgggtccctctgtgactacagtgaacagaaaactcttgacttgtgatgaacatatagcatgagataaaaaaaactccttgctttgttaagccaccgagactatagggctgtttgttactgtggcagagccttggcctgtcctgactgaggcataaggactgacttaagggcagactttgctctcgcacccttgggtttgatctctgatatagtttggatatttgtccccaccaaaatctcatgttgaaatgtaatccccagtgttggaggtggggcctggtgggaggtgtttggatcatggtggtggaagcctcatgaatggcttgggccatctccttggtgataagtgagctctcactctgagttcacacaaaacctggatgtttaagtatgtagcacctccccccaacactcttcctctggatcctgcttttgccatgtaccctgcctgctccaccttcaccttctgccataatcataagcttcctgaggcctccccagaagcagatgccagtgctgtgcctcctataaagcctgcagaactgtgagccaattaaacctctttccttataaattacccagtctcagatgtttctttatagcagtgcaagaacagcctaatacaatctcttactctaccatttgccgattgtatgactttgtcgggttacttaacattgtgtgtatctgttttgtcatgtgtaaaataggaatagtaatggtctctgtgtcacgggattcagcaaaataatacatgtttagcggttagcacagtctctgctgcatagtatgtgtgtaatacatattagttttttactttgcataatcagcaaatgtatactcatcatatgtcagatgccaggcattgtataagtccctggaacatcattagggtccaagacaggcacagtttctgcctttggaaactttatatattcaaatccagttctcagaggtttctcttgggagaacccaaagcaagataggggatcatacaatgtatcaatatgcactgggtcacatctttagagcttcagtttctggaaaagaaggtaatggaaagtcaattagaagtaaaaagacaagagggtgggataaatgaaaagaagtatagaattctttgggagcaagtagggagggcacttgagccagtccaggagtgagggaaggcatactagaggaagtaacacagaagctgggaccctaatgaagagttagaatgatctgggtaaagcaatgggctgaagtagaggccataagggcgggggaggtcagttctccattctgcacagcagtccacccaaaactgtgtggctcaaaacagtagtttattatttctggcaattctgtggattggcagggtggttgttctgcttcatgactccaggcagggtgtaagaatgactggatagcccgaaatagcctcattcatgtggctggcagcaagtgctggctgcccaggagctctttggggccacgagccaggggctgagttctcccccaagggttccaaatcatggctgcttgggctacctcatggcatggtggctgggctccaagaaggagctttccaaacagcaaatgtagaagctgaaggtctctaagagccaccattcttgccatatgctattgaccaaaatctgggttccagcccatgttccaagagagaggaagcagaccctacctcttggtggcatcgtagccaggtcacattgcaaagaaacatgccatgggagttacggttgtgacatctttggaaacacagtgtgctatgagagaaatttgaggaaccacaagttgcattcagaatggtggaaagtcggatgtgaagatgcaagtgataaaaatgctgcagcataagcagggttcagatcaaaggcggctttaccagcagggccacatgtcctgctttgcctgggacagacccaagctactcctgccaggacaagagtacattattagcagtgcccacttttactctaaaaataggactacgcagttgtatgatcacctatcttatttgggtgttcccaggagaaaccctgcagaattcgatttgaatataagaagtttacctgggagacaatcccataaaacaagcaggaaagtagagacatgaaacagggaaagggatggagcattatcaagccactcaccactgtgggcacctggaacataatcccaccaggacactctggaagacagtgcgagacatgcctccgagtgtcccaaccaaggcaggaggaagccagggcatctcgccacctcctcccatcctgcagtgatgagggctgcttcctgcggtactaactccccagcacttccagcttgtcccgtgtttacacccaacacactgctgaggccagaggaaagtgcagatgacagcgaatcgcagtcagtggttcctggagcaggactgaggtgaatgccgggcactgacagcatctgccatattacggatctatttataagccatgttaaggttttaatgttatcttaggggttaaaggaagtcaaggaaggatgttttttaatccatagaataacgtgatcagattgacactttagccagataataccatctgcagagtgcaaaatgcataacaggaagtgagaagctgcagggagaccaaattggaggttgccatggttatcacagaattgcacattgtaatgcacaaagcagctcacatatgtggagaaaatgcaatgtctttatctgtgtctgatgatgtcgtattccttctgggtagcaaaggcaaataagctaaacatccaggctggtttaaagctgattctgacttaatcatttcaaaattccttcctggttgtgctctgtccctcatgaataaaaatgttcagtttctcgaagagcctttcccgtcctctgcttctttctataaggtggggaccaggtgtacagaatataaaaggagacaggcagcaacatgtctagctttagcattctaatgataccgtgggcagggagagacctggatgcatgctggtccttgagtttgcatggccaggcatctgctggcctccagcccagtgtcctgtgtccctgagtgctcttctggccttggagcttaaatctgtggttgatgaacttagagtccctttctttgactcaggcagtgttcccagggagcacctgccatcctgccctttgcttacttgctgtgccctcaatctcccacttgagagacccctaagccctaagtctctttcgcatcctccgtctccccatggcaggttgtcgtcagctatcaagcagtgagggctttcatctaaggcttcatgctgcacgagaatgagatgatgcacgtgaggaccagagaccctgtcggcttactcttcttccctctctacatgaggcttggctgccccatgttagtacaggaccgccccccaccaccaccgaccccctacacagcaacctctccccagagccccagactgggaagcaaggcaagagccctaaacccttggtcccatccgtcatcctttagaaacccacttctgctctctgggccaaagcttagctctcgtctctcctgctgtatctcctccttttctcatagtcttctagggcattaagaaagaaaaaagaaaaaaagaaaaaaagctttgcttttacttcctacaaaaaaaaaaagcaccatctaacaaatagctccaaaactcaattgcttaaaacaacaattctatttttatcactaatctgcgggtcagctaagggccgaagtttctcttgtacacctctcgtcttcctcctgggaccagggagttagcatgggcatgtttttctctggcagagacacgagagaacaagccactcacacaagcactttccaggcctttggtcttgtcacatccactaacatctgattatctaaactaagtcatgtggccaaatccatagtcgaggagaagagaaacttgctttcccttcagtgaagaaaacagcaaagtcacatggcaaaggccacggatacagggaagggtaaagaattaggggccgccaatgccatcttccatacttaggaggtggatgcaggagaactctgtgacctcctcgatgtactaaaaagcctgagtaggcccggctcggtggctcacgcctgtaatcccagcactttggaaagccgaggcaggcagatcacgaggtcaggagattgtgaccatcctggctaacatggcgaaaccctgtcgctactaaaaaatacaaaaaaaaattagccgggcgtggtggtggtcacctgtagtcccagctactcgggaggctgaggcaggagaatggcgtgaacccaggaggtggagcttgcagtaagccgagatcgcgccactgcactccagcctgggcaacagagtgagactacatctcaaaaaaaaaaaaaaaaaaagcctgagcaaaggaacttggggaaatcattttattcactcaaaagtatgttcagtgctcacatgtaccaggtgctaggcacagaacaatggataaaacagaaatctcttatctttatgaaccatgtactctcatgagcatagacagaatgagaaaagagttgtgtaatataaatgttagcaataagtgctatgaagaaaagtaaaagaggcttagcaggaaagcatgttacaatggccaggaaagtcgtctttgagaaggcaatatttaagcagtggccttaacaaagtgagaaagctggctgtgtggacatctgctggaaaagccttccaggaagagagaatggcagtccaaaggctgtgaggtagggacacgcctggcttgttcaaggacaggaagaaaaccaacatggctggaatacagccatcaagggacagagtggcaggagacagatgaagtcagagggttagccagcagccaattgcacagatggagaccatcatggagagtctgcattttattctaaatgagatgagaaacagtagaaggttttgagcacataagtaacacaatccaatttacatattagaaaggtcattccagctgtgggatgctgtattaactgcagaaggggtgggctgatataggggcaggatggacactaagagaccatttcaaatacagttgtggagtccatgtgagagttagaggcacgtgcaccaacgcaacagcagtgatggtgatggagaaatctttggactaggaacacactgaagtcagagcccatagtatttggtgatcaaccggatgtggtgggtgagagaaagagaagtcaaagagcgtttcccaaggtattggcctgaatagctggcccagtggtggggctgcctactacaatgaggtaccctgggagagaagtagtttaggaactgtggaataaaaattaagacttccattctagccacattcaaggctattccatggatgcatagcactgaggtgcatatcagaaaccgaacaccacctgtaacacggccttttcctgtctttatctcccatctcctcctcaggcagatagatgtcttggcttgactaggacattgatcgttactgggaaaggcaaaaaagaaaaaagcctattgataaatgtcagaatatatctccattataaagtcattcaggtgttgcatatgaacgcaatgatgaagaagaacaaattactgatacacaaaacagcttggatgaatctctagagaatcgtgccaatggaaaaaaagccagtcccaaaaggttacatacccaatgatcccatttatgcaacatttttgaaatgacaaaattttacaattgaggacagattagtgagtgccaagggttagtgactaggacaggagggaaggggaaggaagagaggtgtggttagaaaaggaaaacaaggaggccgggcatggtggctgactcctgcaatctcagcactttgggaggctgaggcaggaagatcacttgaggtcaggagttcgagaccagcctggccaacatggtgaaatctgtctctactaaaaatataaaaattagccaggcatggtggcccatgcctgtagtcccagctactcgggaggctgaggcaggagaattgcttgagcccgggagacagagaagttgcagtgagccaagatcatgctactgtactgcatctaggtgacagagctagactccatctcaaaaatttaaaaataaaaaagagagattcttctgcagtgggaattattcattatcctgactatggtggtggatgcacagacctacacagatgataaaattgtgcagaatcacatttgcacacatacaagagtacaaaatctgaaataagatcattggatcatatcaatgttaatatcctgatggtgacactgtactcctgatttgcaaaatgtctccaatggggaaactgggcaaaatacacaggggatctctctgtacaatttcttacaactacatgtgattctacaatggactcaattaaagtttcaattagaaaaagcaataaaaagccgggcacggtggctcatgcttgtaatcccagcactttggaaggctgaggcaggtggatcgcctcaggtcaggagtttcagaccagcctagtcaacacggcaaaaccccgtctctactaaaaatacaaaaattagccaggcaagatggcgggagcctgtaatctcagctacttgggaggctgaggcaggagaatcgcttgaacctaggagacggaagttgcagtgagcagagatcacaccactggactccagcctgggcaacagagggagactccatctcaaaaaaaaaagaaaaaagaaaaggaaaagcaataaaagtaaaagaagaccaagtccaccttcttctgtggagccatttattcatgggatatttagtcagtgtctcctaggggctagtgccatccaccctgggggagcgtgagggacaggagagggacctgcagcgattaagccaccggttctacccattccctctttactttcctgcgctagccagtagagattaggaaatatgtgggaattattatttatttacagcttagaattttgtagttcttttagagtcattattgaagagaatgattaatataatacatttctttaaaaaggagctagagaaaatggggtagattaaactgcctgcaacttctctcaaggaaagtccccgatggcagcttatcgccttgtgatttatctctacctcctaagagtagaatgcagcaaaattgataaatgaacaaatggcaaatagttaattgaaatttctggtcagttgcctttgcgttttactataaggacagaagcagcaggaaagcactgatgagaaagctcattgaagtgataggtgagaaataatatttaaactgaagagaagaaattatgtcctgtttttcatatcctaaagaacatatagcgtagtcttaatgtccagaatcttctcaaggctgaaggaaatctattttaaaagaattcactcagggagttctagttcaaggctggcttctcattcttttttaattgcattgactttcattcttagacatttattgggctttattattattattgccttatagaatcataggaggccctaagaaataatttgttgaaactttgtcacattacagctgaggaaaatgaggcccagaaaggttaaatgaagccaaggtcacatagctggtacttcacaacgtttcctttttttttttttttttttgagacggagtctcactctgtcaccaggttggagtgcaatggcgtgatctcagctcactgcaacctccacctcccgggttcaagcaattctcctgtgagtagctgagactacaggctcacaccaccacacccggctaatttttgtatttttagtagagacagggttttaccacatgagccaggatggtctcgatctcctgacctcatgatccacccacctcggcctcctaaagttctgggattacagtcataagccaccacacccagccttcaacgatattttcaatataatatactgtcaatatcagaataatctttgcttatcacccaaatgtgtctttaacaaggacaataaataattaatacatcataacctgcaaacatactctcaatatctagataaaacagctgcaaaggcaaatcttgtcataagtgtaggctggaagaggatattttgaacattgagggtcaggctcaatacaggctctgtgtcagaacacctgcaattccagttgcctcacctgctcgaggagctttaacaggtttcttacaaatctcagcttcagttttcttaaccgtgaaatgagaatgatagtagtgccaatatcataagctttgttaggaagatgaaagatgctatcatgaatgtaaagggcttatcacacagcctggcacacagtgagtgtccagtacgtcttaggcagtatcattacatctaatctttgacttttagctaatacaaataaagaatggctgactccaatcctgggtcactcataaaaagaacactcaaacaatgaaaaactgaaaaaaacttttgattgaaaaccaattggtatcatcatctttccatggtttccaaaattaaattatttttaattaacaaaagcaacccccaccaaaaaaaatcatttattgttaaaatgtgatgagagatcagaagttctgttttaatcacatttttagtatttggttaaagaagattgtcaaaacacttatttctgtcccaaatcttcaactcacctgtctttgacacacaacatacttttgcatacccaattgttttgaaataaacaaacatttgaaagccaaaattctaggctgggctcggtagctcacacctgtaatcccagcactttgggaggccaaggcaggtggatcacctgaggtcaggagttcgagaccagcctggccaacatggtgaaatcccatctctactttaaaaaactacaaaaattagccaggtatggtggcaggcacctgtaagctcagctacttgggaggctgaggcaggagaattgcttaaacccaggaggtggagttgcagtgagccaccaagatcatgccattgcactccagcctgggcaacaaaagcaactctgtctcaaaaaaaaaaaaaaaaaaagaaagaaagaaagaaagaaagaaagaaagaaagaaagaaagaaagaaaggaaggaaggaaggaaagaaagaaagaattcttattattataacattccaaagtattccagaaggcatggaaaatttttgaatttcttatttatatacagttgatcattattattatacatttcatatttacaaattcacctactctctaaaatttatttagaacctcaaaagtagtattcttggtgcttttgtggttatttgcagacatgtgctgtgcagcaaacaatttgtcatcaatgtgtacattctcatttgaagtcaaacaaggtgatgcccttgccttctagtttcagctcttataccataaacaagtatcatttttgtagtctattcagtgccattttttttgcattcttgtgtttttattggtgattttactgtataaaatggcccctaagtggagtgctgaaatgctatctattgctcctaagcacaagacgctgcgatctgtcctgtggagaaaatacatctgttagatgagctgtctttaggcatgactgattgtgctggcagccatgagctcaatgttaataaatcaacaacatttatttcaaaactgaatattaaataagatacacacataaagcaaggtaatgtattggttggttgataaaatgttatgaccagatgcttgcaggaacctaaccctgtatttactttaggaacaatgttttagtattcactaattgagtgttagcagcaactgtatgaaacatagctactgcaaatagtgacaattgactgaattatttttaacctgcatcacatgaatatgatgatacattatgtttttatattattttgcagtttaaacagctcttccacagctattatcacacatgatgttcatggagcgttacagtttggctgtgtccccacccaaatctcatcttgaattgtagctcccataattcccacttgttgtgggagggacccgatgggagataattgaatcatgggggggtttcccccatactgttctcatggtagtgaagaagtctcatgagatctgatggttttataaggggtttccctttcagttggctctcattctctcttgcctgctgccatgtaagatgtgcctttcaccttctgccatgattatgaggcctccccagccatgtggaactgtgagtccattaaacctctttttctctgtaaattacccagtctcaggtacgtctttatcagcaaagtgaaaacagactaatacatggaggtaagaggagagtggttactgctcagcacactagattaacaagtccaactaaggctacccaggtagagcctggtcttctccttctggtttgtgaaatctcatggtgcttcctatagcataaagactggctgtcactcaacaccactgcatcttaaggtccgtggaaggggaacataacatgtttcgaagaaaaaggtctgggctacaaagaccctttatgtaatcttgctaacgacctggaatttaaactttggagagcttgaaggttaacaaattggaataaaaagaaatcaagtcactccttgtttgaatgctctgaagaacaaaacagaaaaacacaatgaaatggtaacagaagaagcagatttggcccaataagtctatgctttgaatgttcctccggcactaacatggccacatttgggaagactggcatccccacagacttttctgtagcactttgaaggaagaatagagcagttgtagaaaaacaaatgtttgcatgaaagaattattcacctcttaaaaatctatagggtgtgaataatcctgctataaaaagcattaaatgtttataacagatatttaatgggactgttatgttttttggcagcaagcatggctagattttgaatgtcacagctctgtgctctggtgataagacagactctgtggtctaagtaagaattattttcctgcttttaaatgtagctgttaaaaaacaataaagtgtatttatctaaggaagataatcttctaaaagaagtgtttaataatttttaattcacaatttatactacttctccaaggtaaattcattttccaactgttactccatctttattgactgggaggaattagcattcaaaatacaaactcagaggttaaagcaaagccatacacagaagtgagccttattccattgtcttttatcacgggtgccagatttatttaacagactgtctttcagtctcacttacagtaactagacaggtactatggaggacagtgtatgttgaatgccttccaagtgtgaaacacctgcctggcactacattatcactaattctaaccttgcaagtaagtgcctacttaaatctgcacttgacatgtgaggaaagaggctctgaagttttaaagtgacatgtgccaagtcatatagctagtaagtggtagaaccatgattccagggtgggtctttctgtgcttgttggtttatttactgtctgtgtttgttttatgaaagagaaaagaccctgagagataggcatagtacaggtgacccttgaacaacaggagaattaggggtgctgaccccctatgcagtcaaaattttgcatacaacttttggcttttcagaaacttactgccaatagcttactgttgaccagaagccttactgataacatgaacagttgataaagacatattttgtatatgtattatatactgtattcttataataaattaagctagagaaaagaaaacattattaggaaaatcataggaaagataaaatacatttattattccttaaatggaagtggaacatcataaaggtcttcatcctcatcttcttcacattgagtaggctgaggaggaggaagaggggttagtcttactgtctcagggttggcagaggcaggagaaaatctacatataagtagactcatgcagtttaaaaccatattgttcaagggtcaactgtgtatttatttgatgcttcagaaaggggaccatgtcaattcctgataaggttctctcctctttccttttcctccatctctctgtgtcgatcctagtgctctcatcggcttttaaccagtagaggtctccaaactgtcttgtggcagcctgggctccctatacacagaaagacctggcttcaaaattctggttaatatgggaagtgcattaggaagtagaaaggaaagaaaagtcaaacaataaggaaaggattaatataaatcataaattaattttgtgggcctaattactattttttaaaacactgtaagttttagtagattttcttactctaagttatagaagtcaaaccctaaaacacgttaaaaaaaatctttttgttatttcttaactattacggttattttatcaaaattaattaatatcaaattaatgataatacaaaggaagtcacattattaattaaacaaagtgacttagccttgcaaataaaacactatcgtgtggattaatagtttgaaggtttaactttacagccttttcaattgactgtaatttagagcatttttaggttcacagaaaaatggagcaaaaagtacagagagtttccatatactccctcacccctccccacgttatacatagtttctcttcttattaacatctttctacgtcatgtttttggtgttacatacttgccacacatagtaccctaataatctcttgggccgtacattctctgggtttggacaaatgtgtaatgacacagatccaccattacagtatcatagagagtggttcccctgccctaaaagtcctctgtctccacctgttcatccctccctcccctctgctccttgcccggtccccaggcaactactgatctttttcctgcctctatagctttgccttttccagaatgtcatataattggaatcatacaatatgtacccttttcagattagcttctttcactttgtaaaatacatctaagtttccttcaggtcatggcttgatagatcatttcttttgattgataaataatatttcagccttatttttgtaaggaaaaaatcaaatcaagaaactaaagtttgaacagccactatagaaaaaaaggcaaaagtcaataaacaaaaacaattgttcagcttcgctcataattgtatacacctcccagctcttggactaggtaacatcagtggccagcaagatgccaccgattgagtgattgtttttatttcatgccatgtgacccattggccctccttttcctgacacatttataatcatcttaatcccaaagcaactgtttttaacaaatatgcatatatcctctgattttctgttgctataacagaatacccaagagtgggtaatttataaagaaaatgactttatttcattcatgcttctggaggctgggaagtccaaggtccaggggccacttctggtgaggactttcttgctgtgtcatggcatggtggagggcatcacatggtgagaaggcaagaccaggtcaactcaggtctctcttcctctttctttctttctttttttctttttttttttttgaattggagtttcactcttgttgcccaggctggagtgcaatggcatgatgttggctcactgcaacctccacctcccgggttcaattgattctcctacttcagcctccggagtagctgggattacaggcacgtgccaccacgcccagctaatttttgtatttttactagagatggggtttcaccatgttggccaggatggtctcaatctcttgacttcgtgatcggcccgccttggccccccaaagtgcggggattacaggcgtgagccaccgcgcccaacctttttttttttcttttcttttttttttttaaagacagtctcacactgtcgcccgggctggagtgcaatggcacaatcttggctcactgcaagctccgcctcccagcttcaagtgattctcctgcctcagcctcccaagtagctgggattacaggcgcccaccaccatgcccagctacttttttgtatttttagtagaggcggggtttcactatgttggccaagctggtctcaaactcctgacttcgtgatctgcccgcctcatcctcccaaagtgctgggattaaaggcatgagccaccgcgccccgcctctcttcctctttctttaaagccaccagccccatcatagggacccaccgcgatgaccttatctaattctaattacctcccaaaggccccacctccaaataccatcaacatatgaatttagagattaagtgtccaacacatgaaatttgggggacacattcaaaccatagcatcttctttaagataatgtaaaactattaaattaaataatagagtagaaatcacactaataatttgtgggtctattcagattatatattacctaataatttttacctattttttgaaaattgttccaatcattccccctgcttccttttcaaaagagtcaaacatagccagttaatttaaggtatctgcaaaacctttccaccaagacttttatggtacagagaagtgactcataagccacaattcaattaaatttagcaaatatttcttggacaacaactacatgcttgaggttggcatggggacctgtttttaaacctcctgttcattctactttgactttttaattacaacagattaaaatatcttattcagcaaaaaaaaaaaaaaaaaaaaaaaaagagagaaaaacccactttgtatattgaatttttgaatacacaagagaagtgcaactcagggtggtgggattcctacctagcaggcctgtctccctttgattaccccaatattccaaaggtgcaggttttgtgcaccaggcactctaataggaccctatcagctcagcgctctcagaaatttcagttgtctcccagcccctagaaagtcacaatagctccagggttgtgcttaacgggccatagtgggaggatttggaaaggagaaggtgaatcttttctgtgaaaagcaggtggaggaaactgaagagtggggagaagagaggtggatgctgacctgaattgtgttttcaggagcaggaagagtgtgctctctgcttaagagatgacctgaatggcaagactacatgtcactcggatggtacacagatactgtcttgatgggagttttcggaacagatttgtcctcccagggtgaaatagcagagagatttgaggcagccctcaactagagtatgaccaataaacaccaacttacttggtttttttcattcctttttccctgtgtccaagaagcaaaatgataatgtaaatgaatacacacacactcacactcacacacacacacacacacaccccatgttggggaggcgggtaaaggaacagaattgctctcagcaaacactggtggcatcaaaatagccaatcatgctgatggctgccacacagctcatggaagccttccacaggccagctctcttgctgttggctggctggacttcccagctcagtccctcacctctttacaggacaaggcacaccagaaaccaaggctgttgggggaggcagcaacagagaccagacgttccctctgcacacacatgatgtcatcaatagaaactctgctgatgatgaacccactttcacacaaaccttttaaagcctgagttattttttgcaatgacaaaaataacaaaccacatttttttaaatagcttccttaataataatggaaattcaggtgacattaatgaaaattgtagcacatgttcaaatcagaatctatgttcagtgttatatgcagaatataaagggatttcttttctcaattgatagaaaagggaagtcatatttaagtagtcacggtatcctagatttttaatatagcaacataattgaataatattttgatgtatctggttttagtatttaaggtgataaaatattaaatttaagcttaaaattaaaaatagaggaaaaagaaaaacaaattgaactgaagtgaaaatgtttcttgttttttaaaaaatcattgtacataacagttttcaccttcacttttagaaatcaaagcacaaccctctatcacatggtaaagagagtcagccatacggaaaaccaagctgattgttctattcctgtgcaaattctaaccctaaaatatttctctataatgctttaagaaagaaagtaaatctggaaaacattttttatcattttgaaagctgcctttgttttgattctcattgtgaaggtcaaggataggagaatttccagagatgggaatttatcttcactttatgctatcatttcagaatgaatagtgatcaggttctaaataatgcattccacaggtgtgagcaaccaccctatcactttctatcttcatgtggctggtgcctacaacactaaatttctgcggcagattcattaaggtagttgttcattccctgtcgtaattagacctcccatttcagccttttatgtcaaatccatcactcaccctggcactcaggctcacctctttacaaagcccttccctggtgctattctggctctaaacacaggtgataaatgtgtcagcatggggcacattcctgtccctgaggaccatcaatcgttaagtacagagagctttttccagcagccttctaagatttatacccatgaggatattatttttgtggctgcatgaaggagaattattacttgaaatgggttttgtgaaaggatggttttggtgttgctttggcaccattttaagcttcttttcacaaaattgaccggcgcaagtcagaatttatacttctatgaatgtagatcttcaccatctgatggtgctgagtcctacagagaagaggatttgagactttccagtttttagagatctctacgatgtgcaagaatctagatattcagaggccgtactgacttcaatcacatggtaaattagtatatgagagttcgcagtaataaaagaagtatgtaagtgatcagcatgtgttttagtcagggttctctagagggacagaactaatggaatatatatataatatatatatatataaaatatggaatttattattaagtaataactcacacgatcacaaggtcccacaatagaccatctgcaggctgaagagcaaggagagacagtccgagttccaaaactgaagaacttggagtccaatgttccagggcaggaagcatccagcacaagagaaagatgtaggctgggaggctaggccaagtctccctcttcacatttttctgcctgcttgtattctagccgtgctggcagctgattagatggtgcccacccagattaagggtaggtctgcctttcccagcccactgactcaaatggtaatctcctttggcaacaccctcacagatacacccaggaccaatactttgcatccttcagtccaatcaagttgacagttagtattaaccctcacagcatgggaggtaatgcgtatgttaaatagtttcatttagccatttcacaaggtatacagattccaaaacgtcatgttgtataccacaaatatatgaaatttctacttgtcaatttttgaaaaaaaatgtttaaaagaagtgtgtaaataacttcttactttagatataaaatcttaagggccaggaaaagggcaccaaaatccagcctttgacatctcagaagaagcgatgattaatttcatttcattctgttggtttccatggagtggtgctgggtggtgaggcaaacacagcagcaggaatgttaacatttcatattttagccctaggagtaaagaaaaaaaacatgtcccagatcagcactagctagaaccaggaaaccccaaaagcaaaggtttttttgttttgttttgttttgttctgttttttgtaaaagacaggttttcacaaaggaagttttccaaattctatgtataagagagttgagaaggaagatttttctctcttcttgcccaggaggacaaagggaagagtaccacattaagccattcaggtaaagtgaagcttattgaacgctgtggattaggataaaactaatagagttttcatttttaagccagttcagatattcagattaattatggacgtaatgtagaaaataccaatttctgcaagttctacatttcatgtgaaatcccaaagaggttaaagctgatgggttttaactgatgaaaacacgtgcctctgattaaaaatgtttgtagtgatgaaaacaaagcatgctagagttacagtgtgtagcatgctgaagccaccagcagagcttaggggacaaaaacaactgtttcctaagagaaaaagaggctgagtatcttaagcctggggaagggaaaagacagtagttagcaagctcaggttagccactggtattactctacctttcatgagactcttcactggggaggttggggagattcggtctcacctaaaggagagatggctcgtgaacccaaggatgctgcagggaccctggccaccacttgcagcccaaacactagaatgaggaccagagaacacaatctagctgcttcccatccatcccctccaccccaacatctggtctcagcaacttcctctgccctacactgggatgccctccttagttgatctgaaccatgcagcagatgaaacatgttggcctgacaagtagcagatggctataattgcctgagccatctacaccggcaaatttttcttctttatttgcatatgagtaaaatttttcccagtgttaaattatggtgtgagtagagattttttgagggagcacagcgcagttgtatagacatcgtgattgacaaaaaataaataaaataaaataaaataaatgaccaaaatctgctaaatgaatttgaattaaattgttctaatgctttctttttctttgtaactcttcaccaccacctcaatacatgcattcctggacattcacgcatacactcacacaaacacaagcatggtattttttgtgtgtgagacactgaaggtagcatgaaatagcaaccaaaaaatctgcagtattaaagttagatatgacttggtttgacttgcaaatcaactgcctcactagtaagatgacttctggtatatggatatgtctctcagttttacaggcttgttttcggattaatggtaatagatgtaaagaattgggcacggtaagtcaatagtcaaagctattcaacaaattgaggacaaacaaggaaatgggttaggaattggtctgtagccagtctcagaaatgttgtattaacctttgggatataatcccccaaaattaaagtatagtgattcatccaaaagtacaaagtgttactagcaagatggatgaggatttccatctaacatttttcatcttcttatccctgacacattattaaaacacctagattttggtaaaagaggagaagtcatgtcttggacaggattgaaggttgtgtcaacattccctatgctttcaagtttcagctttagaatccaaaacccccgggcacagtggctcacatctgtaatcccagcactttgggaggtcgaggcaggcacatcacttgaggtcaggagttcaagacaagcctagccaacatggtgaaacctcatttctactaaaaatatggaaattagccagtcatggtggcgcattactataatcgcagctactcgggaggctgaggcaggagaaccgcttgaacccgggaggcagaggctgcaataagccgagattgcattgcaccactgcattccagcctgggcagcagagcgaggctccatctcaaaaaaaaaaaaaaaaaaaaaaaaaaaagaatctaaaccctttggttcacagatggaaggaaaaagcaggcggtgtttcctattctatgtgtatgccatgcctcgagccctgaacaggctactcatctgtggccaatattatattataacctctccattctcagaaggcacgctggcacccatctctgcaagaaaggcatcaaattgtctgtaagtcacagaaatgttattgtattgtcctttattcattcattcagaatatactctctaagcatctatgtaattaaacattactaagcttacatataattaacctcgaaataataactaagcattgttagttttatgtacggctaacttaagaaataaactcactttctagttatcagttttggaaaacaaaagagctctataacaattttgaattaatcaaaaattggagaattctgtgcaaacctataatccttccctctttagggtgaaggagcaacgctttgtgttacttaaagacacactttgccattgtgattaactataataacttttaaaataatcaaaaaatcagtccactttcttgtctatttgtgtattgatcactaaaattattgtacctagtatgatcaactttgtatattactgtatttcattaaagcagctaacttctcttgtccagacataagagaacactagaagacaaaaaacaaaaaacttttatgaatctcttttccttacgaacactaattttataccattttaacatacttgaggtggcaaaaataaacatatatatattatatcatccaaaagtatttgcatattttattaatctattgccattctaagaattcagggtaagttaaaattgtgttaccaaccagcatttattttgcatctgtttcactcttgaaattgtctaggtttcaaagattattaactaattaacttcaccatttgtctaaggtcttaaagttagttaaggatcgagaaatcacaatttttgcaaacataatgaatcctgacacccagcacttaaaaattttacaaaacttaattcttttaaaaatccattaccttttcatttaattgactataattatatgtatgtatgtgtatacattttaaacaagttataaaatttgtgatgatccacttataaaaacaatgtaggaaatttaggaacttaaatgataagaaatttatcattggtctcgtacaaaccaaagtattattctgatattatttttatatgataaatgaaattgtaaagaccctaagtcgtgctcaaggctcttcttctatcttgaactaaggttttcttcttatcttgtaactatagtaacaagggctacaaaagaagcacagcttaatatttttccttttagacatttttgactactaatatggtacagatattcctaatgtgcactcataatgatagagtgaatattttaatcaattttttttttttttgagacggagtctcgctctgtcgcccaggcgggagtgctgtggcgcagtctcggctcactgcaagctccgcctcccgggttcaccccattctcctgcctcagcctcccgagtagctgggactaccggtgcccgccaccgcgcctggctaattttttgtatttttagtagagacagggtttcaccgtgttagccaggatggtctccatctcctgacctcgtgatccatccgcctcggcctcccaaagtgctgggattccagacatgagccaacgcgcccggcctcaattaatttttaaagcttcccaaaagaggataaaagaggaggaaaggaatagaaaaaaaagcagtgatagggacccaccttcagacacttaagacattatcgctgtaaaaagcaagggtcttccctctgcaagaagaggcactaaatgtttagattcaggaaaacccactgtgacatatatacatgcaaaagataactcttacagctggtataaacaattatttgggccttgaaattcttatcaagtaacatgtttaaaagccagactttattaatcctcaaagaacagaaatgtagaaaacagcatttacaatgagccaaaaactctctctttttagattgcaagacaggtatctcttcatgaagctttctccaatttttgttctcaggcaccactcaaatgaacaatcttgttcatgtcaaaaaggtccccaaaatagccactgcagttcaaaattatcctgtgaaattggctaggcatggtagctcacatctgtaatcctagcactgaggtgggcagattgcctgagatcaggagtttgagaccagcctgggcaacacagtgagaccccccccgcccaccatctctactaaaatacaaaaaattatccaggcatagtggcatacgcctgtagtcccagctactcgggaggctgaggcatgagaattgcttgcacccgggggtggagttcgcagtgagccaagatcacgctgctgcacttcagcctgggaaacagagcaagactctgtctcaaaaaaaaaaaaaaaaaaaaaaattatcccgtgaaattctgccagttaaagacacaagcatgtcagttaaggtgatgtgagaaagcaggtatttgtttcatagaaaatgcccagttttaggatggatcagacactatgagcactgcaatagatcctcccacacgatggtgcccgtgcagcctactttcgtcaggacttggccaaagcccattccagggtcagacaatcccttctgatttcaagaagcctaatctaaacaaagcagctctcaggaaaagaacaagaccgacgaaaaagttcttctaagggttcgaaatcatgacccaagtcaaagtttattcaaagaatgttgattgtaggagaacttctgaactcctaggcccctgagccagctcaagaactgacttacctggcttatgctcattgtctccctagagaccttttgttttagagataaagaacactcaagacactgtacaagcagacagtccataggaacatatatctgtagactggtaaacagtatcaccaaagaacaataaaaatcagatcagataaccaaaaagtcactggtaaccttattcctaggggaagaaaaaaaaagagagggagatagagaaaaggaaggaaggaaggaaggaaggaaggaaggaaggaaggaaaaacacctaaagtggaaggacctcagcagaatatggaagctcagttcagcatgaacttctcctagcacgggcagtgtggttacatcagacagctagagacacaaagggtctcaaataagcacactaaaattggtgagtggagggttcccatccaagactgtagggctcacagatgaatattgatggatcttcaaatgcagagattaattacagccactgaccactaggagcccacctgtagtagaacaaatgtgggattcttcactcattgcatcatgggagattgctcattatggagaaccatagaggcatctcagtaagaggatgctggaaagagggtgctagaaagtgctattcggttttcagtaggtgatttggggagagttaaaaaaagtaggggtttgttctagattggatactgtcaggaagcaggtaattctgtgattgaatatcttaatttttttttatcttgaagacagtagagaaaaacagctgtagttggtaaagaagtagaaatgatgtgtattaggctgagaaggggtatgttggatcattttcgtgttctggccagttttcttttttcagtgctgagacatgtctcatggagtgacctcttctttgcctttccccatgaaggtcacggaatgaccttgtctgatgttgagttctgtgaaatggatcaccccaaacagaagcacacatggcctggctgtgagttcccaaacagctccccacgctcaagagctgcttttctttctcattctcaattaaggattgaaggaggacacaaaaacacgatcaccaaaggaaaatgaaacaaatttaaagtaaataaaactcagcaaaaagaaaaactacaggaaaagaaaagtaactgtaggaaacaataatgacttagccctaaatggcatttacgtggtcttaatcatatgtgaccttaatcctataaaaaccaaattgtgatctaactccaagtccaacctgcctattttagaagggtagttggatggtgctagtggatggtggggaggagagtagaagctaactcatcatcatccgtattggtaagtgaatagataatgcctaaaaacatgtcatgaaattgcaatgtcaccacatcatttggagatacgtttttaagtcagcctaaagggttgaaaatgcttctaggctggggcaacgggagggcagagcatagaagatggtaatgattcctgaccatccttcaagaactatctttctaattttttccatcttctcctccctgctttattctagccacactggcagctgattagatggtgcccacccagattgagggtgggtctgcctctcccagcccactgactcaaatgctaatttcctttggcaacaccctcacagacacacccaggaacaatactttacatccaaccaagttccaaggattggaacaatacaatcaagttgacactgaatattaaccatcacacacagacatatatacatatatatatattttttagacagggtctcactctgtcacccaggctggagtcgagtggtacaatcatggcttactgcagcctgaagcctcaacctcctcagctcaggtgatcctcccacctcagcctcccaagtaactgggactacaggcacacaccactacaccttgctaatttttgtattttttgtaaagatggggtctcactaagttgtctatggctggtctcgaactcctgggctcaagtgatccacccactgtggtctcctaaagtaagtcatggcacctggccaactttttttttttttctttttttttgagatggagtcttgctctgtcgcctaggctggagtgcagtggcacgatctcagctcaccacaatctctgcctcccaggttcacgcctttctcccacctcagcctcctgagtagctgggactacaggcgcccacgaccacgcctggctaatgttttgtatttttagtagagacagggcttcaccgtgttagccagaatggtctcaatctcccgaccttgtgatgtgccctcctcagcctcccaaaatgctggtattacagatgtgagccaccacacccggccccaactttttaaaaatattttttaaagaatgagtagaagtagccaggtgaagaaaagaaaaggaaacagagctgggaaaaggtgtgttgcatcagaaactagaggagggcatttcgcctggaccagagaaagttctgatgagccaggaaggctgggcagagccagctcaggccaggcaggcgcgattctgcacaggacaggatgcacctccaatgaccacgtgtttctaggttgtttccaagggcacacagataacagtcaacgatttttttctgactagccactgtagtgatcgctgctgtgtgaccctccacactttgcttccctcgggcctcagctccgcctcattccactggcctaataattaactcagccttattttcccaacctaattgtttcacagaccaaaagaaatattggatgtaaggtacaatttgaaaagtgtaatgtgctctagaaatgcataaaatgatgattagtctttgcccagtaggctttttagcttaataagctcctgataatacagaaatcactgtgagcaactggcagagaaagatttttccatttctcttaactaagaaaagagatttaaagtcactttggagagctaacactaaataataataactgccaaaggaattgatttgatgctgaatataggcttgtgtaaggaggtaaaaaactgtccactaaagttaatgctcatagtaagaggcctctgtccttgaattcaccttgagagagttgaacagggataacggattttcaaggacacacatctacagagaaagggcgtatggaaatggaaaagggaaagctgctcctagtgtttttgctgaattgttctctttctctaacccagcaggagagatgctaaaggagattttgtcaaagaaaatccttgacattggattcttaaaagccttatggtttcatgataggccctttaccaaggattcttaagggacaaccttatgttagagagaaacaaagtcctgaatcatatttcctcctctctggaatatatgtagaaatacaagtgagaagataaatacatgtgtaaaaagaaaattcatactttcatactcgttatatgttatgattaaatgttgattgcatttggagagcatcagcatatgaactatattacagaaaggatagtcttttgtttcatggcttaaatcttcttttctcaataagattaaggggctagctaagattataatcataacaattttttttttttcactgagtttccaccctgtgaggaacactaggctaagcaggaaaaaaaaaaaaaaaagtcactaaaagaccctaggctatttgtacaccaatgttcatagcagcattattcacaatagcaaaaaggtggaaagaaccaagtgtccatagatggacagataaacaaaatgtggtctatacgtacaacatgggtgaaccttaacattgtgttaagggaaataagccagttacaaaaggacaaatactgtatgattccatttctatgagatacttagaggagttgaaatcatagacacagaaagtcagatggtgactgccaggggctgggaggagggacaatggggagttgttgtttaatgggtatagagtttcaattttgcaagacaaagaatttccagagatgggtggtggtgatggtgcacaacaatgtgaatacacttaatgccactgacttgtacatttaaaagtaggttaaaatgggccaggcatggtggctcacacctgtaatcccagcactttgggaggccgaggtgggtggatcacgaggtcaggagtttgagaccagcctgactaacatggtgaaaccgcgtctgtactaaaaatacaaaaattggctgggcatggtggcatgcgcctgtaatcccagctactcaggaggctgaggcaggagaatcactggaacccgggatgcggaggttgtagttagccaagatcatgccacttcacttcagcctgggtgacaaggcgagactccgtctaaaaaaaaaaaaaaatatatatatatatataggttaaaatgtccattttatgttaggtacattttactgcataaaaaaaaaaaagactatgggcaagccatttccttcctctgtgcctcagtgacattatctgtgaaataaatgtgtagaaacagatggactccaaggatgcattcaactctgcaagtctgtgtgtctaaacatcccctctgtcctcatggggtttagcagcaagttggagagatgaaatgcagtaataaaatgtaaaatacttctagttaatgttttaagtacccaattagtgattttttaaaaaggaatatgtattcccttgagaagggatagagcagaaatctggaggacagctttgtggagatagaactggaccatgcccacttcaagaagtatgtagctcggatgtggatctgtgccagtgggatggccttaacaaaggtgagcaggcttcaccacaccagggggtccgtagaacagcaagaagatgagcctgttggtggtagaaggcttctgcgtcaaagtgaagcattgaggaggacccatgggtgactttgagggactctgaatggaagagagtggatggacgagacacctggcctatccacaaactggccctatagccttgaataatcactgggacctcagttcctgctgtatgacaccaaggctagctcctttacaagacggaagcacagcctagctgatcttgctcttcctgctggaaaactccatgattctctttgccttccaggcaacagacacataagattcctgctgccaggtcactgctggatgctggactccagcagtgacaggccccgaacctgcccttgtgaaggccactttcttagtggtggtggctcatctagcaggctgaggaatgtacaaaggatgtgtaagaaaatctacctagcagtagggtatataatgagttaaagaactgagcttctactggcaatgagaccagccagggtaatgttgcaaaagtttagatgtacattaagacccagaagggctgaacttggttaggggagaggaacatgaaatgaaaagtctaatgcatgaaccctagaaccacatgaatattaaagctcacactgaagtatctgtgcctccttctcccttgccctgccctttttcagcctcccaaagctgcacccattcctcctgtgtccccaatatcccctatgccatgtgatgtggtttgactctgtgtccccacccaaatctcatctcgaactgtaatccccatgtgtcaaggggggacctggtgggagatggttggatcatgagggtggtttgccccgcgctgttctcaggatagtgagtgagttctcacaagatctgatggttttataaggggctcttctcccttagctttcgcttctctcgcctgcctacttccccttccccatgattgtaagtttcatgagacctccccagccatgtggaactgtgaatcaattaaacctctttcctttataaattactcagtctcgattattctttttttttttttttttttttttgagattgagtctctctctgtcacccaggctggagtgcagtggcaggatctcggctcactgcaacctctgcctcccaggttcaagcaattctcctgcctcagcttcctgagtagcttggattacaggcgcctactactgtgtctggctaatttttgtatttttagtagaggcagagtttcacatgttggccatagttgatcctgatctctcaggagatctgcccaccttggcctcccaaagcacttggattacaggcatgagccttgggtatttctttatagcagtgtgaaaatggactaatacaccatggtaactgggtcccatacatcctgaaaatactaatagaacaaatattcccactcctgaaatttaacttgatcctgaagacgaaggatttccttgagctcataaatggaagtggttcatcttccaggtagagaatgcaaggtagattggttttgttcacaggggtcatgcagagctaagcacatagaaggtgctcagtaagcacctgctgaacatactgaagtgacatagccaggcagagacgggtaggtggacagccaacacgccatgagagctggaagggcgcatcctctcttaggagcttgggccctggccagctgactcagcttcaagctctgctagtacataagtccctcggggcctataagcttggccgtgttgcagctgaaatttctgctgaataaggtcatacatactaagctgagaatgcaatagtgagaatggctccttctttttcgcatcccagaccccagaatagaaatatttaccatcacgtctggatgataatatcaataaattatcagacattgcacgtattaagaaaagctcattttctggaaattgtccttattgtcctaattgggaattatcttgaagccgtggatagaaaatgacctttcagattgctgggacaaagcccaagtctaaattggaaacgtgtttaatggctaagacagcccacttccagattaattatggatgcttttccatttcaagattacattaggaaggaaagttgtcactgggtggaatgtgagtctccactgcatccttttaagataaataagttgaagtttgaagaaaatttgagattacttttggttaagtgaataaaatctgtttagcgaactctttgaagttgtggattgcctgggaatctacaaatctgcaacctccctccctctagatacattcagagggtagaagagaagtcatttaaaaccttatgcttgacttcttgcttcctgccttggtttttaaccaaaactaaaaataaaaaagccaaaagagaggaaacttgataggttcaaaacaggaaattagattgtaagcaaagaaattgtccaaacatcgaaaaaaggaacacatcaaagaagggaggtgctttgtttttatactttgttatcgtcctggaaaaaaatgtctgctgcctctgataatacatattaacacttcttttttacttagcttttatttttatcaaagtaataaaatcatcttgtttaaagtgtcaaatagttctatatggcttattaggataaacaaccatccaattttcaagatttttttttcctttggcatttgtctttaattctctaaatatattcacctgctacttgaggggtcagcagacttttcctgtaaagagcaaaacaatgagtattttaggctttgagagccatagagtctctgttgcagttactcacctctgctgttgtagcacaaaagcagctgtgggcaatatgtaaatgagtgggtgtagctgggtgctgaaaaaactttatctacaaacacaggtggctgcacagtgggctgtcctttaccgtctcctaggctactccttgagtttctgtttttagtcagtcactgttaggtgactcctgactatggaagatgaggattaggctctttcacagccaacaactctcctccatggcctcctcccctccatgtttttcctttaccttcacccttccaataggatggtttactggctttggatagatccgtatgcagtgtttacatcatcatgcttttcataactgaaccatataatagagctgtgtttccagccaggcatggtggttcattcctataatcccagtgctttgggaggcacaggtgagggattgcttgaggccaggagttcaagatcaacctgggcaacatagtgtgagatcctgtctctacaaaaaaaaaaaaaaaagacattaacttggtattatggtgcacacctgtagtcccagctacttgggaggctgaagtgggaggatcacttgagcccaggaattggagactgcagcgagctatgatagcaacactgcactccagcctgggtgaaagaccaaggccctgtctcaaaaaaaaaaaaaaaaaaaaaaaaaaaaaagtttcctttcctacacactattttgttttccttaatcattatattgttttcttcatttgcttaattttttgtgaactaattatgaattgaaactcaagctctctctcaattttaaaatcttccctcaacatattgcagccaatataagaggaactcaccatttcattttcttggaaacttctaccccagagcattctggctggataggccttgggcatctgtattagtctgtcttccttctgctataaagaactacatgagactgggtaatttatgaagaaaagaggtttaattgactcgcagttctgcagggttaacaggaagtctggctaagacgcctcaggaaacttataatcacagcagaaggtgaaggggaagtaagcatgtcttacctctgcaaagcaggagaaagcgagtgagctgggatctgccacatacttttaaaccatcagatctcttgagaacccactcacactatcatgagaacagcaagggagaaatccgcccccatgatccaatcatctcccaccaggaccctcccctgacacatgggattacaattcaaggtgagatttgcgggggggacacagagccaagccgtatcaccatccttgcatctctcttctccatcatcatagataacctgggcctccggatggcatgagatccccctcctacccggcttccatgactttctctttgttgatctagtcccttttttaaaaatggagccatccttctgtagcttcctgagaaagaatgaacgggaatcacattttctgaaacattgcaagtctgaaaatgtctttattctccctcatgcttaattgaaatcagactgaatacagaattctcatttagaaattatttcccttcacaagtttgaaggaatttgtctattgtcaatagtattgctctcaagaaattcaatgccattttcattctcaattctttatttgaactcggtgtttttctctctggaagattttaggttcttattcttctttgttttctgaaatctcatgaatattatttgatgtgggtctattttgactctttctgttggaacacacatggggccttttaatctggaaagccgttcttgaactctaggaatagattttgggggacaatttcttctttcatttcctgttctctcttcccagaatttgttattcagctatcagaccccatggactgatctgttattttcttatattttctttcatttgttcaatttctttggctgttgtttcccctattctctgaacaatgttctcaaatttacatttcataaactctcattgagtttttcacttctttttttatgttctgaatttccaagagctctattttttgttctttgaatgttcctttttttaaatcatctgttctcatttcatgaaagcaatatgttatctctcagaaggtattaatgacggttttctcccaagtgtttcttttcctactcagcctctttttccttcaagtagctttctttggttggttggttggtgtgtgtgtgtgtgtgtgtatatgtgtattttcgtttgtttttcttttttcttctcctgtgtttgagacatgtcctcaaatgcctggttcccctttagctgacacccacatttaagattgaggcactacaaatatgactgaaagttctgtgcacacaaatggggcctgtcacccgtgggcttcagtggctgagttgtttcatcgggaagcccctgatgttgcatcactgagatttttgtcttgggctgattgaaagctccagagaagaattttctgccctgttgcctggagggtagacacctggctgtcactgttctcacagctaagaaggaagaggactgcgaggttcaagattcagtgtgtaaatgttgactgaagatccctgttttcagtacagagcccctgccgtcctatgcctagagtcctccaactgagagtctctgtgtccttcccagagaatacatcgttcctcttctgccagagtgaggggaggacagatgcctggggtagggatctggggatataaatgttcttcacgagcttccagtgagttcttctgtttttagcttcacataaacacacatatccagtggaaactcttgccatcaactgcacaaataatgggcggctttgcagtgccaaccgggctacttctcagcactctccacctcagtgcaagcatctgtccttggatatgctgccacttaagatggttctgctgtttttcagctctaaaaaggttgttatcatcccctgcctcatgatttgttcttacaccttcgtatatcttaacacttcattccccttttcacgggctttatgaagaagcagtggtaaatgtaggtgctcaatccaccatctttaatgggaatccttcagcacttctattttagaaaaaatgtgaagaatatacatagagactgggcatggtagcgcatgccggtaatcccagcaatttgggaggcggaggtgggcagatcacctgagttccggagtttgagatcagcctgggcaacatgacaaaacccacccatctctacaaaaaaaacacaaaaattgcccaggcatcgtggcacacacctgtagtcccagctaatggggatgctgaggcaggagaattgcttgagcctgggagatggaggttgcagtgagctgagatcacaccactgcactctaacctgtttgacagagtgagaccctgtctcaaaaaaaagaatatactaaacactcatttcacaatattcttgacttattaaagctggagtcatggcataatttccaatttgcttttcaaaagaattaattgatcagctaagaaatttacaagtaatttttttcaaatagtgaggtcccttagtattaaaatgaatttcatgttttaatactaggtttttcctcccacgcagtgaattttcttcttgctttaagaagaaatgctctggagagaatataaaattatatatagttgtgtatgaattatatgtcataggattacatataattatatgtaaatataattacaattataacattaatacatgttcactgcagaaaacttggaaaaaaacaaagagtttaagagaaacttcataatcaactgtattctcaacaactacagaaagcttaaccaatgatttgtccgtatccatggctaagaacgaatgtacctacacatctgtgccatttttaaattggcattttttaaaaagtagatccaattttagaagtttgaaatctagtttaaaagcctagattttatttttttccattttaacctatttatgtatttatttatttatttatttatttatttatttatttattatactttaagttctggggtacatgtacggaacgtgcagttttgttacataggtatacacgtgccatggtggtttgctgtacccatcaacctgtcatctacattaggtatttctcctaatgctatccctcccctagccctcccaccccccaataggccccggtgtgtgatgtccccctccctatgtccatgtgttctcattgttcagctcccacctgtgagtgagaacatgcagtgtttggttttctgttcttgggttagtttgctgagaatgatggtttccagcttcatccaagtccctgcaaaggacgtgaactcatccttttttatggctgcatagtgttccatggtgtatatgtgccacattttctttatccattctatcattgatgggcatttgggttggttccaactctttgctattgtgaatagtgccgcaataaacatacatgtgcatgtgtctttatagtagaatgacttataatcctttgggtatatagccagtaatgggattgctgggtcaaatggtatttctggttctagattcttgaggaatctccacaaagcctagattttctagaggaattcttctctatacagggaaacattgcagtaatgagtttaagtgcattgattctttaagcacatttgtttgttgaatgataagactattgtatgtagttcacatccagccccctacacaactgtcacacacaatgaccttcacagtgattcatgcctgaacaacattgtttcctttgcctttaggcttgcaattgggaactcattttatttgaaccaaagccttcagtcgagatgaaaattttcactcacgtctgtgtgaagagaccaccaaacaggctttgtgtgagcaacaaggctgtttatttcacctgggtgcaggcgggctgagtccaaaaagagagtcagcaaagggagatggggtggggccattttataagattcgggtaagtaaaggaaaattacagtcaaaggggggttattcgctggtggcaggagtgggggtcacagggtgctcagtaggggagcttttgagccaggatgagccaggagaaggaatttcacacgataatgtcatcagttaaggcatgaacaggccattttcacttcttttgtggtggaatgtcatgagttaaggcaggaaccggccatctggatgtatacgtgcaggtcacaggggatatgatggcttagccttgggctcagaggcctgacattcctgtcttcttatattagtaagaaaaataaaatgaaatagtggtaaagtgttgggacggcaaaaattttggggggtggtatggagagataatgggcgatgtttcttagggctgcttcgagcgggattaggggcggcatgggaacctagagtgggagagattaagctgaaggaagattttgtggtaaggggtgatattgtggggttgttagaagaaacatttgtagtgtagaattattggtgatggcctggatacgattttgtataaattgaaaaactatacggaataagagaaggagaaaaacaggtattaaaagactaagaattgggaggacctaggacatctaactagagagtgtccaagggggttcagcataattacttacttggttggcaagtttttgggctctatccttgagttttttatgttgtcatacaccaggccagattgatttaggtaaaaacaacactcttcatttaagaatatacagagtcctcctttttcagcagtgagtaagtcaaggcctcagcggttttggaggacaactgcagctaaagagtcaacttgggcctggaggactgataaagtttgtgatatgtctgtgatgctagcagagaagtcattagagaggctacggaaggtcgtgacagaggttgaaatgcctgctattccagtaccgagagcaatagtagaggcagaaagtcctaaaccgacaagcaagggaattagtggaataactcttttttgtcgtgtcggtgtcatgaggggaacagggagctcttcggtcctatttgcaaattgaattttgggggtaaggaagactagtgtgcatgtgcctgtccaattagcaggtagacacatgtaggtagaggatccacagacgaagagaccttgtgcgaggcaaaactggagatgcaaagtaaagagaagcagtgctgaaaggggtgtcttgtacccagactcctaggtatccagctagggtggcagccgtcagaggttgtaatggggattgatgaagtaactgcgtagagggggaggttcgatttacatggtgtgtgagaaaacgttgagtatctacgagcaacctttcactgttattttcggggctgggtataagtaaacaagaagagggctttggagatgaagagtaaaggaacatcgagaaggtgaaagattacctaagggaattccagtaggtctttgctgagagatacataaaggagcggccacaggaatagtagtttgtgttgtgagaggtctaaatatggggggagtagagttgatataaggagaaaggtttttcaagtaagtgtggaggagggtggcagcttgctgatgtgaaatgtctggggaggtcttgctggacctgtctagaaagtaaatgagttcttcaggagggtaaaagtgagggctgttaaaggaagtctggaggtgtagggagacaggaggtgttgcctagtctgcatgtaaggtggggacaactgtgtaggccctggaagaaagggaaatgcaaagccagtggttgtttgctaaggagggattagaaacggctaggagagaatgagtaaggttgatagcgtggtggagatagctggggagaggtagagggtggcagaggaatgggaatgagaataaaagtgagtataaaagtaaagaatagaacttcgtcagggtgaaagtactggagggtcccctgccagcaaagatcatctatccactctaagagggagttaagagttgccagtcctgggcgggggcaaatcctcgagcttgatgtgtagggaagggagggggcctgaataatccctgaagagtagcagaatagcagatggaagaagttacttccttgaggatagatttccacgatggaaagaaaatgagaggttctaagaggcaggctagtggcttgtactatagcatagcctgcctttgctggtgtgtggcgattaggcctggtggaactgccatcaataaaccaagtgtgttcagggtgaggaacaggaaagaaggaaatacggggaaatggggtgaatgtcaagtggatcagagagatacagtcataggggtcaggtgtggtatctggaatactgtgtgaggccggattgaagtctgggccaggaacaatggtaattgtgggagattcaacaaagagtgagtacacctgaaggagccggggagcagaaagtatatgcatcaggtgggagaaagaaaatagatcttggaagttatgagaactgtagacagtgagtttaacacagtttgtgattttttgggcctctaaaagtattaaagcagtggcagcagctgcatgcagacatgagggctaggctaaaacagtaaggtcatagttgtttggacagaaaggctacagggtgctgtcccggctcttgtgtaagaattctgaccgcactaaccatgcctaggaaggaaaggaattgttgttttgtagaagggattggggtttgggagattagccagacacgatcagcagggaaagcacgtgtgtttttatgataattatgctgagacaggtaacagatgaggaagaaatttgggcttgactgaagtaatgggagctgtctgtgaagccttgcggcagtacagcccaggtaatttgctgagcctgatgggtgtgagggtcagtccaagtgaaagcaaagagaggctgggatgaagggtgcaaaggaatagtaaagaaagcatgtttgagatccagaacagaataatgggttgtggagggaagtattgaggataggagagtatatgggtttggcaccacagggtggataggcaaaacaatttggttgataaggcgcagatcctgaactaacctgtaagccttgtctggttttaggacaggtaaaatgggggaattgtaaggggagtttataggctttaaaaggccatgctgtaacaggcaagtgataacagactttaatccttttaaagcatgctgtgggatgggatattggcattgagggggtaagggtgattaggttttaatgggatggtaaggggtgcatgatcggtcgctaaggagggagtagtggtgtcctatacttgtgggttaaggtggggagatacaagtgggggggatgtgaaggaggcgttgaactgggggaaaaggtggcaatgaggtgtggctgtagcccaggaatagtcagggaagcagataatttagttaaagtgtctcggcctaataagggaactgggcaggttggggataactaaaaaggagtgcttaaaagagtattgtctaagttggcaccagagttggggagttttaagaggtttagaagcctggccatcaatacccacaacagttacggaggcaagggaaacaggcccttgaaaagaaggtaatgtggagtgggtagcctccatattgattaagaaggggacagacttgctctccactgtgagaattaccagaagatcggcatccgtgatagtctagggggcttccgaggtgatcgggcagcgtccgtcttcagccactaagccaagaagatctgggaaggagtcagagagccttaggccagagttccaggggctctgggagtggctgccaggtgagttgaacagtccgattttcagtggggtcccgcacagatgggacatggcttaggaggaatcctgggctgcgggcattccttggcccagtggccagatttccagcacttgtagcaagctcccgggggagaaggttctggaggaatccctggcagctgcagttcaggcgtttggagttcttgtgtgctggagatatggctggggtttgtctcacagtggaggcaaggaattgcaactcagaaatacattgctacttggctgcctctactctattattgtacaccttgaaggcaaggttaattaagtcctgttgtggggtctgagcaccggaatttaatttttggagtttatttaatgtcgggagcagattgggtaataaaatgtatattgagaataagacggccttttgaccttttagggtctagggctataaagcgtctcagggttgctgccaaacaagccatgaactggactgggtttttatatttgatgaaaaagagcctaaatgctatctgatttgggataaggaaaaggagcattaaccttgactatgcctttagctccagccacctttttaagaggaaattgctgggcaggttggggagagcttgtcactgaacgaaactgtaagccggactgggtgtgaggaggggagatgataaaaggattgtagggtggaggagtggaggctgaggaagaattggaacctagctcgacctggcaaggaggggagaggtcagatgggtctgtagaaaaggaagattagaaagactcagcgacacttggggttgggactaaggggacaggtgggagggaaagaaggaagatttgggacaagttgcattgggaacagagactagggagggaccgatgtgtaaaagagtgcctggatgtcaggcacctcagaccatttgcctattttatgacaagaattatttagatcttgtaggatggaaaaattgaaagtgccattttctggctatttggaaccactgtcaagtttgtactggggtcaagcggcattgcagaagaaaataaggcatttaggttttaggtcaggtgtgagttgaagaggttttaggtttttaagaacacaggctaagggagaagaagggggaatggagggtggaagcttgcccatagtgaaggaggcaagcccagagaaaagagcaagtagagacatggagagaaggggtcggggggttcttgccccctagaaaagcggtacttgccgctgagggtgaaggagaaggagttggggggttcttgccccccagaaaagcagagaaggggtagagacatggagagaaggggttagggggttcttgccctccagaaaagcggtacttgccactaagggtgaaggaccaaggcaggcgtccccgtgtggtcagatgcctctgaaatgtgggtgaataatcaggcaggcgtccccatgtgattaaacaccaagggaagactgtcttccccagtccgtgaccggtgccggagttttgggtccacagataaaacgtgtctccttcgtctctaccagaaaaggaaaggaactgaaattaagagaagggagagattgaagtgtggcaccaagattgaaaggagaaagaggttgagggatagtgagagaggttggagaagagagtaaaaagaggccgcttactggatttaaaattggtgagatgttccttgggctggttggtctgaggaccagaggtcgtaggtggatctttctcacagaccaaagagcaggaggacaggggattgatctcctaaggaagatcccctgattcgagtcacagcaccaaatttcacttgcgtccatgtgaagagaccaccaaacaggctttgtgtgagcaacaaggctgtttatttcacctgggtgcaggcaggctgagtccaaaaagagagtcagcaaagggagataggggtgaggccgttttataagatttgggtaggtaaaggaaaattacagtcaaaggggggttgttctctggcgggcaggagtgggggtcacagggtgctcagtaggggagcttttgagccaggatgagccaggagaaggaatttcacaagataatgtcatcagttaaggcaggaacaggccattttcacttcttttgtagtggaatgtcatgagttaaggcaggaaccggccatctggatgtgtacatgcaggtcacaggaaatgatggcttagcttgggctcagaggcctgacaaaaatgttgttaattgctctggttatagacagaatagtagcaggaataaataatcagaaacatttatggattatatctttgttgatattttaaacctatcagttacctttctagcctaatgagaatgccttgataaagccacattcttggaaattttggttttcataaatgtgcttgggttttataagtcctgctttgcctaccacttgaccaaattccctacagacttttttatataaacacctatggttaagacaaaatgtgttctttcaacaatgtacagcttctgagagtaatgtctaggctggagtatattcatatatattatttatgctttcatttaacaaacacatgctgagatcctactttttgccggacttagtactgattgctctctcctgagcatccttcttaagtcaaagagaatattcattgttagggaaggaaaaaaagatagagggaaaaaaaatagatggcaagaacatggcaggaacccagtcctgaacacccaggggttttcagaataagggagaggttaacaatctacatagagcaactgggattaaaaatgggaagctggcttcatggggggaggaatagcattaggagatatacctaatgtaaatgacaagttaatgggtgcagcacaccaacatagcacatgtatacatatgtaacaaacctgcacgttgtgcacatgtaccttagaacttaaagtataataaaaatatattaaaaaaaaaagaaatgggaagctggctgccaagactgcaggaagactgtgtcagattcagagcatgaccatcagcaaggtaaatccctactgcccacagtcataattggcaccagactctaggaaggaattatatatttacgtggtgcctaatggggatgtgaggatctcagagggagaaaactaggtaggcacaaataatacccgcacaggccttatttacacctattttatgcaaagttctaatagaaatcattaactggtttcctagcccttgcaagatccaacacaaattagtagaatgttctagaaggaatagaagtaaaaatatcaatcacagtaagaacaggcagctagatgcatattggcaagagggcagataaatagaaagatgtgagaagtcaaaaatcctattgcgatctcattttgcagggaaccaaagatcccaaatagctctctctggaggcaccagtgtatatattattaaagactcagcgagaaaagacaattcactttaagacagcaaataaacaaataaacaatgtggagctgccattcccaatccatttatctggaatagttcagcctcatttggcaatctgtattttttctgaagccccacggggtcattaaaaactccataggtcccaaatgtatttgcataatgatagatgccatccccctgcctgacagtaaagaagcagcaatttaaaaagtatgatgccagccaggcacagtggctctcgcctgtaatcccagcactttgggaggccgaggtgggcagatcacctgaggtcaggagtttgagaccatcctgaccaacatggtgaaactctgtctctacaaaaaatacagaattagccaggcgtggtggcacatgccagtaatcccagctactcgggagactgaggcaggagaattacttgaacccaggaggcagagtttgcaatgggctgagatcatgccattgcacttcagcctgggcaacaagaatgaaactccatctcaaaaaaaaaaaattcatggtattattcttttgaggaagcatactagaaatcaagaatcaggccaagtgctgaggctcatgcctgtaatcctaatgctttggaaggctgagatgggagggctacttgaggccaggagttcaagatcagcctgggcaggacagcaagactccagtctccaaaaaaatatttttaattaaaaaaggaccagtcttattaaagtaaactgcagtcctgttactgatcttagtatcaaagcaatgttagagcccacgtgggattcacacctcctagagttcacagcacaagtttgctgtaacagtagataaggtcttggttgccctgagctcatttcttttttttttttagacggagtcttgctctttcgcccaggctgaagtgcagtggtgcgatctcggctcactgcaagctccgcctcccgggttcatgccattgtcctgcctcagcctcctgagtagctggaactacaggcaccacgcccggctaattttttgtatttttagtagagacggggattcaccatggtctcaatctcctgacctcgtgatccgcctaactcggcctcccaaagtgctgggattacaggcgtgagcctccgtgcccggccctgccctgagctcatttctaaatccatcttcctccaaggtggtggcaagcatgcttctttatcccggagagatggccctttcatcaaagtctcattcagacccttctccttttggaatgcttttcttgggaggttggctgggatgcctactactcttgaggatctgcctctgatagagcctagatcttagaatcaggagagtttcttgcaggcccatcagttactgtgaaagatacctgagctagttggctcacaatccacatccatcaaaccgccccctgcagagaagtcacccggctgtcgcctgcttggcttgccctgcctctcgccattctcatttcattagcaatgcgaatgttcacacccttcaatgtgcatatgatgggtgttaatgagcataacacatctgtgaagcgtgtgtgatttttttgcctaataaataggcagtaaacaagaggaagggaagagctactatctgggggcatctgagaaaacaaaaagcaagcaaggtatgagtcagattgattgttcagtgaatcccaaagggccaaaaacttcctaaactggttttggtgtttctcactaggtgtttggacagcttggaacctggatagtcccacctacccaaaagcattcaaattaggcatgcttttaacaaagcaggtggcatggcatgtaaattgtaggaacactgttaacctttgcaaatgagtttcgtggtccgaatggataattacatatttccctccattaggagctacaaactcatcaagattctacaaccaaccggctcttgagtttcaatctccatgtgacaaggggatttattatgagagggcagagagaaaagaggaacaccgctctctttctctgcaatggaatgatggtcagaaaagaacagatcaaaggaataaacctgctctcctattaactcagcttaccaattctggcctacattttcaaagttatcagtaatcaaaacattgggaaaggaattacaacctcttctcctgaaagtttaacaacttccccatgaagcactgcttttgattgcattacaagctattcctgaagaatttatgacctaagatactctttgtcaatgtaggccatttgtccatgagtggagtgactgataaatcagctattaacatagataagaaagcatatcgattgagtcaactttgtgtttaataatatgctagacagtaatgatgcctggaaaatacactctgtaattaagtacttttccctttatatttcatgaagactcttgtatattttattctggcaaaatagattgtgactaacatctcatagaaaagatcatcatattgtgatcctatatctttatcataaaagtgaatttgagggaaatttttataatttttcaatataaaaattattaagatatcaaaactctttgttttttcactactccaaggtttatttcatcatcttaaaaaccttgtgaatacaatcagtctgctaggtcaggggtcaccaacctagggccatggacacctaccgtggcctgttaggaaccaggccacacagcaggaggtgaatggcagacacgcaattgaagcttcatatgtgtttacaactgctccccatggctcgcattaccacctgagctccaccttctgtcagctcggcagcaacactagattctcataggagcacaaacccgattgtgtactgtgcatgcgagggatctaggttgcacactccttatgagaatctaatgcttgatgatctgtcagtatctcccatcacccctgagatgggaccatctagttgcaggataacaagctcagggctccccttgattctgcattatagtaagttgtatagttatttcattatatattacaatgtaataataataatagaaataaagtgcataataaatgcaatgtgcttgaatcatcccaaaaccatcccctactcccctagtccacggaaaagctgtcttctgcaagactggtccctggtgccaaaaagattgcagaccactctgctaggtagaactgcattcttgtgattatgtattttaatgagcgcatttccttttcatatggagaagggaaccacattgccttaattccccaacttctgccccaaagctttctaggccaatatggctgcattcgagttgctgatggctgtgctaccctcccagggctgatgtacagtttcctgcctgggccgtgtcaccaatcactagggtttaggaggctatagtcagatcttgcagaatatgtcagtctcattctctgtagaattttttgtttgcctgtttttttcttctctttggcactggactatgggcagtggcagttagtggtagatccagggtggagagctgagacctaacaaagaatttttttttctttttttttttttttttttttttttgagatggggtctccataggtcacccaggttggagtgcagtggctcaatctccactcatggcaccctccgcctcctgggttcaagtgattctcatgcctcagccacccaagtagctgggattacaagcatgcaccaccatacccggctaatttttgtatttttagtagagatggggtttcatcatgttggccaggctggtctcaaactcctgacctcaggtgatccgcccgcctccgccttccaaagtgctgggattacaggcgtgagccaccacacccagccaacaaagaatttttaggttcccactattccaccccacctgtgctagaccctgtggtgacaacaaaggtgaaacagacatgctgactgtcattaaaacactgacaatctaaactaagaaagatgaaaaaaattaattgaatacccagtggaaagtaagaaggaatagttttaacctccttaaaatgcttttgattgcattataaactattcctgaagacttaatgatccaagatactacttgtcaatgtaggctattcgtcaatgagtggagagactggtaaattggcagttcatgtgatacatacgctttcagagtaaagagaggtttcttctaataatgagaggagcgcctggccagagagacccaggaaacatatgcaaatactagaaatagccccaagtagcaagtgtggctatagatggtacacgtgaaggagagtagtggggttagaccgtgaagccacgaagaaccaggttaaggaatttagacttttatttggtaggcagtggagagatgttgaatttttttttcaaacagtggagtacagtgaggaaggcaggagactttgcagaaggaaatcaggaattccaaccaatgtgttgagtgtaggattctaaatccagcacaaaaaaaccttcaaagcagcagggaaagggtttggctctgattcagcctcagtggttatactgttgccatcagggagctgggcttgggggtggacagaggctggtggcagagggagggatggagggacagagctgagtttttccaaagcagaagaagacggttttgcaacctagcacaccatctgggtcagatttatcaaacaagattatttgttgacagaccatggttatttcccatttaaaggaagcaatacatatattgtatccaaaatggctccccaaaagcagcgttgagctgatgcaaaagatcagtccattctcccagcaaaagagcagtctcttgacatcccaggtaggagggattcatgtatttcacaaaatgtgtccaatgcaatcatcaggcaaataatattttaatgttttcttgacatgctgagagtaaacttgcttcgatgcactgtctccttctaggcacattactctggagtaaaagaagagaggaaagagacagaggaaagaaaaaatatgtaatcacatatgaactgcaaaagaattctagctgaggttcttagaactataaattcttctttttttttttttttctgagacggattctcgctctgtcacccaggctagagtgtggagtgcaatggcgtgatctcagctcactgcaacctccacctcccaggttcaagagattctcatgcctcagcacccgtccccctcccccaccccaactagctgggattacaggcgcacaccactgcgtctggctaattttttgtatttttagtagaaatggaggtttcaccatgtcggccaggctgctctcgaactcctaacctcaggggatccgcccaccttggcctcccaaagtgctagtattataggcgtgagccaccgcacccagccaagaactgtaaattcttaaaatttgggaggaaccatcaagaaagaaagcctaagccttgtaaccatatgccaacctacattggtctactccctctgccacgctaggcatttcacactctcgtacactctgagggaaactcgagaaacaagtgtaataagaaatattcccgctagagcatggcagccataagctaccaaatttttgttataaaatagaaatatacttctagatgtaaacatgtatatgcttatatctaacctctctaggataacttttgtaagtggattttaatataactaaaactggatgctaaagaaatagccctctcttaaagttgtacttgggcacgtctaggatcaaaaagttaatagttttgtctgtgatcaaggagttaattttttgctgcaatatgtttacatctaacattcttttgagctatccacaatctggttatatatcagtttatccaaccttatttctcctttcctacttcaaagacctccattcaagccgttctccaagctcttgcctaaataagtagttttgttttgttttgttttgttgttttttggggttttttttttttttcaaattttttcctcacttctaagtttcattcagggactacctttccccacttcccctcatcattctctttttctaaaatctatccatccttcaaagcccaggttgaaatttgtcctcttcctgaaatcgccccaaaaatgtgccaaatcattcagatctctgccatctctgagtcttataaatcaaattcttagtggcattcatttgactaagaataataaatacatcactattgttataatcaccataatacctggtgctgttgttagatgctttacctatgttacctcttatccagacaatcctgtcctatcacccccattttacgtgagaagaaaccgaggttcataaaggttaaataactagtccaagttcacatagctagcaagtgacagtcataatagtggttcagacccagaaccgactggcttaaaaatccatggtccttcttctgtgccatatggcttcccaattatggatttcttttttttttttttttttttttttttttcagattgtgatttaggtttattcttttttttttatacttaaagttttaggatttcttacattactttttaacaaacgtattttgtgcatgattctaagaggtagtacactttttttttttaattgtttgcctcattttcccaccatgcctacttttcactttgctgaacccgtatagagtgtctggttaatgttagagaaattgaattgaattcctgacatttgggcccttttcttgagttcctcttctttgtccatagatgaatcatcccattacatctaactccgttggacagcttgcttcttcctcaattgtatgtgaatagttttcaatccactttactaaaatctaatagtcaccatctgtgtctgctatataaatgtgaactcttgaaaacactaacatttgtgggtcagaaattagaggacagtaaaataaaccactggaactgtgaagagggaggaggcgtgaagaggcactcccctctctgctgtctgtgggtcaacctttccggcctgcctgtttctcaaactgagtgagacttgtctctgaagccccattttttttttttttttttttttgagacggagtttcactcttgcccaggctggagtgcagtggtacaatctcggctcactgcaacctccacctcctgggttcaagtgattctcctgcctcagcctcccgagtagctgggattataggtgcacaccaccacactccactaattttttgtatttttagtaaagacggggttttgccatgttggccaggctggtctcgaactcctgacctcaggtgatccacccacttcggccccccaaagtgctaggattacagacatgagccaccacacctggcctctgaaaccccatttaattttccaaatgaaggtgatgtgtcccaggcatcatacataggcaagaacccacaaagtggcagaggagcaggagcaaaggggcctgggcaccccctggaaagtcatcatacagctttactcaactgtcaccttctcctggccttccttgaccactgtttttaattgcaaatcccactgcatgatgccctatccctcttccctgacttattcttctccataactcacattttcaaagcattctatgcatttcaccaaattgtttgtggcccttctcctcccaccagaatgtaatttcaagagagtagggatctgaggtcgggcgcagcggctcatgcctgtaatctcaacactttaggaggccaaggcggttgggtcatttgaggtcaggagttcgagaccagcctggccaacatggcaaaaccccatctctattaaaaatacaaaaattagctgggcatggtggcgggtgcctgtaatcccagctacccaggaggctgaggcaggagaatcacttgaacctgggatgtggttgcaatgagccaagatcgtgccactgcactccagcttgggtgacagagtaagactccatctcaaaaaaaaaaaaagagtagggatttgggtctgttttgtactatgctagatacccagcacccataacagtgtcagacacataggacatgtattgaatgaatgaactgatttataagcagaatatttaagactgttgagaagccatacccattctaatcaggcagagcagaaggttaaaaatccacaacgcttacttttgagttgtgttgaaaccattgaaaatatctgtgtcaaactgattaattacctcggtttacagaatcagctttttaacatacatagcaaattctatatgctagccaatggcaagccagatctcaagcaaggccattcttgtaaaataaatggacagatttttgtcttttctattgtataagattctaaagccttgaaagcagtaatatagaatctccttaaatacaaatttaagcatcttttcacgtttatggcctcagtgcctgtttataaaagtagttttgtaagaaaaacagtgtaagaaaaacatctaagagtagatgataaagacctatccttgtgtgaccttcagatggaaaagcatagatttaatctgagattccagaacccacctagtttttaacttcatttgtttgtctaacttaagaacgtgagtcacaactaacaaagaccatctggtgctgttcttccctcctaggagaatgtctccagaagtaaataaaggagaatcttgtccatgcaagctactctcagttccaatagaaaaccatttcagcatctaattcagagagttgcacaggagatggccaaaggcactatctgccatatgtctgcgtctccagcccagccatgaccccaaaccaatagatttatttttaggtagtatcatgtaaacatagaactttttaaactagcaagttggggaaacttcatgattagtcaatctgctagcacatagcagaagctggtgggtgccttcccagcagccagctcctctttctcctacctcatagcaccccagttattttcaggcatctaccctcctccacacagccaagaacttcagggaggctatttccttccccaggcccaaggagcacagcgtggaaggggaaagagagaggttcatggacggctctaccatgatgccatgtgtctgctagtaaacttctactgactgactgagcatgccccaggtgaaataccctccagtacctccttctgtttttggacttacctgttgtctttctccaacctggagactctcaacccttactgcaaattactgccacgtggggagcttttaaaaacctgcagacacccaagtgcacccaagagagcctgtttcaatggacctatgcaaacaggtttttttttttcattaagttctctgggtgattgtaatgtacagccaacaatgagaaatgttatactaattccattactttgaccctgtctttgagatgctttgggagagcttggcgctcaggaccatctttggggatcttttccatcatccagagggaagctggatcttagagtctggcctctcggttatgggtcctgatgttttttcattgtgtatggtttccatgatctgtcctctgcaataaaacagacattgctttctatatgtaattctactcatccttttggggtctctcttcgttaccatctgcccttccatcttgccatctcactcctcactcccatgattctggaccaaactaaccagcattcctaatctagtctcttcttgaaaggatttgaaacggggaagcagctcttcaggaaagaaaataaatagagcaaatgggccgggcatggtggctcacgcctgtaatcccagcactttcggaggccaaggcgggcggatcatgaggtcaggagatcgagaccatcttggccaacacggtgaaaccccgtctctactaaaaatacaaaaattagccgggcatggtggtgggcacctgtagtcccagctactcgggaggctgaggcaggagaatggcgtgaatcagggagatggagcttgcagtgagccgagatcgtgccactgctctccagcctgagcgacagagcgagaccccgtctcaaaaaaaaaaaaaaaatagagcaaatggaatgaagaacctctgtagggctgtgttgatttaaggcagatgtgggccacagttttggtgttcacacccaggtaaacaaggcagcttccttctgctcatacacgtgctcccctctggaagagccaggtttgcaacgggctcgcagtggctttctcatcctggcagcatccagtttcttgtggacgttgctgcatcccaaccacctagcagattacacgaaggagtgaaatacctaccactgaaaagaatgaacccacagagaagggtggcctcactgctcccaggggctgctgcagtggcccgtgggcagctagactggcctgcaggggactgaccctggtggacgcctgagtctatgtgccaccatctaccctgtgataagtgtagctccgacatgatgtacctttgcctgttgatttccaaggacaattattttagcatttcaaaattcagctcaagtgctggacgacttctccctgagttttgctgtttgccagcagcctcctcttggcatgctccctttccaacatcctcactgaacttgttactattaccaccatgtacttagagaatgcaactatcaagtgctattgaacacaccttgttttgtaaaaaccctgttgtaaattgcctccttattcctctgttccatggccagtcaaatcacaccctcatgtaaatagtgacaaagacatattacccaacttcaaattccagacacctgagtcacaggtgttgttaccactaccccaaaccacaaagtgggattatgtgtctcctagaaccgtattataatagacactcactgtcttgcaaattgctcctaacttgggtagaatattttgtatttattacttttgaaaatctatgggtttctattgcctggaaactcaaggattacagcagaattagagaatctggtctctggatcacagatccccccactgccctgcaccgcccccacccctttctcatggagacctaatcatctccacactggatccactcacatggatcttctgaccttgatccagagtttacaggtaaaatgtccacctgaggacactggtttctgttttgacaaaggtagttagggccttggaaagttgtgaaggaatggcatatctcccagaaccctgacttccatcagcatcttattccaggagctctgaggaaacctctaaggcacaagtgtggaaataaagaccacccagatgagaacacgcagaggctatttattcagagcttgctgtagcaagagagtcagccatcgtcacttgtgcctggcagagactctgaggcaagcggggagtgggaaagctttcaggtggagagaggggaaggctggggtgtgccggggctggagcttgttggcccgggaaagctggaggagggctgcctgacacaggaggcatcctgtgtgattggtgaggggattatatttggctccctctggttggcctaaagttggcagcagggacaaaattagggaatctggtatcaattgatcatttggggccagcttcctggaatgtctgctgcagattgtgggtcagcgtgctgttgtcgcatatggccaagctgttgtctgtctgtagattccatctcttggtgttcaataggccttggggccatgaacttgtagggagggttttctcaagacctgggttatggaaccagcattgaggttcacagaactcacatccaccctcaaatcagggctgggtcacagacagtttattcaagtgctccaggcacctgtcccagggtcattctccctagaaagacccaaacaagctgggcgcggtggctcacacctgtaatcccagcactgtgggaggccgaggcgggtggatcacaagttcaggagtttgagaccagcctgaccaacatggtgaaatggtgaaaccccatctctactaaaaatacaaaaattagccgggcatggtggcgcacacctgtaatcccagctactcaggaggttgaggcaggagaattgcttgaatctgggaggcggagcttgcagtgagccgagattgtgccactgtactccagcctaagcgacagagcaagactctgtctggaaaaaaaaaaaaaaaaaaaaaaaaggcccaaaccatcccagggaattcagttcaagccacttctccctcactgtgttctccatgctgctgcctggggctgctggccccctccctgtctgcaacggactctgacccctggaccaggacacccagcaggctccccaggaccacagattctgtctgaccttggggattctctggtgtttctgaaaattgctgaaagcttccagtggccattgctatgttatttgctagtcggctaaaaagttaaactccatttttatatggtctagattagaagagaggaagaaacactccagaggcatcagaggctcaagaaaatgcctagaatgaagttcagaccatcaagaagtccccggtggctcaggcacattcactgtttgttcattcctctgacagtcacggacagccccctgtggacaaggcatggtggcgggctggggacagtcttctactaggaggatggggaagacctgagaacagtgcaggaacagaaggaacaaatgtgcgggctgtgggtcacagtataataggaacacaggacagaggctgaagatggccccaggatttgagttacgaggccagtgctgtgctattagcaaccaaggggacctggaaaggattggaaggggaaggtcttgaggagaggctcctggtaggttttttctgatcaatagtcccaagggtcaaaaatatcaacagtgacagtcagtgctgggatcattctccctcacagatctgaacccttgagtatgttgattttaatgacagggacgttctttatccagccttatgcctgaccaactctgattcatccttcaagtgaggagatatctcttcaccctcgaagctttccctgatgcacaccccccgggccagggcctgccccagagctccccactgccaccatcacttccccagtgcaggcccttacccccgtctggcctgttgggcttattgactgaggcccccaccctccccagccagcagcatgcctgccccacaaagctatccagcaaatacagattgagacacaaatggatgaaagacatggaaggaatgtatggatggaatggagggatggagtggacacatggaatggatggatagatggagtggatggatggagtggatgggtagaatggatggatggagtggatggatggagtggacggatggagtggacagatggaatgggtggatggagtggatggatggaatggatggatggaatggatggatggaatggatcgatggagtggacggatggatgtaatggatcaatggagtggatggatggagcagacagatggagcagatggatagagtgaacagatggaatggatggatggagtggacagatggaatggatggatagatggagtggacggatagagtggagggatggagtggacagatggatggagtggacggatggagcagacgggtggagcagagggatggagtggatggatgaagtggacggatggagtggatggatggatggagtggatggatggagtggatggatggaatggatagatggagtgcacggatggatagagtggatggatggagtggatggatggagtggacggatgaagtggacggatggaatggacacatggagtggacggacggagtggacggatggaatggatggatggatggatggagtagatggagtggatggagtggacggatggagtgggtgaagtggatggagggaatggatggatggatggatggatggagtggacggatggaatggacagatggagttgatggatggaatggatggatggatggatggagtggagtggacagatggaatggacggatagaatggatggatggaatggatggacggatggagtggctggatggaatggatggatggaatggacggatggagtggatggatggaatggacggatggaattggatggagtggatggatagagtggatggatagagtagatggatggaatgaacgcatggaatgaatggatggaatggacagatggatggagtggatggatggaatggacggatgggatggatggagtggatggatggatagatggagtggacggatggaatggacagatggagtcaatggatgggatgggtggatggatggatggagtggacagatggaatggacggatggaatggatggatggaatggatggacggatggagtggatggatggaatggatggatggagtggatggatggaacagatggatggaatggatggatggatggagtggacggatggagtggatggatggagtggatggatggagtggacgcatggaatggacggatggaatggacggatggaatggatggatggagtggagggatggagtggatggagtggacggatggagtggatggatggaatggatggatgggatggatggagtggacgtatggaatggatggatggatggatggatagatggagtggacggatggaatggacagatggagttgatggatggatggatggatggaatggatggacggatggagtggatggatggaatggacggatggagtggatggatggaatggatggatggaatggatggatggaatggacggatggagtcgatggatggagtggatggatggaatggacggatggagtggatggatggagtggatggatggaatggacggatggagtggatggatggagtggacggatggattggatggatggagtggatggatggaacggacggatggattggatggatggaatggacagatggagtggatggatagaatggcctcctctttgtctaaaacccccagtagctacgaattcccccaacaactactacacactgccctgcacatgatcacgttcggtaagttgtgtgagagggcaggagggagaaaatggagctgcctgcctgcctcacgagcacctttcaccattttgatcacatttccagatgcagcaccaccctctgctctcacttctttcctcccagaccagggaagcattggatggtggttcatgaggtgctggaggagctaaagaaattgctgtcatcgttttgtcaaatccagggcctttatgttttaaaatagatatacaaagagatcacattttacctggtaaaatcatgacaaactgagcggacaaaaaaaaaaaaaaaacctataaacatttggcacaacagagcaaaaatcataattcctataattatttttaaactgtgaaactattgtagagcattgaatagatgtatattaaagccatgtatgctttatttgcttatgacatgaaattctggtttctgtgtgttccaccttcctattttattcttaggataataggatatgatgtgatgctttactcatagttagagggagaattgactgtgaatgagcagttcagagagaaaggatcttgggcttggcaagggcaggggcctccagcgttttgagaaaaatgaattgagcctcagcttattttataaaaatcttgacccagagcgtggcccttctgaactcccaccatgtttatgcatggtaatatattaaaaattggacttagctagtagccaaatacagtgctgtgttctggatactaaaacaaactaattctccctgctaagtaagaaaaatttcacacattatcgtcagtcagacatggaaagaggttctccaggggaagagagagaagcaacatcattcatgtgatttaaaattacaccaggccatccatttatctgcctctcaggctgtttgtccttttttgaacgatgcttcagggctccacgctggaaacggggagggtggatgtagaacagcttgtcaatgtaatcattttactataaatctgcaaaaaaagaaacagagcctaaaccaagtataaaataggatcacagaacctcctatgagcaactttgtaagattatcctttctagtgtgagtactaccacaataaacatgatgacatatcctttatcactatgttgcccaaagattttttttcagatttcagtggactcctcccctgccactcttaacagccctgctcctccaaacatagctgtatggagagagatgtccatcacagggatgtttatacaaaaacatcaaaacactcattttttcaggctggaaacggtggctcacccccgtaatcccaacactttgggaggacaaggtaggtggatcacctgaggtcaggagttcgagaccagcctggccgacatggcaaaaccccgtctctactaaaaatacaaaaattagccaggcatggtggcacacgcctgtaatcccagctactcgggaggctgaggtgggagaatcacttgaacctgggaggcagaggttgcggtgagccgagattgcgcgactgtgctccatcctgggtgacagatcagattccatctcaggaaaggaaaaaaaaaacactcattttttaggtgaagttaattgactgggaggactttatggaacattttggttcttttcctactgctgaaatttgaatagaaaggcatgaggtaacctcatgccatcactacgaaaggctaccagaaatgatagaaaacctcacacagtatcagctacattggtggagtccacctgaatcccagaaattcagttcaacaatgtcactgagttcaccagactactgggaaagggattcatgtagagacagttgtaaaaatattgaccctaacagagaaagattcactgcagtcagaagagatgccacgaagtcaggtctcaactcctggagaggctctttctgtgctgtgcaaaaatgtatgtttatccgacttcccaggccttgaggtacagcaaggaatgccagtgttggatgttctacaagtgaggacactggagcctcaagaaataatctgacttgcacaactcctgtcactgattagtggctaaggacatcctgatttctgctccagaactttccccatgacatcagtcttcccatccttgaagagttttcagttattcttagcgtgacaagtgattgctagagtttgtgtaattttcatcataatgggactaatgacccacaacagcagttctagtgacttccagaagatgttgtacatccccatcctaatgaatggcagcagcatgacttacgttcttttatcagagagtctagtttgatctgagttgtgtctgacctggaattcaggcatgtctggggctaggaaggttttgggttcgaggaggctgttttcatgagggatcccagggtctcttgggaaggaattcactcaagggaggacagaggcaagagaagcacagttcactctcggggctgaaggcagcatgggttttaggtgcagcctggtgacagtcaatcgggtggcctaccatgtagtgattaagactttggaaaagcaggctataagcaaaaatctaaatttgctacacaataacttggcaagacaatggagcagtggctggcaccatggaccttggtaagaaacactagaaaagttaggaaaaggggtttttccaggtcagagagagccagtgcatgctggtggacccacagttctgtagctatgagaaatagccccatctggttgtgcaggaaccacaggctgcactagctgctttagttgtgaccgcagaaagcaccctgccccagcatggagcaccagggcctgcacacctttgccaggccccagaagcactgccactgccatgatacccaagaagagagagattagcaagtgctttgtaccagaggggagggctgcccatgcaaaggcctgcctgggggaactccagcaatcattgggggagactttgggagagtggagagaaggggcctcctgaaaagacacagccaggggaaacctactttcatgatatcaagactctaattttagagggcagtgtttgcagatcctaccaatgactctttgtccttgagtctgtgtttgaggtggaaccactcaaagacggggaagatgaggcacctggagccaggcgcctggtctttgtgtctgcacttagccaaattccctctcagctgtattgtgtctggaggaaatagaagcatgactaagctgatttgtattctgccaaccaagggaaaatataattaacacggcagcaagactcagcaaaccccatgggaaagtccaagaaggaaagagctcccgtggctcaagatgatgtcagaggcaaagagaggccaacccactctaatcccacagcaggtctcctctctaatacctcaactcataaagggaaaagacaatgaaatccaggcctgccatgcctttgaaaagaacacacagcctctaggagtgattgcagggattgagcagactgtgatgggggttttctcatgatgggagtctcctgctgttgctgagtgctgccaatcactgcccacacctccagcagggaggtgacttcctcaggctctgctactccacatcaactgattaacgcagctgtgatagcacacctagcagagacaagagactcccagacactaggcaggagtgagaccaactgctgtatcagatatacacctagcttataattacgtgtcaagagaaggaagattaggcagacatcagtaaccgcaagaactgaaatgtgatggctggtatccatcttcagcctgctccccagctaatcatcccctaaaagaaatgcgggagaaagctgcctcctaatacatttcattggcccttcatctccgtctgctgactcacatttgaatttagagacaatttgctaaactttctagatttttatttacttaacattgccttagcctttttgatatattcaactatagtattctccaggtttaaatattgtacgttttttttcacaactttaacaaattagtgctcagttctcctggcttgaaattcccatatctttcatgaagctgttgaaactaaaaggcttaggaggaaggtcacccacctccctcattctccttcccttcttgcccagaggaatttatgtctgtcttcctgccccaatatctacatatccagccatgactacattgtttggtttaagtaactgcctctcattacagaactagattcatttattcattcattctacaaaaacttgaagaacatttatgctggatttgaatccagtgtcagaattgtctttgattggttctatcttatttcatagatttggggtttgaatttaatagctaagcatataaatataattttatgcaagatagcaccttaattctagtccttatttaatacaaatagtgatataatgaaatgatatagttttatctagtttcatctagagaaatatggaaggaaaaatacaaatagttaaaaaaaggaggaaggctgaaaatatatagcagttgatatgcttctcagagtcatcttttactaatcagtagcagtggtgatggtcttttaaaaaaaaaaagtttcggttgcttttaaaaagagatttccagtgggaagcctgtgagtactgactggctcctgtctaacctacacttcctgtttggttgatgaaaaagaaaaaaaaaaaagccaaaactaaaaggtacattccagaacaagtagtcattttaacaactggcggagccaagaaaatgcgatctagtttccctctgtcccccagtctagagccattattaaataatttaatgccatagaacttatatcaaaaatagacacattccttaggaaacatttgaaacttactggttttgaccttaaaatgtaatcattcatgaagagatcaatctttcatatgttttcaaatatgaaacactcaagtccattgtcagaatcccaatagtgtggaaagaaacctaccagggcaggcttatctctgctcattctttgctaaaatatccattgcatttgctaactgtgaaacgatgggtaggttacttcacttctctgagcattgaagatgccctgtctacaaaggataacagtctctctcccaggggtagctgtaattgtgaaattaggcaacatatataggaaggtgcctaatggagtggcaatcatttattcattcattcccgaaatatttatcgattggccacaatgcccaggcacagagcaaggtgctagtgatatcaacacgggggacacttcacatttccccccattcctccctaacggtgcagcagacaccccactaaagctgaggaggcccctgctgctccccctccctctctgctccctgagtctgtgagaggcatcgctccagcctcccaagaaagccctccccctgcacatccaagcagctccctcttatcctgatgccctgacccgcctgcccacaaggagcctcctccctgagccgggaggactttccttctctcctatgacaagccctggccctaggcagctgaaaacaatcacccaggaagctccttcaccgtcagattccctgacagccctggatctagcgagaatcaggtgatttcgatgtgaaacgaggtttgggaaccactgctttcagtcacattctttttgtttgatcttctcagaatcagcaggcatttccctctgctactttgtccaagatccaacccttctcatctgcgtcttgccagtctctccactttagagctttgttaccagctacttctaacctcttgcacagaaatctctactcaccactgtggagagtgaaaaaggaatgggtttttatgtatttctagccagctcttggccctgcgccatgcagagtatatgctgtacattggactttcgggacacttctctgttaaattctaagccttatgtctgtggtgtctccacagtgagtaagctcttaatcacattccctattgtaccttcttagatgaaagagcaatgggtcagggggactttttaaatgtccttaaacttgattagtttaatctttattatggctacagaatgtttcttaaatttacatacgataaaatccactattttatattaagtagagttatgagttttgacaaacaaatatattcaggtagccaccaccataatcaacacacaaagcaatccattacccccagatttcccttacatcctttgttgtccccctcatcctgtacttccagcccctgagagccacttatctgatttctgtcccgacagtttgccttttccacaatgtcatgttatataaatggagacatacaatatgctgatgtgagcatttagaaagatcatgtatttaaacaattattagagtaagggctggctatggtgacttaattttttggtttctgacacctataatctgatttgaagtgtgtcattctgtgcatcatgatcctttttgcagaacctgtgtctattagaaaatccagatgaagcaggctcttcctgttgtccttcatttggaaaagacagaagaacagagcgctttacgaaagtcaagttacagcttcctaattttctctcccatggacaaactcttccctccccccaccccgacctagcctcttacccactatcctttgcaaattcctatctcttatattgcccagtaattggggcgtgggggggtgaggggggggtgagttactgctgatgaaccaggaggcagagcaaggtttattttgctaaaggcttcagctgctactgcctggacctcaataagcattttctgctctttcctatcactactgtcttccctttctttgagaagcaacataaagataaaaagaaaaatacttgattttgtagcatgccagaatattaagatgctcctgaaaagtgtgggatttaaggcttctcaaaaaagagcagaggagggagtgagagaagaagacggagaaggaggagaaggggaagagaaaggggaggtggaagaagaaaaaaccaccatcagaaactgagtattacacaggacgtaacctgtgctctgagagtgaaggaggccacacagcagtagaaccccgacaggaaaatcagaaaacattatattttttcccagatcccagagtatcagatgttccattcagaaataatccctattgacccagtctctgtgtctctctctctgccaatagcatcaagcacagtaaccctttccatgctaatcccgttattaatgccatccacaacaagcgtagtgtaagtaagacacgaagtgtaaaaaaactttcttccccgcagtccgggctctcagagccctccttgtaggtcaacagtatcaaaggtgcttaacgcagatacaccaggaggctcaaagcccaaacatcgaaaaaaaaaaaaagacccactcttgtgctgtgtgtattgcccacgggtgggaggatgcaagtacaattacgttttttaaaactccagtccagatattggcttttccttggatacttttgtgtggctctcccagtacagtcagatccgccgccgcagcctagcgctccaccccgggttttgcgtcctcccctcacctgcctttcagtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaggcaagtattgcgcgcgggctggctcccacatggagctgcctcccggtgcaagtgttgcaagggtgcgctgctccagcccggggagcgcgggaggcggcggagagagcgtccgggtgatgagcggggcactgtaactggattttaacacctctgcaagcagcgcttttggtcaaaaaatttccgattcttgatcttctctctgcaaggtcgggggttctttggggagtaaatcacagcgtttgggtttgcattcgaagcactaccaagtctactccacagggtcactgcacggggagcaagtaaaggaaaacgaggagaatctgagagtgctccttcgtgcagtgtgtgtgtgtgtgtgtgtgtgtgtgtgtgtgtgtaggcaaagctgagatttacatggtgtgaactgttaaatgttaacagttaaatcccacacttttcaggagcatcttaatattctggcatgctataaaatttttgagacttgtttaaagaaggggacttcctttttaatttagaacaaattagtagttgttataacattatagatactaatcagtaacaatactagtaggtaatgctttctgtaagtagacacaccccaaaagtatctgaaaagtatcaccaaaacggagcgtgctttcacactcctgcaaaacaaattagcccttaaacagaataattaacatcccgagggaagataaagcatataggttccttgaatcattacgttacatttaaagtcggtcctgttcagtttgcctttgtccctaaggagtaaaaatagcatcaaattgcttgtttggttttccccttttgaaactcagcatagtgtttggttatccatgaaggtggctttaatatttcaccctcatatttggcagacagttctggacttgctcctctccccgtagggactgagtcccactggcagtgtgtggagaatagaattgattctcgctttttctttgcataatacctaatcatcaccattagcacttcagacgttcacagctttctgaataggtgtcatttcttccacataccctattgatttgcatcattaacaattgaaaggaagctcttcttttgattaagaagccaaacaattaggaaagcgtggattctttcatagtatttattgagaggcgtctccacctgatctaggctgtgtttaatgggatgagagagactaagagagaacagaaagtgtaattaccgcctctccaggcccgtctttactttttccagaaacagagaattatgaaattatttgtaatgttacaaggacccttggagctcttctagtgcaagtcaagtttatttcacaaacgggaggtctagacagcctttgtttcttctgaacgggtctgcaaggccaagatctggattctgacccacagcgactgctgatccaggaattccatgcacatatgctatgcacttagcgctgattgtgaagaaacaccaaggtggcccgtcaagacctgaactaccacaggtctaacttgggaaagcctcattcctcacgttctttccgcttctactgtaatggtactgtgcctcttgccagcccacacttattcatttgaaatgtgcactttggaagttcactgcatttaatcgattcagaggatttcttttttttttaattttttttttaatcagtagctgagctatactacctagttctaatccgtaatagtgtgttaaaagactgttttctgtgtagttgctggctgttatttaaatcccaaggctgctgaaagttggtaatagaaccaataatagcaaccattactcaaaagtctattgcttactattaactataataattaactattaagtattgatattgtccccatcaatttttaggcgttacctaacattatccccattttacagatcagaaaacggaggcttcagaaaggtgaagttactagcccaatgtcactcaccttctaaggtggggagcagaagccaggttggtctgacccctaagctcatggtctttctatactaccttagtagtatagaaatgttctaactttcacattcccggatgtctgagctcaagacaaattttaaataaattagcgtggctttgatgttctctcactagtgaaagggtctataacactttaggcaaaatgcattgaaattatgttaaaccttcatacactgccaataagcaatgacttcccagaaaccatactccacatttgacccagtctctaatttagtgagaaggtgagatgcatggaaagaaggcaaaggagagtgactagtgacccccagaaaagggaatctcttcccgaggtttgtgttgtgccctgtggagctgagaggagagtagggaattgatggagcagaggcttagccaacgcatctgaaagagaagagtgttttatgtctttaatttcttcttgtcagaatcaaccaagcccagagctatttacgtgttgagaagggtctcccatggagaggccttcccagtggcccttctactctctgctgcggtggtttatcatgtcttcaaaacagactcgccaccaggcttccaacaggataatacaaatgtgaaatttttgtcctcaataaagagtcagaaatgatgaccattctgccactttcatcattttaaaatctgtattcctgaaaactggcctcgaatttatttctgtatagtccaaggtattgatttgaaagtgagaggctagcatgaaagccaacacttctcaactttaaaaaaaaatgccttaatatttagtattttctcattctaatgtatcctgtaagtgttctttctgtacttcttgttaaggcatggctgtgtaaacttcagagggttttgggaacagcctccattgtcatccacttttcattctaaaatcttggtatatctgtgcatacatgcacaaggcctcccatgattgcactgcttttacgaataatcatagtcaaaattcattttttaatactgctagctcaatttttatttcttattcctttgaaattgatcatcatttggacagggactgcattaaagctcaacactgaccttcattgtggccacaggaagaaaagatctgctaaatgaacaaatactgtgatcgatattgtgcaatggcttgagggaaaaaggaggttttaaccacttaaagtaagcccttttagaaacaaaaactatttcagtgaaaatgctaatcctacacctctccaaagtaaatgtgcttagaggacaccagccagagtttctttacaatgggaagttgccttccaacaagaaagggttttcaaagtgcagaagaaaactttatctggaaaaggtgagaagcagagagcctccaggctccagccccacacactctcatcttcaattaatactccacaaagggaaagttccattgtgggccacagcactccctgcttgagaacctgtagggacttaaccgctgggtttatccaatgaagtgtctgaggtccccgctgtttagcttggccctccactctctgttcccaatttcgtaaccactacctcagccagtctccccagcagagcacttttatcttatagccatgaggcatctgtgacatgtcccacaacacatcacaaactctatttgtcctccaatgctcagtgaccttattttcccaggcaaaagtggctcccgtcccggtgcccactaagccttgataccagcccacagtacagtgcttctcagactaggtcgtctcagcatttgtcaatgtattttatttatgtttcgacgtccagtctgttcatcttcagtacaggactgggtcatactcatctttccatcctttcccttgtccaccttcctttcttcgatttgaatattttctgtagttgctccattaatcagtaattaattaattgcagaaatgtatttcccaagatgtagataagtcacacctcagaatgctacaaacatttgtagatgtgactgatcagtaattgtcaggagactttgtcaatctggagaggtgctgaaaaacagagacaagaaaatgtcaactttcaaaaatactcatttaaaaaagtagtttccaagaaaagcgtagactggcaaaaggatgattgacaaaattctggactagattactaaataggtgatatgtgagaatttagaggagaatcgtgtgatttgcataatccaacatgagttccccggaatcaagccatcccatgtgaaccatatatctcttttatatataggttctgaaactggtgaaatggggaccacttgaggttagagattcgtaattcagtgttgcctctgatcagcctggaattgtagtttatatgccagcaactgcatgtagcctgagggctcccatgactgggctacagccaattgatcacaatctaatgatacccctaggagtgccttgggtgagagcgttgtccggggcaaaccttatgaaactttgtcagatggtcttcacacagcatttcttgattttagcagagcctttgactcagtctctcctagcagattttttcacttactccacagatatttatttaggtgtttattcagtgtcaagcattgtattaggtgttcagtgtttgtggctcagaagcaaattctgacttagttgataatatggagagcaaaaccgagtcaaaaattgattgcctgaaattatctttggaactgcaggaagtcaatcgattgatgaattcatgtgtgtccgggtctctggggtacactgtgtgctcccccattcactccagtccctgctcagagtccttctccaatcacctcctctataaaagcaccttgccccatcatttcctattccctcatgctgttttatttttcatctttgcacattttattctctgcaatgatcttattcacacaagcagtcctgtagttgcctgctctctgcccccttgcttggaatgtggtatgaatctagggaggcatttcacagggctgggtcttttgttccttgccgtccattcaatatgtctatcagtgacaattgttgtcattcctgctaatctaatttgcagatgatagaaagtgaggaggcagagctggcatggtaaataaggggatcaaaatgtacatcagcagcatatgtgaaagcactttgataattgaagaattataattaaatgcaagttatcattttttaagtgcgtataaatctaagccaaaaccaataaaatgaaagtatcaaggttaaatataagctcatgcatttaggttcaaaaaatcaattacacaaattcaaaataaaggagacctaagagggcagcacagtccatgccgcgatttagccatgagctgggcgactctagggctgcaacacagtccccgagtggtggagccatggctggaaattcttcgaatgttatcagttaggagggccacatggtgaggtggacattaccaagcccgagtgtggccagtggagggtcactcagaacagcagcaggaattgggacgtttagcctgaaggagaggggacttagggaggtggggacccatctttaactctctgcggggttcacatggaggagacgggcatgtgtgtgctgagtgctaagttagaacctctgggtcctggggggcagactttcattcaaggtacggagaatgatgggagcccagggccagaagcctataacccacagcatctggacgaatactgagcgctgtcactagattctatttttatttgtttgtttgtttgtttgtttattttttgagacagagccttgctctgtcacccaggctggagtacagtgacgcaatctcagctcactgcaacctctgcctcccaggttcaagcaattctcctgcctcagcctcctgagtagctgggactacaggcacccgccaccatgcccgactcattttttgtatttttactattttactctactattttagaagagatggggtttcgctatgttggccaggctggtctcgaacccctgacctcgtgattcgcccatctcggcctcccaaagtgctgggattacaggcgtgagccaccgtgcccggccgtcactagatatttaaagagaaactggacaactgtggggcagaggccagctcttaagagggatcctggctttgggttggatcttcaattgtctttgttctttgtctttccaagtctaacattcttatctgttctaaacttccgtatttttatttgttctgactgatttttttttcttggtgtgacatttgatgtaaatagtacttagcaggcttagcaactcctatatgaaagtgctttgaaatttgctgggctttggaatctctgttgtttttgcccattaagtaattccctcccatccctcttcaatgttcccctttccctatcaaccagccctttctgcaggttggagtttgatagacttggcacttggcacaccccctgagcgccagtgtcaccctctgcgttgtgaatttatagatggagaccccttcatccttttacagtcgtgctctgatcctggggtccctgaggtccagagcagaacctgaactctgagtatcaggcaagcgcatcttacttcaaaaaatgggaagaacaatttaaaaatgcaacttggatatgtttttataagatattcccgctttctgttttctacacttatttagcattttaacattttcagaatacgtgaaaattagatttagtttcttttttaaatgtgaaatataagaaaattatgattacccgtaacacatttgtgattaaaagtacattttttaggaaaaaagtattgtttccagggaacaattttctattaagttggtgcagtaatgattgcgatttttgccattgaaagtaatgcttaggccgggtgcggtggctcatgcctttaatcccagcactttgggaggccaaggcaggcggatcacctgaggtcaggagttcgagaccagcccggccaacatggtgaaaccccatctctactaaaaatacaaaaattagccaggtgtggtggcaggcacctataatcccagctacctgggaggctgaggcaggagaattgcttgaacctgggaggcggaggttgcagttagccaagaccgagccattgcactccagcctgggcaacaagagtgaaactccatctttaaaaaaaaaaaaaaaaaaaaaaaaattaatggttaaaaccacaattacttttgcaccaacct

SEQ ID NO: 1421 - DNA, 117256 bp, Homo sapiens
aaccaatggctatgggctgggtgtctatgggaaggtaagataactgccacagaagaatgtgtagtccagtggtgcttaaaccgtgctccatggtgtactatgtaccctctagaggcccctcaccagtcaccatggagagaatgtgtgtgtgtgttgggggggtggttctgagtggttggggtcttaccccactcccaacatccgtccagccctgctgtttttctttcttttgcatattgagcttctgagcaagatttcatccacagaaaggattgcactgttaaaaaagataaaaaaaaaaaatagttgggccgggcacggtggctcacgcctgtaatcccagcactttgggaggctgaggcaggcagatcatgaggtcaagagatcgagatcatcctggccaacatggtgaaaccccgtctctactaaaaatacaaaaattagctgggcctggtggcgtcggcctggtggcacatccctgtagtcccagctgcttgggaggctgaggcaggagaatctcttgaacccgggaggcggaggttgcagtgagccaagatcatgccactgcactccagcctggtgacagagcgagacttcgtctaaaaaaaaaaaaaaaaaaaagttgaaaaactattgacctaatttttcccactgaatttattcagcatggctttttatagtggtttcaccctcccagcttgcatttggccaacaggatgacctggccaatgtcttggcaccagtcacctacggactcaaccagagaggacctctgaagctgtcccctcagcaggtgagtgtcaccttttgtattggagaaagatgttttgtggtcaaggttagtattatttgcaataataagtaaataaggaatttgttaggggaggtatcacacataaattgactctgaaggcagtctcaaaacagtttcaaaaatgttttaggcagtgacaacactattgaaacacactcatggcccctaaaaatactagaagctctaaaataagctctcaaagttgttttgtaggactcataatatcaaactataactttccaaaggacaggagactggacttttctttaactttgtggtgtgtttgttatggcaacaacccagggatctaagataatcaggggctgatggctcaatcactgatctatagagatgcatctaatataaccaatcaatatctggctcattctgtttttataaagatatttatgcaatccacatatttgcatgttcatagagcatttctggaagatgttctagcatgttagcttcatagagtaagccttatgtttttctgttttgttcactaatgtggtcaaagatgatgcctggcatgtaataaatctttaatagctatgcattgaatgagtaaactcacaataaaatggtaagggtggttacctttagggattaggactagagattggtgaaactattacttttcaatttatatccacatatggcatttatatgaagagggcaggaagactgtctgcttttctctttgtatttgctcctttacccacagagaggaagaaatttctgcctttgctttcactgctatcttttggccttaagactcctccatggccagcccaaatcaaaaaggaatgcacaatctggctggttgttcttggaccatgtattcttagtgggcaagattccactcttcctctctcatttcctatctccattgctttacgatcagggccccccttccagaagaaggcctggtcatgattctactctcaatttcagcttttccattagtgtttggttcatggggctagaggcacatgagcattgaaatttgtccttgtcttagttcatttgggctgctgtaacaaaataacataaataggtggcttatacacatcagaaatttatttctctcagctctggaggctgggaagttcaaaagcaaggcattggcagatttggtatctggtaaaggcctgttttctggttcataggtggccgtctcctcgctggaacctcagatagcagaagggacaaggaagctgtctgggctggggtctcttctttttcttttttttgagacagaatcttgctctgttgcccaggctggagtgcagtggcatgatttccgctcactgcagcctctgcttcctgggttcaagccattcccctgcctcagtctcccaagtagctgggactacagacatgtgccaccatgcccaactaatttttgtatttttagtagagacagggtttcaccatgttgcccaggctggtctcgaactcctgagctcaagtgatccactggcctcggcctccgaacgtgctgggattacaggcatgagccaccacacccagctgggtctcttcctgtaaggacaaaaatctcattcatgaaggctttgtcctcatgacctaattacttcccaaaggccccacctccaaatagttttacaatgggaaagatgttttaacatatggattttggagggacacaaacattccttctgtggcattcctcaaacctggatattttagatacaagcaagttgggtataggaaaccctgagacagagcagctcagcagagatgctttaattttggcaacacagctctcctggtgattcataaaaattctaagttgtaggctgggtgcagtggctcacgcctatagccccagcactttgggaggccaaggcgggcagatcacctgaggtcgggagttcgagaccagcctgaccaacatggagaaaccccatctctactgaaaatacaaaattagccaggtgcggtggcgcatgcctgtaatcccagctactccggaggttgaggcaggagaatcacttgaacccaggaggcggaggttgtggagagccgagattgtgctattgcactccagcctgggcaacaagagcaaaactctgtctcaaaaaaaaaaaaaaaaaattgtaagttgtttcccatttggctcttgtccttctaggtacagtttctgcaaatgaggcctgcagtgtggtatgtgataggattcagaaacccagagcccatcccaacctcatgatactgcagtgcttttacttgtttagtttaccatgtgcagatgtaattctgaaatgagtatatggatcagaacataataacatgtggggagtgagtacgaaaaaagtattttttcctccacctacacaacagaataaaagagttgtttttcataaattctgttgaaggcaatttgtatttataaacaggagaattaataataataataggctggcaggatgatttggcattaagaggccttttgtctaagaaaactagttcatagaatcattaaatactttgtttaaaattgaaaagtaaaggaacagagttaaccccaaagctttggtgtctgaagcagagacttaacaaattcagtatgggtgagtgtaaggagtaagtgctatgtaatgaccaaaaaaaggattgtaatactgccacacatatctcagaaaagttgatctactagggaatgtgtgtggatggacacttttgctgttctgagatgtctgtgatctgtgccaataggcatcagtattgtgttaacaataacagcaattgcaacaacaacacctaagactcattgaatgtttattatgaactacacagacattctttacatgtatcggtccaatgaggaagcttctattattatctcgttttacaggtaaggaaatgaacactcaggttggcttaggtcacatgctgctaaggggcatgggtgggatcagtggagtgttgaagttggcttgtacaggctcttgagagctgactgtgcacacctcttcccaacagtgtgttcaacaacatcatgtcgctaccttgaatttggccattgtgggataatttacaccacaaaaattgacaaaatgccacacatcatgtggcaattttgttttttttttccagagagctcattggcaaacattctaacaaatcactagataggattcaaacccaggcagtttgactggagagcattttggtaaagatgcatgttttcaggccaaagtattgataatggtattaacaattttcttattgtgtgagccacttttattggttggttttatagatgagcttgaggaggcggtgtctcatttacatggggcatagtggattggttggaccaggtgtgctatttacatagtaccagaggaggctggccatcccaccctaatcttttattatgcaaatgaggtctttacctggcctgtgccatgttacctgcacatgtggcaacaaagaaaagggaagggaaaacctccattttgaatataactggcttccaggtatcccttttttattggtacagctgccggcatttacctatgcaagcttcaagcttgcttatctgtgcctgcagcttgatttttcaggctgctttttgttagaaaagaaattattttggggctgctttttattaaaaggaaattccactgagagctcttttgccctaactgcctaaataatttctttttagctcctgtattactatcagttgacttagatgccaaggactttgggtggaaaataatgatccctcttcaccaggaagcagatgctcagctttgtggatagtcaaaatgacagccacaaaaaccccctagcaagatcactgagaaaaagaacaacctgtaattgctgagtgctaactatacggcaggcatttccttaaatctttaacttcatggttttatttcattagcccagaagccctctaatgatgtacagtagtcattgttctcatttttgagaagaggaaatgaggatttggagatgttgaaacattggcttgagatcttctaagtggcgagtggttgagggaattaggagcctataacagctgccagacaatctgactccagagttcatgtccccaaggaggaaaccacattgctgaggagtcccactgagggagtggggccgaaagggtagccctgaggctttcaggttctgagcccatggctagagaagaacctccatcaaagaactcatcatcaaaacacagctgtgttgtctgtgatcttctctgacctcggccctcataacctattgccttggctatgggtaacttaatatgtcctgtcttgaacacatccaacattaccatgtgcctgacttctaataccaccttcccctgctacctgcctctaaacctgatgatccaggtgtattctggtccttgcccgtatcttgaatgcggcccctgtacaccctatgtccaatctaccctatttattgttatttgttttgcagtatactttctatttttttttaaagtgaggatataaaaatgagattcttgaagaaaataataaagtgttgtctttggaaggtaaacttaaaggcaccttatattttgctcttcctatacttatttacttatttcctacattttctataatgaatgagttatttctatcacaaaaaaatgctacttacaaacggataaatgaagacagtcttaaaataaatcttaatacctattcatccaaaaagcaaaagacactttgcaaactattacaatctacctcatttagcccgctgaagacaccaattttctttgcactacccactccatttctcaagagacattaacaacacaccatgattgaaaaactagggtgttatgtgtttaaagaaagaggtttaaaatattttattagagaacacatatcaatattgaacaacacttaaatagatggcattcatattaataaggacaatataaattcttataatttgaacagtcagtttgttcaacaaataaaataaattcatttttatcagtgggcatgatccatgaagtatattttttcaataatttattcatctgcttagtactatatacattcattttctttgaaaagaaacataaaatcaacgtgattgtttatctcatcacatcataaacagatggacctgtaaaaatggcgtgtagaaaattcagaaacacttaaacagcacattccaaggatactgagtccatttaagagaaattaaactctttgaagccattgtagtcagcctgggtgtcatatatattcattgatacaaaatgttgccacaaattcaagtataatgattcacacacataaatatattattctgacacagaagagaatgctcccttgaatagtatagcgtgcataccaaactctcagcacgattcagattaacttttttttttaaatggaaggaaaggtaatgacatcgtcaacttagtcgaccaaataccaaacctggagaaggtggatgtggttcacaaacactgcacagttagaaattgcaccttacatggaatcttatttgtcacaacaattgttaaaggttacagaaaaaccatagcagctaaaatcagccagtcagcccacatttgcttctctggcaacatggaaatgctgtgtttgtattttaaacaaatgtaacaaggagacaagcagaaacgctgcagcaagccaggaaatgtcaccgggttcatggttaaatggcgtcagctttatttactaaagtataattttaatttcacaggcaaaatgaacctccagatttgttttccttagccccagcaagtcaagtccttcctaactgttagttgattgcaaaagtgcagcttcaagtctgtcccttttgctttcatttcccccctgccccacctctgctccatcaggtttgtaacacaagcagacactctttcatacgcttcaatgtagcgtgagctgtgacccttggatggtgtgaaagccagcctttggggatattatagtgattcagttattttctgttttttctttttgttgttgttgttgttgttggaaaaacttgttttttaaaaacatgctgcataacatcttcttgctaaaaacaatttctcaattagtaggaacactgaattgctttgtatatgatttgcttgttaagaagtccaaagcatttggttattcttaagaattaagcacttccattcttgggcaaatatttatttgtatgaagagaaagaaatagacctcctttttttttttttctctgtttagccatcccactgtaatgctgcactaagccttgagaacaaagagaatcacgcaactgggaaaccaaggctttgtgattttcagccaagccaaacatggtcactctgtcaggaaagccttggactcatccctgactgactggctgtttcagtgagttctttcttggcttaaaaaaaagagtgagaagaagagcagttgtgtggtttgcctgtggggacttgggcaatgggggtttgtagagccaagtggccaccatgataagcgagactgacttccctgtgccccgacatttgggaggaggcagcacccccagcacacgcctgaggttcaccagcccctgggccttggcacagattcctcccttctttgcctggaacaactgtttctgttccccaccccattgtgtcctccaggattcaccgtagagatcaccacttttgataagcctaactctgcagccggctgaggcccttcaccaagctcccatggcactgtattaccatcacaggtgcttggagggcaaggactatgtctctgcccttgttattctccaccccctggacttggcgctggagcacagtaaccccacactgaatattatagagtgaataaagaaatgagagagcagagactgcaagagcagctctctttgaacgaaggggattttgttttgcagggtgattttcatgtctatgaatgttctagaatttgagggacactaacttttacaagttaaatgtgcctaactttttttttcttttaaaatattttattctgaaaaatttcaaacatgcacaaacatggaagaacggcatgtggccttgcctgccattcttatttcatctatcacacttgcttccccacttttggcaataaaactttaaagcaaattgcaaacatacttcgatatgcacttaccagttaaggacaatgccattatcacatccaacaaaatttaaaataacgatctaattatctaacatctaataggacacagcctatgcttaattttctccaattacttcaaaaatgtctttttacactttgtttcaatctaaatgaacaaggcttgtacagtatacttgatgaatacatctcttaagaatattttaacccataaaagttccccttttaaaaatgccatttacttattgaagaaactggggtgccttatggaattcctcacaccctacacgtggctgatgattctcaattaacttttaagaatgaaatgggggagggaggttgtatgaaactgatttacaaaaaatcgagctatttgtccctgaaggctcttttcctctttccctttgcattcatgatcattccttaagttactgtttttcctgtatcagtaacagtaacatgttggatttgtgccttagtcagatggatgcttgataaagaagtaaatccaagtgtcaggcaaggctcctgggctcctggggtggattccaaagacagtgggtcgcaggaccagtggtgggtttcatgctccccttccttgggcagtaaggacaacagtcgtggacgggaagctggcttcatgtcatgggtgtgtgtccctttaaaacacaaggtagactaacatttaattaatcatgcatttttaatatcctaggcatcatgcatcaatgtgatcacaattttatccttttgtagagtaagaattcttactccaaacccaatgtgtccatttttccaagttcagacttcagtagagcgggttctcaagttgaggatccctctcatttcctcattagccaggctggtcacattctgctccctgtgagatgatgcttttggtcttctttctccaaacactgaaagaactgaatactcttctttttaatttgggccaacaccaatccgttcatccttgcagctgcttctcaaaatccagaagactgaaatagccatagactgtgtttatataaagcagagttgggccaagaacctcatccccgaaagtgactttttttcctctctttaaaacaagtttgagattctgagtcacgagagaccatttggcagggagatggcagcaagtccctgccaaattcagcctccgagcatggctgactaccccgtcagcctgagtcgtggtgagctgagcttgcagtgtggacttccctgtgaagccacctgcctagaaggctgctggagaccacttaaagggtgccccagaaatgtctagactcgactggcagaacctgaaattagaactaagattgtgacctggagcttccatgagagtctggaagtacagcttcaagtctgtcccttttgcttccatttcccccaccccccacctctgctccatcaggtttgtaacacaagcagacactctttcatatgcttcaatgtagcatgaggtgtgacctttgtatgatgtgaaagccaggctttgggggtattatggtgatcttcaatttgcagtgaagtcaaaacgacctctgttcatgattgggaatttgtggttttggcttgtaaacatttacttccagtagttgcccacgccaagaggtgttcatcccatatttccttagatgatgttacatcttagttttgcttcaaatgctgtactgtcttccagtggtcaaaactacttctctttcccataacatcatttatataagcacacgcacacacacaggcagacactcacaccttttctataatgactgcattttatgtagcatctttcataggacaactatgataacttaatatactttctattgctaagtaagtagccaatgtgaggaagatgacaaacgccagccttggatactcttgttctgggctgtctacaattcagagagcttggtggaaatcttcaaagtagtgtagtttgcctgatttttaaaagctaagacaaattttccaggtggggatatttccaacccaaagaaaatagtgtggtgtggggaataactgagagttgggatttagtgcctagcaccttgaatgtaggaatgacaggacctgagccgcggtgcagcaggtagtttgtgacctgctttctaattacagagaaatgaatgtcttcaggtggggatgaccagctcctggaaatgtaaacctgaagtgagataaagagcaaaggaaagtgaaggacttattttctctcttcctgcacatggcactttcagtgcttgaagatactttaaaggtgatctaatttttagttgtgtcttattcagatggcatttgagaggggaaatgaagatgggaatagagtgctagcatttatagggggcctactatgattttatagctttatcacctcataaggcatttcatgtacacaattgtatctgctaatcccatttcacaggtgaggaaaatggctcaagagaggtcacgtgatttgttcagggccacttaaataggtacagagatgggaactgcaatgaagcccaggcccgtggttcccagtccatcatcggtcttctctcaacaccattttccaggtccttccagtgcccttcctagcatgggcattggggtggagttgggaaggtcacgtttagcaagctaagaggtgagcacaggagaacaccaggagaacacacaagagagcgcagctctttccagtatttctctttttcaaaactccctgcagacttgacttacttgcctcttctcatacccataatgttgtatttattctctgggaaaatttttttttgtaatgtgactatgaaatctcataccttaccatatcatgtgcaaaaacttggcatgtagtggatactctgaaaatacaatttttactatttaaactttatctttgtaaatcatcatggatgcattataggcagcaaaatgatttcgttgtcaggaatattggattaagtttctgtgttaatactggagagtgaattgcttgtgacttgttatacccagagataaaaatagtttgttttctctcacatctgatgaagaaagcatgtgtttttgattcagctttaaatactgaggcagaatttctgttgcacaaatgtcagctctcacttgttgaagtttaggtatcagggttgcatatggtattcagaagaggaagacggggccagataagctgctgggaatggagatgaaagcaagcaagggacctcagtttttattcaattacttcccaataaaagtatgactctttttttttaaagtatgtagaaaactagcaatggattgttatttaaatatttgtaatgcttgctttgatcttcaaaatacttcacagaagtactttttaatagccttcctacttgtcggattgaatttgggcatccttatttgtagattcaagctgtcattcagcaccacattcatcaaggtctcctccttctctgctctttacaaccactgtcacctctgttatgactccaggactgactcggggaggcactgtggggcacgaagtactctgcccgatgctcagcttttgattaatgggccacagccctcccatcccttgagacttcagttagccgaactcttttccttaagaaagataaggctgcatttagcaacagggatgaagacaagggaggagaagaaacgcaatttttaaagataaatcaataagccattgctacacttattcgaacttggttttggatggcttttgggcttgaaaagacagaatacttttgtaggctttgccttttgatgtgattttccccctgtcatttctagattggactgaagctggtgcatcacgtgactctagatagcaagggtgttctgatgtgattgatattgtggaaccagatatacttgcaacctgagagtccccagggaggaaggaggtggataggaggccacagcggcatggtgtcttgcccagaaaacacaacagtaggtactatgcagttagaacagtcctgattcttccaaatgaggataaatgctcctcgcttctcagcaggaaccaggacagaagagaatatatcactctgtgtctgtcagggaacactgtgaggcaatacaagggtcttgggttgggtgattaagtggaaatggcatgggatttttcaagaggcacaaggtgtgcaggccaggatgccctgagaccaggcagagtgggtggcagggcagcaggaccgtctcattgtgctcatgaaggcttaggctttaagagtgggaggtggtcttcagaaggtcgaaattaagagagcttttagcagggcctggctgtctacatcctcatatcaaatccaaacagtgcagcttcctttcctcttttctgtctttcttagactatgagaagagtagaggaaaactacatgaggctccttggcacccatttttcaagccagtcatgatacagggcagacagcactgacatacccttaacccacctatcactggcacgggtgccccagggtgatcacagggctctcatgtggtcctcaatgccccagttcccaagattgggctctgctgttggttcttatcccatcttgttctgcctcaccctcctctcggagtctagggtctgtcctatttaatgatggggctctgcttcctcaggtgcaaatgtctctgggtaagcatatgcccacctgactcgagatggctgtgattccccactgctgacctggggttccccactgctgtgctctgcacacctaactgggatcttactgtcccttagaatcctcagggtcatcaacttgagcctttctgggtggatcttctgatgtttccaggtccctggggactggcctcccagctgctatctgtaactagtggttggatcttattacttgttctgctgtgcacccctctctccatgcctgcttaggggctggagtactgtcatgggcatgctaagtgacagaccattgctgccatccaggagttctcctctagttgagaagacagaacttatataagtacagtatatacaaggtaccctttaaaatactttaaatagatataaactttaaaaaacaacagaaaaattacaacagagtacagaattagttgccaaatacattctacagacaattgctgtaagaacttggagagaaattgggatgatcagaaatggctgaatttaaacttctaatctgggaaaagaattatggataacattttgtatgggcagaaatgagagagtgaggagggagtccttgtgggctcaaatgagtctcctacagattcctatgttgaagtccccaggacctcagaatgtgactgtattcggcgatagtgccttttaaggcatggtgtggttaaataaggtgatgagggtggacccaaatccaataaaaccggtgtccttataagaagaagaaattgggacagagaaatgcagaggaaagaccaagtgaagacacagggagaagatatctatctacaagtcaaggagagatacctcacaggaaacaaccagccaacgccttaatcttggattttccaacctccagaatggtgaggcaatgcatttctctttttgaagccaccccatttgttatgattggctaggacactaatatggcagggctacaaatgcatggagctgtgctgtatctgcaaatgcaggagcatactcgttgggagaagatcctttacttaaagcagaaaagttcctggaacaagaatatgataagttggcagaaggactctgtgaacaagttccagtagcagatgggctgctggggacagggacgaagagcagagcgccagaagagaaagaacaccctttgcctggttgacagttttgcttagggtatacattccgatgggttaagcattgctcaatgctaacataaaaccaggtttactttatgggattaatcaaggccttgaagaccctcaggcactcctaagggggaaagtcaaaaagaaaggaacaataaaggaaagagacagaagatgcagaagaagagaaagagaaggttactttgctgggctcagtagagactttcgaaccatcagagagtggtaagaggtgcacaccagggaggctcatagaaatactgcagccacccactctgaccaccagctcttttccaaaatgtggctgcacgttgtttgtacctttcacttggaagtaattgtgtaagaacaggaaggcagcactgcaagcagagggtaaaagtcattgggggccttcagaatgtcctcatcctcctggcactgtctcctgccctgggctctctggaagctgtgggcctggagctcacagaatcaggctgacctgggaagaggatggagttgctgagagcagccccatctcatcactcagagctatgcatggagcatggattccatgggaaatggcaccctctggagcaagggcacccaccccagcttctttcactgtttgtaagtttagcaagaaggggagagtggaataatggagaggatgggatcaagaaaggagatgggaaagatgaaagggcacaggaccaagaccaaacaggggacgaagaagggaagggagggaaagctgccatgaagcatcagccaaaggtcacagattacttaatggcctcagtatttccaggttcttccatatcagttctgcacccaccaccatccacgccccatctcagagctctgctgtggagcctcctctctcaacactgtgaacaccgtgccctcggctgcaggaactgcaccttatttctgattgggagagtctttctcttcctcgttgcccatcaggactggagagaggaaggaacaagaggtccctccaacaagtgtgtcagctcagggaaacatgaatctggtattcttaggggagggctaaatatgcttccccatagtaatatcatttctattccagttagtcaaaggaaaaggaaaaataagaaaagaaggaagaagtagaggaggaggaggaggaggaagaagagaaaaaggaggagagaaattctgcatcctatctgtcatttggaaatgcccctcatacccagcatgctttctgaaccccatggctctccttggtgagctccaggcaggccctcaaatgccctggtgtggggtgccatgtccaggaggccttcccaaggagccaagtgtggccctgaaattctcttggggtcctctggggacttccacttgggcaggtcccaagggtctgggagaaatttcaggttggccttggtcaggaggtgtgtatttattgttgctactcttagggtcagccagattgtgctgtgggggtttccctgatgaggtgaggagctgaatgatattgaggctacctgggccccagtggacctttctgctctacagatgacagcagtgggggtggcggatgctcacctcttatcctgatacctgcttggaaggtcacaacaattcatggagtggggccactttgaatatggacttgccactttatccaatgactcatgcaggttagccaagtggagttgtgtcaatggcatatgaaaaaaatatttgtatgtggaacaccgaaacctattgtttagcatcatctgtactacactgttagctagtaacggcatagatcatgacggcaaattacggcccatgagctcactccggcctgcagcctgtttttttgtttgttttgttttgtttgagagaagaagggtttttacattttagagggttgtccccctccctgcaaaaagtcaaaacagataagaatgtgtgatagagactgtatgaccccacaatgcctaaaatatttactatctagtcacatacagaaaaggtttgcaaactcctaatatacattaaatagatttttattttttggttaatctgggaacatcctccccctcccccatttataacaatgcctcttggaaaaatgcattcttgactttgaaacagatgaacttgaactctatccagcttgtaagctggggactctctgtgcctctctgtgtttttcatgccaagtgcagggcggggtgcaggagaggttgtttgctgctgctgatgaccagtgggtatgcaatgacccacaggctgaccgggaaaagaattatttcccaaactccctttgggacctctacgttcctgaggacattaaggtggcaatcactgccttacatgtcaccctgtggagcaaaccaagagcctcctgccctgcctatttccttggctctgctgctgccatctagggagaaacaacagaatcacatgtgcttgtctgtcagtcaatgacagaagcatagacaaatttgccctcggcccctagaacagtgacatgctgcccagccatggcagagataaggcaggagagaaagtgccaatagagctggaattataggtcagggacaaatgagtgagatatgaacgtcaagagtgtcgagaaacacagtggacctgggaaacatggaggtgtcatggaaaaaggagtcggaggctggatttggggatattcaaagaaacccttaaatctcccacctcctcttttctttatatgctaaagtgtaggtaataatctcttccttctccttctactgcacagggatgacttaagataggcacaattactttgacaaacataaagtgctatataaacggacagaaatattaaactcaagttgggatttttctgtcttagctttctctctactgcgtttgaatgcacctacaggatccggcttttgaagaagccagtgccgtcatttttttctcaaaatacagtgtacatttgctcttagattttctgcctaattaagtctgtagtttttatagtttagtaataatcatttccagtttataacgtggctgcactgaatatgatacagagagagaaaaagtaaagtaataactcctgagccacacgaaaaggaaaggcaattattttgtcttttgaaatgaataagccacaatctttagggcagttccttgcttatcagttgcagcaagccatgactcaaccatcctgctttaagcgacgtctatggtaaatcttcctgctcctaaacccctctaaccccaaaccccacaaccttccttttaggtgggagaaccagtaatccatgttgcagcagcaaagcagaaatgacaatttcctgaatagagcagataaggccaattctcaacccctcctccacatttgggtctggggagcgtgaatgagctaatgctgatgggagcagggctggtgtcctccactgaaattctaacttgcttttgtcagcctagccccacagtgatcatctccactcattctgctcccaggggttctggagggccaggaggccacagctgccattgctttctgaagatggttggcaccacagcagcctggctcagcccagctccccagcacagtctgcagatacggggcaggtgcaaacagtgttccaactgggctccactggagctgtgcgcaggtggtttcatagttaaaagtcctagtagtgtaaaaaaatcagagtaactggtaggcatacctctgatgtctccatatttgcctcctctgctttcttttcacttggtttttccttggagagtttacctcccatctgcttcagtgccctttgctaatgagcagagctctttctttaattaagtcaacaagtattcacacacagaggcagcatcttttttggccaaaggacctgagcagaccagccccagaagcaattgagaaagtttgtcaagctctgattaagtagctgtgatcagagtgaaaaattgcctgcccaagcaaatagttcctaaaatgttctcactaccaggtcttaaccatgaaacctactgggccagaaggttgggatatccagttttcacttaggaacaagcgatgtcacataatacatagccatagcttccagctgactcctcatttgcagactgcctaggtctccagctacctggagatcagcattctgaaccctttctccacggtggcatcataaaattcacatgcttgatatgctctctgcaattcttggtgaaatatctacaatccattcccctctgtccaaacaaaaaaaaagttggaatacaggtgagtgagagtgagttatgtcgtatttgctttcatttatttttaaaagggatgtacttcccaaaagtgtttctatgaactgtggttggtcatcaataacttcaatacaacacccgatatgtgtcctgtcagcaactgcattttactgttcttggccaatgtggccccttctgcatactcttctatgcccatcttcccccagcgtgccatagtatgtcctccttgcaaggccttaatcacattccaggccattaactcctaaaaatgtgatgcagtctgatagaagtgcagacaccaaattcttccacagatgccctgctcttgggtttgactgggctggagatttggcagcatgtttgccatggttaatttggaggcaaatctcaaggaaacagaacattaaaaagtttggatatggcttggcatcctcagcacacctaatccaaatgggaaaacgtttacccccattctcttgaggaaggggggctatggaaaatgtgcaggttgagaatagggagacccaggtttaaatcatggttccccttggccttgggcaagtccttaacctcttacaatgatcagatttttatctgtaaaataggggtagcagagtttccaaggagtttagaggcaatgggtgcaaaattccctgaagatgcctggcacactgtaggacctaacaaaaatcttaagagaatatttatttacccaaacactactgtctaccatggaatatttatttttgaatattttggagagtgttagatatgctatgtgacgacaagcagaaaccctcttggataagacatgagagaggcaaaggaaagaaaactgatgagtaaaatgcttttctgaaatccttgacataatctggggaaatttttgaataatgagattcagggtctctcataatgcatgcagtttgagttgcagaataaactcaaattttccctgtcccataatgtcagaataaactcaaacttgccctatcccataatgtcacgttgatttttgtgatgtttagacaatcccaaagcaactactttttataacacattagagaagacatcgttactctgggtaaattcctcaaactccaaatagaagcagtaaacatgtgagtataaatatgacaatcatttgctaaactgcaacaattttagatattttttggcatgcttaaaggtacagagatttagggggaatgagcgaaaagtaattcaactcatatattctttaccccactttgactaagttttgggtgacgttatcaatttcttgtaaatttggtgtatcatgctatgggaaaggaaaaaaatgttaaaagtttacctccctggagagagggggctggagaagagtgtagcagaaaattatttacggatagttttacatggatacaattgtcatggttttaatccgttgactgaaagattctctagttgtttattttgattagatgtggcattagggccagatttcctgtatttctaagctttcccgtatctaaaatttaatatgtctgtaaaggtgtttaaaggatcatctcaaacatggaaccataatttgttgaagaaaaacgataatcattcttcctgttgggacgctcttcctgtaagggggagtggggcaagtgattttcttattcagatcctggaccaagctcttgtcaacaatgaaactgatctttcctatcaaggccaaagagaagcaagggtttgcatattcaagttcttcatagatgcctgcctctataataggacattcacatctggcagagctcttatgggacacagagagagaacagaagagtctaaaaatccggccaacatctcagtgccagaatccaagttctgaacacaaggctgaatatgtatctggccagtaagaagacactcttcagaaaaaggctgaaaaaacagtcacactccaggtctaaatacaacctataacaaaacccaaatccacatgcaaacataccctccattgcaatgtggaaagagatttggttttaagaagaatttaaggaaattatcattttgctgcaagagaagaagaaaaagatgttgaggccgctactcttgctgtgaaggttacagctgctttgaatttgttagaggaaattaccctaatagaggaaagaggccaggcaaatggtctttagttttagaccactgattgttgtcgagaattattccaaaaacttaaattctattttaaatccttattgtgaaaagacagccatattttaatttttacttatagttaccatcttcatccttagtaatctatagcttgagcagccctaatccgaaaatctgaaatccgaaatgctctaagatccgagattgtttgagcaccgacatgacgccacaggtggggaattccacacctgacctcatgtctatgggttgcagtcaaaaacagtcaattaaaaatattgtataaaattaccctcaggctatgcatatgaggtgtatatgaaacataaatgaattttgtgtttagacttgggtcccatcccagagatatttgattatgtatatgcaagtatttcaaaatttgaaaaaatctgtaatctgaaacacttctggttccaggcatttcagaaaagagatacacaagttctgtactgagttattatggtttaccaaaatttggtatacataaagcaaaatatagcatgttccccaagctcttgcagaaaagtaggaatagatgaagttgagttgactactggatcttttaccagaacaaatggccttctatcaaaaaatgtttgcaaactcctgcgttagacagttctttggtgatccatcagtattgtctgaagctaagcattagtatttttcaaagttcgggaataatgtacttggatcataaggctcattccaacatgccacaggtgaagctcattcattatgcaatagtgaagcagataagaagtaatgggagacaatcttttgcctttcaaaatattataagctctggattttcataacagagttctggaacaggtaagtgatttgtcaagaaaggcttttgtaagccatgttgaaatggctgtgcagtaagtgaacagcctctatctttgcaagaaattaacagccacaccaacctcttgctctttaaagatattagagagaaagcctatcatcatctgatcttggaactgtttaatggattttctctctagtagttaaattgaaagaatgatgctcaggtctattgttttctcttgggaaaagccataccaccctggttggttctttcaaccctctcctgacccaaggatagagaacactacattccaagacatcatgagtgcccctcactctcatctttgggaaatgaggagcagcatccattcaaagtgcagtcaaaggtaaacctcactgccaagtttccctcaagctgagaaattggatgtatcagaaagggtggagtttcaggacttgctctaaaaataatgtgtctggatctcggccaccatcttaatgctcttcctctctaggccctctccccataaatgtcaaatgtggctgtcagtaggttgagcctgaaaataaaatcccctcacttccatcaagaaatagctccaaacttagagtgtgtgctcaaaatattcatgatgaaatcataatcctatatttatagtcttttggattgtgcatgaaattctgtttcccatggtggttttcgttgaagtgggcacagagtgaccaagaaagcattagctgcagggaaatgctgttccgtatcattctgaactggttggttgtgagacaccctccctcttccctgtgccctacccgctgcctgatgagttgggtctaccacccaccccattcccagcaggtcccctctttgattggtcctgtcttgtcctccaagaagagctggccttccgagaaggaagtggggtgggtacctaagattattcccctttcctctgcatctttcctgtcctagacttcctccccgttctcactgagggagatggtgtggaccttaatggttggaacttgatggttcttgtcaaggctgggggttgagggccctacacagcagcagacctgcaaaaagcttttacttctcacccgggctgtggtacaggaggattggtctttggacactgtaatcctggcagatccacggggcatggaagagaaaaatttccattcacaaacgccatccgtcttggagatcctgtagaaggtctctcttgatcccacggggatgcgcaccatgtccttgtgttgcccttccacggcctggctgggcgggtgcagggtgtagcccagggcatgtttggaagactgctttctgcagagacactggattctcaagacattctgaaaggcctttttgaactcttggctggagcatgggtatatgatggggttgatgcagctgtttagatatccgagccaaaatactattttaaaaactgtttcagagggcttgaaatcagggaagaaagaccctggaagaaaacacacagatttatacatattatttgaaagccagcaagccaattggctaggaaaacaatcaaacagacatctttctgtatttttaaacggttaaaatgatcccaaacacatatgagtttctcacatttgactgactagctcctatgactgtcacccttttgcaatatcttcaaagaccattcctacttggtccgcgtgtgtcattaattacaggagcaggcccagtgggtagggttgcactggctctcagtgaccaacagctgctgtgaagttttaccaaatgaaaatgtgaaactcagactgagtccacatatgtaaattgttttgcctaaattgaaaagtaagttggaatccatgcaagtaatccatattaaaattcggttatctgaacatgccctttattctctgatgcagtgttatgcaacagacacagcctcagtgtttatgaattcctcccctcccaaatgttagaattatggattttgatgagaatctcaactttacacaatattggccttgccaaagttgggccagtgattctcaatcacttttcctagatgatgtcttttgatgtcaccgttagctccctttgtcaatatccctcgatgtctcccaaatgtgtgtctttgcttcacattcggagtcctccacagcctctggtctaaccagctttctaatatgactagttgctattttttctctagccagactcactacactttttctccaggtcattgatcattttttttgtcctctcaagttgggccactgtgtccttgatgcccttttccaccttctctacctacccaaaccctacccgttgatgtgcacggcaggaaccaggcctcaggacccgtcacatcctgcgcagagactgccacagggcatttcgcagcagaagaacaaaactgtgaagtcttaaaatggaacaaccttaaggattatctcctccaattactcaatttacaaatttaaaaaatgcttatttagccttttcccagctgccgccaagatgctctgcccttctgagctgaggctgcgttggggtcaggccctcactgcatccagcactagcactactccgggcagcccagccttgcacttgtccacaccacggactccatctcagagctcgcctgcactgactcagccctcattctgtataacgctgaggggatcatcacataggataaggtcaatgtcgtttctaaagcagctggggtaaatgatgacggcttttggcctggcttgtctgccaaggccctggccatcgtcaacttcgggagcctcctctgcagtggaggggcggggtgggaagacctgctcagcagctggtggtgtacctgcgggaggtcctgcccttctgtcactgtggcctaggccgagaagaagaaggtggaagcaaagaaagaagaatctggagtctgatgataatatgggctttttttttttttttttgagtaaacctattttataacacgttcaataaaaagctgaactcttaaaaatgcttattaaagagattgtcacaaacctcatagctacaatactgataagagtgatggataaagggtatgggactcccaatccaatgttctttattctctgattctcagacttccaagggcttttgctaaaggagctttatgaattatgaaatcccaaacgtccctcttcactcctttcagagaaattgcaaaataacatcttgactttccttccacctcctttcttttctttcttggctcccaagctccttttccttctccgcgggcttttagtcacagcttcgtgtacagttggtagaatggctttgggaaactcctatgatgcctttgggcctccagttttcttatctgaaaaaggagtatgttgaatggatgattcctaatggccctgaacaatttttttgttgctgttgtttcaaacctaaggtcttgattttatgtctttcttttcctctctgctctgtggacctatcagagccgtgacaaattgctggtgctattaaaatccactctggcaaacagtgctctgaaattaagtcaaaaagctcatcaatataaacaaagagtaaacttaaatactgaagaacccaaagaagacacaatagtgtggttgttgatgggagcatttattacctctgaagcacactccctgctaagttccatgtgtctcaaattcacacacacacacacacacacacaatgggtgtttatttggaaaacatgtaaagtgagaaagttttattctttagctctaaagcttttcatgttgtcctataattataataaagtttacagtctttgaatgcctgatttgaaacaggcaaggcactgtgctgaacactttccatatgatttaatcatcgttagtaacatgaagagttatgtgactcttccctattttacaaatgaagaaactgtggcttaatgagtttgagtagctcaaccgaggtcactcacatagttactggtaggtttgaaattaggcagtgtgattgatttcagggcccatgctcctttgtggaatctccaaatatactgcaataatacatctcttaggaggatagctgatggggagtgataaagtgtgcagctgggggaagctgaattggaaaaatgctttttcgaacctcatctgtgatggaaaaaatggctaatgccaacatgactgatggttttgtgcaaatgcggtcagttccagaaaaaaatttgtcttacattatgaaacctatatattgtccaatatttcctactaatagtgacagtgatgtgattaaggaaacccatttcacaaagacctgcctgggcctgtgcttaatgactacaagaatgtctgagctgagcacactgaaacccaccttgtctgggaatgtcactactctgtaaatcagcgagggaggggagggtcgtttccttatttgaagaatttcaatttttaaaaaagaaaaaaaaatatgcactatgaatgtgaatgctaataaatatggtttgagagtcttggaatttcccataattccttcaattacactcattctgcttacagaacccagttttgcactcgtaaatctcaacatttccttttagtcacttccttcccatcccttctttccttgcgtggccctgctcttaattccaggtatggctgacccagagccaagctcttgggccctctctctagtctcttgctgtgttccagtcttcacaggtgaatcctggcctccccctctctgtaccccactcaaaacactcatttcttcaacatggctcaggtataggtatagggtgagaaagagagttgattaaaactaatttacactaagatctgaatgtcagataatctctaggcctaaccccaggaatattttctttttaatccaagcaaatctctagattttggcttatgcttccagaccagagaccttcctgtaaatgacaatgtttggtttatcctattaagtgtgtgacagcagccagatgtgtgtaagcctagcacggatttgcatgctcccaaactgatagttccaccaggggcaggttgcaggatccattctcatgcttggagtattcttcccttgtgatggggaacaggtgctgggagccatgtgattttctttgagcagctgctgactggctggggttagatgagagactcatagctatgcttccttcaagaactttccaaagagtgagaaaagacagcaaaagggctaggcatggtggctcacgcctgtaatcactgcactttgggaggccaaggtgggcagatcacttgacaccaggagtttgagaccagcctgggcaacatggtgaaaccccatctttactaaaaatacaaaaattagctgggtgtggtggcatgtgcctgtagttccagttactcaggaggctgaggtaggaggattgcttgagcccgggaggtagaagttgtagtgagctaatgcgcaccactgcagtccagcatgggcaacgggagtgaacccctgtctaaaaaaaaaaaaaaaggacagcaaaagaactgctcctctccttattgacattattcccatccacgtatttcttcctttatttttcctctcctagaaaggagagatggggctggaattgggcttggaaagcagctgcatggccccaaaccctcctcctgctctctctttctctgcccaaaccttccccgtctggttctattttctctgaactctgcattagttctatcctcagcctccattcttcccaaatctctttcttcctgaggactggctatgtttttagggtgggaagacagctggagaatgcttgttcctggcctccagccatcaggacctagagggtcagggctgaaccagcctggttcaggggtgggtgcctctgacccagtcactctgtggggaagtccattcgagcagccatccggccggctttgctcactcacggagctccagaatccagtaaaatgctagagtcttgaaggcattctcctagtttttgctgcatgaatggccgaccttctgacagacggatggactgactgactgaatgaatgaatggctgtgtctctgtgttcttgccatggttcttcttcacagtgtggcttggttttcttttctgcgtgatggctgtagcctcatattatctcccaaccctgacttctttctgctgtctcattcttcttttttttgcccaccatttcagttcagtcatttggtttttttgtaatgttattttactaccattttttccttgctctatcatctggcatcagaccctctagtttttctcatgatgcttcataggaagagccagacttccaaatcacccacatgagaataggggctcctacttctttggtcaccgtagctatggttttctcctcaacaatctctgcttcaagaagagccaacagctcctgacttaatcccctgaacaccttgccctgcagctcaagccatcctttgcatgtgaatttgcctggtttaattcttgggctttggaaaatccccacagcctaaggattcttcctgtcactgagtttctttccaccatttggtctgctgcagaatttctgcctctttcctgaccctctggacaccctgaccaacttacgccggtcagactgaggtggatagaacaggagtttatggccaaacaccatcaacattctcattcatggagattcagaatcctcacttccactgtaaaggcctctagatgccaagaagaaattgaaacgaataatttaaaatgttgcctctatgtctttccactgaatgctatatccattgggaaaatctgacttcatttttgaactggggctcatctaataggcttatgagggggcactaggaggcatcccagtaaaggcttggcgactagagtcaccttttacagttataaaattacagcaacatttgcctcaatggctccaatacaagataaaaccattttttcctgcccatgctggtctcctccatgaatttgatacaccggtgagtgctatggttagcttcaaaagttggtgagagtaggaactgagttctcgaattcctatccagcactggtcattagggggttcctccttagttcaactgtttctctcagaatgagggtgacttgatatggaagctgaaagctgtgagtcagtcttcttggttccagcctccagcttctgcgcttcattttaccccctggaaaacttgacatcttaatgacaaccttgagagacactgggctatggtaaaccctacttagctggagttgcataaggctaaaatgtgaagactggcaggcacttagagatcagagctgtcaacctgtcctttatatgtgaagacagcaaggctgaagacgcgagtagttcccccaaatcacacagctggacccaaactcggctccacctcacccatttccactcctgatctttgtgtgccgtttagcaaccctacgatgacatggaagtgttaatggcagtatgtccagctttcactgaatgacaacaggttttgcagagataaggagaaagaagagaggggagtagtatcctcaataattgcattattttaaaagtcagagtgtgctgttcagaagggtttgtcagcagggccttacattctgagaaatgaagtttgaatgatctcaatttaaaaaaatgtggactccaaagaagaagctaatgttacatgaccatgggagaaaataatctttaattgtttctccttgttcagcgagtggtctctccgatgtgcctggtacacatccaatgagcagaggagagagacaggctgccacaccaacaggccaaggagctccagtgccagtaacattcaggccagacccaatggctccttcttaccaggaagaaaactgccccatcaaattaaaccccagagacaagctatagagtcaaagtttaagagcagaccagagtctaccagatgcctttgtgctgaactactttggcctgaaccctcctggggtttatgtggggccacttgggcagctctcagtcagcaagaagtttttagattatctaccttagatggtgaccagggctctctaagaaggtggtcagaataaccatggacagtaaccttaggcttgcaacctcaggttcacagacagacttcccatgactgacatgaaatgtgtatgtccagagatacattttcctgggaagagtccttagcttgtattagcttctcgcagtgctctctggtgatggtaaagatggttcagcctggatcccaggtagagaggacaagctgtaccctggctggggaacctcacttagcctgtatgtcctaatgatagaatctagcttaccaacagagcaagcagatgtgatttcggtgcctctttggaaggacttcgctagtctttttttcccctatttaactggggcctgaaattgtacagctctccattcatgtatctgagtaaagtcatgtgtatgctcacttgagagtgttggcatgtggagtcttttctgaactttctggcagaaaacttgagtggttggtaaagtgaggaaggtggcactgagcaggaatggaattagctctcctcttgcatggggcaaagcatgggagcatggcatgggagggtacagtgagtaaggggaaccgggcacactgtgctgggcacacatccccgaaggagacaggctcagggcaccctgggggcctgcccagtgtgggatggaagtgctgcccacttttccagggactgaggcacgttggtctatggttactgtgaaaaaccattgctccttccaatccaggcaaggaaagaggtcacttggggagatgtcctctcatccctcaaacttctgcaagtggcagctaaagttctcttgacaggatctgtctggctggccaaggagagctctgaggaatcaggaatttcatcctggatgagtctgagctgctggaattaaaacttgtcaaatggttcgtctcaccagttaacaaagcctaagaagcatttctccttttaggaaaaaggagcaggtccacccaaatgcatgatttggaccccaacgcccataagaacgctggaaagagtaataggggaccccacatgtagacatttctccctagaagacctccttgtgtccaataaataatttgatttgaaacactctcagaagatagcaagattctctaccccactccctttatttaaaagattatttgttcaggaaaaagctagcaataaggaagtcatcatgtgcttttatgggctgcttccttaaaagcagatctcctttcataagccagtgtattttccaagccttgtcaattttactaaggtcaccattgtttcatgagtcttccatttaaaacatttttataatataataaccaaaccaaatgtccaacaatgatagactggattgagaaaatgtggcacatatacactgtggaatactatgcagccataaaaaaggatgagttcatgtcctttgtagggacatggatgaagctggaaaccatcattctcagcaaactatcgcaaggacaaaaaaccaaacaccgcatgttctcactcataagtgggaattgaacaatgactatacttggacacaggaaggggaacatcacacactggggcctgttgtggggtggggggaggggggaaggatagcattaggagatatacctaatgtaaatgacgagttaatgggtgcagcacaccaacatggcacatgtatacatatgtaacaaacctgcatgttctgcacatgtaccctagaacttaaagtataataaaaaaaatatatatatatataaatttttttaattgtctctgcacaaaatctctccctgagaccacccagtctaaagaagagtaatcttcaaactcacacctgctgaatggcttatttatttcacggtacatatcacagtttttaagttttcttatttacttgttttctttgattgtctcatcctccagagcacagatgatatgctttccaatggtaggagaccaggttatctctctcactgtagtgcaagatgggagcaggaacccaattaacagttcctgccagaagaatatgtatctagttccttctcccttttttttgcctcttacattccaactggtcaccaaaccccacaggtgtctttccttgaaacaccttccaaattttccttctccatcacctccaaccccagcactgctgcatggtgaactggttgtttaaagctgggtgagtcattttttccttcttgggcctcagtttcctcatctgtaaaagtaaagacttagaacagtaattgatgctaccccttcctatctgtaagagcagatgcttctaggcaaatggaaacagtcaaaaggggaaaacagcccatgacaagcaggatgatgaaggaacgtggtggagagatggccagaagggaagagggcaggctttggaaggaagaggggaaactgaggttttggggaaggctttgggaggacaccctcatgtctatcctagaggtttactttgagatcacggaaaggaggggtgggaggagaattcaaaggctgctgtcatgcagtgcgtctgcataggggcccaggcaattctgattgcatgaagcgggaatggaattagctctattcctgcttggagcacagcacggtttgggctgctggtcgcgtcagaacttgtgagcttcttaataatacacgggccacacacctccacatctgaggcctgggaggctaaggctgtgctcatctggtcctttccaaggagataggatggaaagggaagaaaccatgggggaaaattcccagaaataactaaagggaggggaggcttatcaaggggctcagtattgtagctaagggaacctcataatggggtatctgccaagacatgtgttatgcattatctttttgttgctgataagatcaagtccaagctcctcactctgtcattcaaggcccctttattatttggttccaccagccctacacaaccttcttcattcctcattcacttaacacataatttacttagcacctgctcaggccaggcacttccatagatactggaggtagaatggtcaggaacatgcaaaggtgtttaccttctatgagtgtctccaacaaatgcctatgttggaggcatttgttgttccaacaaaggaattatgagtttccaacaccaaggctttcttcctgccgcagtagacttttcactctaactttgttagttcacgaggtgactgtgacctcagctcctgtggctgttttctgctgcactcttctgctcttcactcagtgacctctctcccctgtatctactcaaacttgaatttgtccaattctctctgtcttcaaggctgttttcaaaatcccactcatccacgagcccttctttgttacagtatagcttgctttcttgccatttcccctgtggatttagcaccagtttcttttctttatagcagggaaacccctgggccacagaccagtaccagtctgtggcctgttagaaaccaggctgtatggcaggaggtgtgtggtgggccagtgaagcttcatctgtatttaaaatttacagcctctctccattgctcacattacctgtcagatcagcagtggcattagattccaataggagcaccaaccctatcgtgaactgcacatgtcagggatctgggttctgtgctccttatgagaatctaatgcctgatgatctgttgctgtctccatcacccccagatgggactgcctagttgcaggaaaacaagctcagggctcccactgattctacattatggtgagttgtataattatttcattatatattacaatgtaataagaatagaaataaagtgcacaataaatgcaatgcgcttgaatcatcctgaaaccatcctcccatctccaggcccatgaaaaatttgtctgccatgaaaccagtcccttgtgccaaaaagattggggaacactgctctatagcccttatcaccattttctgtgctttacttatttctatttttggttgcttttcttgactataaactcccttgaaggaagagcttcctgtctttttaatttactgctgtatcctcaacactcataatggtgtacagcatttagtaggctcccaacaatattgctgaatgaatgacacattcaatcctcctggttttagtctccttaaagatacaccctccttcttatccttcattcgtgtctctctaagtgatcaacatgattctcaatgaatgcttttgagccaatagatgacattggttgatggaagaaaacaacattttgaacacagctcctgcttcaattactcacagctggagatagattctcaaatgcagaaacagagcctgtcttaactcacattccaaggagatctttcagatcttcaagacactcacatttatgtgaaaacaagaccattctccaagtagttttatacagctaagttgcaggcacttcataaaatgattacttccagtacttataaaaacattttatagggtcctggaagaagggttgaagcctataattcagatgtgatagtcatcatctcctctcatatttgtgggattcaagtccaaggccaaacaccacacatctgaagcagtgacacaaacaaccaaaactgatctcccaaggaggaagtgtgaggctttttcaggactgtgtcccttcatattcagcttaaaggctaaagcaggtttaggtcctgatccttgccagaaaggacacaggtgagttggctgatgcttgaatagtcacaggtgaacaggggagcaggaaaatgggtttttgcttccggactgctgcaaagatgcttaatctgagtgctctggacagttccgggtcctctcccaggccactggctcacccagaggcatggcccttgcatcttccaacagcatcttctagctttgtgcgaagcaggaatatgaataaacccttgctcttcactcccagctcctgtgcagctccctcccctgcctggattaagctagggatgaagattggctataggtctctgctctttctccccagccacttgggtaaacagtcctaggctccatctggactagaacacctgaccagggcctgacctctatcagtcatgggtcctgtattcaaatggacataatacatatatataggaattttaatagctcatttaaaacatgcaggatgtctttttggaagctataatatggcttctaagtatagctgggcagaccaaattttaacacgcagaaagggattggggcaatttcctctttaattttaaaaggcaatagagtatggtactgttttgattatagacatttttgaaaataggaattggccatgccttcctctttcatataaatgtcacatttagaaatctcagctttgcttgcaagagacatccttgctcttttcaaacttaatgaagccttctgcattctcatctgagaactggctggtactttcagggggaagatcaaggtcagggcagctcattcatttcatacctttagtttctttcttttccctatgacttgcaaatctctatgcctagaccatctctgccacctgagctccgtcctgcacacacaactattaccagacatccctcctgatgtttccaaactatctcatccttaacatcatcaaactgaattcaccatctctcacaaaaccgactcttgcttctctgcttcactttgggcagccttcctctcacttgtccaagccagaaacccactgtcatcctcaaccgtccactctccaacctcttccacaacatccaatcacccagccctgactacgaaacctgtattcacttgttattgtccattccagttctggccaccaccacgtctagctagaacctcatatcagttttctaactgggcttcctgcttctggtcttatctgcttccaacccatttctcacactcttgccagagagattctgagaaagcaaacatgacactatccctcccttgagtaagtcatttcaatgattctttactgaattaaagatgaagtatgagttatatatgaaaacttattaggcccgggagactgaaaattcacttggctggataagtaggtagtagagcatggtaatccaagtgcccacccagagactctagtcagtgtcatagaagagcagagaattacatcctccaggatgtgatcatttgcgtgactgttaactcagctgagcgatgtggcatcttttgttcactaggatgtaggttagggttatagtggttgagatatcagaatttaattttaagaaataaatatacgtctcctataaggcagtgtgtccactaaaaaactcttccgaaggccaaagaatattcagaatgagtttccaactgttccagagatagtggtgacaatgattcagaaagttttgtaaaacctggaagacccaagacaggcataaaaatacctgaaggatcaacatgggaagtggtaaaaataccatttgacatagcaatcccattactgggtatatatccaaaggaatataaatcattctatttcaaagatacatgcgtgtgtatgttcattgcagcactattcacaatgtcaaagacatggaatcaacccaaatgcccatcaatgatagactggataaagaaaatgtggtacatatataccattgaatactatgcagccataaaaaggaatgagatcatgtcctttgcagggacatggttggagttggaacctgttatcatcagcaaactaacgcaggaacagaaaaccagacaccacatgttctcacttataagtgggagctgaatgaacacagggacacaatggggggaacaacatacactggggcctgtttggggggtgtggtgaatgagagcatcaagaagaatagctaatggatgctgggctcaatacttaagtgatgggttgatctgtgcagcaaaccaccatggcacaagtttacctatgtaacaaatctgcacatcctgcaacatgtaccccggaacttaaaataaaagttgaagaaaaatagtcaaacaaagaaacaagtgcatttgaggctgtctcagaaggactaatccctggtacccgttgtgattttctgtgacctcacaccagccatgtttctaagaaaaagtcgtttcccgctgtcgggattcccctctgaaatgctcacccaatatctgctccaattaggtgattaattcagaacatatcagatcaccaccaataatagtttctggatgtgctgttagagaacaatagtgttggtcagcaatctcagcacagatgtactaattccccaggtgggtgtggaagcagtaaaacttttactcaactgtagttatcaatttctctctctctcactcacagaaaaatgttcatgagaagaaaagaaagctgacacagttcgtcaaaatgaaaataatgagactcactattgttgtttattcagatttgattttggagagttagaagagtttctatctcaagataggaattggtgttagcaagtgactgccttcagaatgtgttagaacctggggatctggcatgactctattttcctaagtttttcataaggcttatactatctaagaataactaaagaagaaggctgctagggagaccaaccaggaggctagcatattggtttggggtcagagctctaaccgatggctgaaagctataggaagactgatttgggctgccctggaacttggctttaccatcaatgatacatgaaaagtatctcagaataggcgggatacccactcactgaggccagagactggggagttaagtaccacacagcatcctattaaaatactctttaggggacatttaaatcctgaaattttacaacttattgagaaagcaaaaattattggtggagagaaagttgattgttttttgaatgttgaatgaatgaatgttgaatgaatgaaaaaattgaatgtcttgcttcccttttaatattgcaataaggtgtacattagaagcattttaaggggcatatatatataagaatatggatatattattggacatgacaacttatttagcatgatttatctgtttctgagaatgagactagtctatatgtatttcaataactcctaaattttctccatttagcattcattacacacattttgatctaatttgttgttgaagccatttataatcacctcatataaacacttaaggcaacaagagctgagctgacgtctggactacaaatacgcaaggatgtcaacattcagaaaagatcaggaacttgctcagggttacacagccagtgagcaaaacgactaggttaaaaactctgttcttcagatttccagtttagaaatctttcttttaattgacacattgatttttttttcaattgcaagagtagaaatatcctccaattatttgggggctctcagaaaccctactctaaaaaaacatgaatacattcaagctgagtatctgcagctagcattcagccatcaagcgagtggcttcagtccttgcttatttcagctcatgattcatacatgcctcttcatgtaaatgtctcacagaaacctcagggttaatgtgttcaaaatgacacatgctagtctgcttgattctggcatttcccatctttataaattatatttggtattcactcactgttaagaaaaagtgacaatcagtcctgatgtcttcttgacgtcttcagtagatcagaactcctagtattgccccagtctttccacgtctctccatctccattgtcaggccctactcagccacaacacctgtcacctgtaagtgccttcttgttgatctcctgcatgcctgggtcaccttcccttttccctaggatgacctttatggaatacaactctaattcggtgacatttccacttaaaggcctcaaacactttccagtactcttagatgaagcccaacgtccatagcatgggccatagggccatatgatctgctcttgccttccgctcctggcctgcctttcactctcttccctatcccctgctctggccaccctgacctcttttttatttttatttttaaattttttttttttgagataaggtctcactctctcacccaggctggagtgtagtggcgcagtcttggctcactgcaaccttcgcctcccaggctcaagcaattctcctgcctcagcctcccgagtagctgggattacaggtgcacgctactatagcccagttaatttttgtatttttagtagagacagggtttcaccatgttgaataataagactcattattgcaagagatgtactccattgagtacatctcctgacctcaaatgatccacgtgcctcagcctcagcctcccaaagtgctgggattacacaacctgatctcttgatctatggaatacttctctgcaccaggcccttcacttctgctcttctccttgcatggagtgtcctctcaacctctgtcccctccactcaccatttatatcttagcttaaatcacccttcctcaggggaaagatctttgatccccttccacccatccatatacctcagactccatgctgggttgggggggggggtctctcattaaatgttatcaaagcatcctaaactttttcttcatagctcaagcaattgttcttatttgattatgtgggtgatgatttgttcaacatatctccctatgtaaatttcataaagataggatttgtgcctggtacattgtagttgttaaataagtattcgttcatggataaaatatttatagagcactcattatgtggcagacatcatgcaaaatattacacaaacattatcccatttaattctcccaagaacatgatgtgactgtattaccaacctcatcttacagatgaggaaactgaggcttaaggagtttaatttgcaactaaggaaaatagctgagctcagattcaaattcaggcttcatgcccaaactcatgttttaaatttctagatgatgctatctgcgaatctgtcactgctttgctggctttatagtgaaaatagtgcacagagccatagtacttgaagttcaaaacaaagacaatcatcagaatagccaagaaaattaatcacacattccatgtcctattttttcagaaagcagagacatgtgtaattcaaattattaatacaaaaataaaattctcgaatgttaataattaggtttgttcagaatagacatgtttggacatggaaaaaaaacccacacatactatattctgtctgaaaagactttgacaaaatgcaactaataaagtacgcctaaaaaacaatcaggtaagattggtcagaaagtatgatctgttatgtatgacaaaatctgggtgaaagtgtaggaataaaaggagaactgtcatctgtagttcttggatatggagagaagggaaaagtgaaggagagatgataacagaaatagttaccatctcgtgtgctgcataaaaatatcaatgcctgacacagacttcttagttcttagtacttgttccccagggaggaaatcccgacagctcacttggtagttcagggatgagggcaagattgttcccttttctgtgcctcagtttcctggcacacgtaagttcagtgtctggctgtaagcatttgctcatttgctatcccagagctatgatcagtttccttcctctgcatgtagcagctctgcatctactttcagggtatcttctcagtcattagtgctatcttgtctatttttttttttttaacatttggggataatttccaaggtcagaaaccggacattgagtacatcttcctgcagagatgcccctggatgtgtggttctggtttacacaatggttacccagatgccacacctgtcagctgctctgagaatccccaagtatttcaagagaatttctcttattcagagtgctggggaaaagacatattcacagagaaatgtgctcacatttcttgcatagcctgttgtccaatattacctaattgtggctacagaaagataaggtataattttatttatttgggatttttttcaaggctaagttgaatctaatcaggtaaataataggtgtgtttctacaagttgtgctaagtctactctagagctgaggccatatgtttattacataggatttcttgctggaatttcttccatggatacctgggctttctatcacatctggcactttgtttcttctttttgtcacttttagagaaaaagcctcccagaaattagacataatttttgaaaaagagttagagaagtttttaagtttcatgatctcataacccatgtggagagttcttcctagcaccatgagggtgatgatggtggcactaataatagtaattataacagtagatgtaatttattagtaatttcaactgtccagcaatgtgctaagtacttttcatgcaccacctcatctcctcatatcaaccatgtaaggtaggcattgtttatccccattttacaaatgaggaaaatgagactcggggagtttaataatttgccaaaaaacaatcagccaataagagtgaagctgggttcaaacccatgcttgcctggctccagaccctgtcctgtacctgctaacaccgaatgcgctacaacccactgcctggtttctctactgctgtatagtgctgtgtgcttattgccaaattttcactggcaaaatcagatcctgatttagacaacaaaacaaagcaatttgaatcaattattaagaaattttatggttaaaaatatatatttttaaaattttactttaagttctgggatacatgtgcggaacgtgcacatttgttacacagacatacatgtgcaatggtggcctgctgcatgcaccaacacgtcatccaggttccaagccccacatgcattagacctatgtcttaatgcccccattccccttttccccccacccctgacaggcctccaggtgtgatgttcccctaaattgtttttaaaaagggtaaaattcatatggaaccacaaaagaccccaaatggccaaagcaatcctgagcaaaaagaacaaagctagaggcaacacactacatgccttcaaaatatgttgtgaagctacagtgatcaaaacagcatggtactgatgtaaaaatagacacatagaccaatggaatagaatagagaatccagaaatcaatccatgcatttgcagctaactgattttcaacaaagctgccaagaacatacagtggggcaaggatagtatttttgataaatggtgctgggaaaattggatatccatatgcagaagaatgaaacttctaaactcctatctctccccttatataaaaattcaccaaaacagtttcaaaacttaaatgtaagaccaaaaactataaatatactagaagaaaatataagggaaatgcttcaggacattggtctgggaaaaatttaataaacaagacctcaaaagcacaggaaacaaaagcaaaaatagacaaacgggattatatcaaactaaaaaccttctgcacagcaaaggaaacaagctatgcatctgacaacagattaatatccagaatataaacggaatttaaactattaaacagtgaaaaatgtgataatccaattaaaaagggaaaataatctgaacagatatttctcaaaagaagacatacaaatggctaaccaatatataaaaatatcacgaatcatcaggtatatgcaaatccaaaccacaatgagatatcttcttaccccagtaaaaatgtcttcatcaaaaagaaaaaacataacaaatgctggtgaggatgggaagaaaagggaactattatacactgttggtgggaatgtaaactagtacagccattgtaaagaacattatggtggttcctcaaaaaaccaaatacaagtagaactaccatgatccagcaatccagctactgggtatatagccaaaggaaaggaaatcagtacctttaagggatctctgcacttctgtgtttattgcaatgctattcacgatagccaatatatggaatcaacctaagtatttatcaaaagatgaatggataacagaaatgtggtatatatacacaatagaatactactcagccctaaaaaagaatgaaattctgtcatttgtggcaacatggatgagcctggaggacactgtgttaggtgaaataagccaggaacagaaagataaataccacatgttctcactcatatgcagaagctaaaaaagttggtctcgtagaagcagagattagaatagtggttactgaaggctgggaagaatcgtggggagggggatagggagagattgggtaaaggatacaaaattacagctagataggaggaataagttctagtgttctatagcactataagatgactatagttaaaaagttgtgatatattgttggatggctagaacagtttgaatgtttccaacacaaagaaatgatcttataaatgtttgaagtgatggatatgttaatcactctaatttgaccactatacattatatatatcaaaacatcactatgtgccccataaatataatatgtatggttattttgtgtcaattaaagaaataaaataaaaataaattgttaaaaacttcctaacatagaaattatagtgactttctctttggaataagtttgatctatattcaggcaccaaaacagtttgaagaaggtcatagcaaccatgtttaaaaattactgtgtcttttaagatacaaaattaatatatgctaaatttttacaatctgtggtatccacaattggtatgcctcccatgcacatataggtgcatgtgtacacacacatacacacactcacacacacacaatacaaaaatcaaccatgatgctacaatctagaaataagaccagattttaaacaactatgattgtatttagagcacatgctttttaccagcctttatgtaatatgtcatgaacattttgctattttatttttattatagaacacaatttttcatggcatcttagtatttcattgcatgaatataacaaaatttatctacttctgctaatttgaatattttggttatttccagtttcctctattataaataactatgaaataaatatttgtgtggatagatttggagtattttcttaagttacatttctagagaaagaattctgggtcatataatataaatttcataaggtttttgatccgtattgccaaattgctctctggagaggctatacctacttatacttatccagcagtgaaaagtaatgacagtatggcgatgatgatggcagtaaattatgagtgcccactgggtgctaaactcctagagcttcacatgcagcagctgatctaattttcccatgtgttcagtgaggttgggtgccacgaagcctgttttatataggcaggttttatctgcataggaactaagaaagacattcttgccaaagactacaagggtctgcctgacctggcctctgccatttggtaagaaaacatttaacagccatgccaaagtgctttttacttcttaaactgcccagattttcctaacaaagcttttgtattcattcatgttccctcttcttgagatgttcttcccttgggtttgcaggtctagacctttctcttttatgtctcagctcagaggctgttcagtgaggctgggtgccacaaagatgcattttctaaacatgtaatctaaaggatacttctgtccctacttcccaatatccctaacaccagcctccctatcacatcagcccactgtatttctttaatggctcttgtccttttctgaaacatttaaaaattgtctgtttcacttatgaaatgtaatttccctaaggacaaggagcactagaatggaggctggtaaacagtaggaatacaatacatgcttgctggctgatgaataaatgcccatatgaaaggaaagctacaaagcagccatcaggattggaacccaagtgcgcttttgaatcttgctttaatcattgcaatctacagaggatgtctcctatcccaccctcagcagcagtatgtatttatttgctctttgccaatttgataggtaaaatatgatatattttaatattttattagttatttgtatttctgcttttgttaattacctctgcccattttttccattagttagtcatcttttctcattttttgtatttatcaatatttgtattagacctctaaatatatccttgccaggtaagaaaacaggtagaaaagaagaatacatgattaatttgatagatgtagaaagacattaagtagaattcatcaccaattctggataaaatcattttaatgcatatagactggaaggacattctcttagtagcacaaagaagacctgtaagttccatcacaatatttcacaaagaactaccaaaaacatagacatttaactcagtactttctcactcatgctttgccttaggttctttatgtagtaaatgtttactttgtaagcatcaaatgaattaatgtagacaggaatatatagatcagtgtctggcacatagtaaggtcatatacgttggtgattattgttattaccactatataacataaacaagtaaaataatgagtttgtaaccattcattaattattgcttacatttttagtacatccatgctcaccctttcatgagtaaaattaagtatgaacatgttcaaatatgtgaattacaaaaataaatgtaaatggattaaagtgctgtgttaaaaaataaagcctctcacactgaattaagaaaaaaattgaatatatactgttatgaaagacacaaaagacatggttacaaaaataatatggtttggaaatatatactaagcctaggtaaaaaaaataaactgagacggtaatattagtattaaacaaagcagactccatgacataaagcatttcatggaatagacaggattattttaggttgataaaagtcatgcttaccaatagagccatatttattaaattttatgtaccaagagatagcaaatacataggtatatgtatgtatatttttaaaatgcttaaaaattgataaaattttacttgaagtagatgactaagatacagacaacaaaatatgtatcaagttttcagtttaagagtaaatcaatgacaacttagaaaatactgaaaatgagagcttcatgcaagaagccaaagttattctcctctgtgaagtcttagatggttatatttaaacaagaaagacacaaatagcttaatttgggcattagagtaaataagttggaaaagaactacaaattaaaacaaaggaagcaaaaattaatgaattaaaaagcagaaaatcattagaattaattagtacatttaagctgattcattgaaaagactttaaactggacatgcctctgacaagcctgactagaaagtaagaggaagagtataattgtccatcagtaataagaaataatatattttcagatgctgaaaaaagtgaaagcaatttcaagtaaaaaaccgtatgcagataacatgaagaattttgataaatttgaagatatttgtctaattttattcaaggagaaataatatatgaaaactataatgattatagaagacacaaaaattgacaaaatttatccttagaaactgttggatccaaataatttatattcatgctatataagtattttcagagtctttaagtatgtaaaaatgcttcctaattcactttcaaagctagcataatcttgatctcaaaactgagaaatagagccaaatcaaaagaaaacaaataaaaagtaaatatgaacaacccactgtcaccacaaaacaaacaatcccacagacttgtatcatttagaaatgaagttgaaatacaatgaaagttgtcgattatatctaccagtctattaagtaaaaacaaaccatgatcaagtagggcaggaagtggcaaactttttaagttttattattaaaaacattagggaataatggaataattaacaggaagggaacactttcatttcaaggattgaagttgttacctgaggtggctctttttgtattcagtgatacaccattagattctgcatcattttcatgcaactttatctgtctcttcattgttgtcagaataaattaagagaaaaagtgaaatttaggaggaaagaagcctgctatctctggtaatagatagtctgtgtggttcttctggcctcagaattgtggttcatgaatcttgcatgaattttgggatacagggccagatagtaaatattttaggccttgctagctgtatggtctctgtttctattattcagttctgccactgtagcttgaatgcaaccatagtcattaggtaaatgaatgtgtgtgactgtgttttaacaaaactttatttgtgaacactaaaatttgaatttcatataattttcctgtgtcacaaaataaattctttgtttgattgttaaaaattatttaaaaatgaaaaaattgtatttaattcatgtggccataccaaaaaaaaggaggcaggttggatttgacctatgagctctagttagctaacatctaaggtaggatttatccctcactttaaagggaattaagaacaaaagtgtttcttctgccctttgattattaagaatattattatgaacaagaaagagatgtctaaaattacaattaatgaacaatgttctagaagattaagtcaatttaatgagagaagaaaagaaagcagatataaataatggaaaaggcaacttattaagatgtgtatcctgtgtactataataatttgttacctggaaaacaaacgttgtattttttaaaaaatcttttttcctaactttgaattctaaaaaaactaagaaacaatgatcagggcagttgcaatgaatattccattagattgtgtccttcaaacaccatctcctactaaaaaggaccaagacttcctggagaaatggctgattccaggtctggccaggaaacatacaagaacagacttattgctactggtcaggtggccacaagagactgcagtatcgtgtcaaaagagctaaggaactaacttaaatgaacaaccattggccaatgatgagacaatgtgagactcgataagcattcacaaaggattaaaaatcgctgcaaggattaataatgagtttcaattagtaaaatctcgatgctgggggaaaataaacctttatttattacctttgaaggaaactaataactgccttattattttgaaaactgataagtaaagaaccaggcgtttatcccacctttcttgtaaaatctacacctcagttaatcaaatggttgatgagcagaagttgctccatctatgtgttttcaaactaataaatgaaagtggaatgatagaatatcgccactttgcaaccctaaaaataaaacaaattaataaatttaggcaattactataattagcaatattttgaaaaaaacaataaaacattttttacctcctgatggaagtatataccatctaagcattagttttaccacaaacaaacagacaaagtgatacatccttctaagtctaatagccaacttgcaggaaccataaggaggagaatatattaaatgacaccactgtgatgaagtcagcaaaattcaggctacggaaaattgtttattcaaaggaaaattaaatagaaattccaagaaaaagaaagcgtaagggagaacttgtacaggaaataaacttagacttataaaccattcatactatatggacctgatttggatctcaattcaaataaaaaagttctaaaagtgtcctaagaaaattgaagatatatgataatataaaattattgtcagcttttgtttagatataatagtattattgttatacatttcaaaaaaagagtaatgtttagaagtaaatagtaaaatatttacagatgaaatgacatgctctctagaatttgcttccaaagaacctgagtggagtgagaaatctgaataaaataaaactgcctatgaattagtttacaattattaaaattgggttataggtacatcagcttcattacatgattgtctctacttttgtatgcatttgataatatccataataaatacttaaaatattaaaaaagaataaaagcacataactaaaaaataactcactgattacctacaacatttcgctaccttcatctgcatttccaagtttttttaaatagctttcataaataagtttgctttttaattcatcctgcttgaaagccaaatgcattcagggctgtgaaggacacaaagaggtgggattttgttcccagcctcctggattcattatgaatgaacaaagactggtagaaatcctatggtaattcacagcctacagtaccgtgaagacaaggaggaaagattcgaggacaaatgtatcctacacgtggccgcagagaacagacaccatggggacatatgagacagtggagtggagggtattttaaatgaaggggaatgatgctaaaggagggtcagtgtaaaagtggatagagagatgattaatttcgaaaggggggtacaagatgaagggacacccctgaaatcgggcacaggcacatagatttgataccatgattatcaggcagcctctgtaatgtgtgaccacaggaagcttttgcatatggctttgttttaaaggcagatatgttcaggacatattggagaggtttattccctcactgcgcaaatttttatagagatgagactggaattgagagtgaaatgaagggagtcgtattagagcatgagttctctcagcgttctcctccaaagggtctgcaaggtgaacaatatgttcacaacgatactaaggcagtatttgcctttgccactatcattctgttgtgagagtggagtgaaatgtttcagagatgaaatgatgtgtgttattgtaacagattaaatgaagagcagatatgaggatttagctatcatttatagcctgacatcaaagacacttgcaaaaatgtagaacaatattaccccctcactgttttaaatttggaaaatccagtttgttttaacaaaagtatgttatttatgttaatatgtaatgggtttattatttttattttattttattttatttatatttaaaacagcgtctcgctctgtcgcccaggctggaatgcagtggtgcgatcacagttcacggtagccttcaactcctgggcttaagcaatccccctgacttagcctcctgaatagctgggactataggcatgagccaccatgcctggctaattttttgattttttttgtgaagatggggtctcattatgttgcctaggctgggcacaaactcctgaactcaagtgatcctccagcgttggcgtcccaaagtgctgagattacaggtgtgagccatcatgcctgacctattattgttattttaaagaaattaatatattttttaaatttctcagttttaattttgaatattgtaaatatcaacagagtctacatacacaaaaactctttaatgtcctatataattttaagagtgtagaggggtcttaagaccaacaggtctgggaattcctacatttgagtgtttattgaggctatggagaagggggattcaagaggaattgcaaaggaaaagtgatcatgacatggtgtttacgtcagtacataattgttaagtgctcataaagtccaaggtcttaaacatgaagtagaaggacacaaggtgtcttcaggtggtcaaggtggaggtctgtttgattcagatacaaattctcatctgcatcgacagtaagttagtcttttttttttgggatggaatctcacttgtcacccaggctggagttcagtggcaccatctctgctcactgcaacctccgcctcccaggctcaagtgattctcctgcctcagcctcctgagtagctgggattacaggtgcttgccaccacacctatctactttttgtatttttagtagagacagggttttgccatgttggcaaggctggtcttgaactcctgacctcaagtgatcctcccacctcagcctgccaaagtgctgggattacaagtgtgagccactgtacctggctagtcttgaataacttctagtgatgttccaagtgatttgctctttcagagaattagatgggcgagattctaaatctcactcagaaaagcatggcttttttaacccataaagaaaaaatgctttctcaaaaggactcaatatgttaagcagatccgaatatacttatccctttgcttacacaagtcataaactgtgtcagctctcacctacctcctgcttattctcatttacttttgttcaaaggacatttttttattcctaaattatttccccagacagagatgataattcagtatcttgatgttcatttaatgcatgtgcatgggaagccaagtcatttgactatcaggagtctagtgaaaaatagaactagaatggtatctgcctgtgaaaaagacacaaagtttagagaatatactaaagtttacaaaaagaggattttgggggttatgtaggttaccattattaaatacccaaataagattatttctataagaaacactttaaaacaccactcacctaccaccatccccatgacaaaattaaacactctccttgtgctcccacgagtactaccattttcctctatagtattaccaacatctctgatgtatgacagtttgttacatttctttcttttttctctctctgcccagggatatcttgcagagcaggtattttgctttattcccatttgatttccaacaatcccttacatggtacattctatctagcaagtttcaataatggatgttgaatttaatgaactaaaaaagccccggatgttgtcaagattgcatttgtttatttaatgtatatagttgttcaaaagttcattaatggggtccagttatgacacagtaatgggtatgatatactcttctgctgtaaaaaaaaagatgtaattgattacaatatatgaagtccttgtttttaagcatttaggattttgatcctctggagaagtaaacacatgagatgagctcaatgttactctttctccttcagggcattttctaaattgtggcacagagaagttgtgccctaatgaaactgatctctgggtggagaaaacagaggttgtcacccagggaaactgagatgggtgaaatttgcaaggcaaggtgccacagaggagagagctgtgcagtgacttccagtgaatctgtgtgctggttctcagttaaactacagccaaatatttgaatctgtggtcaaatatacccagtgccagcacagggtaattgcctacaagaataccagtaggtgggttcatttgattctttgaggcatggccttaagctttgccattacttttaaggctagagcaatgctgatctaagatatacttttctggggtctcagctgatcccagattatggaacaagctctctactgtagcttgtttcaccttcaatgtgtcatgtatgacatctggagtctctgttgagtttgcagctctctgggacaataagtgaatattttagactgtatgccagtaaattaaacaaactaaatgaattgaacaaatttcttgaggtacacaaattttcaaaagtgatttaagaagaaagaacatttgaataaatcaatttacatggaaatgcacgtaatctagaattgccaattcaatgtgaaaaaaataaagttggaggagttatgttacttgacttcatgatgtattaaaaagattatcatctgctgggcttggtagctcatgcctgtaatcccagcactgtgggaggctgaggattgtggatcacttgaggtcaggagtttgagaccagcctgatcatcattgtgaaaccctgtctctactaaaaatacaaaacttagccaggcatgttggcgcatgcctgtaattccagctacttgggaggctgaggcaagagaattgcttgaacctaggaggcagaggttgcagtgagctgagatcgtgccactgcaccctagcctgggttacagagtgagactcggtctcaaaaaaaaagagaaaaaatgatcatcatcaaaacaatattacattagcattaaagacagactaatagatgaatagaagagaacagaaactctaggaacaggccaagatgtgaaaaatgatttttcaaaaacagtataaaaataattcaatggaggaaggtagctcaatgggggaaagtcttttcaacaaatggtgtaagagtaattgaatacctatatgccaaaatgaccatccttgaacctagaagaaatggacatattcccagacacatacaacctaccaagactgaatcaataagcaatcaaaaatctgaatagaccaataacaagtaataatatcaaagccataataaaaagtttcctagcaaagaaaatcctggaacccaatcaatggttttattgctgaattctaccaaatattcaaagaagaactaatacgaatcctactcaaactatttcaaaaaatagaagaagagggaatgcttccaaatactcattgtatggggccagtattaccttgctaccaaaacacatgaaaaatcatcaaaaagagacataaaaaaccccaaaacaaaattacaggataatatctctgatgaccattgatgcaaaaaccctcagcaaaacacttgtagtccaaattcaacaacatattaaaaagattattcatcatgaccaactgagattcattctagggatgcaaggatggttcaacatattcatatcaatcagtgtgatacagcatatcaatagaatgaaggacaaaaactgtatgattatttcaattgttgctgaaaaagcatttgataaaattcaacatcgcttcatgataaaaagcctcaaaaaattgggtatagaaagaacatattccaacacaataaaagccatatatgacagacccacagctagtattaaactgaattggaaaaagtgaaagcctttcctctaagttctagaacaagacaagcatgttcactttcactgccgttatttaacatggtactgggagtcctaactagatcaatcagacaagagaaagaaagtaaaggcatccaaattggaaaggaagaagtcaaattatccttgtttgcagatgatataatcttatgtttgaaaaaaatctaaagaccacactgaaaagctattagtactgatttaaaaattcagtaaaattgcaggatacaaaaatcagcagcatttctatatgccaacagcaaacagtttgaaaaagatatttaaaaagtaattctatttacaatagctacaaataaaataaaatacctaggaataaacttaaccaaagaagtgaaagatttctacaatgaaaactgtagaatactgacgaaagaaattgaagaagacacacaaaaagtggagatattctatgttcatggattggaagaatcaatactattaaaatgttcataaacacaaagcaatctacagattcagtgcaatccctatcgaaataccaatgaaataaaataaataaaatttatatggaaccacaaaaaaccagaatagccaaaggtatccagagcaaaaagatcaaaactggaggaatcacactacctgacttcaaattatactatagagctatggtaaccataacaacatggtaccggcataaaaacagacatacagacaaacaaaactgaatgaagaacccagaaataaattcatacatctacagtgaactcatttttgacaaaggtgccacgaatatacactggggaacgaacactctcgtcagtgaatggtgctggggaaaccagatatccatatgcagaagaattaaaccagacccttatctcttgcaatatacaaaaatcaaatgaaagttgattaaagactatgaaactactaaaacaaaacatcagagaaactctccaggacgttgggctggcatacatttattgagtaatatcccaaagcacaggcaaccaaagcaaaaaaaacggacaaatgggatcacatcaagttaacaagcttttgcacagcaaaggaaacaatctacaaagtgaagacacaatccacagaatgtgagaaaatctttgcaaactatccatctaaaaagaaactaataaccgaaatttataaggagctcaaacaactcaataagaaaacatacaataatctgattaaaaatgggtgaaagatatgaatagacatttctcagaagaagacatacaaatggcaaacaggcatatgaaaatgtgcttaacattatttatcatcagagaaatgcaaatcaaaactacaatgagttatctcaccccagtaaaaatggcttttattcaaaagacaggcaatgacaaatgctggtgaggatgtggagaaaagagaactctcatacaccgttggtgggagtgtgaattactacagccactatggagaacagaatgggggctcctcaaaaagctaaaaatagagctaccatatgatccagcgatcctactgctaggtatatacctaaaataaaggaaatcaatatattgaggagacatctgcattcccatgtttttggcaacactattcacaatagccaagatttgaaagcaatctaagtatccatcaacagctcaatgaataatacaaatgtggtacatatacacaatggaatactattcagccataagaaagaatgaggttctgtcgtttgcaacaacatggatggaactggaggacattttgttaagtgaaataagccaggcaaggaaagacaaacttctcatgttgtcatctattttggggagctcaaaattaaaacaatctgactcatggagacagagagtagaatgatggttagcagtgactgggaagcgtagtgggagggtgaagatgggaaatggggatggttaatctaaaaatatagttagatatgaagaatgatatctagtatttgatagcataacagagtgactacagtcagcaataatttgttttatattgtagaataactgagggagtacaattggaatgtttgtaaaacaagaaatgatgaatgctagaggtgatgaaaacctcatttattctgatacgattattacacagtatatgactgtatcaaaatatgtcatgtactccataaatgtatcctactatgtatccataaaaattaaaaatgaaaaaagatgactcttgaactatacttatactgtgcacaaaaattaatttgtatggagtctgaacataaacataaaagctaaacctataaagctttaagaagaaaacatcgaaaaatacctttgtgatcctagagtagtgaaatatttcctggataagacttggaaagtgataaatgtaaaagtagataaataagcttgatcaaaatgcaaacttctgctcatcaaaagatggcattaacaaaatagacaaaacacagcctacgagacaatacagacaatataaatttctaacaaagtacttgtatccagaatatatgcagaaatgctacaactcaataattttaaaagtccagttaaaaacagatgaaagactagaatagacacttgacataggaagatatacaaatagctgatgagcacaggaaaagatgctcagcatcgccagtcatcagggacatgcaaatgaaaagcgtaatgagatactaccacatacctactacaatcactctgcaaaagaatattttggaagtttccttttttttttttttttttttttgagatgatttcactctgttgcttaggctggagtgcagtggcaagatcatagctcactgcaaccttgaattcctgggctcaagagatccttccaccacagcatcccaagtagctgaggccgcaggtgtgtgccaccacacttggttaatttttaaattttttttagagtcggggtcttgctatgttgtccaggctggtctcaaactcaagggtcaagtgatcctcctgccttggccccccaaagtggtggggttatgggaataagccatgaatttcttgagaagttaaatgtgtatctgtcttaggacccattactctccttaatgcttacccaggagacatgaaaacacatccacatgcaggcttgtctatgagtgttcaaagaggctttatttggaatagccccaaagtggaaacagtccaaatttcatcgatatgtgaaagtataaaaaattatacctattactctagaataaaaaagaatagactattgatacatgtgacatgcatctcaaaatcattatcatgaatgaaagaaaagaggccaagaagattcatactgcatgattttcttcattgtaggagtctagaaattgcaagataatctacagtgatggtaaacagatcagtatttgcctggggacagaatccgtaactccatggattccatgggtgtcagagttgtgctctgacttatctgacatatatcactatttgatggacaaatgatcatataaagtgaaaaatcaacctctaaactaagagtttgggatctaactccagaataacaccagtaacctctgtgtgtctcattggaagaacatatgatgcttcgaggatggttatgtcagagagcaaatgagatggtgtgtgaaaaataatagtaattataagatctgatataaatttaatttattcttattgtttgttattaatagctagagataagcctgaaattataatttcatagctcatcagtgagggcaatgaaggatttgcatcaaaataagcttcggagtcagtctctctctctcacatgcatacacacatacacacatgctcgtatgcatgcacacacacaaacatacaccactcaggtttcatagacattatttctggagataaagagtatggctctgaattttgtttctaatgctgttggttgtttgcatgctaattctagactaggaatcaaatcctaaaacgtcagttatattgtgtcccactgtgacgaccaagaatggggctctcacctctgcctacctggctcttcacgtgaagtcgccttcctcatttgtccactctcaatttacacctattgcctcagtatggttattaattgtgctttcttacattttgagtgttatgagctagacagtaagttaacattgaattaatatttctggtttggatctacaaggtgggaattattcccactttaaagatgaagcaaatcacttgtctactacgctacaacattgtcttagagaagggagaccaagactctgggtaatacaagactgaatacttactgcgtgtccactctatgcccagtactttcgaaacgctttccatatattagctcatttaattttccaaaaatgctaggaggataccaagacattagtgttattacagattacgaaacaggcatgagaggctaagtaacttgcccaaggccatggaacaagtgagagatggaactggatttgaactctggtaccccagctccagagctggtgggtaataattacttgctatgaaaagtattacaaggctttcttttttgtgttgcttctacctggtacaagaatcttgatgagccaagagttactggaacttcagtaagctcattacttgaacacatttatttttaaccattttcccccccacatagatttggcattattaacagagccaaagccaagtgacgttggcccttgataaagacacagcttatcagagcctgtgcccccttccccctaggcatcttctatcactgttgcaggtgcaggccccctccacacccactctggaaagctgagggttgtggctggttctccttttctaggacattccctgaggccacttgtggcagccgccaatgtgcttgctcttcctattttatccttccaggcatgtggcagctttacctaatgaccgaactcccgaatgttcccattctgtcctgcctctcttttccccttactccaagaatgacccattatgggttattagcactgccctgtttttaactgggttgcaattcatgcagcctcctaactgcaaaatcacttccctacagccttccttcagacaaggtggaactggccccagaagctgggtgtttacaccaaagatttttttttttttttcgaaagctgccttctgttttgctcttcccttactgtataacagatagcagggtgcaaaaagccctttatcctgttaatagtggccttaggtaaggaaaaaaaaagagcatgattcaagttttctgtggcctctggctcagttgaaatggaatgtaagtgcaatgccagagcctggtaaaaatagaaactccagtgtccagactcctctccagatggtgtgggaatccagatagcaactcatcactaaggagggccaccattaattagtgggaagatgtcatgcctcacactggggagtaaatgaaatggcctatagcttagaatggaacctctctaatcgccagagagtccgaggtttctccctaagtctctttactctggcttaaccgagagttcggtcattacataaagctgccacatgcctggaaggaggaaataggaagagcacgtgcagtggctgctgctagaagtggcctcatggaacatcctagaaaaggagaaccagccacaccctcagcttcccagagtgggtggggagggggctggcatctgtgataatgagagaagatgcctagagggagctggacccaaactctgataagctgggtctttaccaagggccaaagtggcttggctttggctctgttaataatgtcaaacttatgtcgggggtaaagtgctataaaaataaacatgttcactgaacgagcttactaaaattccagtaactcttggcttatcaagtttcttgtatcaagtagaaacgacacaaaaagaagccttgtaatacttttcacagcaagtaactattacccttcataagaatcacaaatctaacccctttccattaagcatagcctcctaaaaggaattagctttgggccctgggcaagccactgagctctgctagtctccccttctttatcaatgtcatgagggtgatcatactgattttcagattttcacagggctgcttcttttgataattaaataataagaaggtacaagaatcaagaagggtgacaagcacatgggtggctaaaaatattaactgaagaaatcaaagcaatacaaatgtttggcaccactaagttagaaagagtgtatgagaactggagggaacccctctgctggtcaatttttattatttggagtaaatgtcatctctcagagaagctgttctcaaagatcatgttgcattgttaattttggtatctgtctctcttaatagacagtgaaccttcaaagtggggaggaccatagcatgttcaggtctcattatagcatgtagtgcataaaggtgcttggatgtttattgaataaaagaatgagtgaagatttggaataatggaaaacattgggaagggtgtttcttttggtgggaatgtagcatgatgcaaactaggaagttacttagaatgtccaggaaaagacaggagagggcagcgtgggtggaaaacaggaattgaggagtactgagcaagagacacaccaaagaggccaggacccatccaccttatctcctcacctataaattctgctcccctcctcctttgcaaggtccaagcctcacaatgtggctccctctctacaccatcacctcctgctcctctttggaaaaggaaccacagttcccaagctctttatactagacacagggcaatgcattctgcacttattttttctaagttcatactttgaataagtaatacatttacgtggctcaaaaatgagaacactgtaacaaattataccctaaggtgttatacccttgactttatttcccctatcccccttcaatccctagacataatccttttaattagtttcttttttattcttccagtgttttatgcaaatataagaagtatgtctatatattatttacttatgtttcctacacaaaagattgcatactacatatacttctacatattgctttttccacttaatacaacctggtcctcttttccctatcaatgtgtaaagatcttcatccttttttatagctgtgtagtattccattgtatgtatttagcatagtttattcaactaatcttctagtgctggatttttttcattatatacactgtggaaatgaataactaaaattttgaacagtttttttaacttagccttttacctgattgttgatgccttttcttctttggtgatcttggcaattcttaggactctatagatcacttctatgctgatgacaaagccccattgcggtgtgcatcccctttcctgcttctagctgccttcctgatctattacaatcaacagcaactctaaacttgacctcattttctcctcctttgcttaggaggttttcctagtgaaaagtatacactgagatgtcacattctctctcctactcactaagataagaaacttcagttgcctgtgatttcttctctgccttgaactctacatccattgggtgtaacaaacacattgttttcttgcataacattttggacatatgtcctttctttttattcttattgtcataaataactgatttttccacttttctcttacatgtcttctgcaataatctagacagctttggtaggaaacatctcacaacttgggtgggatcatttttctgccattagaggtatcccaatgcctaatgaagaaagtgtacattgctgtttgtaatgagaaacttgctttctctttattgatgagtgagctctttaggagtagacacctgccttatttactacaatacccttaccacctgccatgatgctgggcataaggtatgtgttcagtaaaaaattgttgaatttatctctgcaatacaatttcaacgggcatttccaatcttatctcccattattcccctaaacaaactttactgccaaagctaatttgaactattgtccagatatactatttaactttcatgacttggattatgccattctctctgcctagaatattcttcctctgtctctatgtgttactctgttcaggtactgaaaagccaacagtttccaaggcccagcacctctgagaagttctatctgattaccctgaaaccaccgaggcccaaaagaaagcaacttcctcagtagaggaaatggaaccagaaccctgatttctcagctctcatgagcctagaaagagtagagactctaagatccagaactgcacattctatttcccagtgagccatgacatcctgccttggaggccagaatgatacttgtcttacaactttattggataatagggaggatcccatggaatgatggaattagtaatcatttataaaagcacaaaatcttataaactgtagtgaagtatgtagtgcatttctattcaattaaataaacatgtattaaactcctacctctactatacactgagcaatgtgctacaaatggaatggtttcttcccacaaagcgctgagtaagagaaagctgtggccttattgaatctattgatttagcctcaataaatgcagaaggatgtcatctactcacacgaagataaaagggttacaatcatggacatggcttacctctctaaatagctcgctatataattttggcaaagttccttgaacaatttggtccttagacttcctagattgttcatggaactttcttcttagattattataccctgttctgtgtctcagtttgcaatttttatcccagcagaggaactctagttctaagagggagatctgcccttgaaaaccggctgcccttattacttcctgcctttcttttaactgagctccactggctcagacacataatttttgttaaccatgaatgctttaataaactcagaggtcgaatcaataaagccaagatttttgaccaattgtggtcaacacaagtaccaaagtaaatttttacaaaagggtcaccattcaatttctagtaatttagggcaaattccacgttgggttaatttcatgctgcatttctgaattcccaaagcagtttctacagaatgtcatcatgactatgggttttttcccttgatccgtcctaagacttggtgacaggcaacaagcctgaaacagccattctatttcactggggagagagattgcatgtgtacctggaatgaaaccatctgctagaatcttgcagcagtgtgataatggagaataaaatggagaattgttcaagggtcttagttgaaggtaacagtatttacgggatgacctaaaacaattcaaataagaaagccagctttaagtaacaatatcccactgctatgtcacactagtgaggcagctctggcatggtccagcttaaaatatggctagtgatttgattgtaaaatattagctagctcactggagagctggcacaggactttagaggagacctggactcattttttcaggtctcactcttcaacctcagcatgcccactcccatagaatcatatatgaccaacacatctttgttccttggatggcacgtttgcagttattcttaatgagcatgcttcctactcaactgacccgaaatagtttgtaagtaaaataaagagaattgccctaatttcaactatgattaatcaattagttgaaaaatcaattacctgacaaaaaaaaatccaagattcacttcgcatgactttttagtctttcatcatttcccacatttgtgctcctgtgttcaaccagctttggaagtaaattaatagaaaaagatgaaggaactgctttgaatccatacaagacatggtttatcaaacagttcactagcaaacatagatgaaccttgggtgcatttctttatcatcatttttgtgtgaggccctagggtgagaaatagaaatgaaggctggattctgtccatttgggtctcactgtctagctttctttcttttcttttttttttttgttgagacggagtctcgctctgtcgcacaggctggagtgcagtggcgcgatctcggctcgctgcaagctctgccttccaggctcacgccattctcctgcctcagcctcctgagtagctgggactacaggcgcctgccaccaccctcggagaattttttgtatttttagtggagacggggtttcaccgtgttagccaggatggtctcggtctcctgacctcgtgatccacccacctcggcctcccaaagtgctgggattacaggcgtgagccaccgcgtctggccctcactgtctagctttctaaagacaaactggtatttacaccaatctctccttgtcactgccactaaactccagtccactagagcccactcagaaaacctttctcaactgatgggagcataaagtttgagattttgcgatcactcttaaatttcttctatgttttagatggatataacttaagatttgtaaagttccaaatcttcagatatagaacatttccagcacctcagaaggctccctcatgctccctccctataaaggtaacaactattccaatctctgacactacagcttagttcgatctgcttttgaacttgacgtaaatgtcgtcacgtggaacgtactatttgtgcctgactttgtttactcagcattacctctgcgtgattcattcacattgttatatgcatcagtgctttgttcctttttatttatagtaggaatataacacaatttatttacctattccacaggtgatgggcactggaataggtaaatattacaaataaagcagccaaaaacattcttacaaatatctttgggctgatatgtcttttctaaagaaatcaaaatttctaatttaataaattatatgttttctagcttggaagacgaagacaatgagatctaatgaaatgagaggctgagaaaactggacctgattagatgcatccagacgtaatctgtgcaaaaaccatgttttttccttcttcgacattctcatgcctgcttcttcctcctcctctgctcccactcttagcagtggcaactcctggtgacctatttttcttctgaggcttttctcatactatctccatattctgtcaactcataaccactcagaaaatttaatatcgaataactgatactcaggttaaaataatggttacactactctcctgaataatcaaataactaataggtttaaataataatgacactactttcttaaggatatatgcttatttacaggaaacagggatctatctctgtggagaaattttagaagtcagtaaagttcaggagatagtttttgagtgggtaaaactgattttcagtaccagaaaatcataaatgagcatctttcttgtgaagccagttcttaatacatccaaaaaagggagttgcctttttatttttatttatttatttatttatttatttattttctttattattattatttttttgagatggggtctcactctgtcacccaggctggagtgcagtggcgcggtctcggctcactgcaagctccgcctcccgggttcacgccattctcctgcctcagcctcccgagtagctgggattacaggcgcccgccaccacgccaggctaatttttctgtatttttagtagagactggagtttcaccgtgttagccaggatggtctcgatctcctgaccttgtgatccgcccaccttggcctcccaaagtgctgggattacaggcttgagctaccacgcccggcctgcctttttataatacatttaattttttaaaaatgctgataaagacctctagtttgatatataattctcagagttgcgctatcgtctaactacaatttttcactcatacccttcctgtcaattgaaagctaagggacaggtaataaaagactacacttgcattaatagtaaaacatactagggaaaagtttttcagttacagtttcagaaagttgttcagttgctatgagagtggaaactaaatatttgcttccttctattacaaacacagcagaccaacctaacctaagtcaccaaaggagcagttaaaatcattttcagtgacatcgtggggctaggctttttaaagcaggattgagaagaaggcaaaacaactataaggtatccttttgttttttctttcttaacccactcatctaactttctgcctcattgagcttccttcttacaaataaatgaattaattaagaccctacttgcaagaaaacctgtggttaaaagggatcttaattcctcttgcatctatccatccatccatccatccatccatccatccatccatccatccacctattaatccagtcaaccatccctcaggtgcttggcctggatcccaggctggtgggttacactgtggacatccatcctatgcttgagtgtttccagtgatatggaattcatacaagccaagcagccagctcagttctgacaaggtaacaaagttgcctaattagaaagtaatcaatagctagttttgataaggtggcattttttctcattattttatttcccatttttttaagcttttttttccaaacactgggaaaataggatattaaaaacaaaaagcaatttcatatgtaaatgtctttttagactaggctcaaaaacctggacacagtgaaggatgatgttgacagctaacatttttctatctgacttggagcaggtgaaagatttctctacaagtgacatggacctgccaagccaaaccagtgatcctcaggtcaggccaagctttgtaacttggggcccacagatgtggtttgtttagctagcacaatatttttaaaataatgagttagttgccaagttttaaaattagactgtttcacataaaatttgagtctggctgatcctaacaaaaagagggtgcttatttatttttataaagtttttttcttagctttaaaggagtggttttagtgattactatctcctatggtgaaaaaaaaaaacatacttcctagaattaaatgattcctttctaaaatttttcatttatttatgtttctagagacagggtcttgctctgtcgcccaggctggagtgcagtgatatgatcatagattactccagcttgaaactcctgggtttaagcaatcttcccacctcagcctcctgagtagtagggactgcagaatagctgagacttcaggtgtgagccaccacacctgcctaattttaaaaagtatttgtagagatggggtcttgctatgttgcccaggctggtcttaaactcctggcctcaaggaatcctatcaccttggcctcccaaaggccaaggattacagctatgtgccactgtgcctggccaagtgattcctttcatttagctttaattttacttctgttaaataatttaaatttaacacttctttaaaataaagaaatatatatcatctgttttataattttctttctctccatctatttactcatccatctacccttccatctagagagatgtctagatttgtgttggccaaatgataatggtggttactttaggatggtggaattttagatgacctttaactttctattttgtattttgctgtgctgaatttttagtactcaacatatttcatttttatataacattagtccttgtcatttaagaagtcctttaaaattaaaatatgtctctcttcttttatctcttgaactgaacctttaatggatgtgattaagtgagatctaaattaatggtgaatgccctttttcaggtaacaagaaaaatgtgaaaatttgagcttccttattagacaggcttctcccctgatatcaatccttatgtatttaactcactgtagtaatttagaaaaacatgttttatttcttttattggtcaatataatttagacgcatgggccaaagtatcaaaaatttccactaccaaatcctcaccaagacttactgggttaaatcttgtggtaaactataataggataacagtcttaaatagatacttgaaatcacatgcagatttccttttctggaaatagggcattctagaatactgaaaactattttgccagagaacacctagacagagtggaaaaagttgataagctttcttttacatgcatggttaggtttgcaagatagtaaaatttttccaagggagcaaaaaattatccaaagcactaaaacaagaggtagcaaaaacctaagtattaatgtaacactgatttcaagctaccttatgggatttgttggtcttgacaatcaagtgatgtgggttgcataaaccacatcaggacagaagatgaggccttgggcttacataaaattggaaggaaaataaacagagatccctacatgcaagcttgaaccctcacagagctaggcctttagtgaaaggtagatgactaggaacctgatcagtctcagcctggatactgtttgtgggagagaaaggtctctgttgagtactgaacaagaataaaaataaagcataccaaaacttgtagaatgcagccaaagcaataattggaaatgtgcagcctcaaatatttctatcagagaagaagaaggctgaaaattaatgagcaaagtagctgtctgtgttccctataaaacaaagggtaaggcagtgagtgattaagtgctaatgcttctctggagaggttccagggcagaaggaatgagagaaaagggaaatgagacagggcaggatgagaagcaagggagggggcgtgtccaggtgctgctggttgctttatcatgagccttgaaaagtcgctggttccatggcagctgtacccatttggtcactctttgggatctccagaaaggcaagacacagaaacagtgcctcacagcagcatcccgaggagtcgtccctcttagtgtaggcctgagggcgtggggaggagcagccctacaggatagatgtaaaatcccacctggatctgtctttcctatatttcctttggaacaaaagccttaaattggtgtgggaaggacacaaaccctgtcaccttcaaggaattggagaaaatccactgaaactggggaagggcatgagaaaaaccgtattccatgaaggtgggataaacttgctgggttcagacctattgattgggatcaaagcaaatcactgagggactcctctcctgagacccaaggatgcagtgcctgccaaggacagagacttaaccagagcatcagagcccacccatgtgctgcccctggaaccagtgtagcatacattgagtaacaagtaacagtggtctatggctgggagaagggcaaaaacaacaagagaggtgctcatggtgtatgtgtgtgtgtgtgtgtgtgtgtgtgtgtgtgtgtgcatccacattgtgtgcacacgctcatgtgcacacgcctaacacactgaggcagcctgcatggcacccagaccagagcacctgtgcggtcacacaaacactcgagtggacactggctcactcacacctccatgtggcacctcagcgcccaccagctgctcagtaccttgtccacacacacttcttgtagcacaatgggaagacctaaagcggaatatggagaagaccctatgaaagcccctggcatgccagcccccatcctacaggagtttgaacctccctctcactctttgcaacaaactaactcaaacatgtcatagactcaaatgtaaaactccaaactgtaaaacatctagaagaaaatgtagtagaaaaatctttgtcatctggagttagtcaaggattctggggttaaagatttcttaactacaactccaaaagcatgacccataaaagaaagaagataaattgggcttcatcaaaatgaaaaactgttatttaagaagtctgtgctgagagaatgaaaggcaagccatatactaggataaaaatatttacaaaccatatatctgataaatgacttgtattcagaatatacaaaaccatcaaacgaagtaataagaaaacagacaattcaataaaaatagaattgaaataaatattgggacacatacttcaccaaaaagataagcaaatgtcaaataagcaaatgaaaagatgctcaacatcattagtctttaggaaaatgaaaactaaagcaacaatgagataccattttacatgtattaggatggctaaaaccaaaacgaaaacaagaacatcctgacaattttgtgtactggattgttcatatattgcttaaaagaatgcaaaatgatacaaccactttggaaaacagcttggtgatttcttataaagttaaacatacgagccgggcactgtggcccatacctgtaatcccagcactttgggaggacaaggcaggtggatcctttgagttcaggagtttgagaccaggctgggaaacatgaaaaatgctgcctctacaaaaaatacaaaaattagctgggcatggtggcagatgcctgtagacccaaccactagggaggctgacattggaggattgattgagcctgggaggttgaggctgcagtgagctgtgattttgtctctgtactccagcctgggtgacagagcgagaccttatctcaggtaaacaaaaacaaaaacaaaataggcttatcctaccacccagaaattcatttgctgatgttaacccaagttaaataaaaacttgttcatttaaaatctgtatgtgaatgtttacagtggctttagttacaagagccaaaatctggaatcaacacagacatacatccttcagctggggattgatgaatacactgtggtgtatccacatagtggaatgttactcagcaacaggaaggaacatcccaacatatggatgaatctcaaacacattacgctgagtaaaagatgcctgactccaaaggctacaaactgtatgactccatttatatgacatttttacaaagacaacactatagagaaagaaaactcagtggttgccaaggatgggggtggacagacggtttgactataaacagacatgagaaaatttctgtgggtaatagaacttttctgtcttttttatggtcatggcatgtgactgcagaaatttgactcacagaactggacactacaaagataaattttagtctatataaatgaaatcttaatattaaaaatgaaataatattaagtcaaaaagaattccatggtatgtcactatccaaagacaaccttattaacatttttttgtttgtaaaattttctgaaatcatttttaaaaaactgcacttgctgcttcctacacgtgaacaatagacccagaaaactttacagatgagttttaccaaacattcaaggaattgatggcttaactatctcaaagtataatacataggaaaaggggcaaaattttcctagttcgttttatatgactataaataaaaagaaccaaacagaaattctggagctgaataatacattaaaaaagaaccaaagagagattctggagctggataatacattaatacctctggaaatgaggtacagagcgtcaacagcagacttgatcaaggagaagaaagaatctgtgaataaaaaggccagtaatttgaagttatccagagaagaaaaagtaaaaaaattaaaataaaaaaagtgaagaaagactccaggatttatgaaatgttatcaggtaaaataatacatgcataatgaagaatttaagaggaaaagagagagagagagaaagcggcagaaagcttgtttcaagaaagaatggttgaaaactttccaaaacttagaaaggatgtggacatccagacttttgatgttcagacttccaccaaaagatcaactcaaagatgattacacagagacacattataatcaaattattaaaagtcaaagacaaagaggattccaaaagcagcaagagaaaagcaggaaaattccatgaggctatcagtggatttcacaggagaaaccttgctggccaggaggggagtgatatattaaaaatgctgaaagaaaaagactgccaacaaagctgtcctccagaattgaaggagagagaaagactttcccagagaaacaaaagctgtgggaattcttcaccatgaaactgccttataagaaatgataaagggagttattcaagttgaaataaagggatactaataagtaatttaaaatcatatgaaaatataaaactcacttttactctagtataaaagttaaaatacaaaagtattaaaatatagctacaataattaataaataaacaatacaaaaagatgtaaattgtgatatcaataaatcaaacgtgtgttgggggagagaaattagagggtaagtttttgtatgcaattgaatttaaattgctattagcttaaaatagattgttacaactataagatgtttgatgtaagcttcatggtaatcacaaagcaaaaacctttagtagatacacagaagataaagaaagaaatcaaagcatactactacaaaatatcataaagaaacattgtaatataggaaaaaaggaactacacaacagtcataaaaattaataaattggcaatagtaagtagctatctatcaataattactttaaatataaatggattaaattcttcaataaaaagacacagagcacctgaatgggtttaaaaaacaagatccaaaaacatgctgcctagaaaagactaactttagctttaaagacacatctgaaagggaagtgatggaaaaaagatattgcatgtaagtggtaaccaaaagagagcaggggtagctatacttacaccagacaaaatggacttgaagtaaaaatctgtcaccacagaaaaaaaggtcgttatataatgataaaggggtcaattaaccatgaagatataactgtaagtgcacccaacactacagcacccaaatatatgaagcaaatattaccaaaactgaaaagagaaatagagagcaatataataatagtagtgaacttcagtaccccactgtcaagaatggatagatcatacagatgaaaaatcaataaagaaataccagacttgaattatactacataccaaatgctaacagacgtacagaatatttcatccaacagcagcataatatatgtttttctcaattgtaggtggaacattctccaggatagatcatatactggaccacagacaagtcttaacacatttaagaaaattgaaatcatatcaagtcattttttgaccacaattattgtcaattattacctcaatagtgctggaaaaaaagtgtacatctaaatctcagccccagggatactttcttgactaaacatcattgatcaccacaggtttactttgtctctctttggctggatagtacagccattctcttctcagtgtagacttttcaccaccttccccatgacatagactgagcattttctggctctttgcaccttacactttctcaccttacaaatccatgtatttgtgggcacatgcaccatatgcccacatgcctatgccaatatgcgagcattgttagacagaatcggcttgatgacactgagattctgggaaaatgcagcttctataggtaatgagcatatatatctagtcacatttaaaaaaatagaatttattttgagttaattgtagattcatatatggttgtaagaaataatacagacagatttagtgtaacctttaccatatgcattaggccattttgttgttgttgttgttgttgttgagacagagtctcactctgtcgcccaggctggagagcagtggtgccatcttagctcactgcaacttccacctcctgggttcaagcgattctcctgcctcagcctcctagagtagctaggattacaggcaggtgccaccacacctggctaatttttgtatttttagtagagatggggttttgccatgttagccaggtggtctcaaactcctgacctcaggtgatccacccaccttggcctcgcaaagtgctgggattacaggcatgagccaccacgcctggccacattaggccattttagtgttgctatgaagaaatacccgaggctggatgagttataaagaaagaggtttaattggctcatgttgctgcaggctgtacaaacatggctctagcatttgcttctggtgagggcctcaggaagcatacagtcatggtggaaggctaagggagagcaggaaatatcacatggtgagagtgggagcaagacagagcaagggagtggggaggcctcagacttttaaacaagcagacctcgagtgaactgagaactcacttttcaccacggagatggtgttaagccattcatgaggaagccaactccctgatccaatcacctcccaccaggccccacctccaacattgggaatcacatttcaacacgagatttggagggggcaaacattcaaaccacattaccaggtttcatccaatggcaacatcttgcaaaactacggtacaatatcacaaccaggatattgacaacgatacagtcaagatacagaatagttccatcctggcaaggagctctcaaatagtccttttatagccatacccacttcccttctgccccaccccgatcttcactcctggaaatcactaatctgttctctatttctataattttgtcatttcaagaatgttatgtaaatagagtcatacagtatgcaatcattttgggattggctttttccacttagcattattctctggtacttcatctagagaatgttgcacatatcaatagcttgctattttttattgctaagtaggggtgtattaccatttgcttaacccttcattcactgatgaatatctggattgtttccagtttggggctattacaaataaagctgctgtaaaaactcctgtacaagttttttgtgtgaccataaattttcatctctctagaatatgtggccagaagaacaactactgggttgaatggtaattgcatgttcatatttttaagaatttgtgaaagtctttccaaagtatggtatcgtggttgagagagaaaactgtggagccaaaccaagagatatccaccacttttgagttgtatgtgtcttgatatgagagcaaatctctccaagactcagcttctttgtctataaagctatgcctacttcataaaatgttttgttaaattgtctgagggctaaaagggattatacaaacaagttcttagcatgcaactactcagaacttgaaatgtggccaggatcattgaggaagtgaagcttttcatttactcaattttaagtcacttaaattaaaatagccatacatggctagtggctactatatcagacagcacagatttacattcttacaaaatgaagattacaataatcctcacaaggttgatgcagaatgaagaaaaatgcaaaagaaaactgcatgaaagacattgtagtatacaacctaaggtgctatttatagacaataacttactcaaggatggtttagatacaggctgtattagtctgttctcacattgctacaaaggaatgcctgagactgggtaatttataaagaaaagaagtttaactggctcatggttctgcaggccatgcaggaagcatggtgacttccgcttctggggagatctcaggaaacttacaatcgtggtggaaggtgaaggggaaggaggcacatagctggagcagaagcaagaaagtggtgggaggaggtgccacacacttttaataaacaaatctcatgacagctcactatcatgatgacagcaccaagggaagatggtgtcaaactatgagaaaccaccctttgagtcagtcacctcccaccaggccccacttccagcattagggattacaatttgacatgagatttgggtggggacacagatccaaaccatatcacaggccaagaaagtttttctctcctttccaactgtgaactgtaattttttgttataggcattaacagaagaacaaacaccagcaagaaatgaacaaaaaatgggggagggcagtgtcatgaagcaaaatatgtggctagcctttctgcaaagtgtgctcttgtctgtgacacatgcttctttggccacatggtatagtgtctgccttccacactgtcacgtgctgggggctgggcatgggcggtgacttccatctgcttcctcatggagcacagcctcacagaattcatcatcaagataggtcatgaatgggaatgcacaccagtgtaatatctttgtccctggtgagccgtatctctgataccttctaaaatgttagctagagaaagcagaggtgtttcattgacaggtaattattgttctctcataaaaactgaattctatgaagaacaaaacctttcctccatcttggaagttgggacaaatgcactggttcggggagcgctgggctaaggatcaggctgcttgggctatcaacatatttgtgtcaccacctatctaagtggcaccaggaagcccaccttcctttttcctataagacagaggatcaggactagttggcctaggacccctaccaggaccatcatttcatcactcatacttgacacctcatattcttgcaacttcaagggcacaaccactctctgatgtgtgttataattatagttgtcaaggtgaagaacccgaggtaccataagactatggcttggtcaaaaccccacaatatagtaagacagcggcagaattggaaatgaaatcttcatactccaagcctttctttgggtctttgttccacgctatgttactctgggctcatttagaagaaagtattgccctgggctggaaaatggagtgcccaatgaatagagctgcttctttctcctccccctgcctcttcttgctcagcccccacacctgctgtactggccactgtctggatgtagtaggagagagaagaaaagcagaacaaaataggtagggggcaaggaaagagaaaggtattagaaaggtaatagaaaggatatataatatttttccatctgttcagaaagaaaggcacttagaacttcagaagagccagcatttttacagaatcacgaacagtttaagcaagcaaggacagagaagtgaagtgactcatcctgggtaacaggggtctatctagtaagcaaaaactaataaaggatggcaaagcataggaattaaggccaactagagtctccgtgtcagccctgttgcatgcccgccgggaagccacggtcaaggcagcctccttcaaacttcgttttttgcatctctgaaaggaggccatgataccaacattgtaaggttattgtgaggatcgaacaaggtaatgcctgtcacacagctgaccaaaatttaagagcttaatagaagagaaaattgatgagtttgggctagaacccagatattcctgttcaatcgagtgctcttcccagtagaacacgctgcccctcccccttcctccctttttgctcaatgccagcatgctcccttaagctctctaattagctaaataaagagtgcagacagggcctatgttaaaaaatgctttctgagccaagtgaaatccctagggaagtgaaaagaaaagaaaaaacacacacatggccaattaccatagcatcatttcatttcctcagagtgactaatacccagagacagtcacttaaacactaattgcaggagaacaggtagaaatcatgttaaatgagcccatctttattcctggaagaaaagacagcaagactctccaatgcatgagtatgtctgcctcttaatcatctgcagaaagagaaggcagcttccttctctgattgaacattggattttgatggcatcgtagttcttcttgaactagccggcagatctgcagtgtggaattgagttaccagtggagcaacatgccagcttccttctgacagcgtttggttgttcagaattcaagcatggcataaaacaatgcctgcatgctccagagagacccccagcccccacatgtcccaccctgagcttgctaggccttccagggcctcggtccccacatctgtgttgggagagaggagacagttccttctttagggaatgggggtcatagagatatcttcactctctagcttgttttcttctttctgattgtagctcagctccttttcttttcttctctcttcttcctgcctttaaccattcttccatgaaacactcaagtgggagagtttggttgtttgacaaaaaatggggagggtgggtagggaggaagatggagtttctttgttttctaattccgccctacttcgtttcctataaggggaccaggaacacttttcactggtcatcgtggggcttctcatcccctaaaggccatattaccccaacttctagttgtcagctatccttgtcaaaatttcctaattttgatacttatatcccacttattcactaatcccagatcaagcttcacttcctccaaaaagtctttttcaactatgtcagccttcacagagcaactgtcattctttaggaaaaatcaaaatttagcttgtaatgatatatgaattgcacatgcacgctaatttatactctccctcctgatttaacaatccttaaggaacagtctcccttgtatcctgcgggcattctggttcgatactaggcacagtgttgattgcctgtttgatacctgcttaaaacagaaaatcgacttccaagttctgcgcactggtgtttgcatgaggacatgagccccattccttgaattcctacaatgtcccaagtgctgagctgggcactggccatgccaaaaacacataaacacattctgtccagagagtgcttacctcttcttcctgagaagatggccagctcacttacacaatgagttcattttcgtcatggagatcatgaacagagggtgcattccagctgagctagtacttcctgcccctcaaagctcagctcaaagtgagtttccttctgtggccttcctcaggccatggaaccttaagtttcttcatttttttccctaagacaatgaaaagaagaatgctacagtaattaatgaaagtctcatgagtgatctcttgcatctatttccagtggatagttgggtgtttctgactggcaagcaattctcctgcagaccaaattcagggacccaggctccttccacttgtggctctgccacctgcaaaggccttggagtgacctgcatccagagggcaatggcagggtcacattatgacttttatggctccagtgactcttgccttcatgggctccttcttccatgcaaaaaattaaaaattatattttataactctattggtataaagatgactacattgtatataaatatatttttttggccaaaaagtctattttgttatcttgattttaaagaaatagaaacatttccatgaggccttaaaactcttgtggacctgtgctcatctttgtctgtgcttacctcccagtctgacccctgcggtgctcatcgaccctatgcccttggatccagcatgtgccaccttgctttgccttcttggcatgttcctgttagcctccccagacagacagcaagatcttgggtcttttgctagctccctagcacattacaccaagccttgcctagggcgagggtctcccagtctgattcctgaatttgaccagtaggagagctatctgccaaccagaaacaccgagttcccaactggaaatagattcaagagataatctcataagacctcagtcaattactatagcattcttcatttcactatcttaggaaaaatgaaaaaacttacagttacacagtctgagggaggacacagctatgtatgattgtgcccgttctgcaaatcactaaccctcagtttcctcatctgtaaaatggagggcaagaactgaatctccctcatggtactgcgtgaagaagaaaatagatgattcatgcaatgtgcttaaaatagtatctggcatgttgtaagcactaaataaaggttaacctttttattattatgacaatacaacaatgattcatatttatgaaatacttgcgtttttctaaaaactgccacaagatgataacatagctataatcataatgtctcattgcagccaaaacttgtttatgggaaatgttgaggttgaatggaaatgttaaagacagatgtggatttaaatctcagctttgccacttgccagcttagtgacatgtgatacttacttaatttctctgagtgtcttagtctgtttgggctgctataacaagatgtcctaaactagctggcatataaaaaacagaaacatatttctgatagttctagatgccaggaagtccaagatccaggtaccagcagttgcggtgtctggtgaggtccactttctggttcatagaaggctccttctatccgtgtcctcacaaggtggaagggacaagacagcgctctggggtttttctttcttttctttcttttttttttcttttttagcaacaagaatgctcaatttatttattttttcttagcaacaggaatgcccagtcttgggctttttccataaagacacgaatcccaaacatcagcgctctgcccttgtgacctactcacttcccaaaggtctcacttcctagtactattacattggtgattaggtttcaacatacaaatttggggaggggtggacacaaacattcagatcatagcactgagactctgtcttcttacttgtttttattttactttattttattattatttttttgagacagggtctcactctttcacccaggctggggtgcagtggcgtgatcatggctcactgccccctcaactttctgggctccagcaaccctcccacctcaacctcctgagtagctgggaccacaggcatgtgccaccatgcctggataatttttatatttttggtagagacagggttttaccatgctgcccaggctggtctcaaactcctgagctcaagcgatctacctacctgggcctcccagggtgctaagattacaggtatgagccactgcacctggcctttcttatttgtaaaatcagataataataccacttacttcacaagtattaagaaactgttcttggagtgcttgacaccagtctgccttttcttttttttcttttgtcgagaataaagatgactgtctaaacaaatacctcctactcatccatggttacgaaagcttcaagtcctcattagagacaaactttggtgttaggctcaagaatgctagctcccttcccttttccctatccctgttaaaataaaaaacactacacacctagaaggataatacatgagtccttcctcagtcattaacaccttaacctaaatgtgcttcttgtctccagagagcaagctctatcagctggggaaagaagggagggtttaagaatgtagggcagaggcacaggtctgtgatgccgaggactgattttgtttctgttaattttatttttctgtgatactggcattcgcataatatgacaacattttctggattttagaggatcacattctctgtcgaactctccttgattaaatgaagtcacagggtgaatatttcaattatttcaagcctttgtggtcagtgatctagtattcaattgacctgaacactgaaaacaatcatcatgcctatggctatttgctagggacacgtgataaccacatgcaggaattctgggtaagagcccaggacctcattccaaccctgcctttcccaaatacctgccctgtgagccaaatcgcttaatcttaggattcttttgtttcttctttataattttaaaaagcacagtacctgctttataaggttttatgcatgagatggtgcccatcaagtgtatagtggctggtgtgtgataattttgtaaaagcgtcacatggcagtacatcagagccacatgacatacatgactgctgggagctgggaaacacactaggagcagtggtgccttccagttgtcaccagagcaggcactgaacctccactcacaatgctcgggagactcacctaatgccaaagccagggtctagataaatcctgcttgacacaagaccatataaagagagagagaaatataggctgacaaaaagtggctacaaagcaaggcaaattcaagtggctactggtggcgtgtataaaacagaactgccctgggaaaggaacaatcaaaaaacaagatggtgcctggggaactttctcaaaagtgaggaaacaataagctatgtgtgctccttaaagcaaagatatggcaaagatcccaatccatctcatatttttaataaatatgtcattctaatagaattttccttggtacttaaaattagattataaattttacccttaggaaaaaatatagttaggaaaaagaaggatgattgaatgaatgacgaaaggaaaaataacaagtgaatagtcggtaatatgataatatgataacatgcttaatcacctctcaaagaaatacagctccaagttacataatcctggattccacatctggaaacaaggagcactccctgtatttggagtttattataaatataggcagaaaggctgcaatggaattcagaaggacaacccagtagaaaattgaaacctggaaaaaaaaatcagcaattccataacacatcacttatagacagccccacgctgcccctggtaagtttttgcagaagaacatgaaaatccttagctaaggtacaaacaagccaagtagaggtcaacacatttgggaaatagtggctccacactcctaaatgtcaagggtgtgtgtctggggggtgggggtgggtggggaaggattgtggtatttcagggagaaggaatgtcggatgtttgaagacagcactaagtgtatattagagtgagcactgtcctgggcctctaatggactccattctgagatctgtgtcagaactgtcaataacccagcctagcccaaaactgttaatgtatcacctcccacccagagctgaccctgcttctcagattgcttccaggcaggtcccctgcagagaaagccgaaggatgggtagacacacaggactggtattggaagagatgcttcatggtttatttcttctgcacctgccctcaaagcttgaaggcagctcttgaaacccttatttccaagaaaggggaggaacttggctgtggtattatgatgctccctaagatcttgcagtctgaaagctggcttggagccttgttttcttctgccatctccagaatcccaaatgtactaatcaagactcccttgttcgttctaggataacacatgactggaccacagggaaataaatggccatgaaaagatgacaccctgaagccagacaatattctcctaacaaagaaaggggaagagttaacagagggttaaaccaaagacggtttggctagagagacagcatagttgaaccttctcatcagttgtggctgtaacaagaatttgcaaagatgaaggtttatttaaggaattaaccaagaaataagctgttctacccacagtcatcacagctgccaaaactcaaattattttcttaccctgagatgatcctaggggaaagcatgattcaagttctaccagagtgtcaactactccctctgggcttgtgttaactcttttggaatattaaaattgtttctgtagcctgccagaacaaagctgggttgttgcagtagcctcccagatgaggttagggtcattgcgggcgggagggagtctttctcaccttttttctttttatcttatatacacaaagttaaatgactggatgaaagccccagatactggtctgtagaagtgtctttgttctcatggatgcactgttacttcctggactttgggggactgaggtcttttatagttaaagaaatatacttaggagattggcctggttggggctctgccatcacagtctctggagctgtaacctaatcacatatccttggcagcaaaggcaagatcccctgctgacttgtcaaactctcatatggatgttaagaagattaagataatagcatgcctaacatagctaataagagagatttaaaacaattggcagaaacagattgagttatgaaatgcttattatggatgattctgtgtcacaaaaacagcatatagggtcagcttaatttcacacacaagtaaggggagaagagatgccaatgatgacgaggcagagagagagagagaaggagagagagaaagagagagagcctgctatgccatggccagtgctcaagtgggcagactgatactgagctctgctgggattgcccagtaccaaccccctgcccacaccccaccactgatcatggccagtttggaaagggtgtagaggtcacggaagtgtcaggtcacacccaatgtcctagacactggaggaggtacatctgtgtccaaatatcctaaatagattttcctaaatttgagaatagtcacttcaatctttcttctttccagcctgggtagatcagccacatgccaattgtcttcttgttttctttccaggacaagaagaacatagtttcactcgcagggaatgaaggacccttttgggccttggggggaacacgctgcatgcagcttcctttccatccttgcatcttctttgctgtctagtgctccttgtcatggtctctggggctgtcagcagccaccgcccctgcgctgtgggctccctgccctgtggagtcctgtgctccaggctggctcccacctctccctaagagacacctgggcctggccgtgtggtttgtaggctggagtggggacagaggcctgctggtctcaccccacatttctcatccatttagaggaaggagccatctgagaatccagggacgctcctctggcccaccagccttctcttccccctcccaatctccccttcctttcacaagggaagggaggagattcggtttgcagcgagaaatgttgaagttgggaacgaagtctttggagtggattagccctttgatcttcaggtgggatctccaggtgggacgctcatggtgagaacaagcagcaggctgctctcctgccttgctggtgaaaccctgtcccagacgcctgagaaagtgacctggcaacatcgttaaaattgcaagcacgcattccctttaaaccagaaatccccctcttaggaatctctcccatagaagtaaaagcatctaggtataaagggacctctgtaaacaatgtgcactctttgcggaggcaaaagtctggaaactagataagtatccttgatagaggaaaggaggaatacaatagactacagacaccgttcagagaaaacttaatgaaaacactggcagacacaaatcaggttgtggacatgtgttttcttgggagaaattaaggaagctgaagatggtgtatggcacaagagatgaagaggggttagtcgctcccaacaaacaaaaaagaaaagaaaatgagaaaaatgatgacactttaacagttcaagcagattgtctagggcagggaagtagactgagaaacaggctctgggaagtagactctgagacggaggtttgcctgcaggaggatgtgccctccttgtcacacctgtgggggagggaggcaagcaggatggggtggaaggagaagctgggctgccatgcagtcaggacaaaagcctcagcccatcccggggaaggcagcattgctctggacagctgcccagtcattggatgttggctgcctgcaggaagaaggagactctcatttgcagtgggcagccaccaggagtgagacacagttgggagctgccaggcattggccctcccagcaccatagggaagggacacagaaggcacactgcagcgcccattgcacgggtgcacgatcacatgtatgtatattagtaaagttatagatatacgtgtgtgtggaaatcgataaaggatgagagtaggcagaagaaaagagggtctctgattctcagagtataaaatttatttctaacactggtgagtctgaagcctcactggaccccattccagtgggaaacagacaagactctcagcctgggcagttacagcagtgacactggccggatgatttcccttgacctcgccacatggaagccatgcaacccagccccccatcgtcttagctcctgagaactctgactgccttctatttttgaatgggttgggaatagaaccaagagataaattttgtctcccttttgcttgtcagggttgggtaccttgaatatgggttcaaactggaaccaaaaataaaattcaaagtaaacacctcagaaggacacccagctatctccatggcagaactttgcatagggtgctggaaaattcaggcaactgctctgacccagcacaaactaagaagctcagcaatgactcagtcactcctcttgagagcaattaagctgctgtaaaacatgtaggaacctgataagtagacatacaatcagtccctaaatcccaccttctcctagcaccatattgctaaggcaaagcagagacaattcattcggcttgcatattttcctcaagactgtctttcatacttctctgaatgagattttgtttctatcagcaagtgtttaagaaactatggagaggaagaggaagctggcatatggcttcaaaataacttatttctgttgacatgaaaagaaagccttttatatttcaataggatatcttcatgtatttagcattgttctggaaataatagttaatgcaatgagccaaggaaaaggtgagttatatgtattgagaaggaggaggagcagagttagtaaacattgataatttttgtatgtctggataactcaaaagttattagctggaaaaagttattagtagtatgtaataagaaagcaggaaggtagctgggtaaaggttaaatatattaaaatctatagctttcttatatgccagcattaattgtaattagaatgtaaatattctactcacagtagcaacaaaactataaaataccaagggatacatttaataagcaatgtatacaataaacaatagagaaagctacaaagatgaactgacttgaaagaagtaatacattctgggatcgaagtctttaggttgtgaagatatcagttttatccattctgatttataaattaacagcatttcaacaaagagtttacttagaactagacaaaataattctaaattttacctggaagaataattataggtgaaaaactaaaatgagatgggtggaaagggggagcttttcctatttgatattaggatgtgtttttaagttgcattcatctacagataggaagaccaaaacacaaatcaggacatctgctgattattcagccatttctgatgtttccagacatggaaattaacattctctctttcctcagttgaccatagattctcatgagtgttatttagccttgtagagcacagcaatctccacgtagatcccaccagcccagaagagccatcagcccctgcagtcagatagttcttcactttggacctgtattcctctgacaatactgagtgcatctccaagggcagagtatcaaagcatgtcctctggctgggtctacaggacaccaacatctggcagagaactgacccatccagttggaactctggactttttccacttccaccttttgctggataggtaaaacatacagacttctattttaattcttcacttgtttcctgggatttttgatgccacatataccaagctctcaaatcatcgtgtaaagggccagtttttctcaaatccattgtgcaccatgatgttttttaagtgtatgaaaaataaatcataaacaatgaaattaaaaagaaagccaatgtcaagcaaatacaagcccctatttttattactacatttcatagaaatcaagttactctgtcatgttgccgtatatgtccttaaacacttattttctttggtggcctgacccttatcaactgactgcaccattatataactcatcacaagggaactggctactactttagctagcaattctttatgccttgtgatctaagtaacaagacaatcttacatttttataacacttaactttttgtagtgtgcaaattcttttcctctccaacaacactattttgaggtagttggggcagtttttacaaacccaatttctcacatagtgtattagtctgttctcaaactgctagaaggacatacccaagactgggtaatttataaaggaaagaggtttaattgactcatagttccgtagagctggggaggcctcaggaaacttacagttatgctgaaaggggaagcaaacacatccttcttcacagcgcagcaggagagagaagaatgagggccaagcgaagggagaagccccttataaaaccatcagatcttgtgagaacttactatcacgagaatagcatgggggaaactgcccccacgattcaattaccttccacttgtccctcccacgacacatgggaattatgggaactacaattcaaggtgagatttgggtggggatatactcaaactatgtcaggtaggaaatgcaattcctcatagagatattcagtgacatggtcaaaggggttactgacaaagctggaatgcaccctggaatgccctccctgattcattattttttgttatttccacttctttccccctgcttttccaaagcatttttattcatagttaagtcatgattcagggccccagggtgaggatcaccatgtacccaggtttccctttgcctgggagaaggatgaaggacataggaggggtaagatgcagccagttcagatctttccaggaaatgtgcctttagcccagctgtcatcctagactgaaacccaggagcagggcagaagaacttgtacacacactggtatcattcacacatagagacatcacacccttcagcggttgttgccttctcacagaggtggaagtccaggaagttctgccagcagttcctagtctggttggggaagcgtctgtcaaaaggggcagtcttgtagttcttgattttggtcttcatgtcttttgccaaggtgctgacttctaaagatgctcatgatgcagctggtagctcagtgtgaccctcagcaaagacatcaactttggacctcattccactctttaatgaatctgtttatgtctcagttaatggagctactgatgactgactcagtgagtctaatcccatgaccctgactgacaaagcattgtaaatgctaatcctgcaaaagtcccttctactgttatctacaccgtgaagagaaaacccaccaaactgaacaatgatgatgttcttacacagcagcgctgcattaggaagaaaatttcaaataatccatcacctagtgtgaatatttccacaaaacagcaaatttcactaaaaactctcattaaacactttaagaagagacgtgtagcgagttatttaggctacataaaccaaaaccaaagtgatattgttggtctggtagttctttcttaaaactgcaggtaacacatataagagcaaataagtagcgtcttataggccaagtttacaaaaataaactacaaagagatgtgagaaattttaaacaaaatctctgctcattgttcagaaggagattctcttctctgtgctcttcaggaggggccagcagtggtatttgggctgagtggcaagtgaaggggagtgcttaggtcccttcagactgtgtgccagtgaatgcagttccaaagagctgagagaagggcaaacgaccagcccaggaaggcagcatagtacaggggaaagcccttggttccagaatccaagggttttggtttgaatctcagctttgccacttcctaactgggtaatgggccctcacctcactctgcctaatagaactgtgattactaaacaaaggtagatatacaatggctagtatataagtgctgagagatatttgtccttgtcaatagaaaaaaaaaaagcatatagaattcaccttcctctaccaggcatgtgcctggacctcttcaggctttttaaaaaagctttttaaatttatttttgtctgacattgattatgtgggataaaatatctccaagtgcggtgcagagtctatatgaagaagcacagataggaagagaagtagtcacattaaagtcaaattaagagtcctattaaagtctacaatagccaggctgggcatggcaactcacaccggtaatcccagcactttgggaggctgaggagggcagatcacttgaggccaggagtttgagaccagcccagccaacacagtgaaaccccatctctattaaaaacacaaaaattagccaggtatggtggtgcatgcctataatcctagctacttgggaggctgaggcacaagaatcgcttgagcctgggaggtggaagttgcagtgagccaagatggcaccattgcactccagcctgggtgacagagagagactctgtctcaaaaaaaaaaaaaaagtgtacagtagccattgggctagatagcctgaggcctaaccggtgcccacagtggggatgtgttatagcacaaggaaaaaagctttgctttatgagagaattttgcaagggctattctgacacacacctgagtgagctgacatgtttggagaaggctcaatgagtagaagctcagtacctcccatgtatgctcagaatgttcccacttttactgcctttgattcctatctcaatacattactttagtctctaccaaagtaatacggaagacagaattagaattgtcttttagtgattgtatgcagtgcaatgtacaaccaggacaattgtgttgtttttccggcttgagttgctccagttggctgtctataccaatcacaagacttgtatttctcaggactgtgcaaagttaagccaagtagttgagtacaaaccaggacaggcgtttaatgatacagatgttctacaacatgttttctttttttcaggcaccagaaatctatgtggttactttctttagtttataagaccacatgtaagtactttggacaattgatgtatttttcctttttacattcagatatttaacaaagcaaggcacaggtctaggctctgtatgaatctatatctgaagaagccaagttggagcagcttacaagcagatcccagtcactgacaccaccttccgaggcttagtgatgagtagaaaatccagacccttcaccccgctgctcatctgaaatagaggacaataactggaatctctatgctctccaataatgcaggacttgactttgagtctcttcaatttaattgaacaaatatttattcaggacttactactgtgcttaggccctgaggattccaagctgataagactgattcaggttaggcctatggaatacaatttagagcttacaagatgatcacctaagccactttcatcattcagctggtgaagaactgagccctggagagaaggaagcttcccaatggcacaaagcaagggagaaccagggtcattcaaaaatttgaaatggtaaaaatgtagatgccattactatcaaaaaagtggtagaagataaaggtactgtgtgcaagtccctattctgtagctttggccttagatgtggatccattccttacctggacacagaggaaaggcctccctccttaatgtctgcatagggccaccccctcaggtaaaccaccagtgtgtcctctaatgtgtcccctcagctctggaaccagagttaaggccacctgaccctcaccatgtgactagctctatcctggacaagtcagatattaaacccagtataatgaaaaccaggtctttacattagagatttttatttcaatagatatcaagatagacttgcaagcaaatttgtgtatttaaagcatatgatataatgatggactatgcatgctaattattagaaagtaataagggtgctagttaagtggtgcttcacttctctgtgaagaattttttttttttttttttttgagatggagcctcgatctacgcccaggctggagtgcagtggtgcaatcttggctcactgcaacctccgcctcccgggttcaagtgattctcctgcctcagcctcctaagtagctgggactacaggctcctgccacaacgcccagctcattttttgtgtctttagtagagacggggtttcactgtgttagccaggatggtctcgatctcctgaccttgtgatccacctgcctcggccccccaaagtgctgggattacaggcgtgagccaccatgcccggcctgaagaagttttttgacttcctaaacttcaaactggaaaaccagcctcctctgactgtacctgtacaatgattttggtcctttattgggcttaattacatgctagtctccaccttgaagtcagggtctgttcctgtctggcgcctggtagactctcaatgtttcttgaataaagtaaataaaagatattttgagatcttagtccactctggggtggcttcccagaagagaaaagctgggatttattttaagaaatggaagtaatttggcggaaggaggcatatttcttccttagtgccctcaccaagcctagaaaataggagcaggtcttggggtgggatggtgggaagggtgtgtggggaggaaaggcacaaactatgtgattcccctatggctagagagaagctctcggaggcaggctaactctgccaaggtcaaggagcaaacaggaatggaagccttgaccctcggtccagcctcacaccacatgttctctataggagacacctttgtacggagctttgcactgaccttgagaaataatttccatctggaattctgggtgaatcacaggaaggcaatctgcaatttctcaagtttgcacttggctggggttgttgaatctatgttgtaacccttatgaaacactattgctcaagaacattcgaatggatgcaacatttgtaaattaaaagcctgctgctttaattcccttccaatggacacagttagacatatacagaagtcacaactggatgcagctggaggtttgactttgagaggatgggagactggaaatccctgggcatttggtcagcacagtagcagagtgctggggtttgggaaagtagcggttgggtaggagaaggtgttgcatgcaatatttttctttctggtatttgtcccgggagatccatattgacacctgaactttgtgacacagtcgagccctgctccactggcttctatacaaacaacatgatgcaaaccagctggggccaaagcagttaccatggaaaccctagactttggtttggaaagtaaaagtaaaagacatttatgatgaccacagcagtggtttgtaccaatgcacttcttgggaagtttcttttttatcctgaactttagcgttctttttttttttttcttgccctgtggaatttggcaaaagaaaaatttaaaatcagattggaattattaccttccccattaaatagctaaaacaggaagtcttgatttattcaaaccatatttgctaaagacaaatttaactctaaatggagaaaccgcttaaaggtcaagttttgtcttggatactttgaaagagttgctaagcatttttgtcccctatggaggctgggttgacaccaggaagtgttatttgtgttatttcccctcaaacatttttccacctctcagtaatgacaggagaattatggctatagagagcaaacacagccttatgtgggcatgatcacagttgtagcaagccagtcatgatagcaggaataggctggttgcatgagtgcactgggtgaagactacagaggacattaagggcaccagagggaacaggttcaatttctactctgtcacttacttgctgcatgatcctgggccagttacttaaccaccctctaccacagtttcctcaggttggaaatgagaatcaaaatgcccaactgcccccaaatgttcacatggattcaatgaaataaagcacataaagcataaactgaaatccaaatggaaagcaatcacaaaaagaatccagtggaagggaagtgggaagtagcaggcagatcacgctgacaggttggcttcaagtgaccgttccaatctcagaggaccacagtctcaaggccacctacagtttcctttaccacccactgtctgagccaccaaagcctaccccacccttgcacctcctttcttactcccttctaactgtgaaggcatcgggctttcccagatatcctttgcattcaaatcctctcaaccactgcctgcagattcccctccttctgtactcatttttcttttcttggaaaaaaacaaaaacaaaattggacccttggtggagcccttgatggcgacagcacaatctttcatccctttgctttgtcctctcaggtcctggctctgttcctcacctccacttttatttccacatcctccatgacaagcctcctgtccctaacattcagctgaaactgttcctagatcccaaactcctaccctagcacaagagaaagctggtggcattcctatttagtgacatctcttcccaactctgcatcagctttgataggtcacaaatgacctcagattactaaacgctattttttttctccttttctttccccttgacttctctgctgcatttgatattggcgccactttctcttcactaaaattctctcttctttttgttgccaggattttatgctgtggtgagtctcccacttttccaaaacgttgtgcaagttctgcttgttttttcttctgcctactgatgccaacatattctaacattcagccctccttaggagatgacccattcccttagctttgctattttctattcccatgactctcatctcaagagctcttcttcaccaaatgccaattatttctgctgatctctaggtcaaccctgtccaacagaacattctgagaggatggaaatgttctctgcctgggctgttgaatgcagtggacattagccatatggagctatggagtacttgaaatgcagttagcctgactgcaaaactgaatttttaattttatctaatttcaatttcaatttaatttattacatgtggctagaggctaccatattggacagcatagttccagatagtttcacttaaacaccatcatttcaggcaaaatatgatcaatactaaaggttttctggaaccaactcctctcccagcctctctgtctatggacaactaatccctactgcatgcaaagctcaaaagcctcttttattaattccactctgattcctcagacgcagtctctgattcccattgacctgccttgaaatatccctgttctctccccgaccttctgtattttactgccacacccctgagcaggtcctcattcaaacctaaacagccagcctgaatctctcacttcaacacaccttgcgatcactgcagaccggatcttattctaacactgctctgcaatgttgcttccctgcctcaaacccccagtggctccccacttcctctgatttcatggccaaaacctttgtctggttttcaaaaagacacccagaataatatcatccctggtctgggtcaataatattgtcccaccaagtctggataataatattgtcccaccaagtctggttttccatgactctctctctccctctctctctttctacacacacacacacacacacacacacacacacacacacacaccactcaaggattatctcacaagctcatgaatgtgctgtgttcactcctgtcttggagcttctattggcttttcaaatccgctattggcttttcaaattctacctttcaagacccagttaaagactccttccctctatggaaacttccctaattaagacctgcctggcatatctcccctctggattcctagaccatttataatgagtgttatcttgtcctgatgactattgtttcaagtgtgctatccttttccccagattagacttgaagaaagtggctcttcttcttcctgacctccagaagacttagctcagaaccgagcccgcagcagatgctcagtgctttgtgaacatgtcttgattcatcagcaagtgcaggataagaactggatgtgacaacatctgagagctcagtgaacattagactcgccttgttaataatttactccctttgtcccctagtttcctgctcatccctctatttctcctggctcttttcagcttcaattcctctcatttgtccacttcttccctttgtccagtaaaccacatgggctgatcagggttggagtagagagtgtaggattgtctattttctcttggaactgatggccatggtgaacaccttgcttgccatatgatcaacatggctctatgaggcagttaaaactatgtagacaaaattttttttgtcagataaaatgaggataaaaatacctcctcatcaacatatagaggaactatggaattaaatgaataatgagtaatgggctaagaatataggattggatgtaccagaatcacagtgcaactgcctcatggaaaagctgggcattttcatcttaagggatgatccagaagggcaaagtttaaaacaaaggaactgattcaagtgcaatattttacattgtgtaaatatctgaaggaattcacaaacggaccacaatggctgcagagacacagtggtaaagtgcttaataaattggcgaacacgtgttgtgccataaatgttagtgcatgaagcaagttatgattatttgtttccctttgtgtttttctaatcaaagatttaaaaatcatgggagttttgagcatcatgagataacaagtattgtgatacaggtccaccattccttttccaaaaactttggtattagatgtgttttggaaatcaggatttttcagattttataaaggtcatctggatcatatgttgtatattgtatactactaccagtgggatatgggtcagcaccctacaatcaaacacagaaatatttctgcaacacaacgtgtaaaatataaaatctacaaatggactcacctgagttcagattgagttcactgccaaatgagttctgataaggtcagattttggccccaaattattaatcgagaacttgcaattttcagagcttttgaacttaggaatacagacattgtgtacctgtcctattctacatcattttctttaaaaagaggtagtctttttgaaagtttctattaaacttttagagatgtaaaaaatagtgggtagtaattacagaacttactacaaagctacagtaatcaaaacagtgtggtactgtcataaggataaaggacatatgaaatgtggaatacaattccatttgatggaatagaatttagactccagaaatgaactcatttatctatgatcagttgaatttcgacaagggtgccaagaccactcagtgggagaaagaataatttcttcaatagatgatgcttggacaattggatttctacaagcaaaagaatgaaattggaagcttacctcctatcatgtataaaaattaactcaaaatggatcaaggacctaagtgtaactataactcttaggagaaactataactcttaggagaaaacataaggatacatttttgcaactttgtcaggggtgttcaatcttttggcttccctggaccacagtggaagaagaagagttgtcttgggacacatataaaatacactaaaactaacaatagctgatgagctttaaaaaattggaaaaaatcataatgttttaagaaagtttatgaatttttattgggctgcattcaaagccgtcctggccatgggttggacaagcttgaattagacaatgactccttagatatatgacaccaagaacacatgcaacaaaagaaaaagtagataaattggatgtcataaaaattaaagacagctgtccaccaaaggatactatcaagaatgtgaaagggcaacccacgaatgaaaatatttgcagatcaattatctgaccagggtctggcatccagaatatattaataacccctgcaactcaacaataaaaagacaaataacccaattaaaaaatgggcaaaggatgtgaatagatataactccaaagaagttacatgaatagccaaacatgcatatgaaaagacactcagcattattagtcattagggaaatgcaaagcaacatcactagagatactatttcacacccactaggatggacatcattttaaaaaatgacaagtaatggtgaggatgtagagaaactagagccctcaaacattgctggtgggtatgtaaactggggcgtttgctgtgaaaaacaatttggcagttccttaattagctaaacgtagaagttccatatggccgagcaattcaactcctaggggtatacctaaaagaactgaaaactggtactcaaacaaaaacttgtacatggatgttcatagcaatgctattcatagtggtcacaaggcagaaataacttaaatgaccctcaatggagcaacagataaataaaatatggtacattcatacaaataaatagtattcagtcatacaaaaggaatgaagtcctgaaacataccataacatggatgaagcttgataacattatgcaaaatgaagaggtatacacaaaaggtcacatatatgatcccattcatatgcagtatcaggaatcagcacatccatacagattgatggctgccaggcacttggggagtggggaatgccgagtgattgctaatgggacccagatttcattctggggtcatgaagtgctttggaactagatagtggtgatagttggataacattgcgaatgtattaaatgctacagaattttacaatttaagatggttaaaattgtgaattttacgttatgtgaatttaattacaattaaaacaaagtgagtagacaaatattgcctctttggggacctcaaggcatctggagacctcagggtttgtttggttcatgtgttttgttttgttttgaatcactagctaagatgttggcaacacagtaaacaaaagctgaacaataataataattgatgtctgctttaaatgtgctgtttctgatgtatttttgtaaatttcaggaattcctgtagcataaaccagagtttgttaatcttggcactattgccattttgggctggttaattctctgttgtgggggctgtcctgtggttgtggaacattcggcagcacccctggtctaacccacacaatgccagcagcatctcccaccccaattgtgacactatgacagaaagagatcttgggccaggcgcagtggctcatgcctgtaatcctagcactttgggaggccgaggtgggtggatcacttgaggtcaggagttcgagaccagcctggccaacatggagaaaccctgtctctactaaaaacatacaaaaacttagccaggcgtggtggcaggcacctgtaatcccacccacttaagaggctgaggcagggcaatcacttgaacccaggaggcagaggttgcagtgagccgcgatcgcgccattgcactccagcctgggtaacagtgagacatcgtctcaaaaaacgaaacaaaaattattcacaatagcaaagacttggaaccaacccaaatgtccaacaatgatagactggattaagaaaatatggcacatatacaccatggaatactatgcagtcataaaaaatgatgagttcatgtcctttgtagggacatggatgaaattggaaatcatcattctcaggaaactatcgcaagaacaaaaaaccaaacactgcatattctcactcatagctgggaattgaacactgagaacacatggacacaggaaggggaacatcacactctggggactgtcgtggggtggggggaacagggagggatagcattgggagatatacctaatgctagatgacgagttagtgggtacagcgcaccagcatggcacatgtatacatatgtaactaacctgcacattgtgcacatgtaccctaaaacttaaagtataataataataaataaaaaaaagaaacaaaacaaaagaaaaacactaacaaaaacaaaaacaaacaaaaagaaaaacgtctccagaccttgccaagtgcctcctggaggtcaacatcacccccgattgagaactactaatgtgacctctttaggaaaagtttattatcctgggattttttcctctcctaaagtttctttttaaaaacccatttctgagattgttctttagtaatttccaaatgacagcaaactcatgaaacaaaacaacatgaaaattccaggtaaatgtccaaaacctttttcattaagaggaactaaactacgcagtccacttgtagacagtaggtttctcactggcaacgaatgccctggcaataagctaaatgtggatagcacataaaaaaagtgaatgtgcaatgttcccttttcaaaccctttttgggcaaagacgactgctctgccagcattccagtataatgacagctcatgtgccctttgtcaaccttgcctccttctcctttgaaaatacaaaccacacttcttcccaaacttcttctgataccatttaatgagtctgggatcagacactgttagcacagagagcaacctgtgctccagatccccctcagcagccgctgccagcaggaagggagggctgagtgttcaggacgcagggttccctggctgcttcaccagcgcagtgctgcctttatccattttatgtcttggatttctgagtgggatttattttgcacaaagagttctgaagctgagaagtttgaaagccactggctcaacccaagcccctctcctacagatgaggacaccagagtgcagagcaaagggcaggaccacgtgtgattccagggcttttaactgtagacaggcccctttcctctgttacagggaaggcagccaggcagctcctgcaagatgtcactaatcccttgcgtgcctcagtttccttatctctacatgagcatagcaacctccatcttcctggctacttctgggatttaaattagacacagtaagtgccatgcaagtaccactaatatggatggaaagtttgtgtcctccccaaatccacatgttgaaaccctaaccaccagtgtgatggtgttaggaggtggggcctttgggaggtgattaggactagatgatgtcacgagggtgaaccctcataatgagattcatgcccttatacaaagaggaaggtaccagagagctctctctctctctctcttcatcaggtgagaatgcagggagaaggcaaccatctgtgacctagcaggagaaccctcaccaagagcctgacaatgctagaaccctgatctcagacttccagcctccagagctctgagaaatcaatgtcagctgcctaagctgcccagtctatacctgcccaggtattccattatggcagcctgagctgacaagtctaccgcttgacatcacacacatcctcaggtgtgtgaatggtttcacttcttctttcctaggaaaagagtcattaaactctacacgtttcacacaatcctcttgtgatcacagccacaagggaaagctcagcttactgaactgtgtagggattctgttactgtctcactgcacagttgtcttcctctaactgttgagaatcaaaggctataggaggatgggtctgctttgtcttgaaccacaaacttctgaaggactgaaggagagaatcgcactgcgggtgacccacttctgcttcacactctgatatccccatgaaaaggagcctgcacacaggcagtgaattccagacggagctgaactctcaggtcctctttctaaattctcaatctatctaaaagaatacacatacaggtgaaattttacctccctgctaaaaaccttagggaaagccaaagttcataagccagaatctctgagaagtttcttgaaactatagtttggttaggaccagcctgaataaaaaactgatgaatcctcggttcacatcaacaaaagacgggaaagacggaatggctccagtagcttctcaggaatagccccaggggcttgagagagcagaaactgcgacacacacaggatcagggccagcttgtcaaaggtaaatctcaatgcttacatccaggcaggatgggaaggaccctgaactttcccaggcaaggtcagcagacaaaggaggttctctacaacaggtgcccaggcggtcagtcatgccacccggaggagagggcactacacaccctgcaccaaacagacaagagaaacagcctttgctgtgcaaaatcaaaacatgttacttccatctcttgaaggataaagagttctgtactctggcagattcgaatcacaacaaagacaatccatttccttctccccttaatctggatctgaaagatttgaagaggaacctacccagtttcaaacaaagcccatttcaaattttaataccaggtcaccctctatgaggttgaagaaaaagagaaaaagtactgttcctatgaaaagcttcagctattcaatagaggagattgatcccaggaatcagagcaagtgtacacctttaaaatggtgatgcggaggatgatctctaaattgtattcaaacaagacttaagcagctattaggctcacaaaacaagtgtagggggtgacgaagatggacagtgtgcccaccatatggagtgggatggagggaatatggagattgtgtattacaaaaaccaaataagtaaagtggaacatgaacttgagaaattcaaatggaaatttaaaaaaaaatagtaaaaaagtgactaatgagagagaaatgcaaaaacaaaaaacaaaaaacaaaaaaaaaacagggcaggtataggaattgaaattccaagaggaagatcagagcagaggacatcatcattaaaggaggctgcctttggctttagagcaaaaggtgcactggatctcaagcaatagcaatgaaaagttaccccaaacagaagtccccagtatatatactttttaatttaatagagaaaaaaattttataaacatcttagttgaaaaataaatacacaaagagagtacttgacaaaaaaacaataatcaaggggacctcacgtcatttatgaagcattaaatgccaagaaacaaagaagcaacaagagtattttgaaatgcaaaacaaacaaacaaaaaagaaaaacaaaaccctcacttgaattctatgtcacataagttgtctttcatgtgttaaggtttaggcctggaagggctgagaaaatgtgttttgcttatatcttttttgttgttgttgtcagagacaaagtgttgctctgttgcccaggatgcagtgcagtgtggaaatctcagttcactgcaacatctgcctcctgagttcaagtgattcttgtgcctcaggctcctgaatagctagaattacaggtgtgtgccaccacgcctaatttttgtacttttaatagagacggggtttcaccttgttggctaggcttgtctcaaactcctggcctcaagtgatccgcccacctcggcctcccaaattgctgggattacaggtgtgagtcactgcacatggcccttgcttatatctttataggtaaaattttgtttggtgctatagtcttctctaatataataataaatattttaaactttgtgggccatacagtctctgtagcatctacccaagtccaccactgtcgcatggaagcaccacagacaatatgtcaattacagggcatggccaacctagctggtagaactttactcacaaaagcaggccatgatttgccgacctctgttccatctgggagattaagaaaaatccagagcacaggagtgagtaagtcataatatataataggaggacaattggtaaactaaattatagagagatacaaaagacaggagaggcaatacaaaatttaatgaaaataatctagttttaaaatgcactattttattaactaaaagatagaggttttaaagagaagggaaaagaagagtgtgctaaacttctcaccttccatgggcaaaggtgggtggtggagtaacagagagaactgaaggtttaaacatgcttttgaaaaactagaaagttatgtctagtaaaattaaaaacaggagacaagctttccaaaccaccacagaattaaaaagcaaagaaaaaagttacccgttttacgaaagactgaaaatagtgaaaacgaaggaagcatagagccagaaagcatatgataagttgacaaaaatcacaccaaataatctgtcacaataaatgaaaattagttaaatccttattaaggacaaatacccatattagaaacatggattatgagaaatccatttgatgtgaagtacacaagctgctatataaaatggtgaacaaatgtgaataaaaatagattagagattgaaatattatttttttaaatgtgcatatccaggaaaaataattaaatagaacaaaaagtctatctttaaatgaagatattattgatttgatcttttatgcatgaagcaaaaacataaacatatataaagcaaaacttgttaaaaatgtaagaaatagtgggaagaaacctggtagcaaagggaaactttatcatacttctctcaatatttggcaagtaaagtatataatagataatggtaagataaataaagattaatggataaagaagatctggaaaacaccactattaatgtttagttaatatatacactaaagattaaatctattgtgtattaattattgattacatattaagtcattaagaaaatctcaataagtcccataagctaaaaattattgagctcacactctctgaccacaatgcattaaattagaaattacatttgagaaagtgggagataaaattaccaatgattttcaaatgaacaaacaacaacaacaacaacacaatgaatcctttcctgtctacacaggacaagggaaatattaaaagcaggaaggcagactgattggatgacagcactgcctacccaaacataagggaagaaactaaactttgcgtagaagcaaatgtacagcttggattgtttttaatcttagacaagaaagaattaaaatagatgaactaaacattctgggtaagctaatattgaaaagcaaaatataaccagaaaataaaagagagaaatctctagagattacattaatgtactgggaaagagattaaaatgactaataaattcaggacttggattctttgaaaaaaactaataaaatatacaggctttcagaaagtctgagcaaagacaaaaagaaagaagaaagatagcaaagaaataaaaagttacagaatttcatgtagaagtctatgctaaaaacttgaacctcaatgagaaggcaaatggaaaatacgaaaataaagattatcaaatctgacgatcagaacagaccactatccatggaagaaatagaaaccagtctcaaagaattgcatccataaaaggagctgggcccgaatgttttataggcaagtttttcaaaccttcaaggaacacataattcttacggtatttaagctgttacagtttatagaaaaaaaatgaaaagtgtcacaattcgctttatgaaattaacataaacgtgctaccaaaatgtaacaaagacagtgcattaacgtaaaacaatagactcatttcacacagaaacacagatgcaaatgagaagtgaaatatttcctgtgatacagcaacatgaataacggtgatgtcacctgattgagtagaatttaatccaagaatacatggaaaggttaataatatgaaataaaattttatcaaatcaatgtcaatgaaaaaagattatattgatggatatcaataaagcaaatgtttaatttaacaaaattaaaaattcatttttattgaataatattaaaaatgcaaacaaattaaaatacattttaaatctagatctgtatagttttgtaaactctagaaagatatttctttgatatgatggagtatatcaatctaaaaccaatggacagtgtcatatctgtcaaaatatcaaagcagcatttcccaacatcattgtttaatcaattttccaggagatgttagcagatgtgcttaaaactaaagtctaaacaacagttcaaaagtagtttgggaagtaaatggagtgacaaaatgaatccagagttttcttggcagaatgaatgtacaatagacaaaataattttgaaaaagaatattcatccaggccttaacctagagaatattaaaatgtattatgcaaccacagccattaaagtaatgtgacagcaatactagagcagagagacagataaatggaaaagaagcgagtgtattccaaaatagatccaaaattctttttaatataacaaatgtggttttccaaataagaaaggaaatgatggattatttgataagccttttgagactatctggctaaccatttcaaaataaatactgtgaggcataatctaccaaaatacaaacatgaattccaggtagattacaaatgatgctctaaaagaatgaggaggaaacagacttacattgtggaaggtctctctgagcatccctgagaaggcacattcaatgaaaaaacatgaaaatatttgactatataaatattttaaatgtctaaacatttgcaaaaaccataaaacaacaaaatgcaaataaccaagtggaaaagatagttttaaatatgtataaggattataatattttaaaatattcctcatctttattcttttcttagtaaacctctctctctctctgcctctctctctctctctgcctctctctctctctgctgtccacttggctttgctattccatagaaggtggatgccactctggaaaggaggaggagtgtcccctttagccagaacaaggaagaggaaagacttccctgtcttccctgagggactgtgagaaaggtggggaagaaggtagtggaaagaggcagttggcatttgttctgagccctctctctcaacaagagtggtaggaatgcctgaagattggctgggcacggtggtgcatgtctgtagttccaactactcaggaggctgagaagagaggatcacttgaacccagggttctaggctgcagtgagccatgattgtgccacttcactccagcctgggtgacacagcaagaccatgtctggaacaaaaaaatgcctgaagttaaagcggggcggggggggggagcaggcagaggtgctttctcccattctccattctgggtgtagtcagtcctttccatgagagccaccatacctgttaatgtggcagccagtgtggtggggtagagagtgtggtgtggaaggaacccaccaggctctctgtgccctgagactgggatggaaacattgttgagaatttggtgcaggaggttgtcaaagttgttcacagggctgcagggacaaagtgactccctggccaacagcaacagagccagtgtcactggagccaggaaacaatggagtcatagtcaaaccctctctgactactatgacatttgtaagcccctaggcgtggtcagtatcttagagggcagatctgaaaggccctgtgctgtggtctgaatgtttgtgccccacccccgaaattcctatgttggaatcctggcccccagtgtgatgatattaggagatggggcctttgggaggtgatgcagaaagaggccccagggagctgcctcactccttccaccaagtgagcacacagctagaaggtaccatccataaagatgaaggtaggtcttcttcagacactaaatctgttggtacattgagctcagacttccagcctcgaggattgtgagaaataaattcctgtttacaagccacccagtctatggcattttattatagcagcctgaatggactaggacaccaaggcatccaagagactgaatatgcaaagatgatgcataaattattggatttgaatgagtttattaaatttaactaaaagtgtgtgtgcatgcatgtgtgtgtgtgtgtgcatgtgagtgcatgcatatgtgtatttccatggaagtttgtagaaaagatcacatccgtttttggaaaataagctacatcttcttggcacatttgcatatagtgtgagaagactggcaacccaggatttgtgataaataagtaattatttatcttcaatgtataaaatgagcttaccgataaaaaaaaaaagacagaaaaactgctgtataaaaagtggccaaaaagcacagataggaaatttcacaagaggagaaatataagtgatggataaaaatataaaaagaaatgttcaaataagaacacatgacacggggaggggaacatcacacactggagcctgttgggggttggggggcaagaggagggagagcattaggacaaatacctaatgcatgccaggcttaaaacctagataatgggttgataggtaaagcaaaccacaatggcacatgtacacctatgtaacaaacctgcatattctgcacttgtatcccagaacttaaagaaaaaaataagaaaagaaaagaaacattcaaatagcgaagaaatagaaaacataaaaatgaaaagccactaggcaagtgtcaaactggcaaaccaaatagcagggctaaaatacagtaaacttgttagacaaagaaaatgccttagaaaactgtcctcatatccaccatgaaaccatgaggtgacagaacacagcaatgactttgttactaagtgactaaggattattactccatccaagtaataactcacttgtctatagcctgacttgaaagagtcagctattgttcaaagcattgttagagctcattgttgatgtcttctgagcctgcagcacgttcttttgaaaatgatggtaaatcttcattgacagatttgtcttgtggaaagagccaaaattaatttaaagccaagtctggttatactatttctgatcacgagaaagcttttctcataaatctaagctctgaaggcagtgacaaaagaggcattccagaacgatgtggcagctcacggaaataagttttttaaatggcacggtagaaggattgcacttggcaggatacagctccccttgtcctgcataaaggtctcccaactggtctatccacaatcttgttttcactaagcctttgataatcttgaaatgctgtataaactctatcatgtcattcctgctcatctttggataaaaacacaaacttgtataatggctataaagccttgtttagtctggttcttccctttccagcttcactggacaccagttatctcttggcctcttgtttctggccacagtggccttctagaaagtcattatggacattaagccagccccactaaagtcttcgcacgttctcttccctccctccccatttttgcctttaaacacctactcattcaatagatctggacttaatagtcaagccctccttcccagaaagacctttctaccctcccagtccaggaccacccttagccacaggacatattttcaaggcaccatttatgttcccttcattgctctgtacacggttttcgataacttagtgtggctatctgattaatgtctatctccttctggagattagaagcctgcagggaggcaaagatcccagttggttttactcagtgcattgcatgaagcctggcatatgggaagttctcaatataactgatggattaaagagaaatgtaatttggcacacttgtgaggtcggtgatctgcaagaggactacaatgatctgcccctctgtgtacacacttgctgctctcccatcaagagatgagtctgtctcgcttccccttgaacctaggctggtctcctgacttgctgtgactgcagaatgaaacagcagtgatgctggaccaggtgtgagcctagctcttcaaaggcctcacagtttctgccttgactttcttgggggagagctgccatgctataagaaggtggtttagaagggaacagaggccaccaagactcacagccagcttcaattgccaggcaagctgggtgctgacgtacttttgaccatagaatcatgagacatagatggctgctgctttaagccactaccttttgggatggtctgtggtgtagtaagagtaactgaaacgctggcttcttatcttaaaataaattctagccaggtgtggtgactcatgcctctaatctcaatgttttgggaggctaaagaaaaaggattgcttgaggtcaggagctcaagaccagcctggacaacacagcaagatcccatttctataaaaataaaatataaaaattagccaggcatggtggtgcatgcctgtagtcccagctactcagaaggctgaggtgggagaatcacttgagttcgaggccgcagtgagctatgattaccactgaactccagtctgggtgaaagaatgagatcctgtcattaaataaataaataaaataaaataaatcctaatggcactagtttttcttcacaccattatctctaagaggtgaaccttttccatgagaactagggaactgctccctttgtacctgcagtgaagcaaccctcaacccctggttatcttgggcatccgcagagggtttgggattatcatatatcattgtatgtacttgtcctttttccttgtcatttttcatatacctttgctaggtatctaattgttcagatgttctgctccattagggcagggatttatttgtctttatctccagtgattctatagcttcctggcaaacagtatatgttcaatgaaactgctgaatgaatgaatgaatcattctctgcctcattgcctccacctgataaatccactgccagctgtgccctcctcaaacatccaatcttaaaacacatttttctgctctatcaatgtgctgcctcctgttcttttataaacataatcctcaaatattctatgtctatgtaagccacatctcagcccaatgctgcctcctttgattcagtggcaacagcaatcaatggcttaggtcctataataacgctgggttttgtgtttaaatcagataacatatccagaattcagacacgtaactatgttttcagtgattgttgccttttcatcttctttccaatgctttctatttcttagaatgccaaggacatccacccctcatggcaacatctgcatgttgacatacatcagtaatggtctgtgaatcatttgaattctggtaagatgaacatttattaccatttactctgagttaggcactatgctgggcagctgacctatataacatcccctgttatatgaaaaagaaagcctaggtttaaatctcaggccaacagtttctccattcagcagcacactgcctctggaactagtgggctctagacaatgagatgaaatcaacaaagatgattcataggctttagatgctggagcttcctgagaagcagagttcttatccttccttctctttcgtaggttgaaggctgacaccgtcatagtctctctactcatctccatggccaaaatttgcttttgaaagcatttgctccaaagtataaatgactgttaacaactgcacatggcacccccctcccttgaaggcattctgaatttcaaccaaacatttaggatgcaaaaatggaacaagattagcaagatttagacttggaagcaggcaagtcagattcctcccaacagtcatgctattcaatgcagcaagcaacccagccttagtggaaagaagcttgggaaaagggaacgtgagacttctcacaatatacaggaaggacctttgcagtcaaatagcctactcacctgattttcctgggtcagtccctattaaacatgggtgtttcacttctcagctgtggatagcacactcatccctgccctggtttcagtttttaatctctttcctctcccgcagcctagtgcagaccgacagcccttttctccaaaacagcacgtcatatttaagaatgtatgtcccttgaatataataatatgatagtatatttattcttctgctcacattttgcatgaaaaacatacttaagacagttaataaaaaaacatataacatctcgttgacgacccagcagaagtagtgccatcttctttaagtctctgctctgtcaatggtcatgcatgtagaagcttctcagtgacctctcggcacaatgaactgctatattccttagcacactgtaataatatcattctgagcaccatcctgagcaccatgtaataatatcactctgagcacctatgtcatagacttgcaataattgttgacaatttgtctccttaactagactgtgaggcccttgagggcactgtgttttattcatcttttttattctgtgtagctgagagcctggtgcttattacatagccagtacattcttggaggaaatcatctcttactcaattggtgtcaggaagaaattgagagccacagactggcaggttcagggatcctttgcactactgagcagctactcagaccctgtgaactgtatgttccctacttccctcctgtcatatcatttttcttttttttttttttttagacagaatctcgctctgtcacccaggctggagtgcagtggtgtgactcagctcactgcaacctctgtctcccgggttcaagcgattctccagcctcagcctaccaggtagctggtattacaggcgtgcaccaccatgcccagctaatttttgtgtttttagtaaagacagggtttcaccatgttggccaggctggtctcgaactcctgacctcaagtgatccgcctgctcagcctcccaaagtgctgggattagaggcatgagccaccgcgcctggcacctcactaggatttaaaagaagcccagtgattccgagggctcctgtctaccaccacttctctccaccacaacatcttctcctccacactgctgactccctgggagagcaaatccaagagcgggctatgactagtcagagcatccacctcccctagatgactccaggacccaggccattgtttctcatctctatgcatagctcagccaccactgcaagctccaaactctcaggccacccatcgtcacctgggctccttctacaacctggctgtggatgctccctaacctgaccgagtctgtgtctcttcacacacacactctctgggactcacagtaggtcctcagcattgcctcctgtatccctcagctgcttagctcttagagaaaaacacacaaccctccttcccgctgtactttaatgttatgaccgtaaatctcagataggccttcaggacttcccagtgactctaccaaacttccataaaatgtttactgtcccactctcaaagatgaatctttcacaccttctctgaggctaaaactgccatcgttccccattcctgactctctcttagctgatgaccttgcttcatatttcactgaggacataaacatatcctaaagagatcactatctctctccctctgtctctacttgcctcagggctcacacactttgctctccttgtcacttcccaatgctccccttgggcactgaatcccgttgcctcttttgcctatcccatcagtgcctctctctatcccatcgttcccatcagaatataaatatcatgtcatatccccacctcccaccattgaaagctctctctatacccctccagctacaccgcatctcctagctccagtgtatagcaaaacctttcagaagagttgtctattttccctgttcccactttttttatcctttgttctttctagaaagtacacaatcaggcttttggttccatcactcctctggacctgtgagcctcacgtgccttcctcctatcactaaaaacctgcttactgccaaatctagtgttggctcccagtcctcctctaacctgacctctcagctgcatgtgacacagctgattactcctgccttcttgaaacattttcactaggcttccaggacatcacattctcctgatttttcttctccctggctactcctttgcaatcttgtttgctggctgtttctcctgtttttcctgacctgacccccagaggctctgttttttttttttttttttttagatggagcctcgctctgcacccaggctggagtgcaggcatgatctcggctcactgcaacctctgcctcccgggttcaagcgattctcctgcctcagcctcccaaatagctgggactaaaggtgcagaggctctgttcttatctctctttactctctttatcttttctcttgtcaacctctccattcttgtagctttaaagatgttgatatatcccaagtttatatctgtagcccgcctcctctctaagctccaaatctatgtaaagtgtataactccctacttgccatctctacttccatgtctaatgaatgtttctcaacacagtgatacaaaagaaaggctcatacttctcactccctgcagccccttgcagccacataactctttggttttgccagttttagtgaagtgcattactatttactcagctattcaggccctaaacctacctatttctcacacccttgtccacactcatcaactttacctgtaaaataagtgctgaatgtgatcacgtcttaccacctctacctgtctcacctgagtccaagatgtcatgacctctctcccctcgacttctaatagccttttaactagtctctgcttctgctcttgcccccaaacagccaattttccccccaacaaccagaatgatccttcaaaaatataaatgagactggccactcacctgctaaacacccttgaatgacttcccaccacaattagaataatatgcaaactttactttggcctgaaagaccccatatgactttggtgttgtctatctctccaatctcttcttgaacttgactgccccctccctgtctgtagttgagccatactggcctctgtgatcttcattgaacaggtcaggctctttcccatctctgtactcgctgctccctctgcccaggaagctcttcttcccagatcttgcaagctttgctcttcagtccagtcaggactctgctcaaatatcacctctttagacagaattttccccactacccactaaagcaggccctcattgtctttgtcactttctagcctctcatcctgttgattttttgatagtgcatgttaatcttgacattttaggatacaatcatttgcttatgtctaccctttccaaatacaaccgtctcattggcaaggacttttctgccctgttcatccaaagtgcctagaacagatggtccataaatacttgttgagcgagcacacgcatgaatacgtgtgcaaaggggctcaggtaaagagtgtaatttctataatttcaaagctgtgatgtacttccaggagcagagtaagtaataatgatgggcaggcacaatggaaggccaggtattggattaaggagggcctctctggcagccctacaggacagacatttctgcaatgatagaaatgacctatatctctgctgtctaaaacagtagtcactggccacgtgtgactatggagcacttgagatgtggtcagtgggactgaggaattgaggaactgaaagaattttatttaatttcaattaacatttaaatagctatccttggctggtggctatggtattagaacctgaagaatcccttcccatggcttgtgattgcaggataattgtgtataactcactgagttgtcgaggggactaatgaaataaaaagcttaggaaaatgtctggaacataagtggcacaaaaaaataatagttgctattattccacagagttgcaaattaaagtactttaagtatatgccatttaaattaggctgtaaagcacttgaaatggacttttattaatgttaggcataatgttttgttttttagagttggtggataatcgatgtttgggtctgtatttgagcttacaaactaaaaatagcacacaaccattttgggatctcattgaaggagatagatgtctattccaagtggatcagcttgctgatacttataatgagctaattaattttgacaacagctaatttagcatctgcaaaaattggatttgtaacattatgtgtactgtattattttcaaacagtgttatctgcaacttcccggatgattttggataagagaagtgtttgttttaatacttattattaaaataaaaaaataagtatttacttattggaaatactatgattaattatttaaggcttaaattggtttggacataaaatcatttttttttcttagtggctgaccataattccttccatactgaatccagaaaataaaattagcacagatatagaacataaacagaccattataacaaacccttatgaataacctaatgcaataataaaatcacacatttgtccagaataagcatggtacttattttcaggccaagagaatttgcattctgtagcagagtgaaaatggcattccacagtcagcctaagcacttggtggagactctgagactagagagagcagatgcatttaaattgaacacgtgcttataggcattaagaaaagttgacattcttattaaagagaccaattaatctgcatcagttggaagccactttacagtcgaaaaagtgctctaggacctaatataaatgagactggagtagaaagagaatgaaaattcacttttctacaagggagccttttctaattgccctagagctgtgctgtttgaaatgctaatccttcctcttccatcccggactgggagtctggggtaacagaagccgaggagggtgaagacccccagatgctaaagtgaggggtgttcaagacttaccaatgggcatgactaagaaaaaaggcagccagcagaggacgaagcagccgaccacgatgcccagcgttttggccgctttcttctcccgggagaacttgaggagcctcactgagaagtgcgtcttggtcttggcgctggccatcccgctgcctcctgccggggcgtttttccgatggatgcggagcgtcacttgctccgagtccgacttgtcggtcttgaggccagacttgaggccccggctctccctcttggccaccacgtagacgcggcagtacatgaccaggatgatggccagaggcaggtagaaggagcccagcgctgagaagagcacgtagcccggctcctcgttgatctggcagatggtctcgtcctcgggggccggctgcctccagccgaacaggggtccaatggatatgaccagggagagtgcccagacgcagagcagagccatgagacccctcctctgggtgacgatggttgggtagcgcagcgggtagctcacgccgatgtagcggtcgatggagatgatgcagaggcccatgatggacgcggtgcagcacagcacatccactgccgcccagatgttgcagaagaccctgccgaaggcccagtagcctaggacctcgaagatggcggagaagggcagcaccgtggaggtgagcaggaggtcggccaccgccaggttgacgatgtagtagtgcgtgactgagtgcaggtgtcggtgacaggctacggagaggatcactaggatgttacccagcaccccgaaaagaatgaggccccccaagatcaccccgagcagaatggccttggaaatgttcaccggtgccggcggttgggtgcagttggagctgtcggaagcatttcccgagagaaacaccatggtcccagccggggccgggcgaggtccggctgtccagggccacctcccgggctggcgcggaggcgggagcgcgggagccgggaatcaaaaggtctcggctggagggagccctgccaggtgggtttggctgggggtgagagcgcgcgcgcgggtgggaaacaaccctggccagccctgggaaccctcagaaggccacatgaaggggcagggcattaaagacatggccaggggcgcgcggggctgccggggaccctctccacctgccgggctggcctagcccgggacccggactccctccctacccgaagctgggtgcgaagatccaggagactccttgcaacatgcaattccagaattacgagaatctgcttttccgcgctgtcttattcgtcctggctgggggaagattcagcattctgcacatgattcggaattc

SEQ ID NO: 1422 - DNA, 109010 bp, Homo sapiens
ctcacaccctacacgtggctgatgattctcaattaacttttaagaatgaaatgggggagggaggttgtatgaaactgatttacaaaaaatcgagctatttgtccctgaaggctcttttcctctttccctttgcattcatgatcattccttaagttactgtttttcctgtatcagtaacagtaacatgttggatttgtgccttagtcagatggatgcttgataaagaagtaaatccaagtgtcaggcaaggctcctgggctcctggggtggattccaaagacagtgggtcgcaggaccagtggtgggtttcatgctccccttccttgggcagtaaggacaacagtcgtggacgggaagctggcttcatgtcatgggtgtgtgtccctttaaaacacaaggtagactaacatttaattaatcatgcatttttaatatcctaggcatcatgcatcaatgtgatcacaattttatccttttgtagagtaagaattcttactccaaacccaatgtgtccatttttccaagttcagacttcagtagagcgggttctcaagttgaggatccctctcatttcctcattagccaggctggtcacattctgctccctgtgagatgatgcttttggtcttctttctccaaacactgaaagaactgaatactcttctttttaatttgggccaacaccaatccgttcatccttgcagctgcttctcaaaatccagaagactgaaatagccatagactgtgtttatataaagcagagttgggccaagaacctcatccccgaaagtgactttttttcctctctttaaaacaagtttgagattctgagtcacgagagaccatttggcagggagatggcagcaagtccctgccaaattcagcctccgagcatggctgactaccccgtcagcctgagtcgtggtgagctgagcttgcagtgtggacttccctgtgaagccacctgcctagaaggctgctggagaccacttaaagggtgccccagaaatgtctagactcgactggcagaacctgaaattagaactaagattgtgacctggagcttccatgagagtctggaagtacagcttcaagtctgtcccttttgcttccatttcccccaccccccacctctgctccatcaggtttgtaacacaagcagacactctttcatatgcttcaatgtagcatgaggtgtgacctttgtatgatgtgaaagccaggctttgggggtattatggtgatcttcaatttgcagtgaagtcaaaacgacctctgttcatgattgggaatttgtggttttggcttgtaaacatttacttccagtagttgcccacgccaagaggtgttcatcccatatttccttagatgatgttacatcttagttttgcttcaaatgctgtactgtcttccagtggtcaaaactacttctctttcccataacatcatttatataagcacacgcacacacacaggcagacactcacaccttttctataatgactgcattttatgtagcatctttcataggacaactatgataacttaatatactttctattgctaagtaagtagccaatgtgaggaagatgacaaacgccagccttggatactcttgttctgggctgtctacaattcagagagcttggtggaaatcttcaaagtagtgtagtttgcctgatttttaaaagctaagacaaattttccaggtggggatatttccaacccaaagaaaatagtgtggtgtggggaataactgagagttgggatttagtgcctagcaccttgaatgtaggaatgacaggacctgagccgcggtgcagcaggtagtttgtgacctgctttctaattacagagaaatgaatgtcttcaggtggggatgaccagctcctggaaatgtaaacctgaagtgagataaagagcaaaggaaagtgaaggacttattttctctcttcctgcacatggcactttcagtgcttgaagatactttaaaggtgatctaatttttagttgtgtcttattcagatggcatttgagaggggaaatgaagatgggaatagagtgctagcatttatagggggcctactatgattttatagctttatcacctcataaggcatttcatgtacacaattgtatctgctaatcccatttcacaggtgaggaaaatggctcaagagaggtcacgtgatttgttcagggccacttaaataggtacagagatgggaactgcaatgaagcccaggcccgtggttcccagtccatcatcggtcttctctcaacaccattttccaggtccttccagtgcccttcctagcatgggcattggggtggagttgggaaggtcacgtttagcaagctaagaggtgagcacaggagaacaccaggagaacacacaagagagcgcagctctttccagtatttctctttttcaaaactccctgcagacttgacttacttgcctcttctcatacccataatgttgtatttattctctgggaaaatttttttttgtaatgtgactatgaaatctcataccttaccatatcatgtgcaaaaacttggcatgtagtggatactctgaaaatacaatttttactatttaaactttatctttgtaaatcatcatggatgcattataggcagcaaaatgatttcgttgtcaggaatattggattaagtttctgtgttaatactggagagtgaattgcttgtgacttgttatacccagagataaaaatagtttgttttctctcacatctgatgaagaaagcatgtgtttttgattcagctttaaatactgaggcagaatttctgttgcacaaatgtcagctctcacttgttgaagtttaggtatcagggttgcatatggtattcagaagaggaagacggggccagataagctgctgggaatggagatgaaagcaagcaagggacctcagtttttattcaattacttcccaataaaagtatgactctttttttttaaagtatgtagaaaactagcaatggattgttatttaaatatttgtaatgcttgctttgatcttcaaaatacttcacagaagtactttttaatagccttcctacttgtcggattgaatttgggcatccttatttgtagattcaagctgtcattcagcaccacattcatcaaggtctcctccttctctgctctttacaaccactgtcacctctgttatgactccaggactgactcggggaggcactgtggggcacgaagtactctgcccgatgctcagcttttgattaatgggccacagccctcccatcccttgagacttcagttagccgaactcttttccttaagaaagataaggctgcatttagcaacagggatgaagacaagggaggagaagaaacgcaatttttaaagataaatcaataagccattgctacacttattcgaacttggttttggatggcttttgggcttgaaaagacagaatacttttgtaggctttgccttttgatgtgattttccccctgtcatttctagattggactgaagctggtgcatcacgtgactctagatagcaagggtgttctgatgtgattgatattgtggaaccagatatacttgcaacctgagagtccccagggaggaaggaggtggataggaggccacagcggcatggtgtcttgcccagaaaacacaacagtaggtactatgcagttagaacagtcctgattcttccaaatgaggataaatgctcctcgcttctcagcaggaaccaggacagaagagaatatatcactctgtgtctgtcagggaacactgtgaggcaatacaagggtcttgggttgggtgattaagtggaaatggcatgggatttttcaagaggcacaaggtgtgcaggccaggatgccctgagaccaggcagagtgggtggcagggcagcaggaccgtctcattgtgctcatgaaggcttaggctttaagagtgggaggtggtcttcagaaggtcgaaattaagagagcttttagcagggcctggctgtctacatcctcatatcaaatccaaacagtgcagcttcctttcctcttttctgtctttcttagactatgagaagagtagaggaaaactacatgaggctccttggcacccatttttcaagccagtcatgatacagggcagacagcactgacatacccttaacccacctatcactggcacgggtgccccagggtgatcacagggctctcatgtggtcctcaatgccccagttcccaagattgggctctgctgttggttcttatcccatcttgttctgcctcaccctcctctcggagtctagggtctgtcctatttaatgatggggctctgcttcctcaggtgcaaatgtctctgggtaagcatatgcccacctgactcgagatggctgtgattccccactgctgacctggggttccccactgctgtgctctgcacacctaactgggatcttactgtcccttagaatcctcagggtcatcaacttgagcctttctgggtggatcttctgatgtttccaggtccctggggactggcctcccagctgctatctgtaactagtggttggatcttattacttgttctgctgtgcacccctctctccatgcctgcttaggggctggagtactgtcatgggcatgctaagtgacagaccattgctgccatccaggagttctcctctagttgagaagacagaacttatataagtacagtatatacaaggtaccctttaaaatactttaaatagatataaactttaaaaaacaacagaaaaattacaacagagtacagaattagttgccaaatacattctacagacaattgctgtaagaacttggagagaaattgggatgatcagaaatggctgaatttaaacttctaatctgggaaaagaattatggataacattttgtatgggcagaaatgagagagtgaggagggagtccttgtgggctcaaatgagtctcctacagattcctatgttgaagtccccaggacctcagaatgtgactgtattcggcgatagtgccttttaaggcatggtgtggttaaataaggtgatgagggtggacccaaatccaataaaaccggtgtccttataagaagaagaaattgggacagagaaatgcagaggaaagaccaagtgaagacacagggagaagatatctatctacaagtcaaggagagatacctcacaggaaacaaccagccaacgccttaatcttggattttccaacctccagaatggtgaggcaatgcatttctctttttgaagccaccccatttgttatgattggctaggacactaatatggcagggctacaaatgcatggagctgtgctgtatctgcaaatgcaggagcatactcgttgggagaagatcctttacttaaagcagaaaagttcctggaacaagaatatgataagttggcagaaggactctgtgaacaagttccagtagcagatgggctgctggggacagggacgaagagcagagcgccagaagagaaagaacaccctttgcctggttgacagttttgcttagggtatacattccgatgggttaagcattgctcaatgctaacataaaaccaggtttactttatgggattaatcaaggccttgaagaccctcaggcactcctaagggggaaagtcaaaaagaaaggaacaataaaggaaagagacagaagatgcagaagaagagaaagagaaggttactttgctgggctcagtagagactttcgaaccatcagagagtggtaagaggtgcacaccagggaggctcatagaaatactgcagccacccactctgaccaccagctcttttccaaaatgtggctgcacgttgtttgtacctttcacttggaagtaattgtgtaagaacaggaaggcagcactgcaagcagagggtaaaagtcattgggggccttcagaatgtcctcatcctcctggcactgtctcctgccctgggctctctggaagctgtgggcctggagctcacagaatcaggctgacctgggaagaggatggagttgctgagagcagccccatctcatcactcagagctatgcatggagcatggattccatgggaaatggcaccctctggagcaagggcacccaccccagcttctttcactgtttgtaagtttagcaagaaggggagagtggaataatggagaggatgggatcaagaaaggagatgggaaagatgaaagggcacaggaccaagaccaaacaggggacgaagaagggaagggagggaaagctgccatgaagcatcagccaaaggtcacagattacttaatggcctcagtatttccaggttcttccatatcagttctgcacccaccaccatccacgccccatctcagagctctgctgtggagcctcctctctcaacactgtgaacaccgtgccctcggctgcaggaactgcaccttatttctgattgggagagtctttctcttcctcgttgcccatcaggactggagagaggaaggaacaagaggtccctccaacaagtgtgtcagctcagggaaacatgaatctggtattcttaggggagggctaaatatgcttccccatagtaatatcatttctattccagttagtcaaaggaaaaggaaaaataagaaaagaaggaagaagtagaggaggaggaggaggaggaagaagagaaaaaggaggagagaaattctgcatcctatctgtcatttggaaatgcccctcatacccagcatgctttctgaaccccatggctctccttggtgagctccaggcaggccctcaaatgccctggtgtggggtgccatgtccaggaggccttcccaaggagccaagtgtggccctgaaattctcttggggtcctctggggacttccacttgggcaggtcccaagggtctgggagaaatttcaggttggccttggtcaggaggtgtgtatttattgttgctactcttagggtcagccagattgtgctgtgggggtttccctgatgaggtgaggagctgaatgatattgaggctacctgggccccagtggacctttctgctctacagatgacagcagtgggggtggcggatgctcacctcttatcctgatacctgcttggaaggtcacaacaattcatggagtggggccactttgaatatggacttgccactttatccaatgactcatgcaggttagccaagtggagttgtgtcaatggcatatgaaaaaaatatttgtatgtggaacaccgaaacctattgtttagcatcatctgtactacactgttagctagtaacggcatagatcatgacggcaaattacggcccatgagctcactccggcctgcagcctgtttttttgtttgttttgttttgtttgagagaagaagggtttttacattttagagggttgtccccctccctgcaaaaagtcaaaacagataagaatgtgtgatagagactgtatgaccccacaatgcctaaaatatttactatctagtcacatacagaaaaggtttgcaaactcctaatatacattaaatagatttttattttttggttaatctgggaacatcctccccctcccccatttataacaatgcctcttggaaaaatgcattcttgactttgaaacagatgaacttgaactctatccagcttgtaagctggggactctctgtgcctctctgtgtttttcatgccaagtgcagggcggggtgcaggagaggttgtttgctgctgctgatgaccagtgggtatgcaatgacccacaggctgaccgggaaaagaattatttcccaaactccctttgggacctctacgttcctgaggacattaaggtggcaatcactgccttacatgtcaccctgtggagcaaaccaagagcctcctgccctgcctatttccttggctctgctgctgccatctagggagaaacaacagaatcacatgtgcttgtctgtcagtcaatgacagaagcatagacaaatttgccctcggcccctagaacagtgacatgctgcccagccatggcagagataaggcaggagagaaagtgccaatagagctggaattataggtcagggacaaatgagtgagatatgaacgtcaagagtgtcgagaaacacagtggacctgggaaacatggaggtgtcatggaaaaaggagtcggaggctggatttggggatattcaaagaaacccttaaatctcccacctcctcttttctttatatgctaaagtgtaggtaataatctcttccttctccttctactgcacagggatgacttaagataggcacaattactttgacaaacataaagtgctatataaacggacagaaatattaaactcaagttgggatttttctgtcttagctttctctctactgcgtttgaatgcacctacaggatccggcttttgaagaagccagtgccgtcatttttttctcaaaatacagtgtacatttgctcttagattttctgcctaattaagtctgtagtttttatagtttagtaataatcatttccagtttataacgtggctgcactgaatatgatacagagagagaaaaagtaaagtaataactcctgagccacacgaaaaggaaaggcaattattttgtcttttgaaatgaataagccacaatctttagggcagttccttgcttatcagttgcagcaagccatgactcaaccatcctgctttaagcgacgtctatggtaaatcttcctgctcctaaacccctctaaccccaaaccccacaaccttccttttaggtgggagaaccagtaatccatgttgcagcagcaaagcagaaatgacaatttcctgaatagagcagataaggccaattctcaacccctcctccacatttgggtctggggagcgtgaatgagctaatgctgatgggagcagggctggtgtcctccactgaaattctaacttgcttttgtcagcctagccccacagtgatcatctccactcattctgctcccaggggttctggagggccaggaggccacagctgccattgctttctgaagatggttggcaccacagcagcctggctcagcccagctccccagcacagtctgcagatacggggcaggtgcaaacagtgttccaactgggctccactggagctgtgcgcaggtggtttcatagttaaaagtcctagtagtgtaaaaaaatcagagtaactggtaggcatacctctgatgtctccatatttgcctcctctgctttcttttcacttggtttttccttggagagtttacctcccatctgcttcagtgccctttgctaatgagcagagctctttctttaattaagtcaacaagtattcacacacagaggcagcatcttttttggccaaaggacctgagcagaccagccccagaagcaattgagaaagtttgtcaagctctgattaagtagctgtgatcagagtgaaaaattgcctgcccaagcaaatagttcctaaaatgttctcactaccaggtcttaaccatgaaacctactgggccagaaggttgggatatccagttttcacttaggaacaagcgatgtcacataatacatagccatagcttccagctgactcctcatttgcagactgcctaggtctccagctacctggagatcagcattctgaaccctttctccacggtggcatcataaaattcacatgcttgatatgctctctgcaattcttggtgaaatatctacaatccattcccctctgtccaaacaaaaaaaaagttggaatacaggtgagtgagagtgagttatgtcgtatttgctttcatttatttttaaaagggatgtacttcccaaaagtgtttctatgaactgtggttggtcatcaataacttcaatacaacacccgatatgtgtcctgtcagcaactgcattttactgttcttggccaatgtggccccttctgcatactcttctatgcccatcttcccccagcgtgccatagtatgtcctccttgcaaggccttaatcacattccaggccattaactcctaaaaatgtgatgcagtctgatagaagtgcagacaccaaattcttccacagatgccctgctcttgggtttgactgggctggagatttggcagcatgtttgccatggttaatttggaggcaaatctcaaggaaacagaacattaaaaagtttggatatggcttggcatcctcagcacacctaatccaaatgggaaaacgtttacccccattctcttgaggaaggggggctatggaaaatgtgcaggttgagaatagggagacccaggtttaaatcatggttccccttggccttgggcaagtccttaacctcttacaatgatcagatttttatctgtaaaataggggtagcagagtttccaaggagtttagaggcaatgggtgcaaaattccctgaagatgcctggcacactgtaggacctaacaaaaatcttaagagaatatttatttacccaaacactactgtctaccatggaatatttatttttgaatattttggagagtgttagatatgctatgtgacgacaagcagaaaccctcttggataagacatgagagaggcaaaggaaagaaaactgatgagtaaaatgcttttctgaaatccttgacataatctggggaaatttttgaataatgagattcagggtctctcataatgcatgcagtttgagttgcagaataaactcaaattttccctgtcccataatgtcagaataaactcaaacttgccctatcccataatgtcacgttgatttttgtgatgtttagacaatcccaaagcaactactttttataacacattagagaagacatcgttactctgggtaaattcctcaaactccaaatagaagcagtaaacatgtgagtataaatatgacaatcatttgctaaactgcaacaattttagatattttttggcatgcttaaaggtacagagatttagggggaatgagcgaaaagtaattcaactcatatattctttaccccactttgactaagttttgggtgacgttatcaatttcttgtaaatttggtgtatcatgctatgggaaaggaaaaaaatgttaaaagtttacctccctggagagagggggctggagaagagtgtagcagaaaattatttacggatagttttacatggatacaattgtcatggttttaatccgttgactgaaagattctctagttgtttattttgattagatgtggcattagggccagatttcctgtatttctaagctttcccgtatctaaaatttaatatgtctgtaaaggtgtttaaaggatcatctcaaacatggaaccataatttgttgaagaaaaacgataatcattcttcctgttgggacgctcttcctgtaagggggagtggggcaagtgattttcttattcagatcctggaccaagctcttgtcaacaatgaaactgatctttcctatcaaggccaaagagaagcaagggtttgcatattcaagttcttcatagatgcctgcctctataataggacattcacatctggcagagctcttatgggacacagagagagaacagaagagtctaaaaatccggccaacatctcagtgccagaatccaagttctgaacacaaggctgaatatgtatctggccagtaagaagacactcttcagaaaaaggctgaaaaaacagtcacactccaggtctaaatacaacctataacaaaacccaaatccacatgcaaacataccctccattgcaatgtggaaagagatttggttttaagaagaatttaaggaaattatcattttgctgcaagagaagaagaaaaagatgttgaggccgctactcttgctgtgaaggttacagctgctttgaatttgttagaggaaattaccctaatagaggaaagaggccaggcaaatggtctttagttttagaccactgattgttgtcgagaattattccaaaaacttaaattctattttaaatccttattgtgaaaagacagccatattttaatttttacttatagttaccatcttcatccttagtaatctatagcttgagcagccctaatccgaaaatctgaaatccgaaatgctctaagatccgagattgtttgagcaccgacatgacgccacaggtggggaattccacacctgacctcatgtctatgggttgcagtcaaaaacagtcaattaaaaatattgtataaaattaccctcaggctatgcatatgaggtgtatatgaaacataaatgaattttgtgtttagacttgggtcccatcccagagatatttgattatgtatatgcaagtatttcaaaatttgaaaaaatctgtaatctgaaacacttctggttccaggcatttcagaaaagagatacacaagttctgtactgagttattatggtttaccaaaatttggtatacataaagcaaaatatagcatgttccccaagctcttgcagaaaagtaggaatagatgaagttgagttgactactggatcttttaccagaacaaatggccttctatcaaaaaatgtttgcaaactcctgcgttagacagttctttggtgatccatcagtattgtctgaagctaagcattagtatttttcaaagttcgggaataatgtacttggatcataaggctcattccaacatgccacaggtgaagctcattcattatgcaatagtgaagcagataagaagtaatgggagacaatcttttgcctttcaaaatattataagctctggattttcataacagagttctggaacaggtaagtgatttgtcaagaaaggcttttgtaagccatgttgaaatggctgtgcagtaagtgaacagcctctatctttgcaagaaattaacagccacaccaacctcttgctctttaaagatattagagagaaagcctatcatcatctgatcttggaactgtttaatggattttctctctagtagttaaattgaaagaatgatgctcaggtctattgttttctcttgggaaaagccataccaccctggttggttctttcaaccctctcctgacccaaggatagagaacactacattccaagacatcatgagtgcccctcactctcatctttgggaaatgaggagcagcatccattcaaagtgcagtcaaaggtaaacctcactgccaagtttccctcaagctgagaaattggatgtatcagaaagggtggagtttcaggacttgctctaaaaataatgtgtctggatctcggccaccatcttaatgctcttcctctctaggccctctccccataaatgtcaaatgtggctgtcagtaggttgagcctgaaaataaaatcccctcacttccatcaagaaatagctccaaacttagagtgtgtgctcaaaatattcatgatgaaatcataatcctatatttatagtcttttggattgtgcatgaaattctgtttcccatggtggttttcgttgaagtgggcacagagtgaccaagaaagcattagctgcagggaaatgctgttccgtatcattctgaactggttggttgtgagacaccctccctcttccctgtgccctacccgctgcctgatgagttgggtctaccacccaccccattcccagcaggtcccctctttgattggtcctgtcttgtcctccaagaagagctggccttccgagaaggaagtggggtgggtacctaagattattcccctttcctctgcatctttcctgtcctagacttcctccccgttctcactgagggagatggtgtggaccttaatggttggaacttgatggttcttgtcaaggctgggggttgagggccctacacagcagcagacctgcaaaaagcttttacttctcacccgggctgtggtacaggaggattggtctttggacactgtaatcctggcagatccacggggcatggaagagaaaaatttccattcacaaacgccatccgtcttggagatcctgtagaaggtctctcttgatcccacggggatgcgcaccatgtccttgtgttgcccttccacggcctggctgggcgggtgcagggtgtagcccagggcatgtttggaagactgctttctgcagagacactggattctcaagacattctgaaaggcctttttgaactcttggctggagcatgggtatatgatggggttgatgcagctgtttagatatccgagccaaaatactattttaaaaactgtttcagagggcttgaaatcagggaagaaagaccctggaagaaaacacacagatttatacatattatttgaaagccagcaagccaattggctaggaaaacaatcaaacagacatctttctgtatttttaaacggttaaaatgatcccaaacacatatgagtttctcacatttgactgactagctcctatgactgtcacccttttgcaatatcttcaaagaccattcctacttggtccgcgtgtgtcattaattacaggagcaggcccagtgggtagggttgcactggctctcagtgaccaacagctgctgtgaagttttaccaaatgaaaatgtgaaactcagactgagtccacatatgtaaattgttttgcctaaattgaaaagtaagttggaatccatgcaagtaatccatattaaaattcggttatctgaacatgccctttattctctgatgcagtgttatgcaacagacacagcctcagtgtttatgaattcctcccctcccaaatgttagaattatggattttgatgagaatctcaactttacacaatattggccttgccaaagttgggccagtgattctcaatcacttttcctagatgatgtcttttgatgtcaccgttagctccctttgtcaatatccctcgatgtctcccaaatgtgtgtctttgcttcacattcggagtcctccacagcctctggtctaaccagctttctaatatgactagttgctattttttctctagccagactcactacactttttctccaggtcattgatcattttttttgtcctctcaagttgggccactgtgtccttgatgcccttttccaccttctctacctacccaaaccctacccgttgatgtgcacggcaggaaccaggcctcaggacccgtcacatcctgcgcagagactgccacagggcatttcgcagcagaagaacaaaactgtgaagtcttaaaatggaacaaccttaaggattatctcctccaattactcaatttacaaatttaaaaaatgcttatttagccttttcccagctgccgccaagatgctctgcccttctgagctgaggctgcgttggggtcaggccctcactgcatccagcactagcactactccgggcagcccagccttgcacttgtccacaccacggactccatctcagagctcgcctgcactgactcagccctcattctgtataacgctgaggggatcatcacataggataaggtcaatgtcgtttctaaagcagctggggtaaatgatgacggcttttggcctggcttgtctgccaaggccctggccatcgtcaacttcgggagcctcctctgcagtggaggggcggggtgggaagacctgctcagcagctggtggtgtacctgcgggaggtcctgcccttctgtcactgtggcctaggccgagaagaagaaggtggaagcaaagaaagaagaatctggagtctgatgataatatgggctttttttttttttttttgagtaaacctattttataacacgttcaataaaaagctgaactcttaaaaatgcttattaaagagattgtcacaaacctcatagctacaatactgataagagtgatggataaagggtatgggactcccaatccaatgttctttattctctgattctcagacttccaagggcttttgctaaaggagctttatgaattatgaaatcccaaacgtccctcttcactcctttcagagaaattgcaaaataacatcttgactttccttccacctcctttcttttctttcttggctcccaagctccttttccttctccgcgggcttttagtcacagcttcgtgtacagttggtagaatggctttgggaaactcctatgatgcctttgggcctccagttttcttatctgaaaaaggagtatgttgaatggatgattcctaatggccctgaacaatttttttgttgctgttgtttcaaacctaaggtcttgattttatgtctttcttttcctctctgctctgtggacctatcagagccgtgacaaattgctggtgctattaaaatccactctggcaaacagtgctctgaaattaagtcaaaaagctcatcaatataaacaaagagtaaacttaaatactgaagaacccaaagaagacacaatagtgtggttgttgatgggagcatttattacctctgaagcacactccctgctaagttccatgtgtctcaaattcacacacacacacacacacacacaatgggtgtttatttggaaaacatgtaaagtgagaaagttttattctttagctctaaagcttttcatgttgtcctataattataataaagtttacagtctttgaatgcctgatttgaaacaggcaaggcactgtgctgaacactttccatatgatttaatcatcgttagtaacatgaagagttatgtgactcttccctattttacaaatgaagaaactgtggcttaatgagtttgagtagctcaaccgaggtcactcacatagttactggtaggtttgaaattaggcagtgtgattgatttcagggcccatgctcctttgtggaatctccaaatatactgcaataatacatctcttaggaggatagctgatggggagtgataaagtgtgcagctgggggaagctgaattggaaaaatgctttttcgaacctcatctgtgatggaaaaaatggctaatgccaacatgactgatggttttgtgcaaatgcggtcagttccagaaaaaaatttgtcttacattatgaaacctatatattgtccaatatttcctactaatagtgacagtgatgtgattaaggaaacccatttcacaaagacctgcctgggcctgtgcttaatgactacaagaatgtctgagctgagcacactgaaacccaccttgtctgggaatgtcactactctgtaaatcagcgagggaggggagggtcgtttccttatttgaagaatttcaatttttaaaaaagaaaaaaaaatatgcactatgaatgtgaatgctaataaatatggtttgagagtcttggaatttcccataattccttcaattacactcattctgcttacagaacccagttttgcactcgtaaatctcaacatttccttttagtcacttccttcccatcccttctttccttgcgtggccctgctcttaattccaggtatggctgacccagagccaagctcttgggccctctctctagtctcttgctgtgttccagtcttcacaggtgaatcctggcctccccctctctgtaccccactcaaaacactcatttcttcaacatggctcaggtataggtatagggtgagaaagagagttgattaaaactaatttacactaagatctgaatgtcagataatctctaggcctaaccccaggaatattttctttttaatccaagcaaatctctagattttggcttatgcttccagaccagagaccttcctgtaaatgacaatgtttggtttatcctattaagtgtgtgacagcagccagatgtgtgtaagcctagcacggatttgcatgctcccaaactgatagttccaccaggggcaggttgcaggatccattctcatgcttggagtattcttcccttgtgatggggaacaggtgctgggagccatgtgattttctttgagcagctgctgactggctggggttagatgagagactcatagctatgcttccttcaagaactttccaaagagtgagaaaagacagcaaaagggctaggcatggtggctcacgcctgtaatcactgcactttgggaggccaaggtgggcagatcacttgacaccaggagtttgagaccagcctgggcaacatggtgaaaccccatctttactaaaaatacaaaaattagctgggtgtggtggcatgtgcctgtagttccagttactcaggaggctgaggtaggaggattgcttgagcccgggaggtagaagttgtagtgagctaatgcgcaccactgcagtccagcatgggcaacgggagtgaacccctgtctaaaaaaaaaaaaaaaggacagcaaaagaactgctcctctccttattgacattattcccatccacgtatttcttcctttatttttcctctcctagaaaggagagatggggctggaattgggcttggaaagcagctgcatggccccaaaccctcctcctgctctctctttctctgcccaaaccttccccgtctggttctattttctctgaactctgcattagttctatcctcagcctccattcttcccaaatctctttcttcctgaggactggctatgtttttagggtgggaagacagctggagaatgcttgttcctggcctccagccatcaggacctagagggtcagggctgaaccagcctggttcaggggtgggtgcctctgacccagtcactctgtggggaagtccattcgagcagccatccggccggctttgctcactcacggagctccagaatccagtaaaatgctagagtcttgaaggcattctcctagtttttgctgcatgaatggccgaccttctgacagacggatggactgactgactgaatgaatgaatggctgtgtctctgtgttcttgccatggttcttcttcacagtgtggcttggttttcttttctgcgtgatggctgtagcctcatattatctcccaaccctgacttctttctgctgtctcattcttcttttttttgcccaccatttcagttcagtcatttggtttttttgtaatgttattttactaccattttttccttgctctatcatctggcatcagaccctctagtttttctcatgatgcttcataggaagagccagacttccaaatcacccacatgagaataggggctcctacttctttggtcaccgtagctatggttttctcctcaacaatctctgcttcaagaagagccaacagctcctgacttaatcccctgaacaccttgccctgcagctcaagccatcctttgcatgtgaatttgcctggtttaattcttgggctttggaaaatccccacagcctaaggattcttcctgtcactgagtttctttccaccatttggtctgctgcagaatttctgcctctttcctgaccctctggacaccctgaccaacttacgccggtcagactgaggtggatagaacaggagtttatggccaaacaccatcaacattctcattcatggagattcagaatcctcacttccactgtaaaggcctctagatgccaagaagaaattgaaacgaataatttaaaatgttgcctctatgtctttccactgaatgctatatccattgggaaaatctgacttcatttttgaactggggctcatctaataggcttatgagggggcactaggaggcatcccagtaaaggcttggcgactagagtcaccttttacagttataaaattacagcaacatttgcctcaatggctccaatacaagataaaaccattttttcctgcccatgctggtctcctccatgaatttgatacaccggtgagtgctatggttagcttcaaaagttggtgagagtaggaactgagttctcgaattcctatccagcactggtcattagggggttcctccttagttcaactgtttctctcagaatgagggtgacttgatatggaagctgaaagctgtgagtcagtcttcttggttccagcctccagcttctgcgcttcattttaccccctggaaaacttgacatcttaatgacaaccttgagagacactgggctatggtaaaccctacttagctggagttgcataaggctaaaatgtgaagactggcaggcacttagagatcagagctgtcaacctgtcctttatatgtgaagacagcaaggctgaagacgcgagtagttcccccaaatcacacagctggacccaaactcggctccacctcacccatttccactcctgatctttgtgtgccgtttagcaaccctacgatgacatggaagtgttaatggcagtatgtccagctttcactgaatgacaacaggttttgcagagataaggagaaagaagagaggggagtagtatcctcaataattgcattattttaaaagtcagagtgtgctgttcagaagggtttgtcagcagggccttacattctgagaaatgaagtttgaatgatctcaatttaaaaaaatgtggactccaaagaagaagctaatgttacatgaccatgggagaaaataatctttaattgtttctccttgttcagcgagtggtctctccgatgtgcctggtacacatccaatgagcagaggagagagacaggctgccacaccaacaggccaaggagctccagtgccagtaacattcaggccagacccaatggctccttcttaccaggaagaaaactgccccatcaaattaaaccccagagacaagctatagagtcaaagtttaagagcagaccagagtctaccagatgcctttgtgctgaactactttggcctgaaccctcctggggtttatgtggggccacttgggcagctctcagtcagcaagaagtttttagattatctaccttagatggtgaccagggctctctaagaaggtggtcagaataaccatggacagtaaccttaggcttgcaacctcaggttcacagacagacttcccatgactgacatgaaatgtgtatgtccagagatacattttcctgggaagagtccttagcttgtattagcttctcgcagtgctctctggtgatggtaaagatggttcagcctggatcccaggtagagaggacaagctgtaccctggctggggaacctcacttagcctgtatgtcctaatgatagaatctagcttaccaacagagcaagcagatgtgatttcggtgcctctttggaaggacttcgctagtctttttttcccctatttaactggggcctgaaattgtacagctctccattcatgtatctgagtaaagtcatgtgtatgctcacttgagagtgttggcatgtggagtcttttctgaactttctggcagaaaacttgagtggttggtaaagtgaggaaggtggcactgagcaggaatggaattagctctcctcttgcatggggcaaagcatgggagcatggcatgggagggtacagtgagtaaggggaaccgggcacactgtgctgggcacacatccccgaaggagacaggctcagggcaccctgggggcctgcccagtgtgggatggaagtgctgcccacttttccagggactgaggcacgttggtctatggttactgtgaaaaaccattgctccttccaatccaggcaaggaaagaggtcacttggggagatgtcctctcatccctcaaacttctgcaagtggcagctaaagttctcttgacaggatctgtctggctggccaaggagagctctgaggaatcaggaatttcatcctggatgagtctgagctgctggaattaaaacttgtcaaatggttcgtctcaccagttaacaaagcctaagaagcatttctccttttaggaaaaaggagcaggtccacccaaatgcatgatttggaccccaacgcccataagaacgctggaaagagtaataggggaccccacatgtagacatttctccctagaagacctccttgtgtccaataaataatttgatttgaaacactctcagaagatagcaagattctctaccccactccctttatttaaaagattatttgttcaggaaaaagctagcaataaggaagtcatcatgtgcttttatgggctgcttccttaaaagcagatctcctttcataagccagtgtattttccaagccttgtcaattttactaaggtcaccattgtttcatgagtcttccatttaaaacatttttataatataataaccaaaccaaatgtccaacaatgatagactggattgagaaaatgtggcacatatacactgtggaatactatgcagccataaaaaaggatgagttcatgtcctttgtagggacatggatgaagctggaaaccatcattctcagcaaactatcgcaaggacaaaaaaccaaacaccgcatgttctcactcataagtgggaattgaacaatgactatacttggacacaggaaggggaacatcacacactggggcctgttgtggggtggggggaggggggaaggatagcattaggagatatacctaatgtaaatgacgagttaatgggtgcagcacaccaacatggcacatgtatacatatgtaacaaacctgcatgttctgcacatgtaccctagaacttaaagtataataaaaaaaatatatatatatataaatttttttaattgtctctgcacaaaatctctccctgagaccacccagtctaaagaagagtaatcttcaaactcacacctgctgaatggcttatttatttcacggtacatatcacagtttttaagttttcttatttacttgttttctttgattgtctcatcctccagagcacagatgatatgctttccaatggtaggagaccaggttatctctctcactgtagtgcaagatgggagcaggaacccaattaacagttcctgccagaagaatatgtatctagttccttctcccttttttttgcctcttacattccaactggtcaccaaaccccacaggtgtctttccttgaaacaccttccaaattttccttctccatcacctccaaccccagcactgctgcatggtgaactggttgtttaaagctgggtgagtcattttttccttcttgggcctcagtttcctcatctgtaaaagtaaagacttagaacagtaattgatgctaccccttcctatctgtaagagcagatgcttctaggcaaatggaaacagtcaaaaggggaaaacagcccatgacaagcaggatgatgaaggaacgtggtggagagatggccagaagggaagagggcaggctttggaaggaagaggggaaactgaggttttggggaaggctttgggaggacaccctcatgtctatcctagaggtttactttgagatcacggaaaggaggggtgggaggagaattcaaaggctgctgtcatgcagtgcgtctgcataggggcccaggcaattctgattgcatgaagcgggaatggaattagctctattcctgcttggagcacagcacggtttgggctgctggtcgcgtcagaacttgtgagcttcttaataatacacgggccacacacctccacatctgaggcctgggaggctaaggctgtgctcatctggtcctttccaaggagataggatggaaagggaagaaaccatgggggaaaattcccagaaataactaaagggaggggaggcttatcaaggggctcagtattgtagctaagggaacctcataatggggtatctgccaagacatgtgttatgcattatctttttgttgctgataagatcaagtccaagctcctcactctgtcattcaaggcccctttattatttggttccaccagccctacacaaccttcttcattcctcattcacttaacacataatttacttagcacctgctcaggccaggcacttccatagatactggaggtagaatggtcaggaacatgcaaaggtgtttaccttctatgagtgtctccaacaaatgcctatgttggaggcatttgttgttccaacaaaggaattatgagtttccaacaccaaggctttcttcctgccgcagtagacttttcactctaactttgttagttcacgaggtgactgtgacctcagctcctgtggctgttttctgctgcactcttctgctcttcactcagtgacctctctcccctgtatctactcaaacttgaatttgtccaattctctctgtcttcaaggctgttttcaaaatcccactcatccacgagcccttctttgttacagtatagcttgctttcttgccatttcccctgtggatttagcaccagtttcttttctttatagcagggaaacccctgggccacagaccagtaccagtctgtggcctgttagaaaccaggctgtatggcaggaggtgtgtggtgggccagtgaagcttcatctgtatttaaaatttacagcctctctccattgctcacattacctgtcagatcagcagtggcattagattccaataggagcaccaaccctatcgtgaactgcacatgtcagggatctgggttctgtgctccttatgagaatctaatgcctgatgatctgttgctgtctccatcacccccagatgggactgcctagttgcaggaaaacaagctcagggctcccactgattctacattatggtgagttgtataattatttcattatatattacaatgtaataagaatagaaataaagtgcacaataaatgcaatgcgcttgaatcatcctgaaaccatcctcccatctccaggcccatgaaaaatttgtctgccatgaaaccagtcccttgtgccaaaaagattggggaacactgctctatagcccttatcaccattttctgtgctttacttatttctatttttggttgcttttcttgactataaactcccttgaaggaagagcttcctgtctttttaatttactgctgtatcctcaacactcataatggtgtacagcatttagtaggctcccaacaatattgctgaatgaatgacacattcaatcctcctggttttagtctccttaaagatacaccctccttcttatccttcattcgtgtctctctaagtgatcaacatgattctcaatgaatgcttttgagccaatagatgacattggttgatggaagaaaacaacattttgaacacagctcctgcttcaattactcacagctggagatagattctcaaatgcagaaacagagcctgtcttaactcacattccaaggagatctttcagatcttcaagacactcacatttatgtgaaaacaagaccattctccaagtagttttatacagctaagttgcaggcacttcataaaatgattacttccagtacttataaaaacattttatagggtcctggaagaagggttgaagcctataattcagatgtgatagtcatcatctcctctcatatttgtgggattcaagtccaaggccaaacaccacacatctgaagcagtgacacaaacaaccaaaactgatctcccaaggaggaagtgtgaggctttttcaggactgtgtcccttcatattcagcttaaaggctaaagcaggtttaggtcctgatccttgccagaaaggacacaggtgagttggctgatgcttgaatagtcacaggtgaacaggggagcaggaaaatgggtttttgcttccggactgctgcaaagatgcttaatctgagtgctctggacagttccgggtcctctcccaggccactggctcacccagaggcatggcccttgcatcttccaacagcatcttctagctttgtgcgaagcaggaatatgaataaacccttgctcttcactcccagctcctgtgcagctccctcccctgcctggattaagctagggatgaagattggctataggtctctgctctttctccccagccacttgggtaaacagtcctaggctccatctggactagaacacctgaccagggcctgacctctatcagtcatgggtcctgtattcaaatggacataatacatatatataggaattttaatagctcatttaaaacatgcaggatgtctttttggaagctataatatggcttctaagtatagctgggcagaccaaattttaacacgcagaaagggattggggcaatttcctctttaattttaaaaggcaatagagtatggtactgttttgattatagacatttttgaaaataggaattggccatgccttcctctttcatataaatgtcacatttagaaatctcagctttgcttgcaagagacatccttgctcttttcaaacttaatgaagccttctgcattctcatctgagaactggctggtactttcagggggaagatcaaggtcagggcagctcattcatttcatacctttagtttctttcttttccctatgacttgcaaatctctatgcctagaccatctctgccacctgagctccgtcctgcacacacaactattaccagacatccctcctgatgtttccaaactatctcatccttaacatcatcaaactgaattcaccatctctcacaaaaccgactcttgcttctctgcttcactttgggcagccttcctctcacttgtccaagccagaaacccactgtcatcctcaaccgtccactctccaacctcttccacaacatccaatcacccagccctgactacgaaacctgtattcacttgttattgtccattccagttctggccaccaccacgtctagctagaacctcatatcagttttctaactgggcttcctgcttctggtcttatctgcttccaacccatttctcacactcttgccagagagattctgagaaagcaaacatgacactatccctcccttgagtaagtcatttcaatgattctttactgaattaaagatgaagtatgagttatatatgaaaacttattaggcccgggagactgaaaattcacttggctggataagtaggtagtagagcatggtaatccaagtgcccacccagagactctagtcagtgtcatagaagagcagagaattacatcctccaggatgtgatcatttgcgtgactgttaactcagctgagcgatgtggcatcttttgttcactaggatgtaggttagggttatagtggttgagatatcagaatttaattttaagaaataaatatacgtctcctataaggcagtgtgtccactaaaaaactcttccgaaggccaaagaatattcagaatgagtttccaactgttccagagatagtggtgacaatgattcagaaagttttgtaaaacctggaagacccaagacaggcataaaaatacctgaaggatcaacatgggaagtggtaaaaataccatttgacatagcaatcccattactgggtatatatccaaaggaatataaatcattctatttcaaagatacatgcgtgtgtatgttcattgcagcactattcacaatgtcaaagacatggaatcaacccaaatgcccatcaatgatagactggataaagaaaatgtggtacatatataccattgaatactatgcagccataaaaaggaatgagatcatgtcctttgcagggacatggttggagttggaacctgttatcatcagcaaactaacgcaggaacagaaaaccagacaccacatgttctcacttataagtgggagctgaatgaacacagggacacaatggggggaacaacatacactggggcctgtttggggggtgtggtgaatgagagcatcaagaagaatagctaatggatgctgggctcaatacttaagtgatgggttgatctgtgcagcaaaccaccatggcacaagtttacctatgtaacaaatctgcacatcctgcaacatgtaccccggaacttaaaataaaagttgaagaaaaatagtcaaacaaagaaacaagtgcatttgaggctgtctcagaaggactaatccctggtacccgttgtgattttctgtgacctcacaccagccatgtttctaagaaaaagtcgtttcccgctgtcgggattcccctctgaaatgctcacccaatatctgctccaattaggtgattaattcagaacatatcagatcaccaccaataatagtttctggatgtgctgttagagaacaatagtgttggtcagcaatctcagcacagatgtactaattccccaggtgggtgtggaagcagtaaaacttttactcaactgtagttatcaatttctctctctctcactcacagaaaaatgttcatgagaagaaaagaaagctgacacagttcgtcaaaatgaaaataatgagactcactattgttgtttattcagatttgattttggagagttagaagagtttctatctcaagataggaattggtgttagcaagtgactgccttcagaatgtgttagaacctggggatctggcatgactctattttcctaagtttttcataaggcttatactatctaagaataactaaagaagaaggctgctagggagaccaaccaggaggctagcatattggtttggggtcagagctctaaccgatggctgaaagctataggaagactgatttgggctgccctggaacttggctttaccatcaatgatacatgaaaagtatctcagaataggcgggatacccactcactgaggccagagactggggagttaagtaccacacagcatcctattaaaatactctttaggggacatttaaatcctgaaattttacaacttattgagaaagcaaaaattattggtggagagaaagttgattgttttttgaatgttgaatgaatgaatgttgaatgaatgaaaaaattgaatgtcttgcttcccttttaatattgcaataaggtgtacattagaagcattttaaggggcatatatatataagaatatggatatattattggacatgacaacttatttagcatgatttatctgtttctgagaatgagactagtctatatgtatttcaataactcctaaattttctccatttagcattcattacacacattttgatctaatttgttgttgaagccatttataatcacctcatataaacacttaaggcaacaagagctgagctgacgtctggactacaaatacgcaaggatgtcaacattcagaaaagatcaggaacttgctcagggttacacagccagtgagcaaaacgactaggttaaaaactctgttcttcagatttccagtttagaaatctttcttttaattgacacattgatttttttttcaattgcaagagtagaaatatcctccaattatttgggggctctcagaaaccctactctaaaaaaacatgaatacattcaagctgagtatctgcagctagcattcagccatcaagcgagtggcttcagtccttgcttatttcagctcatgattcatacatgcctcttcatgtaaatgtctcacagaaacctcagggttaatgtgttcaaaatgacacatgctagtctgcttgattctggcatttcccatctttataaattatatttggtattcactcactgttaagaaaaagtgacaatcagtcctgatgtcttcttgacgtcttcagtagatcagaactcctagtattgccccagtctttccacgtctctccatctccattgtcaggccctactcagccacaacacctgtcacctgtaagtgccttcttgttgatctcctgcatgcctgggtcaccttcccttttccctaggatgacctttatggaatacaactctaattcggtgacatttccacttaaaggcctcaaacactttccagtactcttagatgaagcccaacgtccatagcatgggccatagggccatatgatctgctcttgccttccgctcctggcctgcctttcactctcttccctatcccctgctctggccaccctgacctcttttttatttttatttttaaattttttttttttgagataaggtctcactctctcacccaggctggagtgtagtggcgcagtcttggctcactgcaaccttcgcctcccaggctcaagcaattctcctgcctcagcctcccgagtagctgggattacaggtgcacgctactatagcccagttaatttttgtatttttagtagagacagggtttcaccatgttgaataataagactcattattgcaagagatgtactccattgagtacatctcctgacctcaaatgatccacgtgcctcagcctcagcctcccaaagtgctgggattacacaacctgatctcttgatctatggaatacttctctgcaccaggcccttcacttctgctcttctccttgcatggagtgtcctctcaacctctgtcccctccactcaccatttatatcttagcttaaatcacccttcctcaggggaaagatctttgatccccttccacccatccatatacctcagactccatgctgggttgggggggggggtctctcattaaatgttatcaaagcatcctaaactttttcttcatagctcaagcaattgttcttatttgattatgtgggtgatgatttgttcaacatatctccctatgtaaatttcataaagataggatttgtgcctggtacattgtagttgttaaataagtattcgttcatggataaaatatttatagagcactcattatgtggcagacatcatgcaaaatattacacaaacattatcccatttaattctcccaagaacatgatgtgactgtattaccaacctcatcttacagatgaggaaactgaggcttaaggagtttaatttgcaactaaggaaaatagctgagctcagattcaaattcaggcttcatgcccaaactcatgttttaaatttctagatgatgctatctgcgaatctgtcactgctttgctggctttatagtgaaaatagtgcacagagccatagtacttgaagttcaaaacaaagacaatcatcagaatagccaagaaaattaatcacacattccatgtcctattttttcagaaagcagagacatgtgtaattcaaattattaatacaaaaataaaattctcgaatgttaataattaggtttgttcagaatagacatgtttggacatggaaaaaaaacccacacatactatattctgtctgaaaagactttgacaaaatgcaactaataaagtacgcctaaaaaacaatcaggtaagattggtcagaaagtatgatctgttatgtatgacaaaatctgggtgaaagtgtaggaataaaaggagaactgtcatctgtagttcttggatatggagagaagggaaaagtgaaggagagatgataacagaaatagttaccatctcgtgtgctgcataaaaatatcaatgcctgacacagacttcttagttcttagtacttgttccccagggaggaaatcccgacagctcacttggtagttcagggatgagggcaagattgttcccttttctgtgcctcagtttcctggcacacgtaagttcagtgtctggctgtaagcatttgctcatttgctatcccagagctatgatcagtttccttcctctgcatgtagcagctctgcatctactttcagggtatcttctcagtcattagtgctatcttgtctatttttttttttttaacatttggggataatttccaaggtcagaaaccggacattgagtacatcttcctgcagagatgcccctggatgtgtggttctggtttacacaatggttacccagatgccacacctgtcagctgctctgagaatccccaagtatttcaagagaatttctcttattcagagtgctggggaaaagacatattcacagagaaatgtgctcacatttcttgcatagcctgttgtccaatattacctaattgtggctacagaaagataaggtataattttatttatttgggatttttttcaaggctaagttgaatctaatcaggtaaataataggtgtgtttctacaagttgtgctaagtctactctagagctgaggccatatgtttattacataggatttcttgctggaatttcttccatggatacctgggctttctatcacatctggcactttgtttcttctttttgtcacttttagagaaaaagcctcccagaaattagacataatttttgaaaaagagttagagaagtttttaagtttcatgatctcataacccatgtggagagttcttcctagcaccatgagggtgatgatggtggcactaataatagtaattataacagtagatgtaatttattagtaatttcaactgtccagcaatgtgctaagtacttttcatgcaccacctcatctcctcatatcaaccatgtaaggtaggcattgtttatccccattttacaaatgaggaaaatgagactcggggagtttaataatttgccaaaaaacaatcagccaataagagtgaagctgggttcaaacccatgcttgcctggctccagaccctgtcctgtacctgctaacaccgaatgcgctacaacccactgcctggtttctctactgctgtatagtgctgtgtgcttattgccaaattttcactggcaaaatcagatcctgatttagacaacaaaacaaagcaatttgaatcaattattaagaaattttatggttaaaaatatatatttttaaaattttactttaagttctgggatacatgtgcggaacgtgcacatttgttacacagacatacatgtgcaatggtggcctgctgcatgcaccaacacgtcatccaggttccaagccccacatgcattagacctatgtcttaatgcccccattccccttttccccccacccctgacaggcctccaggtgtgatgttcccctaaattgtttttaaaaagggtaaaattcatatggaaccacaaaagaccccaaatggccaaagcaatcctgagcaaaaagaacaaagctagaggcaacacactacatgccttcaaaatatgttgtgaagctacagtgatcaaaacagcatggtactgatgtaaaaatagacacatagaccaatggaatagaatagagaatccagaaatcaatccatgcatttgcagctaactgattttcaacaaagctgccaagaacatacagtggggcaaggatagtatttttgataaatggtgctgggaaaattggatatccatatgcagaagaatgaaacttctaaactcctatctctccccttatataaaaattcaccaaaacagtttcaaaacttaaatgtaagaccaaaaactataaatatactagaagaaaatataagggaaatgcttcaggacattggtctgggaaaaatttaataaacaagacctcaaaagcacaggaaacaaaagcaaaaatagacaaacgggattatatcaaactaaaaaccttctgcacagcaaaggaaacaagctatgcatctgacaacagattaatatccagaatataaacggaatttaaactattaaacagtgaaaaatgtgataatccaattaaaaagggaaaataatctgaacagatatttctcaaaagaagacatacaaatggctaaccaatatataaaaatatcacgaatcatcaggtatatgcaaatccaaaccacaatgagatatcttcttaccccagtaaaaatgtcttcatcaaaaagaaaaaacataacaaatgctggtgaggatgggaagaaaagggaactattatacactgttggtgggaatgtaaactagtacagccattgtaaagaacattatggtggttcctcaaaaaaccaaatacaagtagaactaccatgatccagcaatccagctactgggtatatagccaaaggaaaggaaatcagtacctttaagggatctctgcacttctgtgtttattgcaatgctattcacgatagccaatatatggaatcaacctaagtatttatcaaaagatgaatggataacagaaatgtggtatatatacacaatagaatactactcagccctaaaaaagaatgaaattctgtcatttgtggcaacatggatgagcctggaggacactgtgttaggtgaaataagccaggaacagaaagataaataccacatgttctcactcatatgcagaagctaaaaaagttggtctcgtagaagcagagattagaatagtggttactgaaggctgggaagaatcgtggggagggggatagggagagattgggtaaaggatacaaaattacagctagataggaggaataagttctagtgttctatagcactataagatgactatagttaaaaagttgtgatatattgttggatggctagaacagtttgaatgtttccaacacaaagaaatgatcttataaatgtttgaagtgatggatatgttaatcactctaatttgaccactatacattatatatatcaaaacatcactatgtgccccataaatataatatgtatggttattttgtgtcaattaaagaaataaaataaaaataaattgttaaaaacttcctaacatagaaattatagtgactttctctttggaataagtttgatctatattcaggcaccaaaacagtttgaagaaggtcatagcaaccatgtttaaaaattactgtgtcttttaagatacaaaattaatatatgctaaatttttacaatctgtggtatccacaattggtatgcctcccatgcacatataggtgcatgtgtacacacacatacacacactcacacacacacaatacaaaaatcaaccatgatgctacaatctagaaataagaccagattttaaacaactatgattgtatttagagcacatgctttttaccagcctttatgtaatatgtcatgaacattttgctattttatttttattatagaacacaatttttcatggcatcttagtatttcattgcatgaatataacaaaatttatctacttctgctaatttgaatattttggttatttccagtttcctctattataaataactatgaaataaatatttgtgtggatagatttggagtattttcttaagttacatttctagagaaagaattctgggtcatataatataaatttcataaggtttttgatccgtattgccaaattgctctctggagaggctatacctacttatacttatccagcagtgaaaagtaatgacagtatggcgatgatgatggcagtaaattatgagtgcccactgggtgctaaactcctagagcttcacatgcagcagctgatctaattttcccatgtgttcagtgaggttgggtgccacgaagcctgttttatataggcaggttttatctgcataggaactaagaaagacattcttgccaaagactacaagggtctgcctgacctggcctctgccatttggtaagaaaacatttaacagccatgccaaagtgctttttacttcttaaactgcccagattttcctaacaaagcttttgtattcattcatgttccctcttcttgagatgttcttcccttgggtttgcaggtctagacctttctcttttatgtctcagctcagaggctgttcagtgaggctgggtgccacaaagatgcattttctaaacatgtaatctaaaggatacttctgtccctacttcccaatatccctaacaccagcctccctatcacatcagcccactgtatttctttaatggctcttgtccttttctgaaacatttaaaaattgtctgtttcacttatgaaatgtaatttccctaaggacaaggagcactagaatggaggctggtaaacagtaggaatacaatacatgcttgctggctgatgaataaatgcccatatgaaaggaaagctacaaagcagccatcaggattggaacccaagtgcgcttttgaatcttgctttaatcattgcaatctacagaggatgtctcctatcccaccctcagcagcagtatgtatttatttgctctttgccaatttgataggtaaaatatgatatattttaatattttattagttatttgtatttctgcttttgttaattacctctgcccattttttccattagttagtcatcttttctcattttttgtatttatcaatatttgtattagacctctaaatatatccttgccaggtaagaaaacaggtagaaaagaagaatacatgattaatttgatagatgtagaaagacattaagtagaattcatcaccaattctggataaaatcattttaatgcatatagactggaaggacattctcttagtagcacaaagaagacctgtaagttccatcacaatatttcacaaagaactaccaaaaacatagacatttaactcagtactttctcactcatgctttgccttaggttctttatgtagtaaatgtttactttgtaagcatcaaatgaattaatgtagacaggaatatatagatcagtgtctggcacatagtaaggtcatatacgttggtgattattgttattaccactatataacataaacaagtaaaataatgagtttgtaaccattcattaattattgcttacatttttagtacatccatgctcaccctttcatgagtaaaattaagtatgaacatgttcaaatatgtgaattacaaaaataaatgtaaatggattaaagtgctgtgttaaaaaataaagcctctcacactgaattaagaaaaaaattgaatatatactgttatgaaagacacaaaagacatggttacaaaaataatatggtttggaaatatatactaagcctaggtaaaaaaaataaactgagacggtaatattagtattaaacaaagcagactccatgacataaagcatttcatggaatagacaggattattttaggttgataaaagtcatgcttaccaatagagccatatttattaaattttatgtaccaagagatagcaaatacataggtatatgtatgtatatttttaaaatgcttaaaaattgataaaattttacttgaagtagatgactaagatacagacaacaaaatatgtatcaagttttcagtttaagagtaaatcaatgacaacttagaaaatactgaaaatgagagcttcatgcaagaagccaaagttattctcctctgtgaagtcttagatggttatatttaaacaagaaagacacaaatagcttaatttgggcattagagtaaataagttggaaaagaactacaaattaaaacaaaggaagcaaaaattaatgaattaaaaagcagaaaatcattagaattaattagtacatttaagctgattcattgaaaagactttaaactggacatgcctctgacaagcctgactagaaagtaagaggaagagtataattgtccatcagtaataagaaataatatattttcagatgctgaaaaaagtgaaagcaatttcaagtaaaaaaccgtatgcagataacatgaagaattttgataaatttgaagatatttgtctaattttattcaaggagaaataatatatgaaaactataatgattatagaagacacaaaaattgacaaaatttatccttagaaactgttggatccaaataatttatattcatgctatataagtattttcagagtctttaagtatgtaaaaatgcttcctaattcactttcaaagctagcataatcttgatctcaaaactgagaaatagagccaaatcaaaagaaaacaaataaaaagtaaatatgaacaacccactgtcaccacaaaacaaacaatcccacagacttgtatcatttagaaatgaagttgaaatacaatgaaagttgtcgattatatctaccagtctattaagtaaaaacaaaccatgatcaagtagggcaggaagtggcaaactttttaagttttattattaaaaacattagggaataatggaataattaacaggaagggaacactttcatttcaaggattgaagttgttacctgaggtggctctttttgtattcagtgatacaccattagattctgcatcattttcatgcaactttatctgtctcttcattgttgtcagaataaattaagagaaaaagtgaaatttaggaggaaagaagcctgctatctctggtaatagatagtctgtgtggttcttctggcctcagaattgtggttcatgaatcttgcatgaattttgggatacagggccagatagtaaatattttaggccttgctagctgtatggtctctgtttctattattcagttctgccactgtagcttgaatgcaaccatagtcattaggtaaatgaatgtgtgtgactgtgttttaacaaaactttatttgtgaacactaaaatttgaatttcatataattttcctgtgtcacaaaataaattctttgtttgattgttaaaaattatttaaaaatgaaaaaattgtatttaattcatgtggccataccaaaaaaaaggaggcaggttggatttgacctatgagctctagttagctaacatctaaggtaggatttatccctcactttaaagggaattaagaacaaaagtgtttcttctgccctttgattattaagaatattattatgaacaagaaagagatgtctaaaattacaattaatgaacaatgttctagaagattaagtcaatttaatgagagaagaaaagaaagcagatataaataatggaaaaggcaacttattaagatgtgtatcctgtgtactataataatttgttacctggaaaacaaacgttgtattttttaaaaaatcttttttcctaactttgaattctaaaaaaactaagaaacaatgatcagggcagttgcaatgaatattccattagattgtgtccttcaaacaccatctcctactaaaaaggaccaagacttcctggagaaatggctgattccaggtctggccaggaaacatacaagaacagacttattgctactggtcaggtggccacaagagactgcagtatcgtgtcaaaagagctaaggaactaacttaaatgaacaaccattggccaatgatgagacaatgtgagactcgataagcattcacaaaggattaaaaatcgctgcaaggattaataatgagtttcaattagtaaaatctcgatgctgggggaaaataaacctttatttattacctttgaaggaaactaataactgccttattattttgaaaactgataagtaaagaaccaggcgtttatcccacctttcttgtaaaatctacacctcagttaatcaaatggttgatgagcagaagttgctccatctatgtgttttcaaactaataaatgaaagtggaatgatagaatatcgccactttgcaaccctaaaaataaaacaaattaataaatttaggcaattactataattagcaatattttgaaaaaaacaataaaacattttttacctcctgatggaagtatataccatctaagcattagttttaccacaaacaaacagacaaagtgatacatccttctaagtctaatagccaacttgcaggaaccataaggaggagaatatattaaatgacaccactgtgatgaagtcagcaaaattcaggctacggaaaattgtttattcaaaggaaaattaaatagaaattccaagaaaaagaaagcgtaagggagaacttgtacaggaaataaacttagacttataaaccattcatactatatggacctgatttggatctcaattcaaataaaaaagttctaaaagtgtcctaagaaaattgaagatatatgataatataaaattattgtcagcttttgtttagatataatagtattattgttatacatttcaaaaaaagagtaatgtttagaagtaaatagtaaaatatttacagatgaaatgacatgctctctagaatttgcttccaaagaacctgagtggagtgagaaatctgaataaaataaaactgcctatgaattagtttacaattattaaaattgggttataggtacatcagcttcattacatgattgtctctacttttgtatgcatttgataatatccataataaatacttaaaatattaaaaaagaataaaagcacataactaaaaaataactcactgattacctacaacatttcgctaccttcatctgcatttccaagtttttttaaatagctttcataaataagtttgctttttaattcatcctgcttgaaagccaaatgcattcagggctgtgaaggacacaaagaggtgggattttgttcccagcctcctggattcattatgaatgaacaaagactggtagaaatcctatggtaattcacagcctacagtaccgtgaagacaaggaggaaagattcgaggacaaatgtatcctacacgtggccgcagagaacagacaccatggggacatatgagacagtggagtggagggtattttaaatgaaggggaatgatgctaaaggagggtcagtgtaaaagtggatagagagatgattaatttcgaaaggggggtacaagatgaagggacacccctgaaatcgggcacaggcacatagatttgataccatgattatcaggcagcctctgtaatgtgtgaccacaggaagcttttgcatatggctttgttttaaaggcagatatgttcaggacatattggagaggtttattccctcactgcgcaaatttttatagagatgagactggaattgagagtgaaatgaagggagtcgtattagagcatgagttctctcagcgttctcctccaaagggtctgcaaggtgaacaatatgttcacaacgatactaaggcagtatttgcctttgccactatcattctgttgtgagagtggagtgaaatgtttcagagatgaaatgatgtgtgttattgtaacagattaaatgaagagcagatatgaggatttagctatcatttatagcctgacatcaaagacacttgcaaaaatgtagaacaatattaccccctcactgttttaaatttggaaaatccagtttgttttaacaaaagtatgttatttatgttaatatgtaatgggtttattatttttattttattttattttatttatatttaaaacagcgtctcgctctgtcgcccaggctggaatgcagtggtgcgatcacagttcacggtagccttcaactcctgggcttaagcaatccccctgacttagcctcctgaatagctgggactataggcatgagccaccatgcctggctaattttttgattttttttgtgaagatggggtctcattatgttgcctaggctgggcacaaactcctgaactcaagtgatcctccagcgttggcgtcccaaagtgctgagattacaggtgtgagccatcatgcctgacctattattgttattttaaagaaattaatatattttttaaatttctcagttttaattttgaatattgtaaatatcaacagagtctacatacacaaaaactctttaatgtcctatataattttaagagtgtagaggggtcttaagaccaacaggtctgggaattcctacatttgagtgtttattgaggctatggagaagggggattcaagaggaattgcaaaggaaaagtgatcatgacatggtgtttacgtcagtacataattgttaagtgctcataaagtccaaggtcttaaacatgaagtagaaggacacaaggtgtcttcaggtggtcaaggtggaggtctgtttgattcagatacaaattctcatctgcatcgacagtaagttagtcttttttttttgggatggaatctcacttgtcacccaggctggagttcagtggcaccatctctgctcactgcaacctccgcctcccaggctcaagtgattctcctgcctcagcctcctgagtagctgggattacaggtgcttgccaccacacctatctactttttgtatttttagtagagacagggttttgccatgttggcaaggctggtcttgaactcctgacctcaagtgatcctcccacctcagcctgccaaagtgctgggattacaagtgtgagccactgtacctggctagtcttgaataacttctagtgatgttccaagtgatttgctctttcagagaattagatgggcgagattctaaatctcactcagaaaagcatggcttttttaacccataaagaaaaaatgctttctcaaaaggactcaatatgttaagcagatccgaatatacttatccctttgcttacacaagtcataaactgtgtcagctctcacctacctcctgcttattctcatttacttttgttcaaaggacatttttttattcctaaattatttccccagacagagatgataattcagtatcttgatgttcatttaatgcatgtgcatgggaagccaagtcatttgactatcaggagtctagtgaaaaatagaactagaatggtatctgcctgtgaaaaagacacaaagtttagagaatatactaaagtttacaaaaagaggattttgggggttatgtaggttaccattattaaatacccaaataagattatttctataagaaacactttaaaacaccactcacctaccaccatccccatgacaaaattaaacactctccttgtgctcccacgagtactaccattttcctctatagtattaccaacatctctgatgtatgacagtttgttacatttctttcttttttctctctctgcccagggatatcttgcagagcaggtattttgctttattcccatttgatttccaacaatcccttacatggtacattctatctagcaagtttcaataatggatgttgaatttaatgaactaaaaaagccccggatgttgtcaagattgcatttgtttatttaatgtatatagttgttcaaaagttcattaatggggtccagttatgacacagtaatgggtatgatatactcttctgctgtaaaaaaaaagatgtaattgattacaatatatgaagtccttgtttttaagcatttaggattttgatcctctggagaagtaaacacatgagatgagctcaatgttactctttctccttcagggcattttctaaattgtggcacagagaagttgtgccctaatgaaactgatctctgggtggagaaaacagaggttgtcacccagggaaactgagatgggtgaaatttgcaaggcaaggtgccacagaggagagagctgtgcagtgacttccagtgaatctgtgtgctggttctcagttaaactacagccaaatatttgaatctgtggtcaaatatacccagtgccagcacagggtaattgcctacaagaataccagtaggtgggttcatttgattctttgaggcatggccttaagctttgccattacttttaaggctagagcaatgctgatctaagatatacttttctggggtctcagctgatcccagattatggaacaagctctctactgtagcttgtttcaccttcaatgtgtcatgtatgacatctggagtctctgttgagtttgcagctctctgggacaataagtgaatattttagactgtatgccagtaaattaaacaaactaaatgaattgaacaaatttcttgaggtacacaaattttcaaaagtgatttaagaagaaagaacatttgaataaatcaatttacatggaaatgcacgtaatctagaattgccaattcaatgtgaaaaaaataaagttggaggagttatgttacttgacttcatgatgtattaaaaagattatcatctgctgggcttggtagctcatgcctgtaatcccagcactgtgggaggctgaggattgtggatcacttgaggtcaggagtttgagaccagcctgatcatcattgtgaaaccctgtctctactaaaaatacaaaacttagccaggcatgttggcgcatgcctgtaattccagctacttgggaggctgaggcaagagaattgcttgaacctaggaggcagaggttgcagtgagctgagatcgtgccactgcaccctagcctgggttacagagtgagactcggtctcaaaaaaaaagagaaaaaatgatcatcatcaaaacaatattacattagcattaaagacagactaatagatgaatagaagagaacagaaactctaggaacaggccaagatgtgaaaaatgatttttcaaaaacagtataaaaataattcaatggaggaaggtagctcaatgggggaaagtcttttcaacaaatggtgtaagagtaattgaatacctatatgccaaaatgaccatccttgaacctagaagaaatggacatattcccagacacatacaacctaccaagactgaatcaataagcaatcaaaaatctgaatagaccaataacaagtaataatatcaaagccataataaaaagtttcctagcaaagaaaatcctggaacccaatcaatggttttattgctgaattctaccaaatattcaaagaagaactaatacgaatcctactcaaactatttcaaaaaatagaagaagagggaatgcttccaaatactcattgtatggggccagtattaccttgctaccaaaacacatgaaaaatcatcaaaaagagacataaaaaaccccaaaacaaaattacaggataatatctctgatgaccattgatgcaaaaaccctcagcaaaacacttgtagtccaaattcaacaacatattaaaaagattattcatcatgaccaactgagattcattctagggatgcaaggatggttcaacatattcatatcaatcagtgtgatacagcatatcaatagaatgaaggacaaaaactgtatgattatttcaattgttgctgaaaaagcatttgataaaattcaacatcgcttcatgataaaaagcctcaaaaaattgggtatagaaagaacatattccaacacaataaaagccatatatgacagacccacagctagtattaaactgaattggaaaaagtgaaagcctttcctctaagttctagaacaagacaagcatgttcactttcactgccgttatttaacatggtactgggagtcctaactagatcaatcagacaagagaaagaaagtaaaggcatccaaattggaaaggaagaagtcaaattatccttgtttgcagatgatataatcttatgtttgaaaaaaatctaaagaccacactgaaaagctattagtactgatttaaaaattcagtaaaattgcaggatacaaaaatcagcagcatttctatatgccaacagcaaacagtttgaaaaagatatttaaaaagtaattctatttacaatagctacaaataaaataaaatacctaggaataaacttaaccaaagaagtgaaagatttctacaatgaaaactgtagaatactgacgaaagaaattgaagaagacacacaaaaagtggagatattctatgttcatggattggaagaatcaatactattaaaatgttcataaacacaaagcaatctacagattcagtgcaatccctatcgaaataccaatgaaataaaataaataaaatttatatggaaccacaaaaaaccagaatagccaaaggtatccagagcaaaaagatcaaaactggaggaatcacactacctgacttcaaattatactatagagctatggtaaccataacaacatggtaccggcataaaaacagacatacagacaaacaaaactgaatgaagaacccagaaataaattcatacatctacagtgaactcatttttgacaaaggtgccacgaatatacactggggaacgaacactctcgtcagtgaatggtgctggggaaaccagatatccatatgcagaagaattaaaccagacccttatctcttgcaatatacaaaaatcaaatgaaagttgattaaagactatgaaactactaaaacaaaacatcagagaaactctccaggacgttgggctggcatacatttattgagtaatatcccaaagcacaggcaaccaaagcaaaaaaaacggacaaatgggatcacatcaagttaacaagcttttgcacagcaaaggaaacaatctacaaagtgaagacacaatccacagaatgtgagaaaatctttgcaaactatccatctaaaaagaaactaataaccgaaatttataaggagctcaaacaactcaataagaaaacatacaataatctgattaaaaatgggtgaaagatatgaatagacatttctcagaagaagacatacaaatggcaaacaggcatatgaaaatgtgcttaacattatttatcatcagagaaatgcaaatcaaaactacaatgagttatctcaccccagtaaaaatggcttttattcaaaagacaggcaatgacaaatgctggtgaggatgtggagaaaagagaactctcatacaccgttggtgggagtgtgaattactacagccactatggagaacagaatgggggctcctcaaaaagctaaaaatagagctaccatatgatccagcgatcctactgctaggtatatacctaaaataaaggaaatcaatatattgaggagacatctgcattcccatgtttttggcaacactattcacaatagccaagatttgaaagcaatctaagtatccatcaacagctcaatgaataatacaaatgtggtacatatacacaatggaatactattcagccataagaaagaatgaggttctgtcgtttgcaacaacatggatggaactggaggacattttgttaagtgaaataagccaggcaaggaaagacaaacttctcatgttgtcatctattttggggagctcaaaattaaaacaatctgactcatggagacagagagtagaatgatggttagcagtgactgggaagcgtagtgggagggtgaagatgggaaatggggatggttaatctaaaaatatagttagatatgaagaatgatatctagtatttgatagcataacagagtgactacagtcagcaataatttgttttatattgtagaataactgagggagtacaattggaatgtttgtaaaacaagaaatgatgaatgctagaggtgatgaaaacctcatttattctgatacgattattacacagtatatgactgtatcaaaatatgtcatgtactccataaatgtatcctactatgtatccataaaaattaaaaatgaaaaaagatgactcttgaactatacttatactgtgcacaaaaattaatttgtatggagtctgaacataaacataaaagctaaacctataaagctttaagaagaaaacatcgaaaaatacctttgtgatcctagagtagtgaaatatttcctggataagacttggaaagtgataaatgtaaaagtagataaataagcttgatcaaaatgcaaacttctgctcatcaaaagatggcattaacaaaatagacaaaacacagcctacgagacaatacagacaatataaatttctaacaaagtacttgtatccagaatatatgcagaaatgctacaactcaataattttaaaagtccagttaaaaacagatgaaagactagaatagacacttgacataggaagatatacaaatagctgatgagcacaggaaaagatgctcagcatcgccagtcatcagggacatgcaaatgaaaagcgtaatgagatactaccacatacctactacaatcactctgcaaaagaatattttggaagtttccttttttttttttttttttttttgagatgatttcactctgttgcttaggctggagtgcagtggcaagatcatagctcactgcaaccttgaattcctgggctcaagagatccttccaccacagcatcccaagtagctgaggccgcaggtgtgtgccaccacacttggttaatttttaaattttttttagagtcggggtcttgctatgttgtccaggctggtctcaaactcaagggtcaagtgatcctcctgccttggccccccaaagtggtggggttatgggaataagccatgaatttcttgagaagttaaatgtgtatctgtcttaggacccattactctccttaatgcttacccaggagacatgaaaacacatccacatgcaggcttgtctatgagtgttcaaagaggctttatttggaatagccccaaagtggaaacagtccaaatttcatcgatatgtgaaagtataaaaaattatacctattactctagaataaaaaagaatagactattgatacatgtgacatgcatctcaaaatcattatcatgaatgaaagaaaagaggccaagaagattcatactgcatgattttcttcattgtaggagtctagaaattgcaagataatctacagtgatggtaaacagatcagtatttgcctggggacagaatccgtaactccatggattccatgggtgtcagagttgtgctctgacttatctgacatatatcactatttgatggacaaatgatcatataaagtgaaaaatcaacctctaaactaagagtttgggatctaactccagaataacaccagtaacctctgtgtgtctcattggaagaacatatgatgcttcgaggatggttatgtcagagagcaaatgagatggtgtgtgaaaaataatagtaattataagatctgatataaatttaatttattcttattgtttgttattaatagctagagataagcctgaaattataatttcatagctcatcagtgagggcaatgaaggatttgcatcaaaataagcttcggagtcagtctctctctctcacatgcatacacacatacacacatgctcgtatgcatgcacacacacaaacatacaccactcaggtttcatagacattatttctggagataaagagtatggctctgaattttgtttctaatgctgttggttgtttgcatgctaattctagactaggaatcaaatcctaaaacgtcagttatattgtgtcccactgtgacgaccaagaatggggctctcacctctgcctacctggctcttcacgtgaagtcgccttcctcatttgtccactctcaatttacacctattgcctcagtatggttattaattgtgctttcttacattttgagtgttatgagctagacagtaagttaacattgaattaatatttctggtttggatctacaaggtgggaattattcccactttaaagatgaagcaaatcacttgtctactacgctacaacattgtcttagagaagggagaccaagactctgggtaatacaagactgaatacttactgcgtgtccactctatgcccagtactttcgaaacgctttccatatattagctcatttaattttccaaaaatgctaggaggataccaagacattagtgttattacagattacgaaacaggcatgagaggctaagtaacttgcccaaggccatggaacaagtgagagatggaactggatttgaactctggtaccccagctccagagctggtgggtaataattacttgctatgaaaagtattacaaggctttcttttttgtgttgcttctacctggtacaagaatcttgatgagccaagagttactggaacttcagtaagctcattacttgaacacatttatttttaaccattttcccccccacatagatttggcattattaacagagccaaagccaagtgacgttggcccttgataaagacacagcttatcagagcctgtgcccccttccccctaggcatcttctatcactgttgcaggtgcaggccccctccacacccactctggaaagctgagggttgtggctggttctccttttctaggacattccctgaggccacttgtggcagccgccaatgtgcttgctcttcctattttatccttccaggcatgtggcagctttacctaatgaccgaactcccgaatgttcccattctgtcctgcctctcttttccccttactccaagaatgacccattatgggttattagcactgccctgtttttaactgggttgcaattcatgcagcctcctaactgcaaaatcacttccctacagccttccttcagacaaggtggaactggccccagaagctgggtgtttacaccaaagatttttttttttttttcgaaagctgccttctgttttgctcttcccttactgtataacagatagcagggtgcaaaaagccctttatcctgttaatagtggccttaggtaaggaaaaaaaaagagcatgattcaagttttctgtggcctctggctcagttgaaatggaatgtaagtgcaatgccagagcctggtaaaaatagaaactccagtgtccagactcctctccagatggtgtgggaatccagatagcaactcatcactaaggagggccaccattaattagtgggaagatgtcatgcctcacactggggagtaaatgaaatggcctatagcttagaatggaacctctctaatcgccagagagtccgaggtttctccctaagtctctttactctggcttaaccgagagttcggtcattacataaagctgccacatgcctggaaggaggaaataggaagagcacgtgcagtggctgctgctagaagtggcctcatggaacatcctagaaaaggagaaccagccacaccctcagcttcccagagtgggtggggagggggctggcatctgtgataatgagagaagatgcctagagggagctggacccaaactctgataagctgggtctttaccaagggccaaagtggcttggctttggctctgttaataatgtcaaacttatgtcgggggtaaagtgctataaaaataaacatgttcactgaacgagcttactaaaattccagtaactcttggcttatcaagtttcttgtatcaagtagaaacgacacaaaaagaagccttgtaatacttttcacagcaagtaactattacccttcataagaatcacaaatctaacccctttccattaagcatagcctcctaaaaggaattagctttgggccctgggcaagccactgagctctgctagtctccccttctttatcaatgtcatgagggtgatcatactgattttcagattttcacagggctgcttcttttgataattaaataataagaaggtacaagaatcaagaagggtgacaagcacatgggtggctaaaaatattaactgaagaaatcaaagcaatacaaatgtttggcaccactaagttagaaagagtgtatgagaactggagggaacccctctgctggtcaatttttattatttggagtaaatgtcatctctcagagaagctgttctcaaagatcatgttgcattgttaattttggtatctgtctctcttaatagacagtgaaccttcaaagtggggaggaccatagcatgttcaggtctcattatagcatgtagtgcataaaggtgcttggatgtttattgaataaaagaatgagtgaagatttggaataatggaaaacattgggaagggtgtttcttttggtgggaatgtagcatgatgcaaactaggaagttacttagaatgtccaggaaaagacaggagagggcagcgtgggtggaaaacaggaattgaggagtactgagcaagagacacaccaaagaggccaggacccatccaccttatctcctcacctataaattctgctcccctcctcctttgcaaggtccaagcctcacaatgtggctccctctctacaccatcacctcctgctcctctttggaaaaggaaccacagttcccaagctctttatactagacacagggcaatgcattctgcacttattttttctaagttcatactttgaataagtaatacatttacgtggctcaaaaatgagaacactgtaacaaattataccctaaggtgttatacccttgactttatttcccctatcccccttcaatccctagacataatccttttaattagtttcttttttattcttccagtgttttatgcaaatataagaagtatgtctatatattatttacttatgtttcctacacaaaagattgcatactacatatacttctacatattgctttttccacttaatacaacctggtcctcttttccctatcaatgtgtaaagatcttcatccttttttatagctgtgtagtattccattgtatgtatttagcatagtttattcaactaatcttctagtgctggatttttttcattatatacactgtggaaatgaataactaaaattttgaacagtttttttaacttagccttttacctgattgttgatgccttttcttctttggtgatcttggcaattcttaggactctatagatcacttctatgctgatgacaaagccccattgcggtgtgcatcccctttcctgcttctagctgccttcctgatctattacaatcaacagcaactctaaacttgacctcattttctcctcctttgcttaggaggttttcctagtgaaaagtatacactgagatgtcacattctctctcctactcactaagataagaaacttcagttgcctgtgatttcttctctgccttgaactctacatccattgggtgtaacaaacacattgttttcttgcataacattttggacatatgtcctttctttttattcttattgtcataaataactgatttttccacttttctcttacatgtcttctgcaataatctagacagctttggtaggaaacatctcacaacttgggtgggatcatttttctgccattagaggtatcccaatgcctaatgaagaaagtgtacattgctgtttgtaatgagaaacttgctttctctttattgatgagtgagctctttaggagtagacacctgccttatttactacaatacccttaccacctgccatgatgctgggcataaggtatgtgttcagtaaaaaattgttgaatttatctctgcaatacaatttcaacgggcatttccaatcttatctcccattattcccctaaacaaactttactgccaaagctaatttgaactattgtccagatatactatttaactttcatgacttggattatgccattctctctgcctagaatattcttcctctgtctctatgtgttactctgttcaggtactgaaaagccaacagtttccaaggcccagcacctctgagaagttctatctgattaccctgaaaccaccgaggcccaaaagaaagcaacttcctcagtagaggaaatggaaccagaaccctgatttctcagctctcatgagcctagaaagagtagagactctaagatccagaactgcacattctatttcccagtgagccatgacatcctgccttggaggccagaatgatacttgtcttacaactttattggataatagggaggatcccatggaatgatggaattagtaatcatttataaaagcacaaaatcttataaactgtagtgaagtatgtagtgcatttctattcaattaaataaacatgtattaaactcctacctctactatacactgagcaatgtgctacaaatggaatggtttcttcccacaaagcgctgagtaagagaaagctgtggccttattgaatctattgatttagcctcaataaatgcagaaggatgtcatctactcacacgaagataaaagggttacaatcatggacatggcttacctctctaaatagctcgctatataattttggcaaagttccttgaacaatttggtccttagacttcctagattgttcatggaactttcttcttagattattataccctgttctgtgtctcagtttgcaatttttatcccagcagaggaactctagttctaagagggagatctgcccttgaaaaccggctgcccttattacttcctgcctttcttttaactgagctccactggctcagacacataatttttgttaaccatgaatgctttaataaactcagaggtcgaatcaataaagccaagatttttgaccaattgtggtcaacacaagtaccaaagtaaatttttacaaaagggtcaccattcaatttctagtaatttagggcaaattccacgttgggttaatttcatgctgcatttctgaattcccaaagcagtttctacagaatgtcatcatgactatgggttttttcccttgatccgtcctaagacttggtgacaggcaacaagcctgaaacagccattctatttcactggggagagagattgcatgtgtacctggaatgaaaccatctgctagaatcttgcagcagtgtgataatggagaataaaatggagaattgttcaagggtcttagttgaaggtaacagtatttacgggatgacctaaaacaattcaaataagaaagccagctttaagtaacaatatcccactgctatgtcacactagtgaggcagctctggcatggtccagcttaaaatatggctagtgatttgattgtaaaatattagctagctcactggagagctggcacaggactttagaggagacctggactcattttttcaggtctcactcttcaacctcagcatgcccactcccatagaatcatatatgaccaacacatctttgttccttggatggcacgtttgcagttattcttaatgagcatgcttcctactcaactgacccgaaatagtttgtaagtaaaataaagagaattgccctaatttcaactatgattaatcaattagttgaaaaatcaattacctgacaaaaaaaaatccaagattcacttcgcatgactttttagtctttcatcatttcccacatttgtgctcctgtgttcaaccagctttggaagtaaattaatagaaaaagatgaaggaactgctttgaatccatacaagacatggtttatcaaacagttcactagcaaacatagatgaaccttgggtgcatttctttatcatcatttttgtgtgaggccctagggtgagaaatagaaatgaaggctggattctgtccatttgggtctcactgtctagctttctttcttttcttttttttttttgttgagacggagtctcgctctgtcgcacaggctggagtgcagtggcgcgatctcggctcgctgcaagctctgccttccaggctcacgccattctcctgcctcagcctcctgagtagctgggactacaggcgcctgccaccaccctcggagaattttttgtatttttagtggagacggggtttcaccgtgttagccaggatggtctcggtctcctgacctcgtgatccacccacctcggcctcccaaagtgctgggattacaggcgtgagccaccgcgtctggccctcactgtctagctttctaaagacaaactggtatttacaccaatctctccttgtcactgccactaaactccagtccactagagcccactcagaaaacctttctcaactgatgggagcataaagtttgagattttgcgatcactcttaaatttcttctatgttttagatggatataacttaagatttgtaaagttccaaatcttcagatatagaacatttccagcacctcagaaggctccctcatgctccctccctataaaggtaacaactattccaatctctgacactacagcttagttcgatctgcttttgaacttgacgtaaatgtcgtcacgtggaacgtactatttgtgcctgactttgtttactcagcattacctctgcgtgattcattcacattgttatatgcatcagtgctttgttcctttttatttatagtaggaatataacacaatttatttacctattccacaggtgatgggcactggaataggtaaatattacaaataaagcagccaaaaacattcttacaaatatctttgggctgatatgtcttttctaaagaaatcaaaatttctaatttaataaattatatgttttctagcttggaagacgaagacaatgagatctaatgaaatgagaggctgagaaaactggacctgattagatgcatccagacgtaatctgtgcaaaaaccatgttttttccttcttcgacattctcatgcctgcttcttcctcctcctctgctcccactcttagcagtggcaactcctggtgacctatttttcttctgaggcttttctcatactatctccatattctgtcaactcataaccactcagaaaatttaatatcgaataactgatactcaggttaaaataatggttacactactctcctgaataatcaaataactaataggtttaaataataatgacactactttcttaaggatatatgcttatttacaggaaacagggatctatctctgtggagaaattttagaagtcagtaaagttcaggagatagtttttgagtgggtaaaactgattttcagtaccagaaaatcataaatgagcatctttcttgtgaagccagttcttaatacatccaaaaaagggagttgcctttttatttttatttatttatttatttatttatttattttctttattattattatttttttgagatggggtctcactctgtcacccaggctggagtgcagtggcgcggtctcggctcactgcaagctccgcctcccgggttcacgccattctcctgcctcagcctcccgagtagctgggattacaggcgcccgccaccacgccaggctaatttttctgtatttttagtagagactggagtttcaccgtgttagccaggatggtctcgatctcctgaccttgtgatccgcccaccttggcctcccaaagtgctgggattacaggcttgagctaccacgcccggcctgcctttttataatacatttaattttttaaaaatgctgataaagacctctagtttgatatataattctcagagttgcgctatcgtctaactacaatttttcactcatacccttcctgtcaattgaaagctaagggacaggtaataaaagactacacttgcattaatagtaaaacatactagggaaaagtttttcagttacagtttcagaaagttgttcagttgctatgagagtggaaactaaatatttgcttccttctattacaaacacagcagaccaacctaacctaagtcaccaaaggagcagttaaaatcattttcagtgacatcgtggggctaggctttttaaagcaggattgagaagaaggcaaaacaactataaggtatccttttgttttttctttcttaacccactcatctaactttctgcctcattgagcttccttcttacaaataaatgaattaattaagaccctacttgcaagaaaacctgtggttaaaagggatcttaattcctcttgcatctatccatccatccatccatccatccatccatccatccatccatccacctattaatccagtcaaccatccctcaggtgcttggcctggatcccaggctggtgggttacactgtggacatccatcctatgcttgagtgtttccagtgatatggaattcatacaagccaagcagccagctcagttctgacaaggtaacaaagttgcctaattagaaagtaatcaatagctagttttgataaggtggcattttttctcattattttatttcccatttttttaagcttttttttccaaacactgggaaaataggatattaaaaacaaaaagcaatttcatatgtaaatgtctttttagactaggctcaaaaacctggacacagtgaaggatgatgttgacagctaacatttttctatctgacttggagcaggtgaaagatttctctacaagtgacatggacctgccaagccaaaccagtgatcctcaggtcaggccaagctttgtaacttggggcccacagatgtggtttgtttagctagcacaatatttttaaaataatgagttagttgccaagttttaaaattagactgtttcacataaaatttgagtctggctgatcctaacaaaaagagggtgcttatttatttttataaagtttttttcttagctttaaaggagtggttttagtgattactatctcctatggtgaaaaaaaaaaacatacttcctagaattaaatgattcctttctaaaatttttcatttatttatgtttctagagacagggtcttgctctgtcgcccaggctggagtgcagtgatatgatcatagattactccagcttgaaactcctgggtttaagcaatcttcccacctcagcctcctgagtagtagggactgcagaatagctgagacttcaggtgtgagccaccacacctgcctaattttaaaaagtatttgtagagatggggtcttgctatgttgcccaggctggtcttaaactcctggcctcaaggaatcctatcaccttggcctcccaaaggccaaggattacagctatgtgccactgtgcctggccaagtgattcctttcatttagctttaattttacttctgttaaataatttaaatttaacacttctttaaaataaagaaatatatatcatctgttttataattttctttctctccatctatttactcatccatctacccttccatctagagagatgtctagatttgtgttggccaaatgataatggtggttactttaggatggtggaattttagatgacctttaactttctattttgtattttgctgtgctgaatttttagtactcaacatatttcatttttatataacattagtccttgtcatttaagaagtcctttaaaattaaaatatgtctctcttcttttatctcttgaactgaacctttaatggatgtgattaagtgagatctaaattaatggtgaatgccctttttcaggtaacaagaaaaatgtgaaaatttgagcttccttattagacaggcttctcccctgatatcaatccttatgtatttaactcactgtagtaatttagaaaaacatgttttatttcttttattggtcaatataatttagacgcatgggccaaagtatcaaaaatttccactaccaaatcctcaccaagacttactgggttaaatcttgtggtaaactataataggataacagtcttaaatagatacttgaaatcacatgcagatttccttttctggaaatagggcattctagaatactgaaaactattttgccagagaacacctagacagagtggaaaaagttgataagctttcttttacatgcatggttaggtttgcaagatagtaaaatttttccaagggagcaaaaaattatccaaagcactaaaacaagaggtagcaaaaacctaagtattaatgtaacactgatttcaagctaccttatgggatttgttggtcttgacaatcaagtgatgtgggttgcataaaccacatcaggacagaagatgaggccttgggcttacataaaattggaaggaaaataaacagagatccctacatgcaagcttgaaccctcacagagctaggcctttagtgaaaggtagatgactaggaacctgatcagtctcagcctggatactgtttgtgggagagaaaggtctctgttgagtactgaacaagaataaaaataaagcataccaaaacttgtagaatgcagccaaagcaataattggaaatgtgcagcctcaaatatttctatcagagaagaagaaggctgaaaattaatgagcaaagtagctgtctgtgttccctataaaacaaagggtaaggcagtgagtgattaagtgctaatgcttctctggagaggttccagggcagaaggaatgagagaaaagggaaatgagacagggcaggatgagaagcaagggagggggcgtgtccaggtgctgctggttgctttatcatgagccttgaaaagtcgctggttccatggcagctgtacccatttggtcactctttgggatctccagaaaggcaagacacagaaacagtgcctcacagcagcatcccgaggagtcgtccctcttagtgtaggcctgagggcgtggggaggagcagccctacaggatagatgtaaaatcccacctggatctgtctttcctatatttcctttggaacaaaagccttaaattggtgtgggaaggacacaaaccctgtcaccttcaaggaattggagaaaatccactgaaactggggaagggcatgagaaaaaccgtattccatgaaggtgggataaacttgctgggttcagacctattgattgggatcaaagcaaatcactgagggactcctctcctgagacccaaggatgcagtgcctgccaaggacagagacttaaccagagcatcagagcccacccatgtgctgcccctggaaccagtgtagcatacattgagtaacaagtaacagtggtctatggctgggagaagggcaaaaacaacaagagaggtgctcatggtgtatgtgtgtgtgtgtgtgtgtgtgtgtgtgtgtgtgtgcatccacattgtgtgcacacgctcatgtgcacacgcctaacacactgaggcagcctgcatggcacccagaccagagcacctgtgcggtcacacaaacactcgagtggacactggctcactcacacctccatgtggcacctcagcgcccaccagctgctcagtaccttgtccacacacacttcttgtagcacaatgggaagacctaaagcggaatatggagaagaccctatgaaagcccctggcatgccagcccccatcctacaggagtttgaacctccctctcactctttgcaacaaactaactcaaacatgtcatagactcaaatgtaaaactccaaactgtaaaacatctagaagaaaatgtagtagaaaaatctttgtcatctggagttagtcaaggattctggggttaaagatttcttaactacaactccaaaagcatgacccataaaagaaagaagataaattgggcttcatcaaaatgaaaaactgttatttaagaagtctgtgctgagagaatgaaaggcaagccatatactaggataaaaatatttacaaaccatatatctgataaatgacttgtattcagaatatacaaaaccatcaaacgaagtaataagaaaacagacaattcaataaaaatagaattgaaataaatattgggacacatacttcaccaaaaagataagcaaatgtcaaataagcaaatgaaaagatgctcaacatcattagtctttaggaaaatgaaaactaaagcaacaatgagataccattttacatgtattaggatggctaaaaccaaaacgaaaacaagaacatcctgacaattttgtgtactggattgttcatatattgcttaaaagaatgcaaaatgatacaaccactttggaaaacagcttggtgatttcttataaagttaaacatacgagccgggcactgtggcccatacctgtaatcccagcactttgggaggacaaggcaggtggatcctttgagttcaggagtttgagaccaggctgggaaacatgaaaaatgctgcctctacaaaaaatacaaaaattagctgggcatggtggcagatgcctgtagacccaaccactagggaggctgacattggaggattgattgagcctgggaggttgaggctgcagtgagctgtgattttgtctctgtactccagcctgggtgacagagcgagaccttatctcaggtaaacaaaaacaaaaacaaaataggcttatcctaccacccagaaattcatttgctgatgttaacccaagttaaataaaaacttgttcatttaaaatctgtatgtgaatgtttacagtggctttagttacaagagccaaaatctggaatcaacacagacatacatccttcagctggggattgatgaatacactgtggtgtatccacatagtggaatgttactcagcaacaggaaggaacatcccaacatatggatgaatctcaaacacattacgctgagtaaaagatgcctgactccaaaggctacaaactgtatgactccatttatatgacatttttacaaagacaacactatagagaaagaaaactcagtggttgccaaggatgggggtggacagacggtttgactataaacagacatgagaaaatttctgtgggtaatagaacttttctgtcttttttatggtcatggcatgtgactgcagaaatttgactcacagaactggacactacaaagataaattttagtctatataaatgaaatcttaatattaaaaatgaaataatattaagtcaaaaagaattccatggtatgtcactatccaaagacaaccttattaacatttttttgtttgtaaaattttctgaaatcatttttaaaaaactgcacttgctgcttcctacacgtgaacaatagacccagaaaactttacagatgagttttaccaaacattcaaggaattgatggcttaactatctcaaagtataatacataggaaaaggggcaaaattttcctagttcgttttatatgactataaataaaaagaaccaaacagaaattctggagctgaataatacattaaaaaagaaccaaagagagattctggagctggataatacattaatacctctggaaatgaggtacagagcgtcaacagcagacttgatcaaggagaagaaagaatctgtgaataaaaaggccagtaatttgaagttatccagagaagaaaaagtaaaaaaattaaaataaaaaaagtgaagaaagactccaggatttatgaaatgttatcaggtaaaataatacatgcataatgaagaatttaagaggaaaagagagagagagagaaagcggcagaaagcttgtttcaagaaagaatggttgaaaactttccaaaacttagaaaggatgtggacatccagacttttgatgttcagacttccaccaaaagatcaactcaaagatgattacacagagacacattataatcaaattattaaaagtcaaagacaaagaggattccaaaagcagcaagagaaaagcaggaaaattccatgaggctatcagtggatttcacaggagaaaccttgctggccaggaggggagtgatatattaaaaatgctgaaagaaaaagactgccaacaaagctgtcctccagaattgaaggagagagaaagactttcccagagaaacaaaagctgtgggaattcttcaccatgaaactgccttataagaaatgataaagggagttattcaagttgaaataaagggatactaataagtaatttaaaatcatatgaaaatataaaactcacttttactctagtataaaagttaaaatacaaaagtattaaaatatagctacaataattaataaataaacaatacaaaaagatgtaaattgtgatatcaataaatcaaacgtgtgttgggggagagaaattagagggtaagtttttgtatgcaattgaatttaaattgctattagcttaaaatagattgttacaactataagatgtttgatgtaagcttcatggtaatcacaaagcaaaaacctttagtagatacacagaagataaagaaagaaatcaaagcatactactacaaaatatcataaagaaacattgtaatataggaaaaaaggaactacacaacagtcataaaaattaataaattggcaatagtaagtagctatctatcaataattactttaaatataaatggattaaattcttcaataaaaagacacagagcacctgaatgggtttaaaaaacaagatccaaaaacatgctgcctagaaaagactaactttagctttaaagacacatctgaaagggaagtgatggaaaaaagatattgcatgtaagtggtaaccaaaagagagcaggggtagctatacttacaccagacaaaatggacttgaagtaaaaatctgtcaccacagaaaaaaaggtcgttatataatgataaaggggtcaattaaccatgaagatataactgtaagtgcacccaacactacagcacccaaatatatgaagcaaatattaccaaaactgaaaagagaaatagagagcaatataataatagtagtgaacttcagtaccccactgtcaagaatggatagatcatacagatgaaaaatcaataaagaaataccagacttgaattatactacataccaaatgctaacagacgtacagaatatttcatccaacagcagcataatatatgtttttctcaattgtaggtggaacattctccaggatagatcatatactggaccacagacaagtcttaacacatttaagaaaattgaaatcatatcaagtcattttttgaccacaattattgtcaattattacctcaatagtgctggaaaaaaagtgtacatctaaatctcagccccagggatactttcttgactaaacatcattgatcaccacaggtttactttgtctctctttggctggatagtacagccattctcttctcagtgtagacttttcaccaccttccccatgacatagactgagcattttctggctctttgcaccttacactttctcaccttacaaatccatgtatttgtgggcacatgcaccatatgcccacatgcctatgccaatatgcgagcattgttagacagaatcggcttgatgacactgagattctgggaaaatgcagcttctataggtaatgagcatatatatctagtcacatttaaaaaaatagaatttattttgagttaattgtagattcatatatggttgtaagaaataatacagacagatttagtgtaacctttaccatatgcattaggccattttgttgttgttgttgttgttgttgagacagagtctcactctgtcgcccaggctggagagcagtggtgccatcttagctcactgcaacttccacctcctgggttcaagcgattctcctgcctcagcctcctagagtagctaggattacaggcaggtgccaccacacctggctaatttttgtatttttagtagagatggggttttgccatgttagccaggtggtctcaaactcctgacctcaggtgatccacccaccttggcctcgcaaagtgctgggattacaggcatgagccaccacgcctggccacattaggccattttagtgttgctatgaagaaatacccgaggctggatgagttataaagaaagaggtttaattggctcatgttgctgcaggctgtacaaacatggctctagcatttgcttctggtgagggcctcaggaagcatacagtcatggtggaaggctaagggagagcaggaaatatcacatggtgagagtgggagcaagacagagcaagggagtggggaggcctcagacttttaaacaagcagacctcgagtgaactgagaactcacttttcaccacggagatggtgttaagccattcatgaggaagccaactccctgatccaatcacctcccaccaggccccacctccaacattgggaatcacatttcaacacgagatttggagggggcaaacattcaaaccacattaccaggtttcatccaatggcaacatcttgcaaaactacggtacaatatcacaaccaggatattgacaacgatacagtcaagatacagaatagttccatcctggcaaggagctctcaaatagtccttttatagccatacccacttcccttctgccccaccccgatcttcactcctggaaatcactaatctgttctctatttctataattttgtcatttcaagaatgttatgtaaatagagtcatacagtatgcaatcattttgggattggctttttccacttagcattattctctggtacttcatctagagaatgttgcacatatcaatagcttgctattttttattgctaagtaggggtgtattaccatttgcttaacccttcattcactgatgaatatctggattgtttccagtttggggctattacaaataaagctgctgtaaaaactcctgtacaagttttttgtgtgaccataaattttcatctctctagaatatgtggccagaagaacaactactgggttgaatggtaattgcatgttcatatttttaagaatttgtgaaagtctttccaaagtatggtatcgtggttgagagagaaaactgtggagccaaaccaagagatatccaccacttttgagttgtatgtgtcttgatatgagagcaaatctctccaagactcagcttctttgtctataaagctatgcctacttcataaaatgttttgttaaattgtctgagggctaaaagggattatacaaacaagttcttagcatgcaactactcagaacttgaaatgtggccaggatcattgaggaagtgaagcttttcatttactcaattttaagtcacttaaattaaaatagccatacatggctagtggctactatatcagacagcacagatttacattcttacaaaatgaagattacaataatcctcacaaggttgatgcagaatgaagaaaaatgcaaaagaaaactgcatgaaagacattgtagtatacaacctaaggtgctatttatagacaataacttactcaaggatggtttagatacaggctgtattagtctgttctcacattgctacaaaggaatgcctgagactgggtaatttataaagaaaagaagtttaactggctcatggttctgcaggccatgcaggaagcatggtgacttccgcttctggggagatctcaggaaacttacaatcgtggtggaaggtgaaggggaaggaggcacatagctggagcagaagcaagaaagtggtgggaggaggtgccacacacttttaataaacaaatctcatgacagctcactatcatgatgacagcaccaagggaagatggtgtcaaactatgagaaaccaccctttgagtcagtcacctcccaccaggccccacttccagcattagggattacaatttgacatgagatttgggtggggacacagatccaaaccatatcacaggccaagaaagtttttctctcctttccaactgtgaactgtaattttttgttataggcattaacagaagaacaaacaccagcaagaaatgaacaaaaaatgggggagggcagtgtcatgaagcaaaatatgtggctagcctttctgcaaagtgtgctcttgtctgtgacacatgcttctttggccacatggtatagtgtctgccttccacactgtcacgtgctgggggctgggcatgggcggtgacttccatctgcttcctcatggagcacagcctcacagaattcatcatcaagataggtcatgaatgggaatgcacaccagtgtaatatctttgtccctggtgagccgtatctctgataccttctaaaatgttagctagagaaagcagaggtgtttcattgacaggtaattattgttctctcataaaaactgaattctatgaagaacaaaacctttcctccatcttggaagttgggacaaatgcactggttcggggagcgctgggctaaggatcaggctgcttgggctatcaacatatttgtgtcaccacctatctaagtggcaccaggaagcccaccttcctttttcctataagacagaggatcaggactagttggcctaggacccctaccaggaccatcatttcatcactcatacttgacacctcatattcttgcaacttcaagggcacaaccactctctgatgtgtgttataattatagttgtcaaggtgaagaacccgaggtaccataagactatggcttggtcaaaaccccacaatatagtaagacagcggcagaattggaaatgaaatcttcatactccaagcctttctttgggtctttgttccacgctatgttactctgggctcatttagaagaaagtattgccctgggctggaaaatggagtgcccaatgaatagagctgcttctttctcctccccctgcctcttcttgctcagcccccacacctgctgtactggccactgtctggatgtagtaggagagagaagaaaagcagaacaaaataggtagggggcaaggaaagagaaaggtattagaaaggtaatagaaaggatatataatatttttccatctgttcagaaagaaaggcacttagaacttcagaagagccagcatttttacagaatcacgaacagtttaagcaagcaaggacagagaagtgaagtgactcatcctgggtaacaggggtctatctagtaagcaaaaactaataaaggatggcaaagcataggaattaaggccaactagagtctccgtgtcagccctgttgcatgcccgccgggaagccacggtcaaggcagcctccttcaaacttcgttttttgcatctctgaaaggaggccatgataccaacattgtaaggttattgtgaggatcgaacaaggtaatgcctgtcacacagctgaccaaaatttaagagcttaatagaagagaaaattgatgagtttgggctagaacccagatattcctgttcaatcgagtgctcttcccagtagaacacgctgcccctcccccttcctccctttttgctcaatgccagcatgctcccttaagctctctaattagctaaataaagagtgcagacagggcctatgttaaaaaatgctttctgagccaagtgaaatccctagggaagtgaaaagaaaagaaaaaacacacacatggccaattaccatagcatcatttcatttcctcagagtgactaatacccagagacagtcacttaaacactaattgcaggagaacaggtagaaatcatgttaaatgagcccatctttattcctggaagaaaagacagcaagactctccaatgcatgagtatgtctgcctcttaatcatctgcagaaagagaaggcagcttccttctctgattgaacattggattttgatggcatcgtagttcttcttgaactagccggcagatctgcagtgtggaattgagttaccagtggagcaacatgccagcttccttctgacagcgtttggttgttcagaattcaagcatggcataaaacaatgcctgcatgctccagagagacccccagcccccacatgtcccaccctgagcttgctaggccttccagggcctcggtccccacatctgtgttgggagagaggagacagttccttctttagggaatgggggtcatagagatatcttcactctctagcttgttttcttctttctgattgtagctcagctccttttcttttcttctctcttcttcctgcctttaaccattcttccatgaaacactcaagtgggagagtttggttgtttgacaaaaaatggggagggtgggtagggaggaagatggagtttctttgttttctaattccgccctacttcgtttcctataaggggaccaggaacacttttcactggtcatcgtggggcttctcatcccctaaaggccatattaccccaacttctagttgtcagctatccttgtcaaaatttcctaattttgatacttatatcccacttattcactaatcccagatcaagcttcacttcctccaaaaagtctttttcaactatgtcagccttcacagagcaactgtcattctttaggaaaaatcaaaatttagcttgtaatgatatatgaattgcacatgcacgctaatttatactctccctcctgatttaacaatccttaaggaacagtctcccttgtatcctgcgggcattctggttcgatactaggcacagtgttgattgcctgtttgatacctgcttaaaacagaaaatcgacttccaagttctgcgcactggtgtttgcatgaggacatgagccccattccttgaattcctacaatgtcccaagtgctgagctgggcactggccatgccaaaaacacataaacacattctgtccagagagtgcttacctcttcttcctgagaagatggccagctcacttacacaatgagttcattttcgtcatggagatcatgaacagagggtgcattccagctgagctagtacttcctgcccctcaaagctcagctcaaagtgagtttccttctgtggccttcctcaggccatggaaccttaagtttcttcatttttttccctaagacaatgaaaagaagaatgctacagtaattaatgaaagtctcatgagtgatctcttgcatctatttccagtggatagttgggtgtttctgactggcaagcaattctcctgcagaccaaattcagggacccaggctccttccacttgtggctctgccacctgcaaaggccttggagtgacctgcatccagagggcaatggcagggtcacattatgacttttatggctccagtgactcttgccttcatgggctccttcttccatgcaaaaaattaaaaattatattttataactctattggtataaagatgactacattgtatataaatatatttttttggccaaaaagtctattttgttatcttgattttaaagaaatagaaacatttccatgaggccttaaaactcttgtggacctgtgctcatctttgtctgtgcttacctcccagtctgacccctgcggtgctcatcgaccctatgcccttggatccagcatgtgccaccttgctttgccttcttggcatgttcctgttagcctccccagacagacagcaagatcttgggtcttttgctagctccctagcacattacaccaagccttgcctagggcgagggtctcccagtctgattcctgaatttgaccagtaggagagctatctgccaaccagaaacaccgagttcccaactggaaatagattcaagagataatctcataagacctcagtcaattactatagcattcttcatttcactatcttaggaaaaatgaaaaaacttacagttacacagtctgagggaggacacagctatgtatgattgtgcccgttctgcaaatcactaaccctcagtttcctcatctgtaaaatggagggcaagaactgaatctccctcatggtactgcgtgaagaagaaaatagatgattcatgcaatgtgcttaaaatagtatctggcatgttgtaagcactaaataaaggttaacctttttattattatgacaatacaacaatgattcatatttatgaaatacttgcgtttttctaaaaactgccacaagatgataacatagctataatcataatgtctcattgcagccaaaacttgtttatgggaaatgttgaggttgaatggaaatgttaaagacagatgtggatttaaatctcagctttgccacttgccagcttagtgacatgtgatacttacttaatttctctgagtgtcttagtctgtttgggctgctataacaagatgtcctaaactagctggcatataaaaaacagaaacatatttctgatagttctagatgccaggaagtccaagatccaggtaccagcagttgcggtgtctggtgaggtccactttctggttcatagaaggctccttctatccgtgtcctcacaaggtggaagggacaagacagcgctctggggtttttctttcttttctttcttttttttttcttttttagcaacaagaatgctcaatttatttattttttcttagcaacaggaatgcccagtcttgggctttttccataaagacacgaatcccaaacatcagcgctctgcccttgtgacctactcacttcccaaaggtctcacttcctagtactattacattggtgattaggtttcaacatacaaatttggggaggggtggacacaaacattcagatcatagcactgagactctgtcttcttacttgtttttattttactttattttattattatttttttgagacagggtctcactctttcacccaggctggggtgcagtggcgtgatcatggctcactgccccctcaactttctgggctccagcaaccctcccacctcaacctcctgagtagctgggaccacaggcatgtgccaccatgcctggataatttttatatttttggtagagacagggttttaccatgctgcccaggctggtctcaaactcctgagctcaagcgatctacctacctgggcctcccagggtgctaagattacaggtatgagccactgcacctggcctttcttatttgtaaaatcagataataataccacttacttcacaagtattaagaaactgttcttggagtgcttgacaccagtctgccttttcttttttttcttttgtcgagaataaagatgactgtctaaacaaatacctcctactcatccatggttacgaaagcttcaagtcctcattagagacaaactttggtgttaggctcaagaatgctagctcccttcccttttccctatccctgttaaaataaaaaacactacacacctagaaggataatacatgagtccttcctcagtcattaacaccttaacctaaatgtgcttcttgtctccagagagcaagctctatcagctggggaaagaagggagggtttaagaatgtagggcagaggcacaggtctgtgatgccgaggactgattttgtttctgttaattttatttttctgtgatactggcattcgcataatatgacaacattttctggattttagaggatcacattctctgtcgaactctccttgattaaatgaagtcacagggtgaatatttcaattatttcaagcctttgtggtcagtgatctagtattcaattgacctgaacactgaaaacaatcatcatgcctatggctatttgctagggacacgtgataaccacatgcaggaattctgggtaagagcccaggacctcattccaaccctgcctttcccaaatacctgccctgtgagccaaatcgcttaatcttaggattcttttgtttcttctttataattttaaaaagcacagtacctgctttataaggttttatgcatgagatggtgcccatcaagtgtatagtggctggtgtgtgataattttgtaaaagcgtcacatggcagtacatcagagccacatgacatacatgactgctgggagctgggaaacacactaggagcagtggtgccttccagttgtcaccagagcaggcactgaacctccactcacaatgctcgggagactcacctaatgccaaagccagggtctagataaatcctgcttgacacaagaccatataaagagagagagaaatataggctgacaaaaagtggctacaaagcaaggcaaattcaagtggctactggtggcgtgtataaaacagaactgccctgggaaaggaacaatcaaaaaacaagatggtgcctggggaactttctcaaaagtgaggaaacaataagctatgtgtgctccttaaagcaaagatatggcaaagatcccaatccatctcatatttttaataaatatgtcattctaatagaattttccttggtacttaaaattagattataaattttacccttaggaaaaaatatagttaggaaaaagaaggatgattgaatgaatgacgaaaggaaaaataacaagtgaatagtcggtaatatgataatatgataacatgcttaatcacctctcaaagaaatacagctccaagttacataatcctggattccacatctggaaacaaggagcactccctgtatttggagtttattataaatataggcagaaaggctgcaatggaattcagaaggacaacccagtagaaaattgaaacctggaaaaaaaaatcagcaattccataacacatcacttatagacagccccacgctgcccctggtaagtttttgcagaagaacatgaaaatccttagctaaggtacaaacaagccaagtagaggtcaacacatttgggaaatagtggctccacactcctaaatgtcaagggtgtgtgtctggggggtgggggtgggtggggaaggattgtggtatttcagggagaaggaatgtcggatgtttgaagacagcactaagtgtatattagagtgagcactgtcctgggcctctaatggactccattctgagatctgtgtcagaactgtcaataacccagcctagcccaaaactgttaatgtatcacctcccacccagagctgaccctgcttctcagattgcttccaggcaggtcccctgcagagaaagccgaaggatgggtagacacacaggactggtattggaagagatgcttcatggtttatttcttctgcacctgccctcaaagcttgaaggcagctcttgaaacccttatttccaagaaaggggaggaacttggctgtggtattatgatgctccctaagatcttgcagtctgaaagctggcttggagccttgttttcttctgccatctccagaatcccaaatgtactaatcaagactcccttgttcgttctaggataacacatgactggaccacagggaaataaatggccatgaaaagatgacaccctgaagccagacaatattctcctaacaaagaaaggggaagagttaacagagggttaaaccaaagacggtttggctagagagacagcatagttgaaccttctcatcagttgtggctgtaacaagaatttgcaaagatgaaggtttatttaaggaattaaccaagaaataagctgttctacccacagtcatcacagctgccaaaactcaaattattttcttaccctgagatgatcctaggggaaagcatgattcaagttctaccagagtgtcaactactccctctgggcttgtgttaactcttttggaatattaaaattgtttctgtagcctgccagaacaaagctgggttgttgcagtagcctcccagatgaggttagggtcattgcgggcgggagggagtctttctcaccttttttctttttatcttatatacacaaagttaaatgactggatgaaagccccagatactggtctgtagaagtgtctttgttctcatggatgcactgttacttcctggactttgggggactgaggtcttttatagttaaagaaatatacttaggagattggcctggttggggctctgccatcacagtctctggagctgtaacctaatcacatatccttggcagcaaaggcaagatcccctgctgacttgtcaaactctcatatggatgttaagaagattaagataatagcatgcctaacatagctaataagagagatttaaaacaattggcagaaacagattgagttatgaaatgcttattatggatgattctgtgtcacaaaaacagcatatagggtcagcttaatttcacacacaagtaaggggagaagagatgccaatgatgacgaggcagagagagagagagaaggagagagagaaagagagagagcctgctatgccatggccagtgctcaagtgggcagactgatactgagctctgctgggattgcccagtaccaaccccctgcccacaccccaccactgatcatggccagtttggaaagggtgtagaggtcacggaagtgtcaggtcacacccaatgtcctagacactggaggaggtacatctgtgtccaaatatcctaaatagattttcctaaatttgagaatagtcacttcaatctttcttctttccagcctgggtagatcagccacatgccaattgtcttcttgttttctttccaggacaagaagaacatagtttcactcgcagggaatgaaggacccttttgggccttggggggaacacgctgcatgcagcttcctttccatccttgcatcttctttgctgtctagtgctccttgtcatggtctctggggctgtcagcagccaccgcccctgcgctgtgggctccctgccctgtggagtcctgtgctccaggctggctcccacctctccctaagagacacctgggcctggccgtgtggtttgtaggctggagtggggacagaggcctgctggtctcaccccacatttctcatccatttagaggaaggagccatctgagaatccagggacgctcctctggcccaccagccttctcttccccctcccaatctccccttcctttcacaagggaagggaggagattcggtttgcagcgagaaatgttgaagttgggaacgaagtctttggagtggattagccctttgatcttcaggtgggatctccaggtgggacgctcatggtgagaacaagcagcaggctgctctcctgccttgctggtgaaaccctgtcccagacgcctgagaaagtgacctggcaacatcgttaaaattgcaagcacgcattccctttaaaccagaaatccccctcttaggaatctctcccatagaagtaaaagcatctaggtataaagggacctctgtaaacaatgtgcactctttgcggaggcaaaagtctggaaactagataagtatccttgatagaggaaaggaggaatacaatagactacagacaccgttcagagaaaacttaatgaaaacactggcagacacaaatcaggttgtggacatgtgttttcttgggagaaattaaggaagctgaagatggtgtatggcacaagagatgaagaggggttagtcgctcccaacaaacaaaaaagaaaagaaaatgagaaaaatgatgacactttaacagttcaagcagattgtctagggcagggaagtagactgagaaacaggctctgggaagtagactctgagacggaggtttgcctgcaggaggatgtgccctccttgtcacacctgtgggggagggaggcaagcaggatggggtggaaggagaagctgggctgccatgcagtcaggacaaaagcctcagcccatcccggggaaggcagcattgctctggacagctgcccagtcattggatgttggctgcctgcaggaagaaggagactctcatttgcagtgggcagccaccaggagtgagacacagttgggagctgccaggcattggccctcccagcaccatagggaagggacacagaaggcacactgcagcgcccattgcacgggtgcacgatcacatgtatgtatattagtaaagttatagatatacgtgtgtgtggaaatcgataaaggatgagagtaggcagaagaaaagagggtctctgattctcagagtataaaatttatttctaacactggtgagtctgaagcctcactggaccccattccagtgggaaacagacaagactctcagcctgggcagttacagcagtgacactggccggatgatttcccttgacctcgccacatggaagccatgcaacccagccccccatcgtcttagctcctgagaactctgactgccttctatttttgaatgggttgggaatagaaccaagagataaattttgtctcccttttgcttgtcagggttgggtaccttgaatatgggttcaaactggaaccaaaaataaaattcaaagtaaacacctcagaaggacacccagctatctccatggcagaactttgcatagggtgctggaaaattcaggcaactgctctgacccagcacaaactaagaagctcagcaatgactcagtcactcctcttgagagcaattaagctgctgtaaaacatgtaggaacctgataagtagacatacaatcagtccctaaatcccaccttctcctagcaccatattgctaaggcaaagcagagacaattcattcggcttgcatattttcctcaagactgtctttcatacttctctgaatgagattttgtttctatcagcaagtgtttaagaaactatggagaggaagaggaagctggcatatggcttcaaaataacttatttctgttgacatgaaaagaaagccttttatatttcaataggatatcttcatgtatttagcattgttctggaaataatagttaatgcaatgagccaaggaaaaggtgagttatatgtattgagaaggaggaggagcagagttagtaaacattgataatttttgtatgtctggataactcaaaagttattagctggaaaaagttattagtagtatgtaataagaaagcaggaaggtagctgggtaaaggttaaatatattaaaatctatagctttcttatatgccagcattaattgtaattagaatgtaaatattctactcacagtagcaacaaaactataaaataccaagggatacatttaataagcaatgtatacaataaacaatagagaaagctacaaagatgaactgacttgaaagaagtaatacattctgggatcgaagtctttaggttgtgaagatatcagttttatccattctgatttataaattaacagcatttcaacaaagagtttacttagaactagacaaaataattctaaattttacctggaagaataattataggtgaaaaactaaaatgagatgggtggaaagggggagcttttcctatttgatattaggatgtgtttttaagttgcattcatctacagataggaagaccaaaacacaaatcaggacatctgctgattattcagccatttctgatgtttccagacatggaaattaacattctctctttcctcagttgaccatagattctcatgagtgttatttagccttgtagagcacagcaatctccacgtagatcccaccagcccagaagagccatcagcccctgcagtcagatagttcttcactttggacctgtattcctctgacaatactgagtgcatctccaagggcagagtatcaaagcatgtcctctggctgggtctacaggacaccaacatctggcagagaactgacccatccagttggaactctggactttttccacttccaccttttgctggataggtaaaacatacagacttctattttaattcttcacttgtttcctgggatttttgatgccacatataccaagctctcaaatcatcgtgtaaagggccagtttttctcaaatccattgtgcaccatgatgttttttaagtgtatgaaaaataaatcataaacaatgaaattaaaaagaaagccaatgtcaagcaaatacaagcccctatttttattactacatttcatagaaatcaagttactctgtcatgttgccgtatatgtccttaaacacttattttctttggtggcctgacccttatcaactgactgcaccattatataactcatcacaagggaactggctactactttagctagcaattctttatgccttgtgatctaagtaacaagacaatcttacatttttataacacttaactttttgtagtgtgcaaattcttttcctctccaacaacactattttgaggtagttggggcagtttttacaaacccaatttctcacatagtgtattagtctgttctcaaactgctagaaggacatacccaagactgggtaatttataaaggaaagaggtttaattgactcatagttccgtagagctggggaggcctcaggaaacttacagttatgctgaaaggggaagcaaacacatccttcttcacagcgcagcaggagagagaagaatgagggccaagcgaagggagaagccccttataaaaccatcagatcttgtgagaacttactatcacgagaatagcatgggggaaactgcccccacgattcaattaccttccacttgtccctcccacgacacatgggaattatgggaactacaattcaaggtgagatttgggtggggatatactcaaactatgtcaggtaggaaatgcaattcctcatagagatattcagtgacatggtcaaaggggttactgacaaagctggaatgcaccctggaatgccctccctgattcattattttttgttatttccacttctttccccctgcttttccaaagcatttttattcatagttaagtcatgattcagggccccagggtgaggatcaccatgtacccaggtttccctttgcctgggagaaggatgaaggacataggaggggtaagatgcagccagttcagatctttccaggaaatgtgcctttagcccagctgtcatcctagactgaaacccaggagcagggcagaagaacttgtacacacactggtatcattcacacatagagacatcacacccttcagcggttgttgccttctcacagaggtggaagtccaggaagttctgccagcagttcctagtctggttggggaagcgtctgtcaaaaggggcagtcttgtagttcttgattttggtcttcatgtcttttgccaaggtgctgacttctaaagatgctcatgatgcagctggtagctcagtgtgaccctcagcaaagacatcaactttggacctcattccactctttaatgaatctgtttatgtctcagttaatggagctactgatgactgactcagtgagtctaatcccatgaccctgactgacaaagcattgtaaatgctaatcctgcaaaagtcccttctactgttatctacaccgtgaagagaaaacccaccaaactgaacaatgatgatgttcttacacagcagcgctgcattaggaagaaaatttcaaataatccatcacctagtgtgaatatttccacaaaacagcaaatttcactaaaaactctcattaaacactttaagaagagacgtgtagcgagttatttaggctacataaaccaaaaccaaagtgatattgttggtctggtagttctttcttaaaactgcaggtaacacatataagagcaaataagtagcgtcttataggccaagtttacaaaaataaactacaaagagatgtgagaaattttaaacaaaatctctgctcattgttcagaaggagattctcttctctgtgctcttcaggaggggccagcagtggtatttgggctgagtggcaagtgaaggggagtgcttaggtcccttcagactgtgtgccagtgaatgcagttccaaagagctgagagaagggcaaacgaccagcccaggaaggcagcatagtacaggggaaagcccttggttccagaatccaagggttttggtttgaatctcagctttgccacttcctaactgggtaatgggccctcacctcactctgcctaatagaactgtgattactaaacaaaggtagatatacaatggctagtatataagtgctgagagatatttgtccttgtcaatagaaaaaaaaaaagcatatagaattcaccttcctctaccaggcatgtgcctggacctcttcaggctttttaaaaaagctttttaaatttatttttgtctgacattgattatgtgggataaaatatctccaagtgcggtgcagagtctatatgaagaagcacagataggaagagaagtagtcacattaaagtcaaattaagagtcctattaaagtctacaatagccaggctgggcatggcaactcacaccggtaatcccagcactttgggaggctgaggagggcagatcacttgaggccaggagtttgagaccagcccagccaacacagtgaaaccccatctctattaaaaacacaaaaattagccaggtatggtggtgcatgcctataatcctagctacttgggaggctgaggcacaagaatcgcttgagcctgggaggtggaagttgcagtgagccaagatggcaccattgcactccagcctgggtgacagagagagactctgtctcaaaaaaaaaaaaaaagtgtacagtagccattgggctagatagcctgaggcctaaccggtgcccacagtggggatgtgttatagcacaaggaaaaaagctttgctttatgagagaattttgcaagggctattctgacacacacctgagtgagctgacatgtttggagaaggctcaatgagtagaagctcagtacctcccatgtatgctcagaatgttcccacttttactgcctttgattcctatctcaatacattactttagtctctaccaaagtaatacggaagacagaattagaattgtcttttagtgattgtatgcagtgcaatgtacaaccaggacaattgtgttgtttttccggcttgagttgctccagttggctgtctataccaatcacaagacttgtatttctcaggactgtgcaaagttaagccaagtagttgagtacaaaccaggacaggcgtttaatgatacagatgttctacaacatgttttctttttttcaggcaccagaaatctatgtggttactttctttagtttataagaccacatgtaagtactttggacaattgatgtatttttcctttttacattcagatatttaacaaagcaaggcacaggtctaggctctgtatgaatctatatctgaagaagccaagttggagcagcttacaagcagatcccagtcactgacaccaccttccgaggcttagtgatgagtagaaaatccagacccttcaccccgctgctcatctgaaatagaggacaataactggaatctctatgctctccaataatgcaggacttgactttgagtctcttcaatttaattgaacaaatatttattcaggacttactactgtgcttaggccctgaggattccaagctgataagactgattcaggttaggcctatggaatacaatttagagcttacaagatgatcacctaagccactttcatcattcagctggtgaagaactgagccctggagagaaggaagcttcccaatggcacaaagcaagggagaaccagggtcattcaaaaatttgaaatggtaaaaatgtagatgccattactatcaaaaaagtggtagaagataaaggtactgtgtgcaagtccctattctgtagctttggccttagatgtggatccattccttacctggacacagaggaaaggcctccctccttaatgtctgcatagggccaccccctcaggtaaaccaccagtgtgtcctctaatgtgtcccctcagctctggaaccagagttaaggccacctgaccctcaccatgtgactagctctatcctggacaagtcagatattaaacccagtataatgaaaaccaggtctttacattagagatttttatttcaatagatatcaagatagacttgcaagcaaatttgtgtatttaaagcatatgatataatgatggactatgcatgctaattattagaaagtaataagggtgctagttaagtggtgcttcacttctctgtgaagaattttttttttttttttttttgagatggagcctcgatctacgcccaggctggagtgcagtggtgcaatcttggctcactgcaacctccgcctcccgggttcaagtgattctcctgcctcagcctcctaagtagctgggactacaggctcctgccacaacgcccagctcattttttgtgtctttagtagagacggggtttcactgtgttagccaggatggtctcgatctcctgaccttgtgatccacctgcctcggccccccaaagtgctgggattacaggcgtgagccaccatgcccggcctgaagaagttttttgacttcctaaacttcaaactggaaaaccagcctcctctgactgtacctgtacaatgattttggtcctttattgggcttaattacatgctagtctccaccttgaagtcagggtctgttcctgtctggcgcctggtagactctcaatgtttcttgaataaagtaaataaaagatattttgagatcttagtccactctggggtggcttcccagaagagaaaagctgggatttattttaagaaatggaagtaatttggcggaaggaggcatatttcttccttagtgccctcaccaagcctagaaaataggagcaggtcttggggtgggatggtgggaagggtgtgtggggaggaaaggcacaaactatgtgattcccctatggctagagagaagctctcggaggcaggctaactctgccaaggtcaaggagcaaacaggaatggaagccttgaccctcggtccagcctcacaccacatgttctctataggagacacctttgtacggagctttgcactgaccttgagaaataatttccatctggaattctgggtgaatcacaggaaggcaatctgcaatttctcaagtttgcacttggctggggttgttgaatctatgttgtaacccttatgaaacactattgctcaagaacattcgaatggatgcaacatttgtaaattaaaagcctgctgctttaattcccttccaatggacacagttagacatatacagaagtcacaactggatgcagctggaggtttgactttgagaggatgggagactggaaatccctgggcatttggtcagcacagtagcagagtgctggggtttgggaaagtagcggttgggtaggagaaggtgttgcatgcaatatttttctttctggtatttgtcccgggagatccatattgacacctgaactttgtgacacagtcgagccctgctccactggcttctatacaaacaacatgatgcaaaccagctggggccaaagcagttaccatggaaaccctagactttggtttggaaagtaaaagtaaaagacatttatgatgaccacagcagtggtttgtaccaatgcacttcttgggaagtttcttttttatcctgaactttagcgttctttttttttttttcttgccctgtggaatttggcaaaagaaaaatttaaaatcagattggaattattaccttccccattaaatagctaaaacaggaagtcttgatttattcaaaccatatttgctaaagacaaatttaactctaaatggagaaaccgcttaaaggtcaagttttgtcttggatactttgaaagagttgctaagcatttttgtcccctatggaggctgggttgacaccaggaagtgttatttgtgttatttcccctcaaacatttttccacctctcagtaatgacaggagaattatggctatagagagcaaacacagccttatgtgggcatgatcacagttgtagcaagccagtcatgatagcaggaataggctggttgcatgagtgcactgggtgaagactacagaggacattaagggcaccagagggaacaggttcaatttctactctgtcacttacttgctgcatgatcctgggccagttacttaaccaccctctaccacagtttcctcaggttggaaatgagaatcaaaatgcccaactgcccccaaatgttcacatggattcaatgaaataaagcacataaagcataaactgaaatccaaatggaaagcaatcacaaaaagaatccagtggaagggaagtgggaagtagcaggcagatcacgctgacaggttggcttcaagtgaccgttccaatctcagaggaccacagtctcaaggccacctacagtttcctttaccacccactgtctgagccaccaaagcctaccccacccttgcacctcctttcttactcccttctaactgtgaaggcatcgggctttcccagatatcctttgcattcaaatcctctcaaccactgcctgcagattcccctccttctgtactcatttttcttttcttggaaaaaaacaaaaacaaaattggacccttggtggagcccttgatggcgacagcacaatctttcatccctttgctttgtcctctcaggtcctggctctgttcctcacctccacttttatttccacatcctccatgacaagcctcctgtccctaacattcagctgaaactgttcctagatcccaaactcctaccctagcacaagagaaagctggtggcattcctatttagtgacatctcttcccaactctgcatcagctttgataggtcacaaatgacctcagattactaaacgctattttttttctccttttctttccccttgacttctctgctgcatttgatattggcgccactttctcttcactaaaattctctcttctttttgttgccaggattttatgctgtggtgagtctcccacttttccaaaacgttgtgcaagttctgcttgttttttcttctgcctactgatgccaacatattctaacattcagccctccttaggagatgacccattcccttagctttgctattttctattcccatgactctcatctcaagagctcttcttcaccaaatgccaattatttctgctgatctctaggtcaaccctgtccaacagaacattctgagaggatggaaatgttctctgcctgggctgttgaatgcagtggacattagccatatggagctatggagtacttgaaatgcagttagcctgactgcaaaactgaatttttaattttatctaatttcaatttcaatttaatttattacatgtggctagaggctaccatattggacagcatagttccagatagtttcacttaaacaccatcatttcaggcaaaatatgatcaatactaaaggttttctggaaccaactcctctcccagcctctctgtctatggacaactaatccctactgcatgcaaagctcaaaagcctcttttattaattccactctgattcctcagacgcagtctctgattcccattgacctgccttgaaatatccctgttctctccccgaccttctgtattttactgccacacccctgagcaggtcctcattcaaacctaaacagccagcctgaatctctcacttcaacacaccttgcgatcactgcagaccggatcttattctaacactgctctgcaatgttgcttccctgcctcaaacccccagtggctccccacttcctctgatttcatggccaaaacctttgtctggttttcaaaaagacacccagaataatatcatccctggtctgggtcaataatattgtcccaccaagtctggataataatattgtcccaccaagtctggttttccatgactctctctctccctctctctctttctacacacacacacacacacacacacacacacacacacacacaccactcaaggattatctcacaagctcatgaatgtgctgtgttcactcctgtcttggagcttctattggcttttcaaatccgctattggcttttcaaattctacctttcaagacccagttaaagactccttccctctatggaaacttccctaattaagacctgcctggcatatctcccctctggattcctagaccatttataatgagtgttatcttgtcctgatgactattgtttcaagtgtgctatccttttccccagattagacttgaagaaagtggctcttcttcttcctgacctccagaagacttagctcagaaccgagcccgcagcagatgctcagtgctttgtgaacatgtcttgattcatcagcaagtgcaggataagaactggatgtgacaacatctgagagctcagtgaacattagactcgccttgttaataatttactccctttgtcccctagtttcctgctcatccctctatttctcctggctcttttcagcttcaattcctctcatttgtccacttcttccctttgtccagtaaaccacatgggctgatcagggttggagtagagagtgtaggattgtctattttctcttggaactgatggccatggtgaacaccttgcttgccatatgatcaacatggctctatgaggcagttaaaactatgtagacaaaattttttttgtcagataaaatgaggataaaaatacctcctcatcaacatatagaggaactatggaattaaatgaataatgagtaatgggctaagaatataggattggatgtaccagaatcacagtgcaactgcctcatggaaaagctgggcattttcatcttaagggatgatccagaagggcaaagtttaaaacaaaggaactgattcaagtgcaatattttacattgtgtaaatatctgaaggaattcacaaacggaccacaatggctgcagagacacagtggtaaagtgcttaataaattggcgaacacgtgttgtgccataaatgttagtgcatgaagcaagttatgattatttgtttccctttgtgtttttctaatcaaagatttaaaaatcatgggagttttgagcatcatgagataacaagtattgtgatacaggtccaccattccttttccaaaaactttggtattagatgtgttttggaaatcaggatttttcagattttataaaggtcatctggatcatatgttgtatattgtatactactaccagtgggatatgggtcagcaccctacaatcaaacacagaaatatttctgcaacacaacgtgtaaaatataaaatctacaaatggactcacctgagttcagattgagttcactgccaaatgagttctgataaggtcagattttggccccaaattattaatcgagaacttgcaattttcagagcttttgaacttaggaatacagacattgtgtacctgtcctattctacatcattttctttaaaaagaggtagtctttttgaaagtttctattaaacttttagagatgtaaaaaatagtgggtagtaattacagaacttactacaaagctacagtaatcaaaacagtgtggtactgtcataaggataaaggacatatgaaatgtggaatacaattccatttgatggaatagaatttagactccagaaatgaactcatttatctatgatcagttgaatttcgacaagggtgccaagaccactcagtgggagaaagaataatttcttcaatagatgatgcttggacaattggatttctacaagcaaaagaatgaaattggaagcttacctcctatcatgtataaaaattaactcaaaatggatcaaggacctaagtgtaactataactcttaggagaaactataactcttaggagaaaacataaggatacatttttgcaactttgtcaggggtgttcaatcttttggcttccctggaccacagtggaagaagaagagttgtcttgggacacatataaaatacactaaaactaacaatagctgatgagctttaaaaaattggaaaaaatcataatgttttaagaaagtttatgaatttttattgggctgcattcaaagccgtcctggccatgggttggacaagcttgaattagacaatgactccttagatatatgacaccaagaacacatgcaacaaaagaaaaagtagataaattggatgtcataaaaattaaagacagctgtccaccaaaggatactatcaagaatgtgaaagggcaacccacgaatgaaaatatttgcagatcaattatctgaccagggtctggcatccagaatatattaataacccctgcaactcaacaataaaaagacaaataacccaattaaaaaatgggcaaaggatgtgaatagatataactccaaagaagttacatgaatagccaaacatgcatatgaaaagacactcagcattattagtcattagggaaatgcaaagcaacatcactagagatactatttcacacccactaggatggacatcattttaaaaaatgacaagtaatggtgaggatgtagagaaactagagccctcaaacattgctggtgggtatgtaaactggggcgtttgctgtgaaaaacaatttggcagttccttaattagctaaacgtagaagttccatatggccgagcaattcaactcctaggggtatacctaaaagaactgaaaactggtactcaaacaaaaacttgtacatggatgttcatagcaatgctattcatagtggtcacaaggcagaaataacttaaatgaccctcaatggagcaacagataaataaaatatggtacattcatacaaataaatagtattcagtcatacaaaaggaatgaagtcctgaaacataccataacatggatgaagcttgataacattatgcaaaatgaagaggtatacacaaaaggtcacatatatgatcccattcatatgcagtatcaggaatcagcacatccatacagattgatggctgccaggcacttggggagtggggaatgccgagtgattgctaatgggacccagatttcattctggggtcatgaagtgctttggaactagatagtggtgatagttggataacattgcgaatgtattaaatgctacagaattttacaatttaagatggttaaaattgtgaattttacgttatgtgaatttaattacaattaaaacaaagtgagtagacaaatattgcctctttggggacctcaaggcatctggagacctcagggtttgtttggttcatgtgttttgttttgttttgaatcactagctaagatgttggcaacacagtaaacaaaagctgaacaataataataattgatgtctgctttaaatgtgctgtttctgatgtatttttgtaaatttcaggaattcctgtagcataaaccagagtttgttaatcttggcactattgccattttgggctggttaattctctgttgtgggggctgtcctgtggttgtggaacattcggcagcacccctggtctaacccacacaatgccagcagcatctcccaccccaattgtgacactatgacagaaagagatcttgggccaggcgcagtggctcatgcctgtaatcctagcactttgggaggccgaggtgggtggatcacttgaggtcaggagttcgagaccagcctggccaacatggagaaaccctgtctctactaaaaacatacaaaaacttagccaggcgtggtggcaggcacctgtaatcccacccacttaagaggctgaggcagggcaatcacttgaacccaggaggcagaggttgcagtgagccgcgatcgcgccattgcactccagcctgggtaacagtgagacatcgtctcaaaaaacgaaacaaaaattattcacaatagcaaagacttggaaccaacccaaatgtccaacaatgatagactggattaagaaaatatggcacatatacaccatggaatactatgcagtcataaaaaatgatgagttcatgtcctttgtagggacatggatgaaattggaaatcatcattctcaggaaactatcgcaagaacaaaaaaccaaacactgcatattctcactcatagctgggaattgaacactgagaacacatggacacaggaaggggaacatcacactctggggactgtcgtggggtggggggaacagggagggatagcattgggagatatacctaatgctagatgacgagttagtgggtacagcgcaccagcatggcacatgtatacatatgtaactaacctgcacattgtgcacatgtaccctaaaacttaaagtataataataataaataaaaaaaagaaacaaaacaaaagaaaaacactaacaaaaacaaaaacaaacaaaaagaaaaacgtctccagaccttgccaagtgcctcctggaggtcaacatcacccccgattgagaactactaatgtgacctctttaggaaaagtttattatcctgggattttttcctctcctaaagtttctttttaaaaacccatttctgagattgttctttagtaatttccaaatgacagcaaactcatgaaacaaaacaacatgaaaattccaggtaaatgtccaaaacctttttcattaagaggaactaaactacgcagtccacttgtagacagtaggtttctcactggcaacgaatgccctggcaataagctaaatgtggatagcacataaaaaaagtgaatgtgcaatgttcccttttcaaaccctttttgggcaaagacgactgctctgccagcattccagtataatgacagctcatgtgccctttgtcaaccttgcctccttctcctttgaaaatacaaaccacacttcttcccaaacttcttctgataccatttaatgagtctgggatcagacactgttagcacagagagcaacctgtgctccagatccccctcagcagccgctgccagcaggaagggagggctgagtgttcaggacgcagggttccctggctgcttcaccagcgcagtgctgcctttatccattttatgtcttggatttctgagtgggatttattttgcacaaagagttctgaagctgagaagtttgaaagccactggctcaacccaagcccctctcctacagatgaggacaccagagtgcagagcaaagggcaggaccacgtgtgattccagggcttttaactgtagacaggcccctttcctctgttacagggaaggcagccaggcagctcctgcaagatgtcactaatcccttgcgtgcctcagtttccttatctctacatgagcatagcaacctccatcttcctggctacttctgggatttaaattagacacagtaagtgccatgcaagtaccactaatatggatggaaagtttgtgtcctccccaaatccacatgttgaaaccctaaccaccagtgtgatggtgttaggaggtggggcctttgggaggtgattaggactagatgatgtcacgagggtgaaccctcataatgagattcatgcccttatacaaagaggaaggtaccagagagctctctctctctctctcttcatcaggtgagaatgcagggagaaggcaaccatctgtgacctagcaggagaaccctcaccaagagcctgacaatgctagaaccctgatctcagacttccagcctccagagctctgagaaatcaatgtcagctgcctaagctgcccagtctatacctgcccaggtattccattatggcagcctgagctgacaagtctaccgcttgacatcacacacatcctcaggtgtgtgaatggtttcacttcttctttcctaggaaaagagtcattaaactctacacgtttcacacaatcctcttgtgatcacagccacaagggaaagctcagcttactgaactgtgtagggattctgttactgtctcactgcacagttgtcttcctctaactgttgagaatcaaaggctataggaggatgggtctgctttgtcttgaaccacaaacttctgaaggactgaaggagagaatcgcactgcgggtgacccacttctgcttcacactctgatatccccatgaaaaggagcctgcacacaggcagtgaattccagacggagctgaactctcaggtcctctttctaaattctcaatctatctaaaagaatacacatacaggtgaaattttacctccctgctaaaaaccttagggaaagccaaagttcataagccagaatctctgagaagtttcttgaaactatagtttggttaggaccagcctgaataaaaaactgatgaatcctcggttcacatcaacaaaagacgggaaagacggaatggctccagtagcttctcaggaatagccccaggggcttgagagagcagaaactgcgacacacacaggatcagggccagcttgtcaaaggtaaatctcaatgcttacatccaggcaggatgggaaggaccctgaactttcccaggcaaggtcagcagacaaaggaggttctctacaacaggtgcccaggcggtcagtcatgccacccggaggagagggcactacacaccctgcaccaaacagacaagagaaacagcctttgctgtgcaaaatcaaaacatgttacttccatctcttgaaggataaagagttctgtactctggcagattcgaatcacaacaaagacaatccatttccttctccccttaatctggatctgaaagatttgaagaggaacctacccagtttcaaacaaagcccatttcaaattttaataccaggtcaccctctatgaggttgaagaaaaagagaaaaagtactgttcctatgaaaagcttcagctattcaatagaggagattgatcccaggaatcagagcaagtgtacacctttaaaatggtgatgcggaggatgatctctaaattgtattcaaacaagacttaagcagctattaggctcacaaaacaagtgtagggggtgacgaagatggacagtgtgcccaccatatggagtgggatggagggaatatggagattgtgtattacaaaaaccaaataagtaaagtggaacatgaacttgagaaattcaaatggaaatttaaaaaaaaatagtaaaaaagtgactaatgagagagaaatgcaaaaacaaaaaacaaaaaacaaaaaaaaaacagggcaggtataggaattgaaattccaagaggaagatcagagcagaggacatcatcattaaaggaggctgcctttggctttagagcaaaaggtgcactggatctcaagcaatagcaatgaaaagttaccccaaacagaagtccccagtatatatactttttaatttaatagagaaaaaaattttataaacatcttagttgaaaaataaatacacaaagagagtacttgacaaaaaaacaataatcaaggggacctcacgtcatttatgaagcattaaatgccaagaaacaaagaagcaacaagagtattttgaaatgcaaaacaaacaaacaaaaaagaaaaacaaaaccctcacttgaattctatgtcacataagttgtctttcatgtgttaaggtttaggcctggaagggctgagaaaatgtgttttgcttatatcttttttgttgttgttgtcagagacaaagtgttgctctgttgcccaggatgcagtgcagtgtggaaatctcagttcactgcaacatctgcctcctgagttcaagtgattcttgtgcctcaggctcctgaatagctagaattacaggtgtgtgccaccacgcctaatttttgtacttttaatagagacggggtttcaccttgttggctaggcttgtctcaaactcctggcctcaagtgatccgcccacctcggcctcccaaattgctgggattacaggtgtgagtcactgcacatggcccttgcttatatctttataggtaaaattttgtttggtgctatagtcttctctaatataataataaatattttaaactttgtgggccatacagtctctgtagcatctacccaagtccaccactgtcgcatggaagcaccacagacaatatgtcaattacagggcatggccaacctagctggtagaactttactcacaaaagcaggccatgatttgccgacctctgttccatctgggagattaagaaaaatccagagcacaggagtgagtaagtcataatatataataggaggacaattggtaaactaaattatagagagatacaaaagacaggagaggcaatacaaaatttaatgaaaataatctagttttaaaatgcactattttattaactaaaagatagaggttttaaagagaagggaaaagaagagtgtgctaaacttctcaccttccatgggcaaaggtgggtggtggagtaacagagagaactgaaggtttaaacatgcttttgaaaaactagaaagttatgtctagtaaaattaaaaacaggagacaagctttccaaaccaccacagaattaaaaagcaaagaaaaaagttacccgttttacgaaagactgaaaatagtgaaaacgaaggaagcatagagccagaaagcatatgataagttgacaaaaatcacaccaaataatctgtcacaataaatgaaaattagttaaatccttattaaggacaaatacccatattagaaacatggattatgagaaatccatttgatgtgaagtacacaagctgctatataaaatggtgaacaaatgtgaataaaaatagattagagattgaaatattatttttttaaatgtgcatatccaggaaaaataattaaatagaacaaaaagtctatctttaaatgaagatattattgatttgatcttttatgcatgaagcaaaaacataaacatatataaagcaaaacttgttaaaaatgtaagaaatagtgggaagaaacctggtagcaaagggaaactttatcatacttctctcaatatttggcaagtaaagtatataatagataatggtaagataaataaagattaatggataaagaagatctggaaaacaccactattaatgtttagttaatatatacactaaagattaaatctattgtgtattaattattgattacatattaagtcattaagaaaatctcaataagtcccataagctaaaaattattgagctcacactctctgaccacaatgcattaaattagaaattacatttgagaaagtgggagataaaattaccaatgattttcaaatgaacaaacaacaacaacaacaacacaatgaatcctttcctgtctacacaggacaagggaaatattaaaagcaggaaggcagactgattggatgacagcactgcctacccaaacataagggaagaaactaaactttgcgtagaagcaaatgtacagcttggattgtttttaatcttagacaagaaagaattaaaatagatgaactaaacattctgggtaagctaatattgaaaagcaaaatataaccagaaaataaaagagagaaatctctagagattacattaatgtactgggaaagagattaaaatgactaataaattcaggacttggattctttgaaaaaaactaataaaatatacaggctttcagaaagtctgagcaaagacaaaaagaaagaagaaagatagcaaagaaataaaaagttacagaatttcatgtagaagtctatgctaaaaacttgaacctcaatgagaaggcaaatggaaaatacgaaaataaagattatcaaatctgacgatcagaacagaccactatccatggaagaaatagaaaccagtctcaaagaattgcatccataaaaggagctgggcccgaatgttttataggcaagtttttcaaaccttcaaggaacacataattcttacggtatttaagctgttacagtttatagaaaaaaaatgaaaagtgtcacaattcgctttatgaaattaacataaacgtgctaccaaaatgtaacaaagacagtgcattaacgtaaaacaatagactcatttcacacagaaacacagatgcaaatgagaagtgaaatatttcctgtgatacagcaacatgaataacggtgatgtcacctgattgagtagaatttaatccaagaatacatggaaaggttaataatatgaaataaaattttatcaaatcaatgtcaatgaaaaaagattatattgatggatatcaataaagcaaatgtttaatttaacaaaattaaaaattcatttttattgaataatattaaaaatgcaaacaaattaaaatacattttaaatctagatctgtatagttttgtaaactctagaaagatatttctttgatatgatggagtatatcaatctaaaaccaatggacagtgtcatatctgtcaaaatatcaaagcagcatttcccaacatcattgtttaatcaattttccaggagatgttagcagatgtgcttaaaactaaagtctaaacaacagttcaaaagtagtttgggaagtaaatggagtgacaaaatgaatccagagttttcttggcagaatgaatgtacaatagacaaaataattttgaaaaagaatattcatccaggccttaacctagagaatattaaaatgtattatgcaaccacagccattaaagtaatgtgacagcaatactagagcagagagacagataaatggaaaagaagcgagtgtattccaaaatagatccaaaattctttttaatataacaaatgtggttttccaaataagaaaggaaatgatggattatttgataagccttttgagactatctggctaaccatttcaaaataaatactgtgaggcataatctaccaaaatacaaacatgaattccaggtagattacaaatgatgctctaaaagaatgaggaggaaacagacttacattgtggaaggtctctctgagcatccctgagaaggcacattcaatgaaaaaacatgaaaatatttgactatataaatattttaaatgtctaaacatttgcaaaaaccataaaacaacaaaatgcaaataaccaagtggaaaagatagttttaaatatgtataaggattataatattttaaaatattcctcatctttattcttttcttagtaaacctctctctctctctgcctctctctctctctctgcctctctctctctctgctgtccacttggctttgctattccatagaaggtggatgccactctggaaaggaggaggagtgtcccctttagccagaacaaggaagaggaaagacttccctgtcttccctgagggactgtgagaaaggtggggaagaaggtagtggaaagaggcagttggcatttgttctgagccctctctctcaacaagagtggtaggaatgcctgaagattggctgggcacggtggtgcatgtctgtagttccaactactcaggaggctgagaagagaggatcacttgaacccagggttctaggctgcagtgagccatgattgtgccacttcactccagcctgggtgacacagcaagaccatgtctggaacaaaaaaatgcctgaagttaaagcggggcggggggggggagcaggcagaggtgctttctcccattctccattctgggtgtagtcagtcctttccatgagagccaccatacctgttaatgtggcagccagtgtggtggggtagagagtgtggtgtggaaggaacccaccaggctctctgtgccctgagactgggatggaaacattgttgagaatttggtgcaggaggttgtcaaagttgttcacagggctgcagggacaaagtgactccctggccaacagcaacagagccagtgtcactggagccaggaaacaatggagtcatagtcaaaccctctctgactactatgacatttgtaagcccctaggcgtggtcagtatcttagagggcagatctgaaaggccctgtgctgtggtctgaatgtttgtgccccacccccgaaattcctatgttggaatcctggcccccagtgtgatgatattaggagatggggcctttgggaggtgatgcagaaagaggccccagggagctgcctcactccttccaccaagtgagcacacagctagaaggtaccatccataaagatgaaggtaggtcttcttcagacactaaatctgttggtacattgagctcagacttccagcctcgaggattgtgagaaataaattcctgtttacaagccacccagtctatggcattttattatagcagcctgaatggactaggacaccaaggcatccaagagactgaatatgcaaagatgatgcataaattattggatttgaatgagtttattaaatttaactaaaagtgtgtgtgcatgcatgtgtgtgtgtgtgtgcatgtgagtgcatgcatatgtgtatttccatggaagtttgtagaaaagatcacatccgtttttggaaaataagctacatcttcttggcacatttgcatatagtgtgagaagactggcaacccaggatttgtgataaataagtaattatttatcttcaatgtataaaatgagcttaccgataaaaaaaaaaagacagaaaaactgctgtataaaaagtggccaaaaagcacagataggaaatttcacaagaggagaaatataagtgatggataaaaatataaaaagaaatgttcaaataagaacacatgacacggggaggggaacatcacacactggagcctgttgggggttggggggcaagaggagggagagcattaggacaaatacctaatgcatgccaggcttaaaacctagataatgggttgataggtaaagcaaaccacaatggcacatgtacacctatgtaacaaacctgcatattctgcacttgtatcccagaacttaaagaaaaaaataagaaaagaaaagaaacattcaaatagcgaagaaatagaaaacataaaaatgaaaagccactaggcaagtgtcaaactggcaaaccaaatagcagggctaaaatacagtaaacttgttagacaaagaaaatgccttagaaaactgtcctcatatccaccatgaaaccatgaggtgacagaacacagcaatgactttgttactaagtgactaaggattattactccatccaagtaataactcacttgtctatagcctgacttgaaagagtcagctattgttcaaagcattgttagagctcattgttgatgtcttctgagcctgcagcacgttcttttgaaaatgatggtaaatcttcattgacagatttgtcttgtggaaagagccaaaattaatttaaagccaagtctggttatactatttctgatcacgagaaagcttttctcataaatctaagctctgaaggcagtgacaaaagaggcattccagaacgatgtggcagctcacggaaataagttttttaaatggcacggtagaaggattgcacttggcaggatacagctccccttgtcctgcataaaggtctcccaactggtctatccacaatcttgttttcactaagcctttgataatcttgaaatgctgtataaactctatcatgtcattcctgctcatctttggataaaaacacaaacttgtataatggctataaagccttgtttagtctggttcttccctttccagcttcactggacaccagttatctcttggcctcttgtttctggccacagtggccttctagaaagtcattatggacattaagccagccccactaaagtcttcgcacgttctcttccctccctccccatttttgcctttaaacacctactcattcaatagatctggacttaatagtcaagccctccttcccagaaagacctttctaccctcccagtccaggaccacccttagccacaggacatattttcaaggcaccatttatgttcccttcattgctctgtacacggttttcgataacttagtgtggctatctgattaatgtctatctccttctggagattagaagcctgcagggaggcaaagatcccagttggttttactcagtgcattgcatgaagcctggcatatgggaagttctcaatataactgatggattaaagagaaatgtaatttggcacacttgtgaggtcggtgatctgcaagaggactacaatgatctgcccctctgtgtacacacttgctgctctcccatcaagagatgagtctgtctcgcttccccttgaacctaggctggtctcctgacttgctgtgactgcagaatgaaacagcagtgatgctggaccaggtgtgagcctagctcttcaaaggcctcacagtttctgccttgactttcttgggggagagctgccatgctataagaaggtggtttagaagggaacagaggccaccaagactcacagccagcttcaattgccaggcaagctgggtgctgacgtacttttgaccatagaatcatgagacatagatggctgctgctttaagccactaccttttgggatggtctgtggtgtagtaagagtaactgaaacgctggcttcttatcttaaaataaattctagccaggtgtggtgactcatgcctctaatctcaatgttttgggaggctaaagaaaaaggattgcttgaggtcaggagctcaagaccagcctggacaacacagcaagatcccatttctataaaaataaaatataaaaattagccaggcatggtggtgcatgcctgtagtcccagctactcagaaggctgaggtgggagaatcacttgagttcgaggccgcagtgagctatgattaccactgaactccagtctgggtgaaagaatgagatcctgtcattaaataaataaataaaataaaataaatcctaatggcactagtttttcttcacaccattatctctaagaggtgaaccttttccatgagaactagggaactgctccctttgtacctgcagtgaagcaaccctcaacccctggttatcttgggcatccgcagagggtttgggattatcatatatcattgtatgtacttgtcctttttccttgtcatttttcatatacctttgctaggtatctaattgttcagatgttctgctccattagggcagggatttatttgtctttatctccagtgattctatagcttcctggcaaacagtatatgttcaatgaaactgctgaatgaatgaatgaatcattctctgcctcattgcctccacctgataaatccactgccagctgtgccctcctcaaacatccaatcttaaaacacatttttctgctctatcaatgtgctgcctcctgttcttttataaacataatcctcaaatattctatgtctatgtaagccacatctcagcccaatgctgcctcctttgattcagtggcaacagcaatcaatggcttaggtcctataataacgctgggttttgtgtttaaatcagataacatatccagaattcagacacgtaactatgttttcagtgattgttgccttttcatcttctttccaatgctttctatttcttagaatgccaaggacatccacccctcatggcaacatctgcatgttgacatacatcagtaatggtctgtgaatcatttgaattctggtaagatgaacatttattaccatttactctgagttaggcactatgctgggcagctgacctatataacatcccctgttatatgaaaaagaaagcctaggtttaaatctcaggccaacagtttctccattcagcagcacactgcctctggaactagtgggctctagacaatgagatgaaatcaacaaagatgattcataggctttagatgctggagcttcctgagaagcagagttcttatccttccttctctttcgtaggttgaaggctgacaccgtcatagtctctctactcatctccatggccaaaatttgcttttgaaagcatttgctccaaagtataaatgactgttaacaactgcacatggcacccccctcccttgaaggcattctgaatttcaaccaaacatttaggatgcaaaaatggaacaagattagcaagatttagacttggaagcaggcaagtcagattcctcccaacagtcatgctattcaatgcagcaagcaacccagccttagtggaaagaagcttgggaaaagggaacgtgagacttctcacaatatacaggaaggacctttgcagtcaaatagcctactcacctgattttcctgggtcagtccctattaaacatgggtgtttcacttctcagctgtggatagcacactcatccctgccctggtttcagtttttaatctctttcctctcccgcagcctagtgcagaccgacagcccttttctccaaaacagcacgtcatatttaagaatgtatgtcccttgaatataataatatgatagtatatttattcttctgctcacattttgcatgaaaaacatacttaagacagttaataaaaaaacatataacatctcgttgacgacccagcagaagtagtgccatcttctttaagtctctgctctgtcaatggtcatgcatgtagaagcttctcagtgacctctcggcacaatgaactgctatattccttagcacactgtaataatatcattctgagcaccatcctgagcaccatgtaataatatcactctgagcacctatgtcatagacttgcaataattgttgacaatttgtctccttaactagactgtgaggcccttgagggcactgtgttttattcatcttttttattctgtgtagctgagagcctggtgcttattacatagccagtacattcttggaggaaatcatctcttactcaattggtgtcaggaagaaattgagagccacagactggcaggttcagggatcctttgcactactgagcagctactcagaccctgtgaactgtatgttccctacttccctcctgtcatatcatttttcttttttttttttttttagacagaatctcgctctgtcacccaggctggagtgcagtggtgtgactcagctcactgcaacctctgtctcccgggttcaagcgattctccagcctcagcctaccaggtagctggtattacaggcgtgcaccaccatgcccagctaatttttgtgtttttagtaaagacagggtttcaccatgttggccaggctggtctcgaactcctgacctcaagtgatccgcctgctcagcctcccaaagtgctgggattagaggcatgagccaccgcgcctggcacctcactaggatttaaaagaagcccagtgattccgagggctcctgtctaccaccacttctctccaccacaacatcttctcctccacactgctgactccctgggagagcaaatccaagagcgggctatgactagtcagagcatccacctcccctagatgactccaggacccaggccattgtttctcatctctatgcatagctcagccaccactgcaagctccaaactctcaggccacccatcgtcacctgggctccttctacaacctggctgtggatgctccctaacctgaccgagtctgtgtctcttcacacacacactctctgggactcacagtaggtcctcagcattgcctcctgtatccctcagctgcttagctcttagagaaaaacacacaaccctccttcccgctgtactttaatgttatgaccgtaaatctcagataggccttcaggacttcccagtgactctaccaaacttccataaaatgtttactgtcccactctcaaagatgaatctttcacaccttctctgaggctaaaactgccatcgttccccattcctgactctctcttagctgatgaccttgcttcatatttcactgaggacataaacatatcctaaagagatcactatctctctccctctgtctctacttgcctcagggctcacacactttgctctccttgtcacttcccaatgctccccttgggcactgaatcccgttgcctcttttgcctatcccatcagtgcctctctctatcccatcgttcccatcagaatataaatatcatgtcatatccccacctcccaccattgaaagctctctctatacccctccagctacaccgcatctcctagctccagtgtatagcaaaacctttcagaagagttgtctattttccctgttcccactttttttatcctttgttctttctagaaagtacacaatcaggcttttggttccatcactcctctggacctgtgagcctcacgtgccttcctcctatcactaaaaacctgcttactgccaaatctagtgttggctcccagtcctcctctaacctgacctctcagctgcatgtgacacagctgattactcctgccttcttgaaacattttcactaggcttccaggacatcacattctcctgatttttcttctccctggctactcctttgcaatcttgtttgctggctgtttctcctgtttttcctgacctgacccccagaggctctgttttttttttttttttttttagatggagcctcgctctgcacccaggctggagtgcaggcatgatctcggctcactgcaacctctgcctcccgggttcaagcgattctcctgcctcagcctcccaaatagctgggactaaaggtgcagaggctctgttcttatctctctttactctctttatcttttctcttgtcaacctctccattcttgtagctttaaagatgttgatatatcccaagtttatatctgtagcccgcctcctctctaagctccaaatctatgtaaagtgtataactccctacttgccatctctacttccatgtctaatgaatgtttctcaacacagtgatacaaaagaaaggctcatacttctcactccctgcagccccttgcagccacataactctttggttttgccagttttagtgaagtgcattactatttactcagctattcaggccctaaacctacctatttctcacacccttgtccacactcatcaactttacctgtaaaataagtgctgaatgtgatcacgtcttaccacctctacctgtctcacctgagtccaagatgtcatgacctctctcccctcgacttctaatagccttttaactagtctctgcttctgctcttgcccccaaacagccaattttccccccaacaaccagaatgatccttcaaaaatataaatgagactggccactcacctgctaaacacccttgaatgacttcccaccacaattagaataatatgcaaactttactttggcctgaaagaccccatatgactttggtgttgtctatctctccaatctcttcttgaacttgactgccccctccctgtctgtagttgagccatactggcctctgtgatcttcattgaacaggtcaggctctttcccatctctgtactcgctgctccctctgcccaggaagctcttcttcccagatcttgcaagctttgctcttcagtccagtcaggactctgctcaaatatcacctctttagacagaattttccccactacccactaaagcaggccctcattgtctttgtcactttctagcctctcatcctgttgattttttgatagtgcatgttaatcttgacattttaggatacaatcatttgcttatgtctaccctttccaaatacaaccgtctcattggcaaggacttttctgccctgttcatccaaagtgcctagaacagatggtccataaatacttgttgagcgagcacacgcatgaatacgtgtgcaaaggggctcaggtaaagagtgtaatttctataatttcaaagctgtgatgtacttccaggagcagagtaagtaataatgatgggcaggcacaatggaaggccaggtattggattaaggagggcctctctggcagccctacaggacagacatttctgcaatgatagaaatgacctatatctctgctgtctaaaacagtagtcactggccacgtgtgactatggagcacttgagatgtggtcagtgggactgaggaattgaggaactgaaagaattttatttaatttcaattaacatttaaatagctatccttggctggtggctatggtattagaacctgaagaatcccttcccatggcttgtgattgcaggataattgtgtataactcactgagttgtcgaggggactaatgaaataaaaagcttaggaaaatgtctggaacataagtggcacaaaaaaataatagttgctattattccacagagttgcaaattaaagtactttaagtatatgccatttaaattaggctgtaaagcacttgaaatggacttttattaatgttaggcataatgttttgttttttagagttggtggataatcgatgtttgggtctgtatttgagcttacaaactaaaaatagcacacaaccattttgggatctcattgaaggagatagatgtctattccaagtggatcagcttgctgatacttataatgagctaattaattttgacaacagctaatttagcatctgcaaaaattggatttgtaacattatgtgtactgtattattttcaaacagtgttatctgcaacttcccggatgattttggataagagaagtgtttgttttaatacttattattaaaataaaaaaataagtatttacttattggaaatactatgattaattatttaaggcttaaattggtttggacataaaatcatttttttttcttagtggctgaccataattccttccatactgaatccagaaaataaaattagcacagatatagaacataaacagaccattataacaaacccttatgaataacctaatgcaataataaaatcacacatttgtccagaataagcatggtacttattttcaggccaagagaatttgcattctgtagcagagtgaaaatggcattccacagtcagcctaagcacttggtggagactctgagactagagagagcagatgcatttaaattgaacacgtgcttataggcattaagaaaagttgacattcttattaaagagaccaattaatctgcatcagttggaagccactttacagtcgaaaaagtgctctaggacctaatataaatgagactggagtagaaagagaatgaaaattcacttttctacaagggagccttttctaattgccctagagctgtgctgtttgaaatgctaatccttcctcttccatcccggactgggagtctggggtaacagaagccgaggagggtgaagacccccagatgctaaagtgaggggtgttcaagacttaccaatgggcatgactaagaaaaaaggcagccagcagaggacgaagcagccgaccacgatgcccagcgttttggccgctttcttctcccgggagaacttgaggagcctcactgagaagtgcgtcttggtcttggcgctggccatcccgctgcctcctgccggggcgtttttccgatggatgcggagcgtcacttgctccgagtccgacttgtcggtcttgaggccagacttgaggccccggctctccctcttggccaccacgtagacgcggcagtacatgaccaggatgatggccagaggcaggtagaaggagcccagcgctgagaagagcacgtagcccggctcctcgttgatctggcagatggtctcgtcctcgggggccggctgcctccagccgaacaggggtccaatggatatgaccagggagagtgcccagacgcagagcagagccatgagacccctcctctgggtgacgatggttgggtagcgcagcgggtagctcacgccgatgtagcggtcgatggagatgatgcagaggcccatgatggacgcggtgcagcacagcacatccactgccgcccagatgttgcagaagaccctgccgaaggcccagtagcctaggacctcgaagatggcggagaagggcagcaccgtggaggtgagcaggaggtcggccaccgccaggttgacgatgtagtagtgcgtgactgagtgcaggtgtcggtgacaggctacggagaggatcactaggatgttacccagcaccccgaaaagaatgaggccccccaagatcaccccgagcagaatggccttggaaatgttcaccggtgccggcggttgggtgcagttggagctgtcggaagcatttcccgagagaaacaccatggtcccagccggggccgggcgaggtccggctgtccagggccacctcccgggctggcgcggaggcgggagcgcgggagccgggaatcaaaaggtctcggctggagggagccctgccaggtgggtttggctgggggtgagagcgcgcgcgcgggtgggaaacaaccctggccagccctgggaaccctcagaaggccacatgaaggggcagggcattaaagacatggccaggggcgcgcggggctgccggggaccctctccacctgccgggctggcctagcccgggacccggactccctccctacccgaagctgggtgcgaagatccaggagactccttgcaacatgcaattccagaattacgagaatctgcttttccgcgctgtcttattcgtcctggctgggggaagattcagcattctgcacatgattcggaattc
